United States Patent 8,952,217 (PROCESS FOR DECREASING VERBASCOSE IN A PLANT BY EXPRESSION OF A CHLOROPLAST-TARGETED FIMD PROTEIN) - sequence listing, part 5

SEQ ID NO: 12679 - protein, 1312 aa, Klebsiella aerogenes
MGTTTMGVKLDDATRERIKSAASRIDRTPHWLIKQAIFNYLEKLENDETLPELPALLSGAANESDDASEPTEEPYQPFLEFAEQILPQSVRRAAITAAWRRPETDAVPMLLEQARLPQPLGEQAHKLAYQLAEKLRNQKTASGRAGMVQSLLQEFSLSSQEGVALMCLAEALLRIPDKATRDALIRDKISNGNWQSHIGRSPSLFVNAATWGLLFTGKLVSTHNETSLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPFVIDYLIDLATRSRRRLMIRLVKGAYWDSEIKRAQMEGLEGYPVYTRKVYTDVSYLACAKKLLAVPNLIYPQFATHNAHTLAAIYQLAGQNYYPGQYEFQCLHGMGEPLYEQVVGKVADGKLNRPCRIYAPVGTHETLLAYLVRRLLENGANTSFVNRIADNTLPLDELVADPVSAVEKLAQQEGQAGLPHPKIPLPRDLYGSGRSNSAGLDLANEHRLASLSSSLLNSALHKWQALPMLEQPVAEGEMQPVVNPAEPKDIVGYVREASDAEVQQALTSAINNAPIWFATPPQERAAILERAAVLMESQMPTLMGILVREAGKTFSNAIAEVREAVDFLHYYAGQVRDDFDNETHRPLGPVVCISPWNFPLAIFTGQIAAALAAGNSVLAKPAEQTPLIAAQGVAILLEAGVPPGVIQLLPGRGETVGAALTSDERVRGVMFTGSTEVATLLQRNIASRLDPQGRPTPLIAETGGMNAMIVDSSALTEQVVIDVLASAFDSAGQRCSALRVLCLQEEVADHTLTMLRGAMSECRMGNPGRLTTDIGPVIDAEAKENIERHIQAMRAKGRTVYQAVRENSEDAREWRHGTFVPPTLIELDSFDELKKEVFGPVLHVVRYNRNELDKLVEQINASGYGLTLGVHTRIDETIAQVTGSAKVGNLYVNRNMVGAVVGVQPFGGEGLSGTGPKAGGPLYLYRLLSSRPQDAVGVTFARQDAERPLDAQLKTLLEKPLQALQQWAAGRPELQALCQQYSEQAQSGTQRLLPGPTGERNTLTLMPRERVLCVADNEQDALIQLAAVLAVGCEVLWPDSALQRDLAKKLPREVSERIRFAKAEQLPVQAFDAVIYHGDSDQLRELCEQVAARDGAIVSVQGFARGETNLLLERLYIERSLSVNTAAAGA

SEQ ID NO: 12680 - DNA, 1548 bp, Bacillus anthracis
  CDS (1)..(1548)
atggtagtagcatacaaacatgagccatttacagatttttcagtagaggctaacaaattagcgtttgaagaaggtttaaagaaagtagaatcttatcttggacaagactatccattaattattgggggagaaaaaatcactacagaagacaaaattgtttctgtaaaccctgcaaataaagaggaacttgttggtcgcgtttcaaaagcaagccgtgagttagctgaaaaagcaatgcaagtagcggatgaaacattccaaacttggagaaagtcaaaaccagaaatgcgtgcagacattttattccgtgctgcagcgattgttcgtcgtagaaaacatgaattctctgctattcttgtaaaagaagcaggtaaaccgtggaatgaggcagatgctgatacagcagaagcaatcgactttatggaatattatggtcgtcaaatgttgaaattaaaagacggaattccagtagaaagccgtccaattgaatataatcgtttctcttacattccattaggagtaggtgttatcatttctccttggaacttcccattcgcaattatggcaggtatgacaacagctgctttagtttctggtaacacagtattactaaaaccagctagtacaactcctgtagtagcagcgaaattcatggaagtattagaagaagctggcttaccagctggcgtagtaaacttcgtaccaggtaatggttctgaagttggtgactacttagtagatcaccctcgtacacgtttcattagcttcactggatctcgtgatgtaggtatccgtatttatgagcgcgcagcgaaagtaaacccaggccaaatttggttaaaacgcgttatcgctgaaatgggcggtaaagatacaatcgttgttgataaagaagcagatcttgaattagcagctaaatctatcgttgcatcagcattcggattctcaggacaaaaatgttctgcatgttctcgtgcagtaatccacgaagatgtatacgatcacgtattaaatcgtgctgttgaattaacgaaagaattaacagttgcgaacccagctgtattaggtacaaacatgggtcctgttaatgaccaagctgcattcgataaagtaatgagctatgttgcaattggtaaagaagaaggtagaattttagcaggtggcgaaggagacgactctaaaggctggttcatccaaccaacaatcgttgctgacgttgcagaagatgctcgcctaatgaaagaagaaatcttcggaccagtagtagcattctgtaaagcaaaagactttgaccatgcacttgcaattgcaaacaatacagaatacggtttaacaggagcagttatctctaacaaccgtgatcatattgaaaaagcacgtgaagacttccacgtaggtaacttatacttcaaccgtggatgtactggtgcaatcgtaggataccaaccattcggtggctttaacatgtctggtacagactctaaagctggtggtcctgactacttagcgcttcacatgcaagcaaaaactacttctgaaactttataa

SEQ ID NO: 12681 - protein, 515 aa, Bacillus anthracis
MVVAYKHEPFTDFSVEANKLAFEEGLKKVESYLGQDYPLIIGGEKITTEDKIVSVNPANKEELVGRVSKASRELAEKAMQVADETFQTWRKSKPEMRADILFRAAAIVRRRKHEFSAILVKEAGKPWNEADADTAEAIDFMEYYGRQMLKLKDGIPVESRPIEYNRFSYIPLGVGVIISPWNFPFAIMAGMTTAALVSGNTVLLKPASTTPVVAAKFMEVLEEAGLPAGVVNFVPGNGSEVGDYLVDHPRTRFISFTGSRDVGIRIYERAAKVNPGQIWLKRVIAEMGGKDTIVVDKEADLELAAKSIVASAFGFSGQKCSACSRAVIHEDVYDHVLNRAVELTKELTVANPAVLGTNMGPVNDQAAFDKVMSYVAIGKEEGRILAGGEGDDSKGWFIQPTIVADVAEDARLMKEEIFGPVVAFCKAKDFDHALAIANNTEYGLTGAVISNNRDHIEKAREDFHVGNLYFNRGCTGAIVGYQPFGGFNMSGTDSKAGGPDYLALHMQAKTTSETL

SEQ ID NO: 12682 - DNA, 1548 bp, Oceanobacillus iheyensis
  CDS (1)..(1548)
atggtattaccatttaaacatgaaccatttacagactttacagtgaaggagaaccgtaaagattatcaagatgcgttagcgaaggttaaagaagaattaggtaaagattatccacttgttataaacggtgaaaagatctataccgatgacaagttgatatctataaacccttcaaataaaaatgaagtagtaggaaatgtatccaaagcaacaaaacaacatattgaagaggcttttacttcagcgaaggaagcttttaaagagtggaaatcttggtctgctgaggaccgtgcacgtgtcctatatcgtgcagcagcgattgtaagaagacgtaaacatgagttctctgcatggttatcgtatgatgcaggtaagccgtgggatcaggcagatggagacactgctgaaggaattgactttttagagtattatgctcgccatatggtagagcttgaaaaaggaaaaccgttagcggaccgaccaaatgaagataataaatacttctatcagccacttggaccaggtgtagttattccaccttggaactttgcatttgcaattgtttgtgggacaacagtagctccaatagttgcagggaacccggtgctattaaagccatctgaaaatacacctgtaatcgcctataaattagtggaggtacttgaagaggcaggattaccaaaaggtgttctaaactttgtgccaggagaccctgcggaaatcggtgattatttagtagatcataaagacacacattttattaactttactggttcacgtgcaacaggagttcgtatctttgaacgtgctacaaaaattcaagatggtcaaactcatttgaaacgtattgtagcggaaatgggtgggaaagacacgattatcgttgatgaatcggcagatttagacttagcagcagaatcaattgttcattctgcatttggattttccggtcaaaaatgttctgcatgttctcgtgctgtcattcatgaatctgtttatgatgaagtaattgagaagtcagtagaacttgcaaaaacgcttacagttggtaatccaacggaagataatgtttacatggcgtctgtagttaatcaaaaacagtttgataagataaaagattatattgaagttggtaaacaagaaggtgaacttgtctttgggggagaaacagatgataataagggattctttgtacatccaaccattttcaaagatttagatccaaaagctcgtattatgcaagaagagattttcggaccagtagttgctttttcgaaagcgaaaagttttgatgaattactagatattgcaaataacacagaatatggattgacaggtgcagttatttcaaataatcgcgaaaatctaaaccgagcacaaacagagtttcttgttgggaatttatacttcaaccgtggttgtaccgctgcaattgtaggttatcaaccattcggtggatttaaaatgtcagggacagattcaaaagctggtggtccagattaccttcagcatttcttaaatgcaaaagttgtaaccgaacgattttaa

SEQ ID NO: 12683 - protein, 515 aa, Oceanobacillus iheyensis
MVLPFKHEPFTDFTVKENRKDYQDALAKVKEELGKDYPLVINGEKIYTDDKLISINPSNKNEVVGNVSKATKQHIEEAFTSAKEAFKEWKSWSAEDRARVLYRAAAIVRRRKHEFSAWLSYDAGKPWDQADGDTAEGIDFLEYYARHMVELEKGKPLADRPNEDNKYFYQPLGPGVVIPPWNFAFAIVCGTTVAPIVAGNPVLLKPSENTPVIAYKLVEVLEEAGLPKGVLNFVPGDPAEIGDYLVDHKDTHFINFTGSRATGVRIFERATKIQDGQTHLKRIVAEMGGKDTIIVDESADLDLAAESIVHSAFGFSGQKCSACSRAVIHESVYDEVIEKSVELAKTLTVGNPTEDNVYMASVVNQKQFDKIKDYIEVGKQEGELVFGGETDDNKGFFVHPTIFKDLDPKARIMQEEIFGPVVAFSKAKSFDELLDIANNTEYGLTGAVISNNRENLNRAQTEFLVGNLYFNRGCTAAIVGYQPFGGFKMSGTDSKAGGPDYLQHFLNAKVVTERF

SEQ ID NO: 12684 - DNA, 1545 bp, Staphylococcus epidermidis
  CDS (1)..(1545)
atggtagtacctttcaaaaatgaacctggtattgatttttcagtacagacaaatgttgagcgttttaatgaagaattaaggaaagtaaaagcgcaactaggacaagatataccacttgtgattaacggagaaaaacttactaaaactgatacttttaattcagtgaatcctgcgaatacatcacagctcattgcgaaagtgtctaaagcaacgcaagatgatattgaaaaagctttcgaatcagcaaatcatgcgtatcaatcatggaagaagtggtcgcataaggaccgtgcagaattactgttacgtgtagccgcaattatccgtcgtcgaaaagaggaaatttccgctattatggtttatgaagccggcaagccttgggatgaagcagttggagatgcagctgagggtattgattttatagaatattatgcaagatcaatgatggaacttgcagatggtaagccagtattagacagagaaggtgaacataatcgctatttttataaacctattggtacaggcgtgacaattccaccatggaattttccatttgcaattatggctggtacaaccttagcccctgttgttgcaggtaacactgtattattaaagcctgctgaggatacagttttgactgcttataaattaatggaaatattagaagaagcaggtttaccacaaggtgttgtaaattttgttcctggtgatccaaaagaaattggagattatttagtcgaccataaagatacacattttgtcacatttacaggatcccgagctacaggtacacgtatttatgaacgtagtgctgtagtgcaagaaggacaacagtttttaaaacgtgttattgcagagatgggtggcaaagatgcgatagttgtagataataatgtagatacagatttagcggctgaagcaattgttacatctgcttttggtttctctggtcaaaaatgctctgcgtgttctcgtgccatagtccatcaagacgtacatgatgaaatattggaaaaagcaattcaattaactcaaaaattaactttaggtaatactgaagagaacacatttatggggccagtaattaatcaaaaacaatttgataaaatcaaaaattatattgaaattggtaaaaaagaaggcaaactagagactggtggtggaacagatgattctaccggttatttcattgaaccaacgattttctccggactacaatctgcggatcgtatcatgcaagaagaaatttttggaccagtcgtaggctttattaaggtcaaggattttgatgaggctattgaagtagctaatgatactgactatggtttgacaggcgctgtaattactaatcatcgtgaacattggattaaggctgtgaatgaatttgatgtaggtaacctttacttgaatagaggttgtacagctgcagtagtgggttatcatccatttggtggattcaagatgtctggtacagatgctaaaacaggaagtccagattacttacttaatttcttagaacaaaaagttgtttctgaaatgttttaa

SEQ ID NO: 12685 - protein, 514 aa, Staphylococcus epidermidis
MVVPFKNEPGIDFSVQTNVERFNEELRKVKAQLGQDIPLVINGEKLTKTDTFNSVNPANTSQLIAKVSKATQDDIEKAFESANHAYQSWKKWSHKDRAELLLRVAAIIRRRKEEISAIMVYEAGKPWDEAVGDAAEGIDFIEYYARSMMELADGKPVLDREGEHNRYFYKPIGTGVTIPPWNFPFAIMAGTTLAPVVAGNTVLLKPAEDTVLTAYKLMEILEEAGLPQGVVNFVPGDPKEIGDYLVDHKDTHFVTFTGSRATGTRIYERSAVVQEGQQFLKRVIAEMGGKDAIVVDNNVDTDLAAEAIVTSAFGFSGQKCSACSRAIVHQDVHDEILEKAIQLTQKLTLGNTEENTFMGPVINQKQFDKIKNYIEIGKKEGKLETGGGTDDSTGYFIEPTIFSGLQSADRIMQEEIFGPVVGFIKVKDFDEAIEVANDTDYGLTGAVITNHREHWIKAVNEFDVGNLYLNRGCTAAVVGYHPFGGFKMSGTDAKTGSPDYLLNFLEQKVVSEMF

SEQ ID NO: 12686 - DNA, 24 bp, Primer
atgctatcagcaaggtgcctcaaa

SEQ ID NO: 12687 - DNA, 28 bp, Primer
ttattcataattcgatggatatttgaaa

SEQ ID NO: 12688 - DNA, 1390 bp, Saccharomyces cerevisiae; identical to SEQ ID NO: 531
  CDS (303)..(1118)

SEQ ID NO: 12689 - protein, 271 aa, Saccharomyces cerevisiae; identical to SEQ ID NO: 532

SEQ ID NO: 12690 - DNA, 714 bp, Deinococcus radiodurans; identical to SEQ ID NO: 533
  CDS (1)..(714)

SEQ ID NO: 12691 - protein, 237 aa, Deinococcus radiodurans; identical to SEQ ID NO: 534

SEQ ID NO: 12692 - DNA, 1350 bp, Nostoc sp. PCC 7120; identical to SEQ ID NO: 535
  CDS (1)..(1350)

SEQ ID NO: 12693 - protein, 449 aa, Nostoc sp. PCC 7120; identical to SEQ ID NO: 536

SEQ ID NO: 12694 - DNA, 636 bp, Listeria monocytogenes; identical to SEQ ID NO: 537
  CDS (1)..(636)

SEQ ID NO: 12695 - protein, 211 aa, Listeria monocytogenes; identical to SEQ ID NO: 538

SEQ ID NO: 12696 - DNA, 636 bp, Listeria innocua; identical to SEQ ID NO: 539
  CDS (1)..(636)

SEQ ID NO: 12697 - protein, 211 aa, Listeria innocua; identical to SEQ ID NO: 540

SEQ ID NO: 12698 - DNA, 654 bp, Brucella melitensis; identical to SEQ ID NO: 541
  CDS (1)..(654)

SEQ ID NO: 12699 - protein, 217 aa, Brucella melitensis; identical to SEQ ID NO: 542

SEQ ID NO: 12700 - DNA, 813 bp, Nostoc sp. PCC 7120; identical to SEQ ID NO: 543
  CDS (1)..(813)

SEQ ID NO: 12701 - protein, 270 aa, Nostoc sp. PCC 7120; identical to SEQ ID NO: 544

SEQ ID NO: 12702 - DNA, 615 bp, Deinococcus radiodurans; identical to SEQ ID NO: 545
  CDS (1)..(615)

SEQ ID NO: 12703 - protein, 204 aa, Deinococcus radiodurans; identical to SEQ ID NO: 546

SEQ ID NO: 12704 - DNA, 714 bp, Caulobacter crescentus; identical to SEQ ID NO: 547
  CDS (1)..(714)

SEQ ID NO: 12705 - protein, 237 aa, Caulobacter crescentus; identical to SEQ ID NO: 548

SEQ ID NO: 12706 - DNA, 756 bp, Treponema pallidum subsp. pallidum (syphilis spirochete); identical to SEQ ID NO: 549
  CDS (1)..(756)

SEQ ID NO: 12707 - protein, 251 aa, Treponema pallidum subsp. pallidum (syphilis spirochete); identical to SEQ ID NO: 550

SEQ ID NO: 12708 - DNA, 645 bp, Xylella fastidiosa; identical to SEQ ID NO: 551
  CDS (1)..(645)

SEQ ID NO: 12709 - protein, 214 aa, Xylella fastidiosa; identical to SEQ ID NO: 552

SEQ ID NO: 12710 - DNA, 2034 bp, Arabidopsis thaliana (mouse-ear cress); identical to SEQ ID NO: 553
  CDS (1)..(2034)

SEQ ID NO: 12711 - protein, 677 aa, Arabidopsis thaliana (mouse-ear cress); identical to SEQ ID NO: 554

SEQ ID NO: 12712 - DNA, 582 bp, Bacillus subtilis; identical to SEQ ID NO: 555
  CDS (1)..(582)

SEQ ID NO: 12713 - protein, 193 aa, Bacillus subtilis; identical to SEQ ID NO: 556

SEQ ID NO: 12714 - DNA, 606 bp, Thermotoga maritima; identical to SEQ ID NO: 557
  CDS (1)..(606)

SEQ ID NO: 12715 - protein, 201 aa, Thermotoga maritima; identical to SEQ ID NO: 558

SEQ ID NO: 12716 - DNA, 660 bp, Clostridium acetobutylicum; identical to SEQ ID NO: 559
  CDS (1)..(660)

SEQ ID NO: 12717 - protein, 219 aa, Clostridium acetobutylicum; identical to SEQ ID NO: 560

SEQ ID NO: 12718 - DNA, 744 bp, Saccharomyces cerevisiae; identical to SEQ ID NO: 561
  CDS (1)..(744)

SEQ ID NO: 12719 - protein, 247 aa, Saccharomyces cerevisiae; identical to SEQ ID NO: 562

SEQ ID NO: 12720 - DNA, 1050 bp, Synechocystis sp; identical to SEQ ID NO: 563
  CDS (1)..(1050)

SEQ ID NO: 12721 - protein, 349 aa, Synechocystis sp; identical to SEQ ID NO: 564

SEQ ID NO: 12722 - DNA, 875 bp, Arabidopsis thaliana (mouse-ear cress); identical to SEQ ID NO: 565
  CDS (30)..(722)

SEQ ID NO: 12723 - protein, 230 aa, Arabidopsis thaliana (mouse-ear cress); identical to SEQ ID NO: 566

SEQ ID NO: 12724 - DNA, 741 bp, Debaryomyces hansenii; identical to SEQ ID NO: 567
  CDS (1)..(741)

SEQ ID NO: 12725 - protein, 246 aa, Debaryomyces hansenii; identical to SEQ ID NO: 568

SEQ ID NO: 12726 - DNA, 741 bp, Yarrowia lipolytica; identical to SEQ ID NO: 569
  CDS (1)..(741)

SEQ ID NO: 12727 - protein, 246 aa, Yarrowia lipolytica; identical to SEQ ID NO: 570

SEQ ID NO: 12728 - DNA, 816 bp, Kluyveromyces lactis; identical to SEQ ID NO: 571
  CDS (1)..(816)

SEQ ID NO: 12729 - protein, 271 aa, Kluyveromyces lactis; identical to SEQ ID NO: 572

SEQ ID NO: 12730 - DNA, 687 bp, Kluyveromyces lactis; identical to SEQ ID NO: 573
  CDS (1)..(687)

SEQ ID NO: 12731 - protein, 228 aa, Kluyveromyces lactis; identical to SEQ ID NO: 574

SEQ ID NO: 12732 - DNA, 651 bp, Erwinia carotovora subsp; identical to SEQ ID NO: 575
  CDS (1)..(651)

SEQ ID NO: 12733 - protein, 216 aa, Erwinia carotovora subsp; identical to SEQ ID NO: 576

SEQ ID NO: 12734 - DNA, 840 bp, Candida glabrata; identical to SEQ ID NO: 577
  CDS (1)..(840)

SEQ ID NO: 12735 - protein, 279 aa, Candida glabrata; identical to SEQ ID NO: 578

SEQ ID NO: 12736 - DNA, 744 bp, Candida glabrata; identical to SEQ ID NO: 579
  CDS (1)..(744)

SEQ ID NO: 12737 - protein, 247 aa, Candida glabrata; identical to SEQ ID NO: 580

SEQ ID NO: 12738 - DNA, 621 bp, Bartonella quintana; identical to SEQ ID NO: 581
  CDS (1)..(621)

SEQ ID NO: 12739 - protein, 206 aa, Bartonella quintana; identical to SEQ ID NO: 582

SEQ ID NO: 12740 - DNA, 648 bp, Parachlamydia sp; identical to SEQ ID NO: 583
  CDS (1)..(648)

SEQ ID NO: 12741 - protein, 215 aa, Parachlamydia sp; identical to SEQ ID NO: 584

SEQ ID NO: 12742 - DNA, 636 bp, Listeria monocytogenes; identical to SEQ ID NO: 585
  CDS (1)..(636)

SEQ ID NO: 12743 - protein, 211 aa, Listeria monocytogenes; identical to SEQ ID NO: 586

SEQ ID NO: 12744 - DNA, 633 bp, Thermus thermophilus; identical to SEQ ID NO: 587
  CDS (1)..(633)

SEQ ID NO: 12745 - protein, 210 aa, Thermus thermophilus; identical to SEQ ID NO: 588

SEQ ID NO: 12746 - DNA, 654 bp, Mycobacterium paratuberculosis; identical to SEQ ID NO: 589
  CDS (1)..(654)

SEQ ID NO: 12747 - protein, 217 aa, Mycobacterium paratuberculosis; identical to SEQ ID NO: 590

SEQ ID NO: 12748 - DNA, 1134 bp, Mycobacterium paratuberculosis; identical to SEQ ID NO: 591
  CDS (1)..(1134)

SEQ ID NO: 12749 - protein, 377 aa, Mycobacterium paratuberculosis; identical to SEQ ID NO: 592

SEQ ID NO: 12750 - DNA, 627 bp, Lactobacillus johnsonii; identical to SEQ ID NO: 593
  CDS (1)..(627)

SEQ ID NO: 12751 - protein, 208 aa, Lactobacillus johnsonii; identical to SEQ ID NO: 594

SEQ ID NO: 12752 - DNA, 807 bp, Ashbya gossypii; identical to SEQ ID NO: 595
  CDS (1)..(807)

SEQ ID NO: 12753 - protein, 268 aa, Ashbya gossypii; identical to SEQ ID NO: 596

SEQ ID NO: 12754 - DNA, 687 bp, Mycobacterium tuberculosis; identical to SEQ ID NO: 597
  CDS (1)..(687)

SEQ ID NO: 12755 - protein, 228 aa, Mycobacterium tuberculosis; identical to SEQ ID NO: 598

SEQ ID NO: 12756 - DNA, 618 bp, Photorhabdus luminescens; identical to SEQ ID NO: 599
  CDS (1)..(618)

SEQ ID NO: 12757 - protein, 205 aa, Photorhabdus luminescens; identical to SEQ ID NO: 600

SEQ ID NO: 12758 - DNA, 588 bp, Anopheles gambiae str; identical to SEQ ID NO: 601
  CDS (1)..(588)

SEQ ID NO: 12759 - protein, 195 aa, Anopheles gambiae str; identical to SEQ ID NO: 602

SEQ ID NO: 12760 - DNA, 3762 bp, Neurospora crassa; identical to SEQ ID NO: 603
  CDS (1)..(3762)

SEQ ID NO: 12761 - protein, 1253 aa, Neurospora crassa; identical to SEQ ID NO: 604

SEQ ID NO: 12762 - DNA, 567 bp, Synechococcus sp; identical to SEQ ID NO: 605
  CDS (1)..(567)

SEQ ID NO: 12763 - protein, 188 aa, Synechococcus sp; identical to SEQ ID NO: 606

SEQ ID NO: 12764 - DNA, 612 bp, Rhodopirellula baltica; identical to SEQ ID NO: 607
  CDS (1)..(612)

SEQ ID NO: 12765 - protein, 203 aa, Rhodopirellula baltica; identical to SEQ ID NO: 608

SEQ ID NO: 12766 - DNA, 1329 bp, Prochlorococcus marinus subsp; identical to SEQ ID NO: 609
  CDS (1)..(1329)

SEQ ID NO: 12767 - protein, 442 aa, Prochlorococcus marinus subsp; identical to SEQ ID NO: 610

SEQ ID NO: 12768 - DNA, 1332 bp, Prochlorococcus marinus; identical to SEQ ID NO: 611
  CDS (1)..(1332)

SEQ ID NO: 12769 - protein, 443 aa, Prochlorococcus marinus; identical to SEQ ID NO: 612

SEQ ID NO: 12770 - DNA, 591 bp, Prochlorococcus marinus; identical to SEQ ID NO: 613
  CDS (1)..(591)

SEQ ID NO: 12771 - protein, 196 aa, Prochlorococcus marinus; identical to SEQ ID NO: 614

SEQ ID NO: 12772 - DNA, 618 bp, Streptomyces avermitilis; identical to SEQ ID NO: 615
  CDS (1)..(618)

SEQ ID NO: 12773 - protein, 205 aa, Streptomyces avermitilis; identical to SEQ ID NO: 616

SEQ ID NO: 12774 - DNA, 600 bp, Streptomyces avermitilis; identical to SEQ ID NO: 617
  CDS (1)..(600)

SEQ ID NO: 12775 - protein, 199 aa, Streptomyces avermitilis; identical to SEQ ID NO: 618

SEQ ID NO: 12776 - DNA, 612 bp, Streptomyces avermitilis; identical to SEQ ID NO: 619
  CDS (1)..(612)

SEQ ID NO: 12777 - protein, 203 aa, Streptomyces avermitilis; identical to SEQ ID NO: 620

SEQ ID NO: 12778 - DNA, 645 bp, Enterococcus faecalis; identical to SEQ ID NO: 621
  CDS (1)..(645)

SEQ ID NO: 12779 - protein, 214 aa, Enterococcus faecalis; identical to SEQ ID NO: 622

SEQ ID NO: 12780 - DNA, 666 bp, Lactobacillus plantarum; identical to SEQ ID NO: 623
  CDS (1)..(666)

SEQ ID NO: 12781 - protein, 221 aa, Lactobacillus plantarum; identical to SEQ ID NO: 624

SEQ ID NO: 12782 - DNA, 642 bp, Clostridium tetani; identical to SEQ ID NO: 625
  CDS (1)..(642)

SEQ ID NO: 12783 - protein, 213 aa, Clostridium tetani; identical to SEQ ID NO: 626

SEQ ID NO: 12784 - DNA, 600 bp, Bradyrhizobium japonicum; identical to SEQ ID NO: 627
  CDS (1)..(600)

SEQ ID NO: 12785 - protein, 199 aa, Bradyrhizobium japonicum; identical to SEQ ID NO: 628

SEQ ID NO: 12786 - DNA, 1407 bp, Synechococcus elongatus; identical to SEQ ID NO: 629
  CDS (1)..(1407)

SEQ ID NO: 12787 - protein, 468 aa, Synechococcus elongatus; identical to SEQ ID NO: 630

SEQ ID NO: 12788 - DNA, 582 bp, Oceanobacillus iheyensis; identical to SEQ ID NO: 631
  CDS (1)..(582)

SEQ ID NO: 12789 - protein, 193 aa, Oceanobacillus iheyensis; identical to SEQ ID NO: 632

SEQ ID NO: 12790 - DNA, 648 bp, Bifidobacterium longum; identical to SEQ ID NO: 633
  CDS (1)..(648)

SEQ ID NO: 12791 - protein, 215 aa, Bifidobacterium longum; identical to SEQ ID NO: 634

SEQ ID NO: 12792 - DNA, 1005 bp, Arabidopsis thaliana; identical to SEQ ID NO: 635
  CDS (1)..(1005)

SEQ ID NO: 12793 - protein, 334 aa, Arabidopsis thaliana; identical to SEQ ID NO: 636

SEQ ID NO: 12794 - DNA, 645 bp, Xanthomonas campestris; identical to SEQ ID NO: 637
  CDS (1)..(645)

SEQ ID NO: 12795 - protein, 214 aa, Xanthomonas campestris; identical to SEQ ID NO: 638

SEQ ID NO: 12796 - DNA, 645 bp, Xanthomonas axonopodis; identical to SEQ ID NO: 639
  CDS (1)..(645)

SEQ ID NO: 12797 - protein, 214 aa, Xanthomonas axonopodis; identical to SEQ ID NO: 640

SEQ ID NO: 12798 - DNA, 621 bp, Thermoanaerobacter tengcongensis; identical to SEQ ID NO: 641
  CDS (1)..(621)

SEQ ID NO: 12799 - protein, 206 aa, Thermoanaerobacter tengcongensis; identical to SEQ ID NO: 642

SEQ ID NO: 12800 - DNA, 582 bp, Rhizobium loti; identical to SEQ ID NO: 643
  CDS (1)..(582)

SEQ ID NO: 12801 - protein, 193 aa, Rhizobium loti; identical to SEQ ID NO: 644

SEQ ID NO: 12802 - DNA, 651 bp, Pasteurella multocida; identical to SEQ ID NO: 645
  CDS (1)..(651)

SEQ ID NO: 12803 - protein, 216 aa, Pasteurella multocida; identical to SEQ ID NO: 646

SEQ ID NO: 12804 - DNA, 597 bp, Streptomyces coelicolor; identical to SEQ ID NO: 647
  CDS (1)..(597)

SEQ ID NO: 12805 - protein, 198 aa, Streptomyces coelicolor; identical to SEQ ID NO: 648

SEQ ID NO: 12806 - DNA, 600 bp, Streptomyces coelicolor; identical to SEQ ID NO: 649
  CDS (1)..(600)

SEQ ID NO: 12807 - protein, 199 aa, Streptomyces coelicolor; identical to SEQ ID NO: 650

SEQ ID NO: 12808 - DNA, 660 bp, Gloeobacter violaceus; identical to SEQ ID NO: 651
  CDS (1)..(660)

SEQ ID NO: 12809 - protein, 219 aa, Gloeobacter violaceus; identical to SEQ ID NO: 652

SEQ ID NO: 12810 - DNA, 621 bp, Bartonella henselae; identical to SEQ ID NO: 653
  CDS (1)..(621)

SEQ ID NO: 12811 - protein, 206 aa, Bartonella henselae; identical to SEQ ID NO: 654

SEQ ID NO: 12812 - DNA, 681 bp, Parachlamydia sp; identical to SEQ ID NO: 655
  CDS (1)..(681)

SEQ ID NO: 12813 - protein, 226 aa, Parachlamydia sp; identical to SEQ ID NO: 656

SEQ ID NO: 12814 - DNA, 636 bp, Rhizobium meliloti; identical to SEQ ID NO: 657
  CDS (1)..(636)

SEQ ID NO: 12815 - protein, 211 aa, Rhizobium meliloti; identical to SEQ ID NO: 658

SEQ ID NO: 12816 - DNA, 648 bp, Escherichia coli O6; identical to SEQ ID NO: 659
  CDS (1)..(648)

SEQ ID NO: 12817 - protein, 215 aa, Escherichia coli O6; identical to SEQ ID NO: 660

SEQ ID NO: 12818 - DNA, 648 bp, Photorhabdus luminescens; identical to SEQ ID NO: 661
  CDS (1)..(648)

SEQ ID NO: 12819 - protein, 215 aa, Photorhabdus luminescens; identical to SEQ ID NO: 662

SEQ ID NO: 12820 - DNA, 648 bp, Salmonella typhimurium; identical to SEQ ID NO: 663
  CDS (1)..(648)

SEQ ID NO: 12821 - protein, 215 aa, Salmonella typhimurium; identical to SEQ ID NO: 664

SEQ ID NO: 12822 - DNA, 22 bp, Primer
atgccttcgctaacccccagat

SEQ ID NO: 12823 - DNA, 23 bp, Primer
ttacacatcgccatgctgggatt

SEQ ID NO: 12824 - DNA, 1257 bp, Saccharomyces cerevisiae
  CDS (1)..(1257)
atgtctgccactctgttcaataacatcgaattgctgccccctgatgccctttttggtattaagcaaaggtacgggcaagatcaacgtgctaccaaggtcgacttgggtatcggggcctacagagacgacaacggtaaaccatgggtcttgccaagtgttaaagccgccgaaaagctaattcataacgacagctcctacaaccatgaatacctcggtattaccggtctgccaagtttgacatctaacgccgccaagatcatcttcggtacgcaatccgatgcctttcaggaagacagagtaatctcagtacaatcactgtctggtacgggtgctcttcatatatctgcgaagtttttttcaaaattcttcccagataaactggtctatttgtctaagcctacttgggccaaccacatggccatttttgagaatcaaggcttgaaaacggcgacttacccttactgggccaacgaaactaagtctttggacctaaacggctttctaaatgctattcaaaaagctccagagggctccattttcgttctgcactcttgcgcccataacccaactggtctggaccctactagtgaacaatgggttcaaatcgttgatgctatcgcctcaaagaaccacatcgccttatttgacaccgcctaccaagggtttgccactggagatttggacaaggatgcctatgctgtgcgtctaggtgtggagaagctttcaacggtctctcccgtctttgtctgtcagtcctttgccaagaacgccggtatgtacggtgagcgtgtaggttgtttccatctagcacttacaaaacaagctcaaaacaaaactataaagcctgctgttacatctcaattggccaaaatcattcgtagtgaagtgtccaacccacccgcctacggcgctaagattgtcgctaaactgttggaaacgccagaattaacggaacagtggcacaaggatatggttaccatgtcctccagaattacgaaaatgaggcacgcattaagagaccatttagtcaagttgggcactcctggcaactgggatcatatagtaaatcaatgcgggatgttctcctttacaggattgactcctcaaatggttaaacgacttgaagaaacccacgcagtttacttggttgcctcaggtagagcttctattgctggattgaatcaaggaaacgtggaatacgtggctaaagccattgatgaagtggtgcgcttctatactattgaagctaaattgtaa

SEQ ID NO: 12825 - protein, 418 aa, Saccharomyces cerevisiae
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 12826 - DNA, 1203 bp, Chlamydia trachomatis
  CDS (1)..(1203)
atgagtctttttgaacagttaccttccttttctccggattctattcttggtttagcgcaggctttccaagaggatcctcgtgaggataagattaatttattactaggtacttacgaacgggaaaagaaacgttatggtggtttctcgagcgttagaaaggctcagtctgttttttttgacgatgagaaagataaaaattatctacccatcaaaggatcgtctacctttttagaagaaatggcagctctttgttttggagaagtggatgctagtcgatgggttggtgtgcaggcaattggaggtacaggagccttacatttaggggcttctgtatatgccaacgcatctttagcgggtaaggtgtatattccttctcaaacatgggggaaccattctaggatttttgctcatcaagggttagctttagagtattatccttactatgatcaggagaccaaagaactggatttacagggattgaaagctattttgcgatctgctcctgagacttcattagttctgttgcattgttgctgtcataatcctacagggaaagatattcctctttccgagtggccagaaatcattacgattattaaggagcgggatcttattcctttctttgatatggcttatttaggttttgctagtgggatagaagaagatcgtcgtcctgtgcgactgtgtatagaagctggggttactacttttgtagcaggaggcgctagtaaaattttttcgttatatggttctcgtgtaggattttttggagctatccatcaagataaactggatttaaaccgtattctatcctttttagaagaacagattcgtggggagtactcatctccggctagagaaggagttgctatcgtgacttctatattaagcaatccttacttacggcaagaatgggagcttgaattgaatggcattcggcagtctttggaagagattcgttcgagttttgtgattgccatgcgaaatgtagcggggcactctttcgatttcatagcttctcagaaaggattttttgggtatccaggtttttcaaaggaacaagtgctgttccttagagaagagcttggtatttacacaaccgcaggcgggagattcaatttaaatggcattacggataaaaatataaatcgtgttactcacggttttgctcaggcttatgaataccctcggtccgtatcataa

SEQ ID NO: 12827 - protein, 400 aa, Chlamydia trachomatis
MSLFEQLPSFSPDSILGLAQAFQEDPREDKINLLLGTYEREKKRYGGFSSVRKAQSVFFDDEKDKNYLPIKGSSTFLEEMAALCFGEVDASRWVGVQAIGGTGALHLGASVYANASLAGKVYIPSQTWGNHSRIFAHQGLALEYYPYYDQETKELDLQGLKAILRSAPETSLVLLHCCCHNPTGKDIPLSEWPEIITIIKERDLIPFFDMAYLGFASGIEEDRRPVRLCIEAGVTTFVAGGASKIFSLYGSRVGFFGAIHQDKLDLNRILSFLEEQIRGEYSSPAREGVAIVTSILSNPYLRQEWELELNGIRQSLEEIRSSFVIAMRNVAGHSFDFIASQKGFFGYPGFSKEQVLFLREELGIYTTAGGRFNLNGITDKNINRVTHGFAQAYEYPRSVS

SEQ ID NO: 12828 - DNA, 1242 bp, Vibrio cholerae
  CDS (1)..(1242)
atgatgagttcaatcatcccttcccaccctaacttgacatggatgtgctttatgttcgaaaaagtcgttgccgctcccgctgaccctatcctaggtttaactgaagagttcaaaaaagaccctcgtaccgacaaaattaacctcggtgtaggtatttataagaatgaagcaggtgaaaccccggttctcgctactgtaaagaaagcagaagccgcactgcttgagtcagagaaaaccaaatcttatctcacgatcgaagggacagctgagtacggtttagcagtacaaaaactgctgttcggcgcgaattcggacatagtgacacaaaaactggcaaaaacagcgcaagcccctggtggcactggtgcgctgcgtgtggcgggtgaatttattaagcgtcaactgggcgatgtgaaagtctggatcagtaacccaacttgggctaaccatcacggtgtgttcaatgccgctggcttggaaactacgcaatacgcttattatgatgccaaagccaaagacaaagattttgccgctatgctggcagatttagagcaggcagagaaaggcgatgtggttttactgcatggctgctgccacaatccaacgggtattgacccaacagagcaagagtgggaagtactggcgaaattggtggctgacaaaggcttactgcctctgtttgactttgcttaccaaggctttgcttcaggtgtggaagaagacgcggctggcctacgtatttttgcgaaatacaactctgagattctggttgccagctctttctcaaagaactttggcttgtacaacgaacgtgtcggtgccttcacgctggttgcaccttcaacaaccgttgcagaaacggcgttctcacaagttaaagcgattatccgctctatctactcaaacccaccagctcacggtgctgccgttgtcacttatattctgaacaacccagaattacgcgcagaatgggaagccgaagtcgcggaaatgcgtgaacgtattcaagagatgcgcgtacttttcgttaacacattgaaagaagtgggtgtagacgctgactttagctttatcgagcgtcaaaacggcatgttctctttctctggcctaagcaaagagcaagttgcacgcctcaaatcagagttgggtatctatatcgtcggctctggccgcatcagcgtagcggggatgaccaaatcaaacatgctacccttgtgccaaggcattgctgcggtgatgtaa

SEQ ID NO: 12829 - protein, 413 aa, Vibrio cholerae
MMSSIIPSHPNLTWMCFMFEKVVAAPADPILGLTEEFKKDPRTDKINLGVGIYKNEAGETPVLATVKKAEAALLESEKTKSYLTIEGTAEYGLAVQKLLFGANSDIVTQKLAKTAQAPGGTGALRVAGEFIKRQLGDVKVWISNPTWANHHGVFNAAGLETTQYAYYDAKAKDKDFAAMLADLEQAEKGDVVLLHGCCHNPTGIDPTEQEWEVLAKLVADKGLLPLFDFAYQGFASGVEEDAAGLRIFAKYNSEILVASSFSKNFGLYNERVGAFTLVAPSTTVAETAFSQVKAIIRSIYSNPPAHGAAVVTYILNNPELRAEWEAEVAEMRERIQEMRVLFVNTLKEVGVDADFSFIERQNGMFSFSGLSKEQVARLKSELGIYIVGSGRISVAGMTKSNMLPLCQGIAAVM

SEQ ID NO: 12830 - DNA, 1188 bp, Chlamydophila pneumoniae, Chlamydia pneumoniae
  CDS (1)..(1188)
atgagtttttttaatcacataccaacattttctccggatgctattttaggtttgcagaacgttttctttgcagataagcgtcccgaaaaggttaaccttgtgattggtgtttatgagcatccgcaaaagcgttacggcggcttgtcttgtatacgtaaggcacaaactgtcattttggaagaagaacaaaataagagttatcttcctatttcagggttgcaaatatttttagatgagatgcgtgagctggtttttggtgctgtagatccgagtgctatagtcgggtttcagtctttaggaggtacaggagcgctacacttgggagcccggcttctttccgtggcaaaaggatctggtaaggtttatgttcccgagcagacttggagcaatcatatacgcattttctctcaagagggtcttgaggtaatccgatatccttattatagcaaagaacaaaaacagctgttatttgaacccctgatcgcatttttgaaggaagtagaaaagaattccgttatcttattgcatggttgttgtcacaaccctacaggtgtagattttactgaagatatgtggaaagaactcgccatcttaatgaaagaaagagagttaattccattttttgataccgcataccaaggttttgctcacggcatagagttggatagaaaacctatagaaatttttatatcagagggaaatacggttcttgtcgctgcttcatcaagcaaaaactttgctctttatggtgagcgtgtaggatattttgctgttcacagtacttttactgatgagttggttaaaattcacagtttcttagaagaaaaaattcgaggggaatactcttcaccacaacgttggggtgtagaaattgtttctacaattttgagtaatccatatttgaaagaagaatggcaatcagaactcaattttataagagagtctttgggtaaaatgagaacaagatttgttcaagctttgcgtaaggttgccggtcatacatttgactttttattgtcccaacatggattctttgcataccctgggttttccgataaacaggtgctctttttaagagaacaacacgctgtttatacaacagcgggaggaagaatgaatttaaatggaattacggaaaaaaatatagatcatgtagtgcaaagttttattcaagcttatgagctatag

SEQ ID NO: 12831 - protein, 395 aa, Chlamydophila pneumoniae, Chlamydia pneumoniae
MSFFNHIPTFSPDAILGLQNVFFADKRPEKVNLVIGVYEHPQKRYGGLSCIRKAQTVILEEEQNKSYLPISGLQIFLDEMRELVFGAVDPSAIVGFQSLGGTGALHLGARLLSVAKGSGKVYVPEQTWSNHIRIFSQEGLEVIRYPYYSKEQKQLLFEPLIAFLKEVEKNSVILLHGCCHNPTGVDFTEDMWKELAILMKERELIPFFDTAYQGFAHGIELDRKPIEIFISEGNTVLVAASSSKNFALYGERVGYFAVHSTFTDELVKIHSFLEEKIRGEYSSPQRWGVEIVSTILSNPYLKEEWQSELNFIRESLGKMRTRFVQALRKVAGHTFDFLLSQHGFFAYPGFSDKQVLFLREQHAVYTTAGGRMNLNGITEKNIDHVVQSFIQAYEL

SEQ ID NO: 12832 - DNA, 1194 bp, Yersinia pestis
  CDS (1)..(1194)
atgttccagaatgttgacgcctacgcaggtgaccccatcctttcactgatggaaagttttaaagccgataaccgggcacataaggtgaatctgagtattgggctttattacaatgaacaaggtgaaatcccgcaaatgcaggctgtggatgctgccgaagcgcaattgagtactcaacctcatgggacaccggtttatttaccgatggaaggtctgcaatcttaccgtactgctatccagcaattattatttggtcacgaccatccaatgctggttcagcaacgggtggcgacaatacagacggtgggcggttctggtgcgttgaaagtcggggctgatttccttaatcactatttccctgattcacaggtgtgggtcagcgatcctacctgggaaaaccacgtggctatttttagcggcgcaggttttaaagtgaacacctatccgtatttcgacaatgataagctggcggtgaagtttgacccgatgctggcaaccttgcagcaattgcccgccagaagcatcgtgttgttacatccttgctgccacaatccaaccggttctgatctgaccaatgcccaatgggatcgcctcattgatgtggtaaaagagcgtgaactgatcccgttcctggatatagcgtaccaaggctttggggcagggctgaatgaagatgcttatgctatccgcgctatggccgcagttggattgccatgcctcatcagcaactccttctcaaaaatcttctcgctctataacgagcgggtcggtggtttatctgtggtgtgtgaaagtgacgaggccgcagggcgtgtattgggccaattgaaagcgacagtgcgccgtaactattccagcccgccaaactttggtgcgcaggtcgtttcgaaagtcctaaatgatacggtattgcgcgcgcaatggcaggcagaggtggaacagatgcgcctacggatccttgatatgcgccacacgctggtggaagccttaaaagcctcgttaccagagcgcaattttgattatctgttgcaacaacgcggcatgttcagctacaccggctttagtgaggcacaggtagagagcttacgtgaagagtttggtgtgtatctgattgcgagcggaagaatgtgtatggcgggagtcaatcaccagaatgttgagcaggttgcggtcgcttttgcggcggtacagtaa

SEQ ID NO: 12833 - protein, 397 aa, Yersinia pestis
MFQNVDAYAGDPILSLMESFKADNRAHKVNLSIGLYYNEQGEIPQMQAVDAAEAQLSTQPHGTPVYLPMEGLQSYRTAIQQLLFGHDHPMLVQQRVATIQTVGGSGALKVGADFLNHYFPDSQVWVSDPTWENHVAIFSGAGFKVNTYPYFDNDKLAVKFDPMLATLQQLPARSIVLLHPCCHNPTGSDLTNAQWDRLIDVVKERELIPFLDIAYQGFGAGLNEDAYAIRAMAAVGLPCLISNSFSKIFSLYNERVGGLSVVCESDEAAGRVLGQLKATVRRNYSSPPNFGAQVVSKVLNDTVLRAQWQAEVEQMRLRILDMRHTLVEALKASLPERNFDYLLQQRGMFSYTGFSEAQVESLREEFGVYLIASGRMCMAGVNHQNVEQVAVAFAAVQ

SEQ ID NO: 12834 - DNA, 1191 bp, Salmonella enterica subsp. enterica serovar Typhi
  CDS (1)..(1191)
atgtttgagaacataaccgccgctcctgccgacccgattttgggcctggccgatctgtttcgcgccgatgaccgtccagggaaaattaaccttggcattggcgtatataaagatgaaaccggcaaaacaccggtgctcaccagcgttaaaaaagccgagcagtatttactggaaaatgaaacgacgaaaaactatctcggcattgacgggattccggaatttgctcgctgcactcaggaactgctgttcggcaaaggcagcgcgctgattaatgataagcgcgcacgcacggcgcaaacgccgggcggtaccggcgcgttacgcattgccgccgactttttggcaaaaaatactccggtaaaacgggtgtgggtgagcaaccccagctggccgaaccacaaaagcgtgtttaacgctgccggcctggaagttcgggagtacgcttactacgatgcggaaaatcactcgctggattttgaagcgctacaagccagcctgagcgaagcacaggccggcgatgtggttctgttccacggttgctgtcataacccaaccggcattgaccctactctggaacagtggcaggttctggctgagctttccgttgaaaaagggtggctgccgctattcgatttcgcctaccagggctttgcccgcggcctggaagaagatgcggaaggtctgcgcgcctttgccgcgctgcataaagagctcattgtcgccagctcctactccaaaaacttcggcttatataatgagcgcgtcggcgcctgcaccctcgttgccgccgatgcggaaaccgtggatcgcgcttttagccagatgaaatccgccattcgcgctaactactccaacccaccagcgcacggcgcgtccatcgtcgcgactatcctgagtaatgacgccctgcgcgctatctgggaacaggaactgacggacatgcgccagcgtattcagcgtatgcgtcaactgttcgtgaataccttgcaggaaaaaggcgcgaaccgtgacttcagctttattatcaagcagaacgggatgttctcattcagcggtctgaccaaagatcaggtgctgcgtctgcgtgaagagtttggcgtttatgccgtggcttctggtcgcgtgaacgtggcgggcatgaccccggataatatggcgccgctgtgcgaagccattgtcgcggtactataa

SEQ ID NO: 12835 - protein, 396 aa, Salmonella enterica subsp. enterica serovar Typhi
MFENITAAPADPILGLADLFRADDRPGKINLGIGVYKDETGKTPVLTSVKKAEQYLLENETTKNYLGIDGIPEFARCTQELLFGKGSALINDKRARTAQTPGGTGALRIAADFLAKNTPVKRVWVSNPSWPNHKSVFNAAGLEVREYAYYDAENHSLDFEALQASLSEAQAGDVVLFHGCCHNPTGIDPTLEQWQVLAELSVEKGWLPLFDFAYQGFARGLEEDAEGLRAFAALHKELIVASSYSKNFGLYNERVGACTLVAADAETVDRAFSQMKSAIRANYSNPPAHGASIVATILSNDALRAIWEQELTDMRQRIQRMRQLFVNTLQEKGANRDFSFIIKQNGMFSFSGLTKDQVLRLREEFGVYAVASGRVNVAGMTPDNMAPLCEAIVAVL

SEQ ID NO: 12836 - DNA, 1420 bp, Rhizobium meliloti
  CDS (175)..(1344)
gccggtccgacctgatgaagatcgcctgcgccgagccttcgcgtgcggcgcgaaagccgggggcgctggaggcctgaggctgtcgtttcgaccggtcgcggcgcggaacccgcttgcctttccggctgggggaaacgactatgatccgatccactgctccacaaggaataccggatgttcgacgccctcgcccgccaagccgacgatcccttgctggccctgatcggcctgttcaggaaggatgagcgccccggaaaggtcgatctcggcgtaggagtctatcgcgacgagaccggacgcacgccgatcttccgggccgtcaaggcggcggaaaagcggcttctcgaaacacaggacagcaaggcctatatcggccccgaaggggacctcgtctttctcgatcggctctgggaactcgtcggcggcgacacgatcgagcggagccatgttgcgggcgtccagacgcccggcggctccggcgcgctccgtttggcggcggacctcatcgcccgcatgggcggccgaggcatctggctcgggctgccgagctggccgaaccacgcgccgatcttcaaggcggccgggctcgatatcgccacctacgacttcttcgacattccgtcgcagtcggtcatcttcgataatctggtgagcgcgctggaaggcgccgcatccggcgatgcggtgctgctgcatgcaagctgccacaacccgaccggcggcgtcctgagcgaagcacaatggatggagatcgccgcgctggtggccgagcgcggcctgctgccgctcgtcgatctcgcctatcaggggttcggccgcggcctcgaccaggatgtcgcgggcctccggcatcttctcggcgtggtcccggaagcgctcgtcgcggtttcctgctcgaagtccttcgggctttatcgcgagcgcgcgggcgcgatcttcgcgcggaccagctcgactgcctcggcggacagggtgcgctcaaacctcgcgggcctcgcacgcaccagctattccatgccgccggatcacggcgcagccgtcgtgcggacgatccttgacgacccggaactcaggcgcgactggacggaggagctcgagacgatgcggctcaggatgacgggcctccggcggtcgcttgccgagggactccgcacccgctggcagagcctcggcgcagtcgccgatcaggagggcatgttctccatgctgccgctttccgaagcggaggttatgcggctcaggaccgagcacggcatctatatgccggcatccggccgcatcaacatcgccgggctgaagacggcggaagccgccgagattgccggcaagttcaccagtctctgatctctagatgacgatgcttttaggccgggtcgacctaaaagcatgaacgtgaccggttccgataggtcagagcggg

SEQ ID NO: 12837 - protein, 389 aa, Rhizobium meliloti
MFDALARQADDPLLALIGLFRKDERPGKVDLGVGVYRDETGRTPIFRAVKAAEKRLLETQDSKAYIGPEGDLVFLDRLWELVGGDTIERSHVAGVQTPGGSGALRLAADLIARMGGRGIWLGLPSWPNHAPIFKAAGLDIATYDFFDIPSQSVIFDNLVSALEGAASGDAVLLHASCHNPTGGVLSEAQWMEIAALVAERGLLPLVDLAYQGFGRGLDQDVAGLRHLLGVVPEALVAVSCSKSFGLYRERAGAIFARTSSTASADRVRSNLAGLARTSYSMPPDHGAAVVRTILDDPELRRDWTEELETMRLRMTGLRRSLAEGLRTRWQSLGAVADQEGMFSMLPLSEAEVMRLRTEHGIYMPASGRINIAGLKTAEAAEIAGKFTSL

SEQ ID NO: 12838 - DNA, 1197 bp, Pseudomonas aeruginosa
  CDS (1)..(1197)
atgagtctgttttctgccgtcgaaatggcaccgcgtgatcccatccttggcctgaacgaagccttcaacgccgatacccgtccgggcaagatcaacctgggcgtgggcgtgtactacaacgaggaggggcgcattccgctgttgcgtgccgtgcaggctgccgagaaggcccgcatcgaggcccacgcgccgcgcggctacctgccgatcgaagggatcgccgcctacgaccagggcgtacagaaactgctgttcggtaacgagtccgagctgctggccgccggccgtgtggtcacgacccaggccgtcggcggcaccggcgcgctcaagctcggcgccgacttcctcaagcgcctgctgcccgacgccaccgtggccatcagcgacccgagctgggaaaaccaccgcgcactgttcgaagccgccggcttcccggtgcagaactaccgctattacgacgccgccagcaatggcgtgaaccgcgccggcctgctggaagacctgaatgccctgccggcccgctcgatcgtggttctgcacgcctgctgccataatccgaccggcgtcgatctcgagctggacgactggaaacaggtgctggacgtgctcaaggccaagggccacgtgccgttcctcgacatcgcctaccagggcttcggcaacggcatcgaggaagacgccgccgcggtgcgcctgttcgcccagtcgggcctgagcttcttcgtttccagctcgttctccaaatccttctcgctctatggcgaacgcgtcggcgccctctcgatcgtgaccgaaagccgcgatgaatcggcccgcgtgctgtcccaggtgaagcgggtgatccgcaccaactattcgaacccaccgacccacggcgccagcgtcgtctcctccgtgctcaacagcccggaactgcgggccctctgggagcaggaactgggcgagatgcgcgaccgcatccgcgacatgcgcctggcgatggtcgagcaactggcagcccacggcgccaagcgcgacttcagcttcgtcggtcgccaacgtggcatgttctcctattccggcctgaccgccgaccaggtcgagcgcctgaagaccgagttcggtatctacgccgtcagcaccggccgtatctgcgtcgccgcgctgaacaaatcgaacctggagaccatcaccaaggccatcgtccaggtcctgtag

SEQ ID NO: 12839 - protein, 398 aa, Pseudomonas aeruginosa
MSLFSAVEMAPRDPILGLNEAFNADTRPGKINLGVGVYYNEEGRIPLLRAVQAAEKARIEAHAPRGYLPIEGIAAYDQGVQKLLFGNESELLAAGRVVTTQAVGGTGALKLGADFLKRLLPDATVAISDPSWENHRALFEAAGFPVQNYRYYDAASNGVNRAGLLEDLNALPARSIVVLHACCHNPTGVDLELDDWKQVLDVLKAKGHVPFLDIAYQGFGNGIEEDAAAVRLFAQSGLSFFVSSSFSKSFSLYGERVGALSIVTESRDESARVLSQVKRVIRTNYSNPPTHGASVVSSVLNSPELRALWEQELGEMRDRIRDMRLAMVEQLAAHGAKRDFSFVGRQRGMFSYSGLTADQVERLKTEFGIYAVSTGRICVAALNKSNLETITKAIVQVL

SEQ ID NO: 12840 - DNA, 1194 bp, Neisseria meningitidis
  CDS (1)..(1194)
atgttcttcaagcacatcgaagccgcccccgccgatccgattctcggtttgggcgaagcgttcaaagccgaaacccgccccgaaaaagtcaacctcggcatcggcgtttataaagacgcatccggcgcgacacccctcgtcaaagccgtcaaagaagccgaaaaacgcctgttggaaagcgaaaccaccaaaaactacctcaccatcgacggcgttgccgactacaacgcgcaaacccaaatcctgctgttcggcaaagaccacgaaatcatcgccagccgtcgcgccaaaacagcgcaaagcctcggcggtacgggcgcattgcgtattgcggccgagtttgccaaacgccagttgaacgcgcaaaccatctggatttccaatccgacttggcccaaccacaacgccatcgccaaagcggtcggtatccaagacaaaccttatcgttactatgatgccgccaaacacggtttggattgggacggcatgattgaggacttgagccaagcgcaaaaaggcgacatcgtcctgctgcacggctgctgccacaatcctaccggcatcgaccctacgcccgaacaatgggaaactttggcaaaactttctgccgaaaaaggctggttgccgctgtttgactttgcctaccaaggcttcggcaatggtttggaagaagatgcctacggcttgcgcgtgttcttgaaacacaatacagaattgctgattgccagctcttattccaaaaacttcggtatgtacaacgagcgcgtcggcgcgttcactttggtggccgaagatgaagaaacagcagcccgcgcccacagccaagtcaaaaccatcatccgtaccttgtattccaacccggcttcacacggtgcgaacaccattgcgctggtgttgaaaaatgatgatttgaaagcacaatggattgccgaactcgatgaaatgcgcggccgcatcaaagccatgcgccaaaaatttgtcgggttgctcaaagccaaaggtgcaagccaaaactttgatttcattatcaaacaaaacggtatgttctctttcagcggcttgactcccgaacaagtcgaccgcctgaaaaacgagtttgccatttatgccgtccgctccggccgcatcaacgtcgccggcattaccgacaacaacatcgattatctgtgcgaaagcatcgtgaaagtactgtaa

SEQ ID NO: 12841 - protein, 397 aa, Neisseria meningitidis
MFFKHIEAAPADPILGLGEAFKAETRPEKVNLGIGVYKDASGATPLVKAVKEAEKRLLESETTKNYLTIDGVADYNAQTQILLFGKDHEIIASRRAKTAQSLGGTGALRIAAEFAKRQLNAQTIWISNPTWPNHNAIAKAVGIQDKPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQVKTIIRTLYSNPASHGANTIALVLKNDDLKAQWIAELDEMRGRIKAMRQKFVGLLKAKGASQNFDFIIKQNGMFSFSGLTPEQVDRLKNEFAIYAVRSGRINVAGITDNNIDYLCESIVKVL

SEQ ID NO: 12842 - DNA, 1203 bp, Xylella fastidiosa
  CDS (1)..(1203)
atgcccttatttacagatgtggaattggttccaggtgatcccattctgagcctcaacgatacttataacgccgatacacgtaccaacaaggtcaatttgggtattggcatttattgtgacgagagcggttgtatcccgctgttgcgggctgtccagcaggttgaagagcaacttgcgaagcatccgaaaccgcgcggttatctgccgattgatggtttgccagcctatatcaaagccacacaacaattgttgtttggagtcgactcccccttgttgacggctggccgtgtggcgacctcacagactattggaggttctggggcattgcgggtgactgctgaggtactgaagcaggtgctaccacatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccatgtattgatctggcttaccaaggattcaatcagggcattgatgcggatgcttatgccatacgtttgcttgccgaagaaggtattagtaactatgtagttgccaactcgtactccaaatcgttctcgttgtatggcgagcgtgttggggggctgtcgatcgttgcttccaatacggagcaagcccaagcaatccagtcacaagtaaagcgtattatccgtacgatttattccagtccgtcggcacacggcgcctacttggtcgcaggtgtgctcaacagtcatgagctgcggacgctgtgggagcaggagttaacccagatgcgtgaacgtatccacgggttgcgtgcgggtttggttgctcgattgacggcgctgggtgcgccggagtttgatttcatacaacgtcaagcaggcatgttttcgtattcggggctgagcaagatccaggtggatcgtttgcgcgacgagttcgggatttatgcggtcagtagtggacgtatctgtgtggctgcgttgagtcagcacaaattggaatacgtggcgcaggctgtggtgaaggtgcatcaaggctga

SEQ ID NO: 12843 - protein, 400 aa, Xylella fastidiosa
MPLFTDVELVPGDPILSLNDTYNADTRTNKVNLGIGIYCDESGCIPLLRAVQQVEEQLAKHPKPRGYLPIDGLPAYIKATQQLLFGVDSPLLTAGRVATSQTIGGSGALRVTAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPSAHGAYLVAGVLNSHELRTLWEQELTQMRERIHGLRAGLVARLTALGAPEFDFIQRQAGMFSYSGLSKIQVDRLRDEFGIYAVSSGRICVAALSQHKLEYVAQAVVKVHQG

SEQ ID NO: 12844 - DNA, 1200 bp, Pseudomonas aeruginosa
  CDS (1)..(1200)
atgagtcatttcgccaaggtcgcccgcgtaccgggcgacccgatcctgggcctgctcgacgcctaccgcaacgatccgcgcgcggacaagctggacctcggcgtcggtgtctacaaggatgcccagggcctgaccccgatcctgcgctcggtgaaactcgccgagcagcgcctggtcgagcaggaaaccaccaagagctacgtcggcggccacggcgatgcgctgttcgccgcgcgcctggcggaactggcgctcggcgccgcctcgccgctgttgctggagcaacgcgccgacgccacccagacgcccggcggcaccggcgccttgcgcctggccggcgacttcatcgcccattgcctgcccggccgcggcatctggctgagcgacccgacctggccgatccacgagaccctgttcgccgccgccggcctgaaggtttcccactacccctacgtcagcgccgacaaccgcctggatgtcgaggcgatgcttgctggcctggagcgcattccccagggagacgtggtgctgctgcatgcctgctgccacaacccgaccggtttcgacctgagccacgacgactggcgcagggtgctcgacgtggtgcgtcgccgcgagctgctgccgctgatcgacttcgcctaccagggcttcggcgacggtctcgaggaagacgcctgggcggtacgcctgttcgccggcgaactgccggaggtgctggtcaccagttcctgctcgaagaacttcggcctgtaccgcgaccgcgtcggtgcgctgatcgtctgcgcgcagaacgccgagaagctcaccgacctgcgtagccaactggccttcctcgcccgcaacctctggtcgaccccgccggcgcatggtgccgaggtggtcgcggcgatcctcggcgacagcgagttgaagggactctggcaggaagaggtcgaaggcatgcgctcgcgcatcgccagcctgcgcatcggcctggtcgaagccctggcgccgcacggcctggccgagcgcttcgcccatgtcggcgcgcaacgcgggatgttttcctataccggactgagcccgcagcaggtcgctcggctgcgcgacgagcacgccgtttacctggtctccagcggccgggccaacgtcgccggtctcgacgcgcgccgcctcgaccgcctggcgcaagccatcgcccaggtctgcgcggactga

SEQ ID NO: 12845 - protein, 399 aa, Pseudomonas aeruginosa
MSHFAKVARVPGDPILGLLDAYRNDPRADKLDLGVGVYKDAQGLTPILRSVKLAEQRLVEQETTKSYVGGHGDALFAARLAELALGAASPLLLEQRADATQTPGGTGALRLAGDFIAHCLPGRGIWLSDPTWPIHETLFAAAGLKVSHYPYVSADNRLDVEAMLAGLERIPQGDVVLLHACCHNPTGFDLSHDDWRRVLDVVRRRELLPLIDFAYQGFGDGLEEDAWAVRLFAGELPEVLVTSSCSKNFGLYRDRVGALIVCAQNAEKLTDLRSQLAFLARNLWSTPPAHGAEVVAAILGDSELKGLWQEEVEGMRSRIASLRIGLVEALAPHGLAERFAHVGAQRGMFSYTGLSPQQVARLRDEHAVYLVSSGRANVAGLDARRLDRLAQAIAQVCAD

SEQ ID NO: 12846 - DNA, 1215 bp, Vibrio cholerae
  CDS (1)..(1215)
atgttacctgaatttcaaagggttgtgactttcatgtttactcatttaccagcaccagttttagatccaatactttctctctccgtcgcctttcgcaatgatcctcgtccacaaaaagtggatcttggaatcggcgtttataaaaacagtcttggcgaaacgccaattatgcgtgccgttgcgctggcgcaagataaagtggtggcaagccaaaaaaccaaatcttatgtcggccttgccggctgtgaagagttcaaccagagcatgatgcagctcgtattaggttcaaccttggatacggagcgcacgattgcaatccagactccgggagccagcggcgcgctgcgtatgctgggggatttgatgcgtgtggcgcaaccggatactaccgtgtggatcaccgatcctagttatgtcaaccacaagcccgtgatggaagcggctggtctgaaagtacgttactaccgttatttcagccgtgaaaccaaaatggtggataccgaacaaatgttggccgatctggcacaagcgggaacgaaagatgtggtgttactgcatggttgttgtcataacccgacaggtgccgatatcgatttttctgcgtggcaagcgatcactgagttggcgcagaaaaacggctttatcccttttgtcgacatcgcctatcaaggttttggtgacggcttagaacaagatgcacagggtttgcgttacatggctgagcgcatggaagagatgttgatcacgacatcctgctctaagaatttcggcttgtatcgtgagcgtacgggagcggcgattgtgattgggaaaaatcagcaagaggtgaccaatgcacgcggcaaaatgctgaccttagcgcgttccacttacactatgccgcccgatcacggtgctgctctcgtcaaaacagtgttaagagatgaacagctcacggcaatttggaaacaagagttgagtgaaatgcagcaacgtttgttaactctgcgcaaaaatttgtgtaatgagttgagaaatcaacacaatacgcgacaattcgacttcattgagagccatagaggcatgtttactgtactgggattcagtgcagagcagatgggaaggctgcgtgaagagtttgcgatttatggtgtcgcagatggcagaattaatatcgcagggctgaccgaaaaagacattccttatgtggccaatgctattattcatgtgtcgtaa

SEQ ID NO: 12847 - protein, 404 aa, Vibrio cholerae
MLPEFQRVVTFMFTHLPAPVLDPILSLSVAFRNDPRPQKVDLGIGVYKNSLGETPIMRAVALAQDKVVASQKTKSYVGLAGCEEFNQSMMQLVLGSTLDTERTIAIQTPGASGALRMLGDLMRVAQPDTTVWITDPSYVNHKPVMEAAGLKVRYYRYFSRETKMVDTEQMLADLAQAGTKDVVLLHGCCHNPTGADIDFSAWQAITELAQKNGFIPFVDIAYQGFGDGLEQDAQGLRYMAERMEEMLITTSCSKNFGLYRERTGAAIVIGKNQQEVTNARGKMLTLARSTYTMPPDHGAALVKTVLRDEQLTAIWKQELSEMQQRLLTLRKNLCNELRNQHNTRQFDFIESHRGMFTVLGFSAEQMGRLREEFAIYGVADGRINIAGLTEKDIPYVANAIIHVS

SEQ ID NO: 12848 - DNA, 1287 bp, Staphylococcus aureus
  CDS (1)..(1287)
atgaatcctttagcccaaagcttaaatgaacaacttcaacagtcaaatgcaactgcctttacaatgttatctgacttaggtcaaaatatgttttatccaaaaggcattttatctcaatctgctgaagcaaagagtacaacatataatgcaactataggtatggcgacaaacaaagacggaaaaatgtttgcatcatctttagatgcaatgtttaatgatttaactccagatgaaatattcccttatgcgccaccacaaggcatcgaagaattacgtgatttatggcaacaaaaaatgttgcgtgacaatccagagctatcaatcgacaacatgtcactaccaattgttacgaatgcattaacacatggtttatctttagttggcgatttatttgtaaatcaaggtgacactatcttgttaccagagcataattggggtaattacaaacttgttttcaatacgagaaatggtgcaaaccttcaaacatatcctatctttgataaagacgggcattatactactgattcacttgtagaagctttacaatcatacaataaagataaagtcattatgattttaaattatcctaataatccgacaggttacacacctacgcataaagaagtgactaccatcgtcgatgcaattaaagcattagctgataaaggtacaaaagttatagctgttgtggatgacgcatactatggtttattctatgaagatgtgtatactcaatcattatttactgcattatctaatttaaattcaaatgcaatattacctgttcgtttagatggtgcaacaaaagaatttttcgcatggggattccgtgttgggtttatgacatttggaacgtctgatcaaacaactaaagaagtattagaagccaaagtaaaaggtcttatacgaagtaacatttctagtggacctcttccaacacaaagcgctgttaagcatgtattaaaaaataataaacaattcgataaagaaatcgaacaaaatattcaaacattaaaagaacgctatgaagtcactaaggaagttgtctatgctgatcaatatcattcacattggcaagcctatgactttaactctggatactttatggcaataaaagttcatgatgttgaccctgaagaacttcgtaaacatttaattgaaaaatattcaattggtgttattgcacttaatgcaacagatattcgtattgcgtttagctgtgtagaaaaagaagatatcccacatgtatttgattcaattgctaaagcgattgatgacttaagatag

SEQ ID NO: 12849 - protein, 428 aa, Staphylococcus aureus
MNPLAQSLNEQLQQSNATAFTMLSDLGQNMFYPKGILSQSAEAKSTTYNATIGMATNKDGKMFASSLDAMFNDLTPDEIFPYAPPQGIEELRDLWQQKMLRDNPELSIDNMSLPIVTNALTHGLSLVGDLFVNQGDTILLPEHNWGNYKLVFNTRNGANLQTYPIFDKDGHYTTDSLVEALQSYNKDKVIMILNYPNNPTGYTPTHKEVTTIVDAIKALADKGTKVIAVVDDAYYGLFYEDVYTQSLFTALSNLNSNAILPVRLDGATKEFFAWGFRVGFMTFGTSDQTTKEVLEAKVKGLIRSNISSGPLPTQSAVKHVLKNNKQFDKEIEQNIQTLKERYEVTKEVVYADQYHSHWQAYDFNSGYFMAIKVHDVDPEELRKHLIEKYSIGVIALNATDIRIAFSCVEKEDIPHVFDSIAKAIDDLR

SEQ ID NO: 12850 - DNA, 1182 bp, Bacillus subtilis
  CDS (1)..(1182)
atgaaattggctgggttatcccgggaagttgaagaaaacttaaataaaggatcatggattcgcaagctgtttgatgaaggtgcaaggctgaagaaggagttcggggaagaccaggtatttgatttttcactcggcaacccgattgttgaaccgcctgaagcttttaagagagcgttaatagaggaagctgaaaaaggcagccacggatacatacaaaaccaagggcttcttgcagcgagagaaaaagtcgcgcaatttctgggctcgcgttttgaagctgatttctcagcggagcgcatcgtcatgacggtgggcgcgggaggcgctttgaatgttgcgttaaaaagcatcgtaaaccctggggaagaggtcattattcttgcaccttattttgccgaatataagttgtatattgagaactacgggggaaaagccgtcagctgcccgttgacaagccggtttgagatcgacattgaagcggtaaggcaatcgatcactccacagacgaaagggctgattctcaatacaccgcataaccccacaggcactgttctcagccagaaaaatatagacgatttaggcgctttattaaaagaaatagaagagaagagcggccagacgatttatgtgctgtttgatgaaccgtacagtcaattaatctatgatgaagagctggcaaatccgtttcaatcgtaccatcgtgtgatattggccagctcattcagtaaagatctcggcatagccggagagcggctcgggtatatcggattggacagccgaatgccggatgcggaccttttgatcaacgcttttgtgtattgtaatcgaacgcttggatttgtgaatgcccctgtcatgatgcagcgggctgtggcacgaatggatgatttaagagtagacgcgagcgcttataaagagcgccgggatttaatggtagacattttaaaagaagccggttttgaatttgaaatgccaaagggaggtttctttgtttttccgaaatcgccgattgaagatgaagttgcattttgcgtgcatgccgcccaaaaatacaaattattaattgtgccgagcagcggttttggaatgagcgggcatttccgattatccttcagtgtgccgatcgagcagattaaaaactcacgggacattttcatttctttatataaagattttgcttaa

SEQ ID NO: 12851 - protein, 393 aa, Bacillus subtilis
MKLAGLSREVEENLNKGSWIRKLFDEGARLKKEFGEDQVFDFSLGNPIVEPPEAFKRALIEEAEKGSHGYIQNQGLLAAREKVAQFLGSRFEADFSAERIVMTVGAGGALNVALKSIVNPGEEVIILAPYFAEYKLYIENYGGKAVSCPLTSRFEIDIEAVRQSITPQTKGLILNTPHNPTGTVLSQKNIDDLGALLKEIEEKSGQTIYVLFDEPYSQLIYDEELANPFQSYHRVILASSFSKDLGIAGERLGYIGLDSRMPDADLLINAFVYCNRTLGFVNAPVMMQRAVARMDDLRVDASAYKERRDLMVDILKEAGFEFEMPKGGFFVFPKSPIEDEVAFCVHAAQKYKLLIVPSSGFGMSGHFRLSFSVPIEQIKNSRDIFISLYKDFA

SEQ ID NO: 12852 - DNA, 1218 bp, Plasmodium falciparum
  CDS (1)..(1218)
atggataagttattaagcagcttagaaaatatcgaagtcgacaatatcttaaaaacggcaagagagtttaaggaagatacatgtgaggagaaaataaatttatccatcggtgtgtgttgtaatgatgatggagacttacatatatttgatagtgtattaaatgccgataagttagtaacagaaaattataaagagaaaccatatttgttaggtaacggtacagaagatttttcaacattaacacagaatttaatatttggtaataattccaaatatatagaagataaaaaaatatgtacaattcaatgtattggaggtactggtgctatttttgttttattagaatttttaaaaatgttaaatgttgaaactttatatgttacaaatccaccttatattaatcatgtgaatatgattgaatcaaggggatttaatttaaaatatataaatttttttgattataatttgatagatataaattatgatttatttctaaatgatcttagaaatataccaaatggatcctcagttattttacaaatatcttgttataatccttgtagtgttaatattgaagaaaaatattttgatgaaataatagaaattgttttacataaaaaacatgttattatctttgatatagcttatcaaggatttggacatacaaatttagaagaagatgtcttacttattcgaaagtttgaagaaaaaaatatcgccttttcggtatgtcaatccttttcaaaaaatatgtcgctttatggagaaagagcaggtgctcttcatattgtttgtaaaaatcaagaagaaaaaaaaatcgtttttaataatttatgttttatcgtacgtaaattttattcgtctcctgttatacatacgaatcgtattctatgccaacttttaaataatcaaaatttaaaattaaattggattaaagaacttagtcaattatcacaacgtattacgaataatagaatcctattctttaataaattagaaacatatcaaaaaaaatataatctaaattatgattggaatgtctataaaaaacaaagaggccttttttcattcgttcctctactagccaaaattgctgagcatttaaaaacacatcatatttatataattaataatggtagaataaatgtctccggaataaccaaaaataatgtcgattatatagccgacaaaatttgtctttcgctaagtcaaatatga

SEQ ID NO: 12853 - protein, 405 aa, Plasmodium falciparum
MDKLLSSLENIEVDNILKTAREFKEDTCEEKINLSIGVCCNDDGDLHIFDSVLNADKLVTENYKEKPYLLGNGTEDFSTLTQNLIFGNNSKYIEDKKICTIQCIGGTGAIFVLLEFLKMLNVETLYVTNPPYINHVNMIESRGFNLKYINFFDYNLIDINYDLFLNDLRNIPNGSSVILQISCYNPCSVNIEEKYFDEIIEIVLHKKHVIIFDIAYQGFGHTNLEEDVLLIRKFEEKNIAFSVCQSFSKNMSLYGERAGALHIVCKNQEEKKIVFNNLCFIVRKFYSSPVIHTNRILCQLLNNQNLKLNWIKELSQLSQRITNNRILFFNKLETYQKKYNLNYDWNVYKKQRGLFSFVPLLAKIAEHLKTHHIYIINNGRINVSGITKNNVDYIADKICLSLSQI

SEQ ID NO: 12854 - DNA, 1194 bp, Neisseria meningitidis
  CDS (1)..(1194)
atgtaccgacacatcgaatactatcctggcgacccgattttgagtttggtcgaaaccttcaaaaacgacccgcgccccgaaaaagtcaatttgagcataggcatttatttcgacgacgaaggcaaaatgcccgtgttggaatccgtgagccgagccgaaaccgcccgtgccgccgcgcctgcgccgtcgccctacctgccgatggaaggcttggacacttaccgcagcgcggtgcagcatttattgttcggcaaagacaatcccgcgcttgcgcaagggcgcatcgttaccgtacaaaccttgggcggctcgggcgcgctcaaagtcggggcggacttcctgcaccgctggtttcccgaagcgcgcgcctacgtcagcgacccgacttgggacaaccatcgcggcatttttgaaggcgcaggtttcgaggtcggcacttacccatattacgaccctgccactgtcggcgtgaaattcgacgaaatgaccgcgtttttcaacaccctgcccgaaaacagcgtcctgatcctccatccctgctgccacaacccgaccggcgtggatatgtcggaacggcaatgggacgaagtgttgcacatcatcaaaacgcgcaaactgattccgtttatggacattgcctaccaaggattcggcggcgatttggacagcgatgcctacgccgtccgcaaagcggtggaaatggaattgcccttgttcgtcagcaattccttctcaaaaaacctgtcgctctacggcgagcgcgtcggcggcttaagcgtggtttgcccgaataaggaagaagcggatttggtgttcggacagctcaaattcaccgtccgccgcatctactccagcccgcccgcgcacggcgcgtatatcgccgccgacgtgatgaacagccccgaactttacgccttgtggcaaaacgaggtttatatgatgcgcgaccgcatccgtgcgatgcggcagaaactttatgatgtcttaactgcgcaaatccccaatcgcgatttcacttatttcatcaaacagcgcggcatgttcggctacacaggattgagcgtggaacaagtccgcaggctgcgcgacgaatttgccgtttacctgctggattccggcaggatgtgcgtcgccggactgaatacgtcgaataccgactatgttgcccgcgcatttgcggaagtcttgaaataa

SEQ ID NO: 12855 - protein, 397 aa, Neisseria meningitidis
MYRHIEYYPGDPILSLVETFKNDPRPEKVNLSIGIYFDDEGKMPVLESVSRAETARAAAPAPSPYLPMEGLDTYRSAVQHLLFGKDNPALAQGRIVTVQTLGGSGALKVGADFLHRWFPEARAYVSDPTWDNHRGIFEGAGFEVGTYPYYDPATVGVKFDEMTAFFNTLPENSVLILHPCCHNPTGVDMSERQWDEVLHIIKTRKLIPFMDIAYQGFGGDLDSDAYAVRKAVEMELPLFVSNSFSKNLSLYGERVGGLSVVCPNKEEADLVFGQLKFTVRRIYSSPPAHGAYIAADVMNSPELYALWQNEVYMMRDRIRAMRQKLYDVLTAQIPNRDFTYFIKQRGMFGYTGLSVEQVRRLRDEFAVYLLDSGRMCVAGLNTSNTDYVARAFAEVLK

SEQ ID NO: 12856 - DNA, 1293 bp, Arabidopsis thaliana (mouse-ear cress)
  CDS (1)..(1293)
atggctttggcgatgatgatccgaaacgcagcttcgaagcgaggaatgactccgatctccggtcatttcggtggtttgagatctatgtcttcatggtggaagagcgttgagcctgctcctaaagatccgatcctcggagttaccgaagcttttctcgctgatcctagtcctgaaaaagttaatgttggtgtgggagcatatcgtgatgataatgggaagcctgttgtcttggaatgtgtcagagaagctgagaaaaggcttgctgggagcactttcatggagtaccttcctatgggaggaagtgccaaaatggtggacctaacattgaagcttgcctatggggacaatagtgaatttatcaaagataaaagaattgctgcagttcagactctgtctggcactggagcctgccggctctttgcagacttccagaaacgtttttctcctggttcacagatctacattcctgttccaacctggtccaaccaccacaacatctggaaagatgcacaagtccctcaaaagacatatcattactatcatccagaaaccaagggcttggatttctcagcattgatggatgatgtgaagaatgctccggaagggtcattcttccttcttcatgcttgtgctcataatcctactggagtagaccctacagaggaacaatggagagagatatcacagctattcaaggctaaaaagcatttcgcattcttcgatatggcttaccaaggttttgctagtggagatccagcgagagatgccaagtccatcaggatctttcttgaagatggtcatcatattggaatttctcagtcctatgcaaaaaacatgggactctacggccagagggtgggatgtctcagtgtgctttgtgaagatccgaagcaagccgtggctgtgaaaagtcaattgcagcagctagctagaccaatgtacagcaacccacctttgcatggtgctcagctggtctcaaccattcttgaagacccagagttaaagagtctgtggctaaaagaagttaaggtcatggctgataggatcatcggcatgagaactactttgcgagaaagccttgagaagttaggatcgcctttgtcatgggagcacgttaccaaacagattggaatgttctgctacagtgggttaacaccagaacaggttgaccgcttaacaagcgaatatcacatctatatgacccgtaacggccgtatcagtatggctggtgttacaacaggaaacgtgggataccttgcgaatgctatacatgaagtcaccaagtcatcttaa

SEQ ID NO: 12857 - protein, 430 aa, Arabidopsis thaliana (mouse-ear cress)
MALAMMIRNAASKRGMTPISGHFGGLRSMSSWWKSVEPAPKDPILGVTEAFLADPSPEKVNVGVGAYRDDNGKPVVLECVREAEKRLAGSTFMEYLPMGGSAKMVDLTLKLAYGDNSEFIKDKRIAAVQTLSGTGACRLFADFQKRFSPGSQIYIPVPTWSNHHNIWKDAQVPQKTYHYYHPETKGLDFSALMDDVKNAPEGSFFLLHACAHNPTGVDPTEEQWREISQLFKAKKHFAFFDMAYQGFASGDPARDAKSIRIFLEDGHHIGISQSYAKNMGLYGQRVGCLSVLCEDPKQAVAVKSQLQQLARPMYSNPPLHGAQLVSTILEDPELKSLWLKEVKVMADRIIGMRTTLRESLEKLGSPLSWEHVTKQIGMFCYSGLTPEQVDRLTSEYHIYMTRNGRISMAGVTTGNVGYLANAIHEVTKSS

SEQ ID NO: 12858 - DNA, 1191 bp, Haemophilus influenzae
  CDS (1)..(1191)
atgtttgaacatatcaaagcggcaccagccgatccaatcttaggcttaggcgaagcatttaaatccgaaactcgcgaaaataaaatcaatttgggtattggcgtttataaagatgcgcaaggcacaaccccaattatgcacgcggtaaaagaagccgaaaaacgattatttgataaggaaaaaaccaagaattatctgactatcgatggtattgcggattataacgaacaaacaaaagcactccttttcggtaaagattctgaagtcatccaatctaatcgagcaagaacagtacaaagtttaggcggaacaggtgcattacgcattgcggcagaatttattaaacgccaaactaaagcacaaaatgtttggatcagcacaccaacttggccaaaccacaatgcgattttcaatgctgtcggtatgaccattcgtgaatatcgttattatgatgctgaacgcaaagcccttgattgggaacacttattagaagatttaagccaagcaagcgaaggcgatgtggtgcttttacacggttgttgccataatccgactggtattgaccctactccagaacaatggcaagaattagccgcactttcagctaaaaatggttggttgccactctttgactttgcttatcaaggtttagccaacggattagatgaagatgcttatggtttacgtgcttttgcagcaaaccacaaagaattattagtggcgagttcattctcgaaaaactttggtttatataatgaacgtgttggtgcatttacccttgtggcagaaaatgcagaaattgcatcaacctcattaacccaagtaaaatcaattattcgcaccctatactctaacccagcttctcacggcggggcgaccgtagcaacagtattaaatgatgctcaacttcgccaagaatgggaaaatgaattaactgaaatgcgtgaacgcatcaaaaaaatgcgtcacttattcgttcagttattaaaagaatatggtgcagaacaagatttcagctttatcattgaacaaaacggtatgttttctttcagtggattaacaggggaacaagtggatcgtttaaaaaatgaatttgccatttacgctgttcgttctggtcgtatcaacgtagctggaatcacagaagataatattcgctatctatgtgaaagtatcgtgaaagtactttaa

SEQ ID NO: 12859 - protein, 396 aa, Haemophilus influenzae
MFEHIKAAPADPILGLGEAFKSETRENKINLGIGVYKDAQGTTPIMHAVKEAEKRLFDKEKTKNYLTIDGIADYNEQTKALLFGKDSEVIQSNRARTVQSLGGTGALRIAAEFIKRQTKAQNVWISTPTWPNHNAIFNAVGMTIREYRYYDAERKALDWEHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTSLTQVKSIIRTLYSNPASHGGATVATVLNDAQLRQEWENELTEMRERIKKMRHLFVQLLKEYGAEQDFSFIIEQNGMFSFSGLTGEQVDRLKNEFAIYAVRSGRINVAGITEDNIRYLCESIVKVL

SEQ ID NO: 12860 - DNA, 1701 bp, Bacillus circulans
  CDS (367)..(1665)
aagcttcagccggaagcggctatgctacgattgatgcacaggacccgaagtatgccaaaaggctgaaaggggtcgccgtcatcaagctggtgccccatcggctgagcgcaaaattcaaattcgggcaaaatctgacaccggagcgtctggagagcatcgcgcaggcgctcgaaagccgggatcaggagcaggatcgcgaaaccgcaaaactaatgcgaaaatatttcacgggatcgcattaaagcgacgcgaattgatcgtgacggttgatgtgcaaggtggtataatgttaggcaatgaatcggagacattacatccaatgtcgtcataatatccaatagaattgcggaaggaaggagccaattcatgaacccattggccggacaattgaatgagaagctgcaagccggtaacccgcatgtatttgacatgctctccacactcggcaaggagctctatttcccgaaggaaggcattctgagccaatccgctgaggcagcagcccatgcgaaaaaatataatgcaacgattggaatcgcaaccgaaggcggcattcctatgcatctgggggtcattcaggagaagctgtcggctttcgctccgaaggacctgtacccgtacgcccctccagccggcaagccggagctgcgctctctatggcgggacaagatgctggaagagaacccttcgctgcaagggaagagcttcggcaatccgattgcaaccaatgcactgacccacggtctcagcatcgtcgctgacctgttcgtagatgaaggcgatgccgtcatctatcccgacaagaactgggaaaactatgacctgacattcggcgtccgccgccatggggtgaacgtgaatttccctcttttcacatcggagatgacctttaatgccgcaggtttgcgcgacgcccttctggcccagaaggataaggggaaagccgtggtcatcctcaacttcccgaacaacccgacaggctacacacctggggcagccgagggagacgccatcgtcgcagcgatcaaggatgcggccgaagcgggaatcaatgtcgttgtggttacggatgatgcgtatttcggcctgttctttgaagattcgctcaaggaatcgctgtttggccgcctggccgatctgcatccgcgcgtgctggcggtgaaggtggatggagccacgaaggaggaattcgtctggggattccgtgtcggcttcattacctatgcttcggagaacaaggacgtgctggatgccctggagcagaagacgctcggcatcatccgcgcaaccatctccagcggtccccacccttcgcagacctttgtgctggatgcgttgaaggcaccgggattcaaggagcagaaggaagagaagcttcagattatgaaaggccgcgccaataaagtgaaggacattctggacagcggcaaatatagcgaagcatgggactactacccgttcaactccggatacttcatgtgtctgaagctcaagacggtccaggctgaagcgctccgctcccatctgattcacgagtacgggatcggcaccattgccttgggcgaacatgatctgcggatcgcattctcttgcattgaggagccatatttggaggatctgtttgatttgattcaccagggtgttcaggatctgcagcaggcgtaatcacgcagtgaccggacacacgcggtgatgatcgat

SEQ ID NO: 12861 - protein, 432 aa, Bacillus circulans
MNPLAGQLNEKLQAGNPHVFDMLSTLGKELYFPKEGILSQSAEAAAHAKKYNATIGIATEGGIPMHLGVIQEKLSAFAPKDLYPYAPPAGKPELRSLWRDKMLEENPSLQGKSFGNPIATNALTHGLSIVADLFVDEGDAVIYPDKNWENYDLTFGVRRHGVNVNFPLFTSEMTFNAAGLRDALLAQKDKGKAVVILNFPNNPTGYTPGAAEGDAIVAAIKDAAEAGINVVVVTDDAYFGLFFEDSLKESLFGRLADLHPRVLAVKVDGATKEEFVWGFRVGFITYASENKDVLDALEQKTLGIIRATISSGPHPSQTFVLDALKAPGFKEQKEEKLQIMKGRANKVKDILDSGKYSEAWDYYPFNSGYFMCLKLKTVQAEALRSHLIHEYGIGTIALGEHDLRIAFSCIEEPYLEDLFDLIHQGVQDLQQA

SEQ ID NO: 12862 - DNA, 1578 bp, Oryza sativa (rice)
  CDS (20)..(1312)
ctcctccgatcgcgcgcgcatggcgatgtcacgagcggccgccgctgccgcggggactcccgtggcgcggcggcgattgatgggggccgtggcggcgaggtcgatggcgtcgtggttcggccacgtggaaccggccgccaaggaccccatcctcggcgtcaccgaggcgttcctcgccgacccctccccggacaaagtcaacgtcggcgtcggcgcgtaccgggacgacagcgggaagcccgtggtgctggagtgcgtgcgcgaggcgggacggcggatcgccgggagcatgaacatggagtaccttccaatgggtggaagcataaagatgattgaagaatcacttaaactggcctatggggagaactgtgagttcatcaaggacaagaggatcgcagcagtgcaggctctttcaggaactggtgcatgtcgcctctttgcagatttccagaagcgtttcttgccagattcacagatttatatacccacacctacatgggccaaccatcacaatatttggagggatgcccaagtaccacaaaagacatttacctattaccatccagagtcaagaggacttgactttgcaggcctaatggatgatatcaagaatgctccagatggttcattctttttgcttcatgcttgtgcgcataatcccactggagtagatccttcagaagaacaatggagggagatatctcatcagttcaaggtgaagaaacattttccattcttcgacatggcataccaaggatttgctagtggtgatccagagagagatgccaaggcaattcgaatatttcttgaagatggacatcaaattggatgtgcacagtcatatgcgaaaaacatgggactttatggacaaagagcaggatgccttagtattctatgtgatgatgagatgcaagcagttgctgttaagagccagttacaacagattgctagacctttgtacagcaacccacccgttcatggtgcattaattgtttcaactattcttggtgatccggagttgaaaagtttatggctgaaagaggtcaagggtatggctgatcgtatcattggaatgcgaacagcactcaaagagaaccttgaaaagttgggttcaccaatgtcatgggaacatatcactaatcagattggaatgttctgctacagtggtatgacacctgaacaagtcgatcgcttgacaaaagagttccatatctacatgactcgtaacgggcggataagcatggctggagtaacaacaggaaatgttgcctatctggctaatgctattcatgaggttaccaagacaaagtgagagtgttggagacattcctatcatcattttcagtacctttttaccgaccgcaaaatgggtcaaatggtgaaataaaattgtagtccgatatgatgtgaaataaaatggctggtaagctagaaaagggcaagtttattttttgaggacaagacttttgctgtaccagtgaaaacattttttaggacaagactttacagttagaacgaacgttctaactgtgacagtgtcatgctttgtaaaggaagtgtacctttccaccgatgggc

SEQ ID NO: 12863 - protein, 430 aa, Oryza sativa (rice)
MAMSRAAAAAAGTPVARRRLMGAVAARSMASWFGHVEPAAKDPILGVTEAFLADPSPDKVNVGVGAYRDDSGKPVVLECVREAGRRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 12864 - DNA, 1334 bp, Paracoccus denitrificans
  CDS (131)..(1315)
cgggggtgacggcggccgtgctgttcctggcgcttgaacgcatcgggcaccgggaccattcgctttatgacggaagctgggccgaatggggcaggttccccgaccttaaaatcgcaaccggagacgcgtgatgctgggcaatctgaaaccgcaggcccccgacaagatcctggccctgatgggcgaattcagggccgatccccgccagggcaagatcgacctgggcgtgggggtctacaaggatgccaccggccacaccccgatcatgcgggccgtccacgccgccgagcagcgcatgctggaaaccgagaccaccaagacctatgccggcctctcgggcgagcccgagttccaaaaggccatgggcgagctgatcctgggcgacggactgaaatccgagaccaccgcgacgctggcgacggtcggcggcaccggcgccctccggcaggcgctggaactggcgcgcatggcgaacccggacctgcgggtcttcgtcagcgatccgacctggccgaaccatgtctcgatcatgaatttcatgggcctgccggtgcagacctatcgctatttcgatgccgagacccgcggcgtcgatttcgagggcatgaaggccgacctcgccgccgcgaaaaagggcgacatggtgctgctgcacggctgctgccacaacccgaccggcgccaacctgacgctggatcaatgggccgagatcgcctcgatcctggaaaagaccggcgcgctgccgctgatcgacctggcctatcagggcttcggcgacgggctggaagaggacgcggccggcacccggctgatcgcctcgcgcatccccgaggtgctgatcgcggcctcgtgcagcaagaacttcggcatctaccgcgaacgcaccggctgcctgctggcgctttgcgccgatgcggcgaccagggagctggcgcagggcgccatggccttcctgaaccgccagacctattccttcccgcccttccacggcgccaagatcgtctcgaccgtgctgaccacgcccgaactgcgcgccgactggatggccgagctggaagcggtgcgcagcggcatgctgcgcctgcgcgagcaattggcgggcgagttgcgcgatctcagcggttcggaccgtttcggcttcgtggccgagcatcgcggcatgttctcgcgcctgggcgccacgcccgaacaggtcaagcgcatcaaggaagagttcggcatctacatggtgggcgattcgcgcatcaacatcgccgggctgaacgacaacaccatcccgatcctggcccgcgctatcatcgaggtgggggtctaagccaccgcaagggcgccgg

SEQ ID NO: 12865 - protein, 394 aa, Paracoccus denitrificans
MLGNLKPQAPDKILALMGEFRADPRQGKIDLGVGVYKDATGHTPIMRAVHAAEQRMLETETTKTYAGLSGEPEFQKAMGELILGDGLKSETTATLATVGGTGALRQALELARMANPDLRVFVSDPTWPNHVSIMNFMGLPVQTYRYFDAETRGVDFEGMKADLAAAKKGDMVLLHGCCHNPTGANLTLDQWAEIASILEKTGALPLIDLAYQGFGDGLEEDAAGTRLIASRIPEVLIAASCSKNFGIYRERTGCLLALCADAATRELAQGAMAFLNRQTYSFPPFHGAKIVSTVLTTPELRADWMAELEAVRSGMLRLREQLAGELRDLSGSDRFGFVAEHRGMFSRLGATPEQVKRIKEEFGIYMVGDSRINIAGLNDNTIPILARAIIEVGV

SEQ ID NO: 12866 - DNA, 1677 bp, Panicum miliaceum (proso millet)
  CDS (84)..(1370)
cagagaccaagcccaaaaagcccacagctttcctccccctccccctccccggcgccgcccagctcctccacctccgtcccggcatggcggcgctgtcccgcgcggcctcctgcttgacccggcggccgcagatgcagccgtcgaggctgcaggcggcgagggcgatggcgtcgtcgctgttcggccacgtcgagccggcgcccaaggaccccatcctcggcgtcaccgaggcctacctcgccgacccctcgcccgacaaggtcaacgtcggcgtcggcgcctaccgggacgacaacggcaaacccctcgtgctcgactgcgtgcgcgaggccgagcgccggattgccggcaacctcaacatggagtacctcccaatgggaggcagtgtaaagatgatcgaagaatcgctgaagctggcatacggagaggattccgaactcatcaaagacaagaggatcgcggcagtgcaggcgctttcgggcactggtgcctgtcggctctttgctgatttccaaaagcgattcttgcccgattcgcaaatctatatacctacacccacgtggtccaaccatcacaatatttggagggatgctcaagtgccacagaaggcatacacatactaccatccagagtcaagagggcttgattttgcaggattaatgaatgacatcaagaatgctccagatggttcgttctttatgctccatgcatgtgctcataatcctactggagtagatcctacagaggaacaatggagagaaatatcccatcagttcaaggtgaaaaaacattttccattctttgacatggcataccaagggtttgccagcggtgatccagagagagatgctaaggcaatccgaattttccttgaagatggacaccaaattggatgtgctcagtcatacgcaaagaacatgggactttatggacagagagtaggatgcctgagtattttgtgtgaggatgagatgcaagcagttgctgtcaagagccaactgcaacagattgcaagaccaatgtacagcaacccacctgttcatggtgcacttgttgtttctataatcctcaatgatccagaattgaagagtttatggttaaaagaggtcaagggtatggctgatcgtatcattggaatgcggacggcacttaaggaaaatcttgaaaagctaggttcatctttgtcatgggagcacatcactaatcagattggaatgttctgctacagtgggatgacacctgaacaagttgaccggttgacaaatgaattccatatttacatgacccgcaacgggaggataagcatggctggtgtaacgacacgaaatgttggttacttggcaaatgctattcacgaggttaccaaatagaattgagttcggccctcctaccctcgtcggccgatgaaatgaggctttcaagtggcttttttggtgcctgacatatcaacattatcattctcgagaaataagttaagcctgttggggctgtccaaagcatgcccggcgcttcagccacttcagttgcggattagtgaaaatgcatattctgtcaaccagatgctgtgaggattgacaacgataagccatgacatatcctaacaggcttgttctactcgattttgttgcaacttctcagtgagaatttttaccaaagctgctgctaaaaaaaaaaaaa

SEQ ID NO: 12867 - protein, 428 aa, Panicum miliaceum (proso millet)
MAALSRAASCLTRRPQMQPSRLQAARAMASSLFGHVEPAPKDPILGVTEAYLADPSPDKVNVGVGAYRDDNGKPLVLDCVREAERRIAGNLNMEYLPMGGSVKMIEESLKLAYGEDSELIKDKRIAAVQALSGTGACRLFADFQKRFLPDSQIYIPTPTWSNHHNIWRDAQVPQKAYTYYHPESRGLDFAGLMNDIKNAPDGSFFMLHACAHNPTGVDPTEEQWREISHQFKVKKHFPFFDMAYQGFASGDPERDAKAIRIFLEDGHQIGCAQSYAKNMGLYGQRVGCLSILCEDEMQAVAVKSQLQQIARPMYSNPPVHGALVVSIILNDPELKSLWLKEVKGMADRIIGMRTALKENLEKLGSSLSWEHITNQIGMFCYSGMTPEQVDRLTNEFHIYMTRNGRISMAGVTTRNVGYLANAIHEVTK

SEQ ID NO: 12868 - DNA, 1659 bp, Panicum miliaceum (proso millet)
  CDS (84)..(1370)
cagagaccaagccccaaaagcccacagctttccttcccctccccctccccggcgccgcccagctcctccacctccgccccggcatggcggcgctgtcccgcgcggcctcctgcttgacccggcggccgcagatgcagccgtcgaggctccaggcggcgagggcgatggcgtcgtcgctgttcggccacgtcgagccggcgcccaaggaccctatcctcggcgtcaccgaggccttcctcgccgacccctcgcccgacaaggtcaacgtcggcgtcggcgcctaccgggacgacaacggcaagcccctcgtgctcgactgcgtgcgcgaggccgagcgccggattgccggcaacctcaacatggagtacctcccaatgggaggcagtataaagacgatcgaagaatcgctgaagctggcgtatggagaggattccgaacacatcaaagacaagaggatcgcagcagtgcaggcgctttcgggcactggtgcctgtcggctctttgctgatttccaaaagcgattcttgcccgattcgcaaatctacatacctacaccaacgtggtccaaccatcacaatatttggagggatgctcaagtgccacagaagacattcacatactaccatccggagacgagagggcttgattttgcaggattaatgaatgacatcaagaatgctccagatggttcattctttttgctccatgcatgtgctcataatcctactggagtagatcctacagaggaacaatggagagaaatatcccatcagttcaaggtgaaaaaacattttccattctttgacatggcataccaagggtttgccagcggtgatccagagagagatgctaaggcaatccgaattttccttgaagatgggcaccaaattggatgtgctcagtcgtacgcaaagaacatgggactttatggacaaagagtaggatgcctgagtattttgtgtgaggatgagatgcaagcagtttctgtcaagagccaactgcaacagattgcaagaccaatgtacagcaacccacctgttcatggtgcacttgttgtttctataatcctcagtgatccagaattaaagagtttatggttaaaagaggtcaagggtatggctgatcgtatcattggaatgcggacggcacttaaggaaaatcttgaaaagctaggttcatctttgtcatgggagcacatcactaatcagattggaatgttctgctacagtgggatgacacctgaacaagttgaccggttgaccaatgaattccatatttacatgacccgcaacgggaggataagcatggctggtgtaacgacaggaaatgttgcttacttggcaaatgctattcacgaggttaccaaataattgactttggctctcctaccctcgttggccgatgaaatgaggctttcaagtgacactttggtgcctgacgtatcaacattatcattctcgagaaataagttaagcctgttggggctgtccaagggcgaatttcacatacatgtacgagaactatagatgtgaaacttcagtcttgatagctacatgatcctgtttattttctttttctttcttttttccccatcttgtcatggcaatttttacacttagctgcaaatggttgtagcatgatctacagttctgaagaaaa

SEQ ID NO: 12869 - protein, 428 aa, Panicum miliaceum (proso millet)
MAALSRAASCLTRRPQMQPSRLQAARAMASSLFGHVEPAPKDPILGVTEAFLADPSPDKVNVGVGAYRDDNGKPLVLDCVREAERRIAGNLNMEYLPMGGSIKTIEESLKLAYGEDSEHIKDKRIAAVQALSGTGACRLFADFQKRFLPDSQIYIPTPTWSNHHNIWRDAQVPQKTFTYYHPETRGLDFAGLMNDIKNAPDGSFFLLHACAHNPTGVDPTEEQWREISHQFKVKKHFPFFDMAYQGFASGDPERDAKAIRIFLEDGHQIGCAQSYAKNMGLYGQRVGCLSILCEDEMQAVSVKSQLQQIARPMYSNPPVHGALVVSIILSDPELKSLWLKEVKGMADRIIGMRTALKENLEKLGSSLSWEHITNQIGMFCYSGMTPEQVDRLTNEFHIYMTRNGRISMAGVTTGNVAYLANAIHEVTK

SEQ ID NO: 12870 - DNA, 1755 bp, Glycine max (soybean)
  CDS (73)..(1464)
gtttccttcatcttcttcttcttcttctatctctctacaacacacttttttaagtgattcgttcgcagaaacatggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagagaatcttatgctggagagaggggataacaaagagtatctcccaattgagggtttggcagcatttaataaggcaactgcagagttgttactcggagcagacaacccagcaatcaaacagcaaagagttgccactgtccaaggtctttctggaactggttctctgcgactaggtgcagctctgatagagcgatattttcctggggcaaaagttttgatatcagctcctacctggggtaatcacaagaatattttcaatgatgctagtgtcccatggtctgagtaccgatattatgatcccaagacagttgggttggattttgagggcatgattgaagatataaagtcagctccggaaggatcttttatcttacttcatggatgtgctcataatcctactggtattgatccaacacctgaacagtgggaaaaaatagctgatttaattgaagaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctgaaaggattggagcaatcaatgtgatttcatcgtcaccagaatctgcagcaagggaaacgagccaactgaaaaggattgcccgaccaatgtactctaatccaccggtacacggggctaggatagttgccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacatgacaaacaagtggcacgtatacatgacaaaggatggaaggatttccctggcaggattgtcgttggctaaatgcgaataccttgcggatgctattattgattcatatcataatgtcagctgaaactcaattagatatttttggtgagtgttatacccaatcggagcgattggcatacatgaaaataatttagaataatttatgtatgcattatgtgtgtacatatgtaccctcaaagtaccctaggaaattttttttaactttgaaacaagttgactcaaagtattgatgcgtaatgagtcaggttctcagacttaaagctagttgaatcgaagtactgatgcatagtgaggatgtttatcatttcatatgggtgagattggataaatcatggtaacaatagtttcgttaaaa

SEQ ID NO: 12871 - protein, 463 aa, Glycine max (soybean)
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARETSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISLAGLSLAKCEYLADAIIDSYHNVS

SEQ ID NO: 12872 - DNA, 2114 bp, Saccharomyces cerevisiae
  CDS (466)..(1821)
cttgctgtaactaattggtttatatttaaatatttcactttttaaagggcgtttgcatgcgaccatcgtcgatgattcatattgttcggatgcggaagatggcttccatgagttttgcacgccgtctcatgtgattgttggagtcatagctcgcatatcttcctattgtcagatgtaatatcgacggaaatggcatcttggagtatggaagcactattctgctttgctccaatatttaggatgccgcatttttcatatttttttttacatttttcgcttacgtatataaattgctagcaagtattcgctctctctgtcttggttatctaattgctaaccgtcgcaattgaaaagaaaaaaaaaatacagaatagacgatagcggattgaacgatagcatactattgagtgcgttttcccttctcatttgaaaattactatccgtttttcactgccgaaagacttgatgttgaggacgaggcttactaattgcagtctatggaggccctactacacgtcatcgcttagtagagtaccaagagcacctccagataaagtcttggggttatctgaacacttcaaaaaggtaaaaaatgttaacaaaattgacctgaccgtaggaatatataaagatggttggggcaaagtgacgacgtttccctccgttgcaaaagctcaaaaattgattgaatctcatttagagttgaataagaatctttcatatttaccaataacaggttccaaagaatttcaggaaaacgttatgaaatttttgttcaaggaatcatgtccgcagtttgggccattttatttagcccatgatagaatcagctttgttcagactttgagtggtacaggcgccctagctgtagcagctaaattcttggcattatttatttcaagagatatttggatacctgacccatcatgggcaaatcataagaacatttttcagaacaatggttttgaaaatatttaccggtattcctattataaggacggtcagatagacatcgacggatggattgagcaattgaaaacctttgcatataacaaccagcaagaaaacaataagaacccaccttgcataatcttgcatgcgtgttgtcacaaccctacaggtctcgacccaactaaagagcaatgggaaaagattatagatactatatatgagctaaaaatggtacccattgttgatatggcttatcagggtttagagtctggtaacttactaaaggacgcatatttattgaggctatgtctcaatgtaaataaatatccaaattggagtaacggtatctttctttgtcaatcttttgccaagaacatgggcctttatggtgaacgagttggttccttaagcgttatcacgccggcaactgcgaacaatggaaagttcaaccctctacaacagaaaaactcattgcagcaaaatattgactcccaattaaaaaagattgtcagaggtatgtattcttctccaccaggatacggttctcgtgtggtaaatgtagtattatcagatttcaaattgaaacagcaatggttcaaggatgttgatttcatggttcagagattgcatcacgtcagacaggagatgtttgaccgtctagggtggccggatcttgtaaatttcgcacaacagcacggtatgttttactatacaaggtttagtccaaagcaagtcgaaatattgagaaacaattacttcgtctatttaacaggtgatggtagattgtcgcttagcggagtcaatgattcgaacgttgattacttatgtgaatctcttgaagcagtctcgaaaatggacaaactcgcataattttttcaccttacagttcacctttgtctttatttttttattacttttcccttctcattttgccacacaataatttatagaatataataattttttgtaataattaataaaccttttttttatctactctatatacacttttcagataactagattggattaattcgtgatcgaactagttattaaattttaaatgaaaagaaagctagcgctagccaactattttaattacggtggcagtgcatcatatccttacatttcattttaggtttcctatgttttcttctttcaaa

SEQ ID NO: 12873 - protein, 451 aa, Saccharomyces cerevisiae
MLRTRLTNCSLWRPYYTSSLSRVPRAPPDKVLGLSEHFKKVKNVNKIDLTVGIYKDGWGKVTTFPSVAKAQKLIESHLELNKNLSYLPITGSKEFQENVMKFLFKESCPQFGPFYLAHDRISFVQTLSGTGALAVAAKFLALFISRDIWIPDPSWANHKNIFQNNGFENIYRYSYYKDGQIDIDGWIEQLKTFAYNNQQENNKNPPCIILHACCHNPTGLDPTKEQWEKIIDTIYELKMVPIVDMAYQGLESGNLLKDAYLLRLCLNVNKYPNWSNGIFLCQSFAKNMGLYGERVGSLSVITPATANNGKFNPLQQKNSLQQNIDSQLKKIVRGMYSSPPGYGSRVVNVVLSDFKLKQQWFKDVDFMVQRLHHVRQEMFDRLGWPDLVNFAQQHGMFYYTRFSPKQVEILRNNYFVYLTGDGRLSLSGVNDSNVDYLCESLEAVSKMDKLA

SEQ ID NO: 12874 - DNA, 1257 bp, Medicago sativa (alfalfa)
  CDS (1)..(1257)
atggcttctcaaaacatcactccttctccaaccgcttcttctgattccgtcttcgctcatctcgttcgtgctcctgaagatcctatcctcggtgtaactgtcgcttacaacaaggatccaagcccaattaagctcaacttgggtgttggtgcttaccgaactgaggaaggtaaaccccttgtgttggatgttgtgaggcgagttgaacgccaactattgaatgacatgtcacgcaacaaggagtatattccaattgttgggctcgctgattttaacaaattgagtgctaagcttatttttggtgcagacagccctgctattcaagagaacagggttaccactgttcaaggcttatctggtactggttcgctaagagttgggggtgaatttctagctaaacactatcatcaacgcattatatacttgccaacacctacttggggcaatcatacaaaggttttcaacttggcaggtttaactgtcaaaacatatcgctactatgctccagcaacacgagggcttgactttcaaggacttcttgaggatcttggttctgccccatctggatctgttgttttgctacatgcatgtgcacataaccctactggtgttgatccaacgcttgaacaatgggagcagattagacagctgataagatcaaaatctttgttacctttctttgacagtgcttatcagggttttgccagtggaagtctagatgcagatgcacagcctgttcgtttgtttgttgctgatggtggagaattgctggtagcccagagttatgcgaagaacatgggtctttatggtgaacgtgttggtgccttgagcattgtcagcaagtcagcggatgtttcaagcagggttgagagccaactgaaacttgtgattaggcccatgtactcaagtcctcctattcatggtgcatccattgtggccgccattctcaaggacagggatttgtacaatgactggactattgagttgaaggcaatggctgatcgcattatcaatatgcgccaacaactttttgatgctttacgtgctagaggtacaccaggtgattggagtcacattatcaagcaaattggaatgtttactttcacagggttgaatcctgagcaagtttccatcttgactaaagagtaccatatatacctgacatctgatgggaggattagcatggctggtttgagctccaaaacagtcccacatctggctcatgcaatacatgcagttgtaacccgagttgcttaa

SEQ ID NO: 12875 - protein, 418 aa, Medicago sativa (alfalfa)
MASQNITPSPTASSDSVFAHLVRAPEDPILGVTVAYNKDPSPIKLNLGVGAYRTEEGKPLVLDVVRRVERQLLNDMSRNKEYIPIVGLADFNKLSAKLIFGADSPAIQENRVTTVQGLSGTGSLRVGGEFLAKHYHQRIIYLPTPTWGNHTKVFNLAGLTVKTYRYYAPATRGLDFQGLLEDLGSAPSGSVVLLHACAHNPTGVDPTLEQWEQIRQLIRSKSLLPFFDSAYQGFASGSLDADAQPVRLFVADGGELLVAQSYAKNMGLYGERVGALSIVSKSADVSSRVESQLKLVIRPMYSSPPIHGASIVAAILKDRDLYNDWTIELKAMADRIINMRQQLFDALRARGTPGDWSHIIKQIGMFTFTGLNPEQVSILTKEYHIYLTSDGRISMAGLSSKTVPHLAHAIHAVVTRVA

SEQ ID NO: 12876 - DNA, 1368 bp, Medicago sativa (alfalfa)
  CDS (1)..(1368)
atggcatcatcttcattactctcctctgtaccttcacactctgcttcactttcgatcctcgacaccaacatcaagggaaagcttaagcttggaatcaacaacttctccaatttaaggtcatctggtcggatctgcatggctgttgcgactaatgtttctcggtttgagggtataccgatggctcctcctgatccaattcttggagtttctgaagcatttaaagcagacacgaatgatgtcaagctcaatcttggagttggggcctacagaacggaagaactacaaccatatgtgcttaatgttgtgaaaaaggcagaaaatcttatgctggagagaggggaaaacaaagagtatctccccattgagggtttggctgcatttaacaaggcaactgcagagttgttgctcggagcagacaatccagcaatcaaacagcaaagagttgccactgtccaaggtctttcaggaactggttctctgcgactaggtgcagctctgatagaacgatattttcctggagcaaaagttttgatatcaaatcctacgtggggtaatcacaagaatattttcaacgatgctcgagtaccatggtctgagtaccgatactatgaccccaagacagttggcttggattttgagggcatgatagaagatataaagtcggctccggaaggaacttttgtgctacttcatggatgtgcacataaccctactggtattgatccaacaccagaacagtgggaaaaaatagctgatgtaattcaacaaaagaaccactttccattttttgatgttgcttaccagggttttgctagtggaagccttgatgaagatgcggcttctgtgagattgtttgagtcacgtggcatggaagttcttgtagctcagtcatacagtaaaaacctcggcctttatgctgaaagggttggagctattaatgtcatttcctcatcaccggaatctgcaacaagggtaaagagccaattgaaaaggcttgctcgaccaatgtactctaatccaccagttcacggggctaggattgttgctaatattgttgggactccagctctctttgatgaatggaaagcagaaatggaaatgatggctggaaggataaaaactgttaggcaggcgctgtatgatagtatttcttcaaaagacaaaagtggaaaggattggtcattcatactcaagcagataggcatgttctcattcacaggcttgaacaagagccagagtgacaatatgacaaataagtggcatatatacatgacaaaggatggaaggatttccctggcaggattgtccctggccaaatgtgaatacctggcagatgctattatcgattcatatcataatgtcagctga

SEQ ID NO: 12877 - protein, 455 aa, Medicago sativa (alfalfa)
MASSSLLSSVPSHSASLSILDTNIKGKLKLGINNFSNLRSSGRICMAVATNVSRFEGIPMAPPDPILGVSEAFKADTNDVKLNLGVGAYRTEELQPYVLNVVKKAENLMLERGENKEYLPIEGLAAFNKATAELLLGADNPAIKQQRVATVQGLSGTGSLRLGAALIERYFPGAKVLISNPTWGNHKNIFNDARVPWSEYRYYDPKTVGLDFEGMIEDIKSAPEGTFVLLHGCAHNPTGIDPTPEQWEKIADVIQQKNHFPFFDVAYQGFASGSLDEDAASVRLFESRGMEVLVAQSYSKNLGLYAERVGAINVISSSPESATRVKSQLKRLARPMYSNPPVHGARIVANIVGTPALFDEWKAEMEMMAGRIKTVRQALYDSISSKDKSGKDWSFILKQIGMFSFTGLNKSQSDNMTNKWHIYMTKDGRISLAGLSLAKCEYLADAIIDSYHNVS

SEQ ID NO: 12878 - DNA, 1514 bp, Panicum miliaceum (proso millet)
  CDS (47)..(1276)
agcggcagcagcagacacctccgccaccctcgaatccttccccaccatggcgtcgcaggtggcctccgtcttcgcaggcatcgcgcaggccccggaggaccccatcctcggggtgacggttgcgttcaacaaggatcccagccccgtgaagatcaacctcggcgtcggcgcctaccggaccgaggaagggaagcccctcgtgctgaatgtggtcaggcgcgccgagcagatgctgatcaatgacccgtctcgtgtgaaggagtacctaccaatcactggtttggctgaatataataagctgagcgctaagcttatcttcggtgctgacagccctgctattcaggagaatagggttgctacagtgcagtgcctatcaggaactggttctttaagagtgggaggtgaatttcttgcaaagcactaccatgagcgcactatctacatcccagtaccaacctggggaaaccacccaaaagtcttcaccctagctggattgactgtcaggagctaccgctactatgatcctgcaactcgtggtcttgacttcaacgggctcttagaagacctcagttctgctcctttaggatcaattgtactgctgcatgcttgcgcccataaccctaccggggtagatcctaccattgatcagtgggaacagattaggcagctgatgagatcaaaatcattgcttccgttctttgacagtgcttatcaaggctttgcgagtggaagtcttgacaaagatgcccagccagtgcgcatgtttattgctgatggtggtgaattgctcatggctcagagctacgctaagaacatgggaatgtatggagagcgtgttggtgctttgagcattgtatgtggaagtgctgatgtagctgctagggttgaaagtcaactcaagcttgtgattaggcctatgtattcaagccctcctcttcatggtccctctgtcgtggcaaccatactcaaggacagtgagatgttccacgaatggactgtggaactgaaggccatggctgataggataattagcatgaggcaacagctatttgatgcgctaaaatccagaggaactcctggagattggagccacatcattaagcaaattggtatgtttactttcactgggctcaatagcgagcaagtggccttcatgaggcaagaataccacatttacatgacatccgacgggaggatcagtatggctggtttgaacatgaagaatgtgccccatcttgcagatgccatacacgctgcagttactcaactgaagtgagtggcagcatctcgtcttcctccatggataaaatccaaatcacctacagcagtgtcctgaggactcagctagtggtatttactggcagaactcctgtaatttgccttttaatagacatgtttgactctgtcgtcggagcagttttctactgacggattcaaacatcatggtgctttcagacaccaaatataaaaaaaacgcacatgcatatgttttttgcaaaaaaaaaaaaaaaaaa

SEQ ID NO: 12879 - protein, 409 aa, Panicum miliaceum (proso millet)
MASQVASVFAGIAQAPEDPILGVTVAFNKDPSPVKINLGVGAYRTEEGKPLVLNVVRRAEQMLINDPSRVKEYLPITGLAEYNKLSAKLIFGADSPAIQENRVATVQCLSGTGSLRVGGEFLAKHYHERTIYIPVPTWGNHPKVFTLAGLTVRSYRYYDPATRGLDFNGLLEDLSSAPLGSIVLLHACAHNPTGVDPTIDQWEQIRQLMRSKSLLPFFDSAYQGFASGSLDKDAQPVRMFIADGGELLMAQSYAKNMGMYGERVGALSIVCGSADVAARVESQLKLVIRPMYSSPPLHGPSVVATILKDSEMFHEWTVELKAMADRIISMRQQLFDALKSRGTPGDWSHIIKQIGMFTFTGLNSEQVAFMRQEYHIYMTSDGRISMAGLNMKNVPHLADAIHAAVTQLK

SEQ ID NO: 12880 - DNA, 1717 bp, Glycine max (soybean)
  CDS (54)..(1337)
ctctccctctctgttcgcactctgtctttcccctgtttccgcgtcactgagtcatggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccaacggaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagacattccgttactatcaccctgagtctagaggattggatttttcaggactgatggatgacataaagaatgctccagatggttccttctttctgcttgtgcttactgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagtgtgctttgtgaagatgagaaacaagctgtggctgtaaaaagtcagttgcagctgattgctagacccatgtacagtaacccacctctccatggagcacttatagtttctactgtccttggtgatccagatttgaagaagttatggcttaaagaagtcaaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgtcttggacgctatccatgaggttacaaaatcattctagattattcaatcacccaacaggtgaccaaatttttgtctttggagacaaacatctcagaagtagtacccttatccaggggagcaaaataaatttaataaagtctgacaaattttcaacttgtttcggggtaagatagtgatactcttcagggtttaccttgcatattgaagacccttattgcaatacgtatccgatttatcatatccatgcaccatagattatatccatttttacagacatcttgtttagcactttaatgagcataaccctgtatcatcattttttttataaaataatttgagtagtagattgaataagggctttatttatggtgaacaggaagtacgtagcttcattccttactacactattattctgtt

SEQ ID NO: 12881 - protein, 427 aa, Glycine max (soybean)
MAIRNSLTGQFLRRSSVAGARLMSSSSSWFRSIEPAPKDPILGVTEAFLADQSPNKVNVGVGAYRDDQRKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLVLTAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVLDAIHEVTKSF

SEQ ID NO: 12882 - DNA, 1681 bp, Panicum miliaceum (proso millet)
  CDS (64)..(1437)
cttcagtacagtagtagtagcaggcccacgcctccgatccgctgctccctcgccgtccggaagatggcttccgccgccttcgccctcacctcgccggcggcccccgccatcgccgcccggtccaaggtgcttggatgggggaagaatcaggggagaaatggctgccgcgtggggatcacgaggaagaactttggccgtgttttgatggcccttgcagtggatgtttctcgttttgagggagtgccaatggctcctccagacccaattcttggggtttcagaggcctttaaagcagataaaaatgacctgaagctcaatcttggtgttggtgcctatagaacagaagagttgcagccttatgtcctcaatgtagtcaagaaggctgaaaatcttatgttggagaaaggagaaaacaaagagtatcttcctattgaaggcttagctgcatttaacaaagcaactgcagagctactgcttggagctgacaaccctgtcatcaagcaaggactggttgctacacttcaatctctctcaggcactggatcgctacgacttgccgcagcgtttatacaaagatacttccctgaagccaaagtactcatatcatcgcccacgtgggggaaccacaagaacatcttcaatgatgctagggtaccttggtcagagtaccggtactatgaccccaaaactgttgggttagattttgagggaatgatagctgacattgaggctgctcctgaaggatcttttgttctgctacatggttgcgctcacaacccaactggaatagacccaactcctgaacaatgggagaaaattgcagatgttattcaagagaaaaagcatatgcctttcttcgatgttgcgtatcagggttttgccagtggaagccttgatgaagatgcattttcagttaggctttttgttaagcgtggcatggaagtgtttgttgcacaatcttacagcaagaaccttggtctatatgcagaaaggattggggcaataaatgttgtttgctcagcaccagaagttgcagatagggtaaagagccagctgaaacgtctggcacgtcccatgtactcgaacccccctattcacggtgctaggatagttgccaatattgttggtgatccaactatgtttggtgaatggaagcaggagatggaacaaatggcagggcggatcaagaatgtaaggcagaagctctacgatagtttgtctgcaaaggacaagagtggcaaggactggtctttcattctgagacagattggcatgttctcctacactggcttgaacaaagcacagagtgataacatgacagataaatggcatgtttatatgaccaaggatgggcggatttcgttagctggactttccctggctaagtgcgattatcttgccgacgccatcatcgattccttccacaatgtcagctagatagaggcctgaggattcaggtgaagctattccggttgagtccttggacgcttggctgggatttttgggtccttccagctatagtttttgggtgtattacatccagtgtaatttggagaaataatttttttgtcatcacagcaaaactcaagtgcctggctgcatgtaacagtagtacgctatttacaggatcgtaaaacttaattgaataatggcactggcaatgttaattgcgccctgcgcc

SEQ ID NO: 12883 - protein, 457 aa, Panicum miliaceum (proso millet)
MASAAFALTSPAAPAIAARSKVLGWGKNQGRNGCRVGITRKNFGRVLMALAVDVSRFEGVPMAPPDPILGVSEAFKADKNDLKLNLGVGAYRTEELQPYVLNVVKKAENLMLEKGENKEYLPIEGLAAFNKATAELLLGADNPVIKQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYAERIGAINVVCSAPEVADRVKSQLKRLARPMYSNPPIHGARIVANIVGDPTMFGEWKQEMEQMAGRIKNVRQKLYDSLSAKDKSGKDWSFILRQIGMFSYTGLNKAQSDNMTDKWHVYMTKDGRISLAGLSLAKCDYLADAIIDSFHNVS

SEQ ID NO: 12884 - DNA, 1447 bp, Arabidopsis thaliana (mouse-ear cress)
  CDS (1)..(1362)
atggcttctttaatgttatctctcggttccacttctctgttaccgcgcgagattaacaaggataagctaaagcttggaacttctgcttcgaacccgttcctaaaagcaaagtcttttagcagagtgactatgacggttgcagtgaagccttctcgtttcgagggtataactatggctccaccagaccctattcttggagtcagtgaagcattcaaagctgacactaacgggatgaaactcaatcttggtgttggtgcttatcgtactgaggaactccagccttatgtgcttaatgttgttaaaaaggcggagaatttgatgttggagagaggagataacaaagagtatcttccaattgaggggttggcagcattcaacaaggctactgctgagttgctatttggagctggtcatcctgttattaaggaacaaagagtagcaacaattcagggtctttcgggaacaggttcactgcgattagcagcggctcttatagagcgttatttccctggagcaaaagttgtgatctcatcaccaacctggggtaatcacaagaatatcttcaatgatgccaaagttccgtggtccgaataccgctactatgatccaaaaacaattggtttggattttgagggaatgatagcagatataaaggaagctccagaaggatccttcatcttgcttcacggatgtgctcacaacccaactggaattgacccaacaccagaacagtgggtaaaaattgctgatgtcattcaggaaaagaaccatatcccatttttcgatgttgcataccagggctttgctagtggaagccttgatgaagatgcagcatctgtgagattatttgctgagcggggaatggagttttttgttgctcagtcatatagtaaaaatttaggtttgtatgcagaaagaattggggcaatcaatgtcgtgtgctcctcagctgatgctgctacaagggtcaagagccagttgaaaaggattgctcggcctatgtactcgaatccaccagttcatggggcgagaatcgtggccaatgtagtgggtgatgtaactatgttcagtgaatggaaagcagagatggaaatgatggcaggaagaataaagacggttagacaagagctgtatgatagcctcgtttcaaaagacaagagcgggaaggactggtccttcattctgaagcaaattggcatgttctctttcaccggcctaaacaaagctcagagcgataacatgacggacaaatggcacgtgtatatgactaaagacgggaggatatcattggccggattatctctggccaaatgcgagtatcttgctgatgcgatcatcgactcataccataacgtaagctgagcttccatctcagtagatgacaataagaaacagttttatataccctttttagcttcttcttgatctttgattgaaaccagatggc

SEQ ID NO: 12885 - protein, 453 aa, Arabidopsis thaliana (mouse-ear cress)
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 12886 - DNA, 1523 bp, Daucus carota (carrot)
  CDS (24)..(1241)
caaaaccctagcttatacttccgatgtcttccgtcttcgctaacgtcgttcgcgctcctgaggatcctatcttaggggtcactgttgcttatcacaaagatcaaagtcctaataagttgaatttgggtgttggtgcttatcgaactgaggaaggaaaacctcttgttcttaatgttgtgaagaaagcagagcagatgcttgtaaatgatcagtctcgagtaaaagagtatcttcctattgttggactggcagactttaacaaattgagtgccaagctgattttcggcgctgatagtcctgccattcaagagaatagagtcgcaactgtccagtgcttatctggtactggctcactgagggttgggggtgaattcctggccagacattatcatgaacatacagtgtatatcccccagccaacttggggaaaccatccaaaaattttcactttagcaggcttatcggtgaagacataccgctattataatccagaaacgcgtggattggattttgaaggcatgctagaggatcttggttctgctccattgggagcaatagtgcttcttcatgcatgtgctcacaatccaaccggtgttgatccaaccattgagcagtgggagcagatcagacagctgatgagatcgaaaagcttgttacctttctttgacagtgcatatcagggttttgctagcggcagccttgacgccgatgcacagtctgttcgcatctttgttgcagatggtggtgaatgccttgcagctcagagttatgcaaagaatatgggactctatggggaacgcgttggtgccctgagcattgtttgcaagactgcagatgtggcaagcaaggttgagagccaattgaaactagttatcaggcctatgtattccagtccacctcttcatggtgcatctattgtggctgcgattctcaaagatggtgacctctataatgaatggacactggagctgaaagcaatggctgaccgaatcatcagcatgcgacaggagctctttaatgctttacaagcaaaaggaacaccaggtgactggagtcacattgtcaagcaaattggaatgtttacattcactgggttaaactctgagcaagtcaccttcatgaccaatgagtatcatatatatttgacatctgatgggcggatcagcatggcaggtcttagttcccgaacagttcctcatcttgcagatgctattcatgctgcagttactggcaaggcctagatactgttgtgttatatatacatgtttcatgagatttttgggtagatgtctgaaaaccttgtttggagctcactgatcttcagttagctttaataaagatgtacatgtcgcctggagccaaatggttaggttttatctgtgagctagcatgtctggtaagagcatgacatgacattaagcacaatataaatgcctagacagctattacaggaacatgattgacgctgagaaatgacttcgtttttgcaaaaacttttttatatatctaaatgcatcatattt

SEQ ID NO: 12887 - protein, 405 aa, Daucus carota (carrot)
MSSVFANVVRAPEDPILGVTVAYHKDQSPNKLNLGVGAYRTEEGKPLVLNVVKKAEQMLVNDQSRVKEYLPIVGLADFNKLSAKLIFGADSPAIQENRVATVQCLSGTGSLRVGGEFLARHYHEHTVYIPQPTWGNHPKIFTLAGLSVKTYRYYNPETRGLDFEGMLEDLGSAPLGAIVLLHACAHNPTGVDPTIEQWEQIRQLMRSKSLLPFFDSAYQGFASGSLDADAQSVRIFVADGGECLAAQSYAKNMGLYGERVGALSIVCKTADVASKVESQLKLVIRPMYSSPPLHGASIVAAILKDGDLYNEWTLELKAMADRIISMRQELFNALQAKGTPGDWSHIVKQIGMFTFTGLNSEQVTFMTNEYHIYLTSDGRISMAGLSSRTVPHLADAIHAAVTGKA

SEQ ID NO: 12888 - DNA, 1245 bp, Caenorhabditis elegans
  CDS (1)..(1245)
atgagcgtttccaagaagcttttctctaccgccgtgcgaggaaagtcgtggtggtcgcatgttgagatgggaccaccagatgcgattcttggagtcaccgaggccttcaaagccgattcaaacccaaagaagatcaaccttggagtcggagcttaccgtgacgatcaaggaaagccatttgttctcccatcggtcaaggaagctgaacgtcaagtgatcgctgccaatcttgataaggagtacgccggaattgttggacttcccgagttcaccaagctctctgctcaactcgctcttggagagaactctgatgtgatcaagaacaagagaatcttcaccactcagagcatttctggaactggagcccttagaatcggatctgagttcctttctaagtacgccaagaccaaggttatctaccagccaacaccaacttggggaaaccatgttccaatcttcaaatttgccggagtcgatgtcaagcaataccgctattatgacaagtccacctgtggttttgatgaaactggagcactcgctgacattgctcaaatcccggaaggatccacaatcttgcttcacgcttgtgctcacaacccaactggagttgatccatcccgtgaccagtggaagaagatctccgacattgtgaagaaacgcaacttgtttgtcttcttcgatatggcttaccaaggtttcgcttccggagatgttgacaatgacgcgttcgctgttcgttactttgtcgagcaaggacacaacattgttctctctcaatcctttgccaagaacatgggactttatggtgaacgagtcggtgctttctccgttgttacctcggacgctgatgaggctgctcgtgttgcttctcaagtcaagatccttattcgcccactctactccaacccaccagtccatggagctcgcattgcttcccgcatcctcgcggatccagctctcaacaagcaatggctcggagatgtcaagctcatggctgatcgtatcatcaccatgagaactacgctcaaggatttgctcgccaaggagggatctactcgtaattgggagcacattaccaaccaaattggaatgttctgctttactggaatcaacccacaacaagttgagaagcttatcaaggaacactctgtctacctcaccaaggacggacgtatctcggtggcgggaatttcatcgaacaatgtcgcttaccttgcccacgctctccaccaagtcaccaagtaa

SEQ ID NO: 12889 - protein, 414 aa, Caenorhabditis elegans
MSVSKKLFSTAVRGKSWWSHVEMGPPDAILGVTEAFKADSNPKKINLGVGAYRDDQGKPFVLPSVKEAERQVIAANLDKEYAGIVGLPEFTKLSAQLALGENSDVIKNKRIFTTQSISGTGALRIGSEFLSKYAKTKVIYQPTPTWGNHVPIFKFAGVDVKQYRYYDKSTCGFDETGALADIAQIPEGSTILLHACAHNPTGVDPSRDQWKKISDIVKKRNLFVFFDMAYQGFASGDVDNDAFAVRYFVEQGHNIVLSQSFAKNMGLYGERVGAFSVVTSDADEAARVASQVKILIRPLYSNPPVHGARIASRILADPALNKQWLGDVKLMADRIITMRTTLKDLLAKEGSTRNWEHITNQIGMFCFTGINPQQVEKLIKEHSVYLTKDGRISVAGISSNNVAYLAHALHQVTK

SEQ ID NO: 12890 - DNA, 1095 bp, Caenorhabditis elegans
  CDS (1)..(1095)
atgattcaaatccacatccgaaatgaagtgataatggcaaacagttatggggaaatgctcgatgtattgagagcattgctggaagattatgtgcagcgtcttgagcgtctggatcaagtgttgatccaagtgatggagctgaatcctggcgaatttcgggatcgtcagcgtctgatgcaagatatcagggacctgattcaggagaccactttccaggctcgagaagtacgcgttgcacgtcgaatggtgcgaactcttcacgaacgggaatcccaccatctcatctgtaaaaaagctggctttacgacagtcgccgaatacactttctggaattatgaggaaaagtgtgtagatattgaaaagctcctctccgatcttgaattcgcccctgcaaaatcggtcatcattcttcctgcatgtgcttacaacccgactggaatggatttgagcgaaaatcagtggaagcagatcgcccgggtcatcaagagaaaacgccttttccctttttttgacatttcttaccaaggatgtgcatctggagacccggccgccgattcttgggctatccgacactttgttagtgacggaatagaattgtttgtggctcagtcgttcgctaaaaacttattttttacgaatccgcggttgggaaatcttacagttgtcgtaaacaacgctgccgtcattcctggaataaaatctcagatgtcgcttgctatccgcattaacgcgttttatccaacagcatttggagctacaattgtacacaaggtcctctccacctcagctcgtcgtgaattttggattcagtctattcaacagatatcttctcgcatcaagcaaatgagaactgctttgtttgacgttttgagtgctctcaaaactccaggaagctgggatcatatcattcgacaaactggaatgtttagctacactggtctcacttctactcaagtcgatcacctcgttcgcaaccacaaagtcttcctcctcagcgacggacgcataaatattagtggactaaacatgaaaaacgtcgaatacgttgccaaggcaatcgacgagactgttcgtgccgtcaagagcaacgtctaa

SEQ ID NO: 12891 - protein, 364 aa, Caenorhabditis elegans
MIQIHIRNEVIMANSYGEMLDVLRALLEDYVQRLERLDQVLIQVMELNPGEFRDRQRLMQDIRDLIQETTFQAREVRVARRMVRTLHERESHHLICKKAGFTTVAEYTFWNYEEKCVDIEKLLSDLEFAPAKSVIILPACAYNPTGMDLSENQWKQIARVIKRKRLFPFFDISYQGCASGDPAADSWAIRHFVSDGIELFVAQSFAKNLFFTNPRLGNLTVVVNNAAVIPGIKSQMSLAIRINAFYPTAFGATIVHKVLSTSARREFWIQSIQQISSRIKQMRTALFDVLSALKTPGSWDHIIRQTGMFSYTGLTSTQVDHLVRNHKVFLLSDGRINISGLNMKNVEYVAKAIDETVRAVKSNV

SEQ ID NO: 12892 - DNA, 1074 bp, Caenorhabditis elegans
  CDS (1)..(1074)
atgcggctatctttctttgatggaattcatgttgcttcgccaatcaaagagctccatacatcggaactcttccagaaagaaatttgccctgtgaaaataaatcttgcaatagaagcttatcgcacggaagatggagagccgtgggttttgccagtggttcgagaaatcgaacttaaattccctcacgagcctcatcacaatcatgagtacctaccgattcttggacatgatggattctgcaaatcagccaccgctttgctactcggaaatgattctttggctatcaaagagggaagatcatttagtgttcagtgcatctctggtacaggtgccatatgtgttggagcagagtttcttgctcaagttcttagtatgaagacgatttatgtcagcaatccatgctgcctgtgctataatccaacaggaatggacccaactcgagagcaatggatacaaatggcgcaagtcatcaaacagaagaatcttttcactttttttcatattgctgatcagggattagcttctggcgacgctgatgcagatgcttgggctgttcggttctttgtcgaacagggtttggaaatgattgtctctcaatctttctcaaagaattttgggctttacaatgatcgtgttggaagccttactgtgatcgtgaacaaaccaagtcatattgcgaacctaaaatcccaactgacacttgttaatgtttctaatttttctaaccctccagcttacggagcacgtattgtgcatgagattctcaagtcgccgaagtacagagaacaatggcaaaattccattaaaatgatggcttttcgtattaagaaaacaagacaagaactgattcgagagttgaatatgcttcaaacttctggaaaatgggatcgtattactcaacaatcggggttgttcagttataccggattgacgccttgtcaagtcgaccatctcatagcccatcacaagatctaccttctcagtgacggtcgtattaatatctgcgggcttaacatgagtaacttggattatgtggctagagcaattgatgacactgtacgaacaattcattaa

SEQ ID NO: 12893 - protein, 357 aa, Caenorhabditis elegans
MRLSFFDGIHVASPIKELHTSELFQKEICPVKINLAIEAYRTEDGEPWVLPVVREIELKFPHEPHHNHEYLPILGHDGFCKSATALLLGNDSLAIKEGRSFSVQCISGTGAICVGAEFLAQVLSMKTIYVSNPCCLCYNPTGMDPTREQWIQMAQVIKQKNLFTFFHIADQGLASGDADADAWAVRFFVEQGLEMIVSQSFSKNFGLYNDRVGSLTVIVNKPSHIANLKSQLTLVNVSNFSNPPAYGARIVHEILKSPKYREQWQNSIKMMAFRIKKTRQELIRELNMLQTSGKWDRITQQSGLFSYTGLTPCQVDHLIAHHKIYLLSDGRINICGLNMSNLDYVARAIDDTVRTIH

SEQ ID NO: 12894 - DNA, 1227 bp, Caenorhabditis elegans
  CDS (1)..(1227)
atgtccttctttgacggaatcccagttgctccaccaatcgaggtgttccacaagaacaagatgtacctcgatgagacggctcccgtcaaagttaacctgacaattggagcctaccgcacagaggagggacagccatgggtgcttccagtcgttcatgagactgaagtcgaaatcgccaacgacacctcgctcaatcacgagtatcttccagttctcggtcacgagggtttccgcaaggctgccaccgagcttgtcctcggagccgaatcgccagctatcaaggaggaaagatcgtttggagtacagtgtctctctggaaccggagctcttcgtgctggagccgagtttcttgcttcagtgtgtaacatgaagaccgtctacgtgagcaacccaacatggggaaatcacaagcttgtcttcaagaaggctggtttcaccaccgtcgccgactacaccttctgggactatgataacaaacgtgtgcacattgagaagttcctctccgatcttgagtcagccccagagaagtctgtcatcattcttcacggatgtgctcacaacccaactggaatggacccaactcaggagcaatggaagttggttgccgaggtgatcaagagaaagaacctcttcaccttctttgacattgcttaccaaggattcgcatctggtgatccagctgcggacgcctgggcgatccgctactttgtagaccagggaatggagatggttgtgtcccaatcatttgccaagaactttggactttacaacgagcgtgtcggaaaccttactgtcgtcgtcaacaatccagctgtcattgccggattccagtctcaaatgtcgttggttatccgtgccaactggtccaatccaccagcacatggagcaagaattgtgcacaaggtgctcaccaccccagctcgccgtgaacaatggaaccagtctattcaagcgatgtcttctcgtatcaagcagatgagagccgccttattgcgccatttgatggatcttggcactcctggaacttgggatcacatcattcaacaaattggaatgttcagctacaccggacttacttctgcccaagtggatcacctgattgccaatcacaaagtattcctgctcagagacggccgcatcaacatttgtggtcttaacacgaaaaacgtggaatatgtcgccaaggcgattgatgagactgtgcgtgccgtgaagagcaacatctaa

SEQ ID NO: 12895 - protein, 408 aa, Caenorhabditis elegans
MSFFDGIPVAPPIEVFHKNKMYLDETAPVKVNLTIGAYRTEEGQPWVLPVVHETEVEIANDTSLNHEYLPVLGHEGFRKAATELVLGAESPAIKEERSFGVQCLSGTGALRAGAEFLASVCNMKTVYVSNPTWGNHKLVFKKAGFTTVADYTFWDYDNKRVHIEKFLSDLESAPEKSVIILHGCAHNPTGMDPTQEQWKLVAEVIKRKNLFTFFDIAYQGFASGDPAADAWAIRYFVDQGMEMVVSQSFAKNFGLYNERVGNLTVVVNNPAVIAGFQSQMSLVIRANWSNPPAHGARIVHKVLTTPARREQWNQSIQAMSSRIKQMRAALLRHLMDLGTPGTWDHIIQQIGMFSYTGLTSAQVDHLIANHKVFLLRDGRINICGLNTKNVEYVAKAIDETVRAVKSNI

SEQ ID NO: 12896 - DNA, 1350 bp, Caenorhabditis elegans
  CDS (1)..(1350)
atgctggcattcttcagaaggttcatgtcaacgactactgtaactgctcaaccagtgctcccgtggttcagaaatgtgccgctagcgcctgctgatccaattctaggagttactgaagcattcaagaaggatacgaatccgaataagattaatttaggagttggagcatatcgtgatgatcagggaaaaccattcgtgctccgagcggtccgcgaagctgagcagcaaattatagatgctaaaatggacaaagagtactcaacaatcactggagttccagaatttgcgccattggctgcgaaactcgctttcggcgacaattccgaagtgattcgcgatggaagagtcttcacaactcaatcgatatccggaactggtgctttgagaattggaggacaatttgtggaaaagtttattccatccaagactttgttttatccaacaccaacttgggctaatcatttgccagtttttagagaaaatcgaagaaccatacttttcgattttttgattttccgtaaagcaaaaaatcaaaatttccatgcacttgttgtattttttcccctaaattctggtctttcgattcaaccataccgttactacaatcaagaaactcttggatttgatgttgaaggagctctcgaagatatttcaaagatgccagaaggatctgttatacttttgcatgcttgtgcacataacccaactggtgttgatcctactaaggagcaatggaaaaagctgagccaagtgctgaaagaacgaaaaattcttccattcttcgatatggcttatcaaggatttgcatcaggagacgttgacgatgacgcatttgctcttcgtcatttcatagaacaaggacacaatgttctcgttgctcaatcatttgcaaaaaatatgggattgtacggagaacgtgttggtgcattttcgattgtttgtgattctgctgaagaagcgattcgtgttggatctcaaatgagaattatcattcgtccaatgatctcaatgccaccacttcatggagcaagaattgcttcacggattttgagtaatccagagttgaagaaatcttggctggaagatgtgaaactaatggctgaccgtatcaaatcaatgcgtacggctctaaaagacggcctgaaagctgaaggatctactctcaactgggatcatattaccaatcaaattggaatgttttgtttcactggaatcaatgagaaacaagttcaaaagctcatcaaagagcactcagtgtacttgacaaatgatggacgtatttctatttctggtattaatactggaaatgttgcatatttggctaaagctctccatgacgtcaccaagtaa

SEQ ID NO: 12897 - protein, 449 aa, Caenorhabditis elegans
MLAFFRRFMSTTTVTAQPVLPWFRNVPLAPADPILGVTEAFKKDTNPNKINLGVGAYRDDQGKPFVLRAVREAEQQIIDAKMDKEYSTITGVPEFAPLAAKLAFGDNSEVIRDGRVFTTQSISGTGALRIGGQFVEKFIPSKTLFYPTPTWANHLPVFRENRRTILFDFLIFRKAKNQNFHALVVFFPLNSGLSIQPYRYYNQETLGFDVEGALEDISKMPEGSVILLHACAHNPTGVDPTKEQWKKLSQVLKERKILPFFDMAYQGFASGDVDDDAFALRHFIEQGHNVLVAQSFAKNMGLYGERVGAFSIVCDSAEEAIRVGSQMRIIIRPMISMPPLHGARIASRILSNPELKKSWLEDVKLMADRIKSMRTALKDGLKAEGSTLNWDHITNQIGMFCFTGINEKQVQKLIKEHSVYLTNDGRISISGINTGNVAYLAKALHDVTK

SEQ ID NO: 12898 - DNA, 1230 bp, Schizosaccharomyces pombe
  CDS (1)..(1230)
atgtcagactacgggtttgcaaatattgaggaagctaaggcagatgcaatttttaaattaaatgctcaataccatcaggatgaagatcccaagaaggttaacatgagtgttggcgcctatcgtgacgatactggtaagccttggattttgcctgcagttaaaaaagcatctaaaatagtggaagaacaggcaagcttcaaccatgaatatttaccaattgctggattgcctcgtttcactaaggctgcggctgaagttcttttcagacccaatcctcatttattgtccgaggaccgtgttgcatctatgcagtcagtctctggtactggtgccaattttcttgctgctagtttcattgagactttctatgtaaagcacactggagcccatgtatacatctccaaccctacttggcctgtccatcgcactttgtgggaaaaattgggagtcactgtagatacatatccttattgggatgccaagaatagatcttttgattacgaaggcatgctaagtaccattaaatctgctcccgaaggaagtatatttttacttcatgcttgtgctcacaatcctactggtattgaccccactagggaacaatggctttctatattcgagagtctgctttctcgcaagcatctggtagtttttgacattgcttatcaaggttttgccagtggtgatctgaatcgtgactcttgggctctaaacgagtttgtcaaatataacaaggactttttcgtttgtcagtcatttgctaaaaatatgggtctttatggtgaacgtactggttgcatgcattacgttgcaaaggacgcttccactaaaaacaaggtcttatctcaattgtgtattgttcaacgtaacaccatttctaaccctcccgcttacggtgcacgtattgctgccgaaattcttaacagtcctcaattgtttgctgaatgggaacaagatttaaagactatgtcttctagaatcattgagatgaggaaacgtcttcgcgattctcttgttgcactcaaaacccccggttcttgggatcatattacacaacaaattggaatgttttcttttaccggtttaacgcctgcacaagtccaattttgccaggagcggtaccatctttatttcagtgcaaatggtcgtatttctatggctggtttgaacaattctaatgtagagcatgttgcacaggcatttaaccatgctgttcgcgagttgccttaa

SEQ ID NO: 12899 - protein, 409 aa, Schizosaccharomyces pombe
MSDYGFANIEEAKADAIFKLNAQYHQDEDPKKVNMSVGAYRDDTGKPWILPAVKKASKIVEEQASFNHEYLPIAGLPRFTKAAAEVLFRPNPHLLSEDRVASMQSVSGTGANFLAASFIETFYVKHTGAHVYISNPTWPVHRTLWEKLGVTVDTYPYWDAKNRSFDYEGMLSTIKSAPEGSIFLLHACAHNPTGIDPTREQWLSIFESLLSRKHLVVFDIAYQGFASGDLNRDSWALNEFVKYNKDFFVCQSFAKNMGLYGERTGCMHYVAKDASTKNKVLSQLCIVQRNTISNPPAYGARIAAEILNSPQLFAEWEQDLKTMSSRIIEMRKRLRDSLVALKTPGSWDHITQQIGMFSFTGLTPAQVQFCQERYHLYFSANGRISMAGLNNSNVEHVAQAFNHAVRELP

SEQ ID NO: 12900 - DNA, 1314 bp, Schizosaccharomyces pombe
  CDS (1)..(1314)
atgttggccaggaatttgcgttgtttgcatccaaatacatttgcatcgttaaaaaccaacgtttcctaccatggagtaaaatgcttggcaagtcagagcaagcgtggattcaaggtttgggcagatgtacctatgggaccaccggatcccatctttggtattacagaggcctataaaaaggatggagatgttaagaaaatgaacttgggtgctggtacatatcgtgatgatgccggaaagccttatgttctgcccagtgttcgtcaggcagaaactgagctgttgagtcagaaactcgacaaagaatatgcacccatcacaggaattcccagtttccgtgtgcaagcaacaaaattggcttatggcgatgtttacgagtctataaaggataggctggtttctgctcaatccattagtggtaccggtgccttgtgtatagcagctaatttccttgcttcattttatccatcaaagactatttacgtatctgaccctacttggggaaatcacaagaatgtattttctcgagctggcttgaccgttaagtcctacaagtattatgatcctgctactcgtgggttggacattaaaggcatgttgtccgatttaacttcagctcctgatggctctattatattattgcatgcttgtgctcacaatccaactggtgtagatcctacgaaagctcagtgggatgatatcctcaaaacaatgcaaaagaaaaaccattttgctcttttagacatggcttaccaaggatttgccagtggtgattttgctcgtgatgcttatgccactcgtctgttcgcctccagcaatgtccccatgttactctgccaatcctttgctaaaaacatgggtctatatggtgaacgtgctggctgctttagcattttagccaacgatgctgaggaagccgctcgtatcgaaagccaaactaagattctcattcgtgctttgtattccaaccctcccgtcaatggggccagaattgccaaccatatattgagcaaccctgcacttcgtgaacagtgggctggtgaagttgtaggcatgtccgaacgtcttaagagtatgcgtaaggctcttcgcaacatccttgaaaaggaccttaagaataaacacagctggaagcatatcactgaccaaattggtatgttttgttatactggtttaaatccccagcaagttgatgttttggctaaacagtatcacatttacctcactaagaatggtcgtattagcatctccggtctcaacacttccaatgtaagatactttgccgaagctatcaatgccgttacttcgaattag

SEQ ID NO: 12901 - protein, 437 aa, Schizosaccharomyces pombe
MLARNLRCLHPNTFASLKTNVSYHGVKCLASQSKRGFKVWADVPMGPPDPIFGITEAYKKDGDVKKMNLGAGTYRDDAGKPYVLPSVRQAETELLSQKLDKEYAPITGIPSFRVQATKLAYGDVYESIKDRLVSAQSISGTGALCIAANFLASFYPSKTIYVSDPTWGNHKNVFSRAGLTVKSYKYYDPATRGLDIKGMLSDLTSAPDGSIILLHACAHNPTGVDPTKAQWDDILKTMQKKNHFALLDMAYQGFASGDFARDAYATRLFASSNVPMLLCQSFAKNMGLYGERAGCFSILANDAEEAARIESQTKILIRALYSNPPVNGARIANHILSNPALREQWAGEVVGMSERLKSMRKALRNILEKDLKNKHSWKHITDQIGMFCYTGLNPQQVDVLAKQYHIYLTKNGRISISGLNTSNVRYFAEAINAVTSN

SEQ ID NO: 12902 - DNA, 1381 bp, Arabidopsis thaliana (mouse-ear cress)
  CDS (1)..(1350)
atgaaaactactcatttctcttcctcttcttcttccgatcgcaggatcggtgctctgctccgtcatctcaattccggctcagattcggacaacctgagctctctttatgcatctccgacatcgggaggcaccggtggttctgttttctctcatcttgttcaagctccagaggatcctattcttggggtgacagttgcatacaacaaagatcctagcccagttaagctgaatttaggagttggtgcttaccgaactgaggagggaaaacctttggttcttaatgttgtgaggaaagctgagcagcagcttatcaatgacagaacaagaatcaaggagtatcttcccattgttggattggttgagttcaacaagttaagcgctaagctcatactaggcgctgacagtcctgctattcgggagaatcggattaccaccgtggagtgtttgtctggtactggttctctgagagttggaggagagtttttggctaaacattatcatcagaaaacaatttacatcactcagccaacatggggaaatcatccaaagattttcacgctcgctggtttgacagtgaaaacttaccgatactacgatccagcgacgcgtgggttgaactttcaaggtttattagaagaccttggtgctgccgcacctggttctatagtgcttctccatgcctgtgcccataaccctactggtgttgatccaaccattcaacaatgggagcaaatcaggaagttgatgcgatcaaagggattgatgcccttcttcgatagtgcttatcagggctttgcaagtggaagtcttgatacagatgcgaaacctattaggatgtttgttgctgatggcggagaatgcctcgttgctcaaagttatgcgaagaacatgggactctatggagaacgagttggagctctcagcattgtatgcaaatcagcagatgttgcggggagagttgaaagccaactgaaactagtgataaggccaatgtactcgagtcctccaatccatggtgcatcaatcgtggctgtaatcctccgtgacaagaatttgttcaacgaatggactctggaactgaaggccatggctgatcgtatcatcagcatgaggaaacagcttttcgaggcattacgtactcgaggcactcctggagactggagtcacatcataaagcagattggtatgtttaccttcacagggttaaacccagctcaagtctccttcatgactaaagagtaccacatctacatgacatctgacgggaggataagcatggctggtctgagttcgaagactgtacctcaccttgcagacgctatccatgctgttgtcaccaaagccgtctgagaaactgaacaccaccatgacaccaaagctt

SEQ ID NO: 12903 - protein, 449 aa, Arabidopsis thaliana (mouse-ear cress)
MKTTHFSSSSSSDRRIGALLRHLNSGSDSDNLSSLYASPTSGGTGGSVFSHLVQAPEDPILGVTVAYNKDPSPVKLNLGVGAYRTEEGKPLVLNVVRKAEQQLINDRTRIKEYLPIVGLVEFNKLSAKLILGADSPAIRENRITTVECLSGTGSLRVGGEFLAKHYHQKTIYITQPTWGNHPKIFTLAGLTVKTYRYYDPATRGLNFQGLLEDLGAAAPGSIVLLHACAHNPTGVDPTIQQWEQIRKLMRSKGLMPFFDSAYQGFASGSLDTDAKPIRMFVADGGECLVAQSYAKNMGLYGERVGALSIVCKSADVAGRVESQLKLVIRPMYSSPPIHGASIVAVILRDKNLFNEWTLELKAMADRIISMRKQLFEALRTRGTPGDWSHIIKQIGMFTFTGLNPAQVSFMTKEYHIYMTSDGRISMAGLSSKTVPHLADAIHAVVTKAV

SEQ ID NO: 12904 - DNA, 1791 bp, Gallus gallus (chicken)
  CDS (25)..(1263)
aacgcacctcgcgcccgcaccgccatggccgcctccatcttcgccgctgtgccccgcgctccgcccgtcgccgtcttcaagctgacggcggacttccgggaggacggcgactcgcgaaaggtcaacctgggtgtgggcgcgtaccgcacggatgaagggcagccgtgggtcctgccggtggtgaggaaggtggagcagctgatcgctggcgacggcagcctgaaccacgagtacctgcccatcctcggcctgccggagttccgcgccaacgcctcccgcatcgccctgggcgacgacagcccggccatcgcacagaagagggttgggagtgtccagggtttgggcgggacgggcgctctgcgtataggtgccgagttcctgaggcgttggtacaacgggaacaacaacactgccacccctgtgtacgtctcgtccccaacatgggagaaccacaactctgtatttatggatgctgggtttaaagatatcagaacctaccgctactgggatgctgccaagaggggtttggacctccaggggctgctggatgacatggagaaagccccagagttctccattttcatcctccatgcctgtgcacacaacccaacgggcacagaccctactccagacgagtggaagcagattgctgctgttatgaagcgacggtgcctgtttccgttcttcgactcggcgtatcaaggttttgcctctggcagcctggacaaggatgcctgggctgtgcgatactttgtctccgagggctttgagctcttctgtgcacagtcgttttccaagaactttgggctctacaatgaacgtgtggggaacctgtctgtggtggggaaggatgaagacaatgtgcagcgtgtgctttcccagatggagaagattgtgcgtaccacttggtccaaccctccctcccagggagcacgcattgtggcaactacgcttacttccccacagctctttgctgagtggaaggacaatgtgaagacaatggcagatcgggtcttgctcatgcggtcagagctccggtctcgcctggagtcccttgggaccccaggcacctggaaccacatcacagatcaaattggcatgtttagctttacagggttgaaccctaagcaggtggagtacatgatcaaggaaaaacacatctacctgatggctagtgggcgcatcaacatgtgtggtctgactaccaagaacctggactatgtggccaagtccatccatgaagccgtcacaaaaatccagtgaagcacacgaacaaccaaacttacatgaactcaccaaagttgtaatgtgtagtcctgtcttactcacggcttgccatgtccacacctcttggggtttaataaagatgggagcaggagctcaatcagggatagtcttattttgaccttcaatgaagtacttcttgcaatatgataagccccaagaggtgggggcagcatgagctgtagtttcttgtttgacagcagcctggtcttcaggcacttagagctgcatctttagcacatccaaatcaactccttacccttatctgtttgatctaggcaaagtccggtgccagtgcaatgtgctatgggttgacagcccaaatagttgttctctgcagacaagctgtcaagctgctgtcacttgctagtattttgtgcagggggaaagctgttgctagctttcctccacggcagtttgctgagcccgatgcgagcaaacttttgtgaacctgtgatgattgcgtagtgttgctgacagaaaattaaagtctccatctctgatgct

SEQ ID NO: 12905 - protein, 412 aa, Gallus gallus (chicken)
MAASIFAAVPRAPPVAVFKLTADFREDGDSRKVNLGVGAYRTDEGQPWVLPVVRKVEQLIAGDGSLNHEYLPILGLPEFRANASRIALGDDSPAIAQKRVGSVQGLGGTGALRIGAEFLRRWYNGNNNTATPVYVSSPTWENHNSVFMDAGFKDIRTYRYWDAAKRGLDLQGLLDDMEKAPEFSIFILHACAHNPTGTDPTPDEWKQIAAVMKRRCLFPFFDSAYQGFASGSLDKDAWAVRYFVSEGFELFCAQSFSKNFGLYNERVGNLSVVGKDEDNVQRVLSQMEKIVRTTWSNPPSQGARIVATTLTSPQLFAEWKDNVKTMADRVLLMRSELRSRLESLGTPGTWNHITDQIGMFSFTGLNPKQVEYMIKEKHIYLMASGRINMCGLTTKNLDYVAKSIHEAVTKIQ

SEQ ID NO: 12906 - DNA, 1331 bp, Escherichia coli
  CDS (10)..(1200)
aacctcgtcatgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgcgcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaagcattaaaaacaatgaacgcgctgaaaagcgggctgagactgatgacaaacgcaacattgcctgatggctacgcttatcaggcctacgcgtcccctgcaatattttgaatttgcacgattttgtaggccgg

SEQ ID NO: 12907 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 12908 - DNA, 1208 bp, Escherichia coli
  CDS (14)..(1207)
ggagaaccatcgcatgtttcaaaaagttgacgcctacgctggcgacccgattcttacgcttatggagcgttttaaagaagaccctcgcagcgacaaagtgaatttaagtatcggtctgtactacaacgaagacggaattattccacaactgcaagccgtggcggaggcggaagcgcgcctgaatgcgcagcctcatggcgcttcgctttatttaccgatggaagggcttaactgctatcgccatgccattgcgccgctgctgtttggtgcggaccatccggtactgaaacaacagcgcgtagcaaccattcaaacccttggcggctccggggcattgaaagtgggcgcggatttcctgaaacgctacttcccggaatcaggcgtctgggtcagcgatcctacctgggaaaaccacgtagcaatattcgccggggctggattcgaagtgagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttattccattcctcgatattgcctatcaaggatttggtgccggtatggaagaggatgcctacgctattcgcgccattgccagcgctggattacccgctctggtgagcaattcgttctcgaaaattttctccctttacggcgagcgcgtcggcggactttctgttatgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaat

SEQ ID NO: 12909 - protein, 397 aa, Escherichia coli
MFQKVDAYAGDPILTLMERFKEDPRSDKVNLSIGLYYNEDGIIPQLQAVAEAEARLNAQPHGASLYLPMEGLNCYRHAIAPLLFGADHPVLKQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDAVIEILKARELIPFLDIAYQGFGAGMEEDAYAIRAIASAGLPALVSNSFSKIFSLYGERVGGLSVMCEDAEAAGRVLGQLKATVRRNYSSPPNFGAQVVAAVLNDEALKASWLAEVEEMRTRILAMRQELVKVLSTEMPERNFDYLLNQRGMFSYTGLSAAQVDRLREEFGVYLIASGRMCVAGLNTANVQRVAKAFAAVM

SEQ ID NO: 12910 - DNA, 1266 bp, Homo sapiens
  CDS (1)..(1266)
atgcccaccctttcagtgttcatggatgtgcccctcgcccacaagctagagggcagcttgttaaagacctacaaacaagatgattacccgaacaagatattcttagcctatagagtctgcatgacaaatgaaggccatccctgggtttctctcgtggtgcagaagactcgactacagatttcacaggatccctccctgaattatgagtacttgcccaccatgggcctgaaatcattcatccaggcctctctagcactcctctttggaaagcacagccaagccattgtggagaacagggtagggggtgtacacactgttggtgacagtggtgccttccagcttggcgtccagtttctcagagcttggcataaggatgctcgtatagtttacatcatctcttctcaaaaagaactgcatggactcgtcttccaggacatgggctttacagtttatgaatactctgtctgggaccccaagaagctatgcatggaccccgacatactcctcaatgtggtggagcagatcccacatggctgtgtccttgtgatggggaacattatcgactgcaagttgacaccaagtgggtgggcaaagttgatgtccatgataaagagcaagcagatattcccattttttgatattccctgtcaaggtttatacaccagtgacttggaagaagatactagaatcttacaatactttgtgtctcaaggctttgagttcttctgcagccagtctctgtccaagaattttggcatttatgatgaaggagtggggatgctagtggtggtggcagtcaacaaccagcagctgctgtgtgtcctctcccagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactcccagcaggtggaatacctggtcaggaagaagcacatctatatccccaagaacggtcagattaacttcagctgtatcaatgccaacaacataaattacatcactgagggcatcaatgaggctgtcctcctcacagagagctcagagatgtgtcttccaaaggaaaaaaaaacactgattggaataaaactttag

SEQ ID NO: 12911 - protein, 421 aa, Homo sapiens
MPTLSVFMDVPLAHKLEGSLLKTYKQDDYPNKIFLAYRVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQKELHGLVFQDMGFTVYEYSVWDPKKLCMDPDILLNVVEQIPHGCVLVMGNIIDCKLTPSGWAKLMSMIKSKQIFPFFDIPCQGLYTSDLEEDTRILQYFVSQGFEFFCSQSLSKNFGIYDEGVGMLVVVAVNNQQLLCVLSQLEGLAQALWLNPPNTGARVITSILCNPALLGEWKQSLKEVVENIMLTKEKVKEKLQLLGTPGSWGHITEQSGTHGYLGLNSQQVEYLVRKKHIYIPKNGQINFSCINANNINYITEGINEAVLLTESSEMCLPKEKKTLIGIKL

SEQ ID NO: 12912 - DNA, 1685 bp, Lotus corniculatus
  CDS (119)..(1492)
ttcgattcatccggtacgccattaaaccactctgcaactagatccatcactctttcactcgagtttggttgtaaccgtttccgttatttctgttgtggtcggtttgtttccgttgcagatggcggcgtcttcagtgttctctgtagcttcacactctgtttcgccttcgaatcaccatgctcacaagggaaaaaccaagattggaggtagcggtttgagattggcaaattcaaggtcttttggtagtggccggatctctatggctgttgctgttaatgcttctcgatttgagggaataccgatggctccacctgatccaattctcggagtttctgaagcatttaaagcggacaaatgcgatctcaagctcaatcttggagtcggggcctacagaactgaagaattacagccatatgtgcttaatgttgttaagaaggcagagaatcttatgctgaatagaggggaaaacaaagagtatctacctattgagggttgggctgcatttaataaggcaactgcagagttgttactcggagctgacaacccagcaatcaaagaacaaagagttgccactgtccaaggtctttctggaactggttctctgcgacatgctgctgctctgatagagcgatattttccaggggcaaaagttttgatatcatcccctacctggggtaatcacaagaatattttcaatgatgctagagtcccatggtcagagtaccgatattatgatcctaagacagttggattggattttgagggcatgttagaagatataaagtcagctcctgaaggatctttcgtgctacttcatggatgtgctcataaccctaccggtattgatcccacaccagaacagtgggtgaaaatagctgatctaattcaacaaaagaaccacattccattttttgatgtcgcttaccaggggtttgctagtggaagcctggatgaagatgctgcttctgtgcgattgtttgtgtcacgtggcatggaggttctagtagctcagtcatacagtaaaaatcttggtctctatgctgaaaggattggagcaatcaatgtcatttcctcatcaccagaatctgctgcaagggtaaagagccaattgaaaaggattgccaggccaatgtactctaatccaccggttcacggggctaggattgttgctgatatagttggaaatccagatctcttcaatgaatggaaagcagagatggaaatgatggcaggaaggataaagaatgttagacagaagctatatgatagtatttcttcaaaagacaagagtggaaaggattggtcattcatacttaagcagataggcatgttctcattcacaggcttgaacaagaatcagagtgacaatatgacaaataagtggcatgtatacatgacaaaagatggaaggatttccctggcaggattgtcactggccaaatgtgaataccttgcagatgctattattgactcctatcataatgtcagctgaaactagatgaaatattctttatcaccaagcttatattttttggtgagtattgtatccaatcatagtggtcggcacacatgacaataattcatgtaaacattaatgtcatacatgtacttttaattccctaggaattttgtaaccttaaaataagttgaatcaaactattgatgcaaaaaaaaaaaaaaaaaaa

SEQ ID NO: 12913 - protein, 457 aa, Lotus corniculatus
MAASSVFSVASHSVSPSNHHAHKGKTKIGGSGLRLANSRSFGSGRISMAVAVNASRFEGIPMAPPDPILGVSEAFKADKCDLKLNLGVGAYRTEELQPYVLNVVKKAENLMLNRGENKEYLPIEGWAAFNKATAELLLGADNPAIKEQRVATVQGLSGTGSLRHAAALIERYFPGAKVLISSPTWGNHKNIFNDARVPWSEYRYYDPKTVGLDFEGMLEDIKSAPEGSFVLLHGCAHNPTGIDPTPEQWVKIADLIQQKNHIPFFDVAYQGFASGSLDEDAASVRLFVSRGMEVLVAQSYSKNLGLYAERIGAINVISSSPESAARVKSQLKRIARPMYSNPPVHGARIVADIVGNPDLFNEWKAEMEMMAGRIKNVRQKLYDSISSKDKSGKDWSFILKQIGMFSFTGLNKNQSDNMTNKWHVYMTKDGRISLAGLSLAKCEYLADAIIDSYHNVS

SEQ ID NO: 12914 - DNA, 1748 bp, Moraxella sp
  CDS (340)..(1533)
aaggtagtctgaggtgtgctaccttattaataggagtggtgaatgcgatggaattattgatgctgagsgtttcataatgatttttttgatgaaaaagtactcgcagtcctaattgcatgctgtattaaaattcctcaatttttagtttaaataacaaaaatagactatgttgaggtttttaataatgattttttgcatgcacaaggtattaactgtattaatggcatgctgtattaaaattcctcacttttttgtaccaataacactagtcaacctagcgtgtttttatgataagcttaagctcacaccaaccccctaaataatgataagagatagtcaatgttctcagtattaaaaccattacccacagatcctattcttggccttatggcggcctataagcaagatactaaccctaataaaattgatttaggtgtgggtgtctataaagatgagctaggcaatacaccggtacttaaagcggtaaaaaaagcagaagcgtttcgtttagaaaatgaaaccagcaaatcttatattggtttagcgggtaatttagattactgtcaaaaaatggaaagcttactattaggtgagcacaaaacattactagctaaccgtgtacgtacggcgcaagcgccaggtggtactggggcattacgtgttgctgctgaatttattatgcgttgtaatccaaaagcaacagtgtgggtaactacgccaacatgggctaatcatattagcttatttgaagcagcgggcttaacagtaaaagaatacccttattacgattacgaaaataaagacttattatttgatgagatgatcaacacacttaagcaagtgcctaaaggcgatgtggttttactacatgcgtgttgtcataacccaagtggtatggatttaaacgaagcacagtggaaggtagttgctgagcttgcaaaagaagtgggctttacgccgcttgttgatattgcataccaaggttttggctcttcactagaagaagatgcacgtggtttacgtattttagctgacgcagttgaagagttaattatttgttcttcatgttctaaaaactttggtctttaccgcgaacgtattggtgcgtgttcactaattgcaaaagacagcgcaactgctgatatttcaaactcagtattacttagtgttgtacgtagtatttattcaatgccgccagcgcatggtgctgacattgtaaatacaattttaagcagcactgagcttacgcaaatgtggcatcaagagcttgatgaaatgcgtagccgtataaatggtttacgtacacaaattaaagaaacactagcgactaaagacatagcgcaagacttctcgtttattgagcgtcagcacggtatgttttctttcttaggaattaataaagagcaaattactcgcctacaaaaagagtacggcatttatattgttggctcaagtcgtgtaaacgtagcgggcgtgagtgatgcaaatattgaatactttgcaaatgcagttgccgacgtatgtaaatcataatagttaacctgaactctggttaagagatttactaacatattgaatcatcgttatatttaattttattttctctagccagaggttttcagtgaaaacaaggcgaatttacscgstcaatagctggcctattgcaagtaaatcaacccagttagccctgaaaacagctgcttgagataagttttattatccggacctcaggtagttaaattatttaa

SEQ ID NO: 12915 - protein, 397 aa, Moraxella sp
MFSVLKPLPTDPILGLMAAYKQDTNPNKIDLGVGVYKDELGNTPVLKAVKKAEAFRLENETSKSYIGLAGNLDYCQKMESLLLGEHKTLLANRVRTAQAPGGTGALRVAAEFIMRCNPKATVWVTTPTWANHISLFEAAGLTVKEYPYYDYENKDLLFDEMINTLKQVPKGDVVLLHACCHNPSGMDLNEAQWKVVAELAKEVGFTPLVDIAYQGFGSSLEEDARGLRILADAVEELIICSSCSKNFGLYRERIGACSLIAKDSATADISNSVLLSVVRSIYSMPPAHGADIVNTILSSTELTQMWHQELDEMRSRINGLRTQIKETLATKDIAQDFSFIERQHGMFSFLGINKEQITRLQKEYGIYIVGSSRVNVAGVSDANIEYFANAVADVCKS

SEQ ID NO: 12916 - DNA, 1194 bp, Klebsiella pneumoniae
  CDS (1)..(1194)
atgtttcaaaaagttgacgcctacgccggcgaccctattctttctctgatggaacgcttcaaagaagacccgcgaagcgacaaagtcaacctgagtatcgggctgtactacaacgatgacggcattatcccgcagctgcaggcggtggcggaagcggaagcacgcctgaacgccgagccgcatggcgcctccctgtatctgccaatggaagggtttagcggctaccgtcaggcgattgcgccgctgctgtttggcgcagaacataccgcgcttaagcaaaatcgcattgcctccattcagacggtcggcggttccggcgcgttgaaggtcggggccgacttcctcaaacgttactttcctgagtctcatgtctgggtcagcgatccgacctgggaaaaccacatcgccatttttgaaggggctggcttcgaagtaagtacttacccctggtttgataaagccaccaacggcgtgcgctttgagaacctgctggcgatgctgcaaacgctgccggcccgcgatattgtgctgctgcacccttgctgccacaacccgaccggcgccgacctgacgccagcccagtgggaccgcgtggttgaggtattgaaagcgcgtcagctgatccccttcctcgacatcgcctaccagggctttggcggggggctggaagaggatgcctacgccattcgcgccatcgccagcgccgggatgccgatgttggtcagcaattcgttctccaaaattttctcgctgtacggggagcgcgtcggcggtctgtccgtggtctgtgaagacagcgaaaccgcgggccgcgtgctgggtcagctgaaggccaccgtgcgccgcaactactccagcccgccaagctttggcgcgcaggtggtggcgacggtgctgaacgatgcagctctgaaagccacctggcaggcggaggtggacgccatgcgcgcgcacatcctgaccatgcgccaggcgctggtcgacgcgctgcagcaggttgccccgggcagcaaagtggattacctgctcaagcagcgcgggatgttcagctataccggatttagcgcggcgcaggtggatcgtctgcgcgatgagtttggcgtctacctgattgccagcggacgcatgcgcgtggcggggttaaactcacgtaatgttcagcaggtagcgaaggcgtttgttgcggtgatgtaa

SEQ ID NO: 12917 - protein, 397 aa, Klebsiella pneumoniae
MFQKVDAYAGDPILSLMERFKEDPRSDKVNLSIGLYYNDDGIIPQLQAVAEAEARLNAEPHGASLYLPMEGFSGYRQAIAPLLFGAEHTALKQNRIASIQTVGGSGALKVGADFLKRYFPESHVWVSDPTWENHIAIFEGAGFEVSTYPWFDKATNGVRFENLLAMLQTLPARDIVLLHPCCHNPTGADLTPAQWDRVVEVLKARQLIPFLDIAYQGFGGGLEEDAYAIRAIASAGMPMLVSNSFSKIFSLYGERVGGLSVVCEDSETAGRVLGQLKATVRRNYSSPPSFGAQVVATVLNDAALKATWQAEVDAMRAHILTMRQALVDALQQVAPGSKVDYLLKQRGMFSYTGFSAAQVDRLRDEFGVYLIASGRMRVAGLNSRNVQQVAKAFVAVM

SEQ ID NO: 12918 - DNA, 1737 bp, Canavalia lineata
  CDS (44)..(1441)
aacttaatcttcttgctttggttctttccctcctgaccaaagcatggcttcttcagtcctttccggggccaaccagtcttccccttcgtcgaccgttctcaacacccaccttaagggaaagcctcggctaggtgacaatgctctcagattctctggaaacaaaggaggatccaatgccttctcctcaaggtctcgaggtcgtatctccatggctgttgctgataatgtttctcggtttgaaggcatacctatggctcctcctgatccaattctcggagtttcagaggcgtttaaggcagacaatagtgatgtgaagctcaatcttggagttggggcatacagaacagaagaattacagccatacgtgcttaatgttgttaaaaaggcagaaaatcttatgctggagagagggcaaaacaaagagtatcttcctattgagggtttggcagcatttaacaaggcaactgcagagttgctactcggagcagacaatccagcaatcaaacagcaaagagttgccactgtccaaggtctttcaggactggtatctctgcgactaggtgcagctctgatagaacgatattttcctggggcaaaagttttgatatcaagtcctacctggggtaatcacaagaatattttcaatgatgctagggtcccatggtccgagtaccgatattatgatcccaagacagttggtttggattttgagggcatgatagaagatataaagtcggctccggaaggtacttttgtcctacttcatggatgtgctcataaccctactggtattgatccaacacctgaacagtgggaaaaaatagctgatgtaattgaagaaaaaaaccaccggcccttttttgatgttgcttaccaggggtttgctagtggaagccttgatgaagacgcagcatccgtccgactgttagtggcacgtggcatcgaattattcattgcacagtcttattccaaaaacctgggtctttatgctcaaaggattggagcaatcaatgtcatttcctcatcaccagaatctgcagctaggctgacgagccaactgaaaaggattgcacgaccaatgtactctaatccaccggttcacggggctaggattgttgccgatcttgttggcaatccattgctctttgaagaatggaaagctttcatggaaatgatggctggaaggataaagaatgttagacagcttctgtatgattccatttcttcaaaagacaaaagtggaaaggattggtcattcatacttaagcagataggcatgttctcattcacaggcttgaacaaggaacagagtgacaacatgacaaataagtggcatgtatacatgacaaaggatggaaggatttccctggcaggattgtcgttggctaaatgtgaataccttgcggatgctattatcgattcatatcataatgtcagctgaaactcaatgagttatgcttcagaactaagcttcttacttttttggtgagtattatacccagtcacagtgggcacattccaagaccgaaatagtgtatgcattatttagaataattatatagtacccaatgtgccttcggaaattatgttgtgaccttgaatatgttccctcaaagtattgatgtaacaaagaaataacttttttcgagatttgaaacaagttgattggaaccaaatttaagaatatgatttcttatgttgtccataaagtctgcttgaagtataaaaaaaaaaaaa

SEQ ID NO: 12919 - protein, 465 aa, Canavalia lineata
MASSVLSGANQSSPSSTVLNTHLKGKPRLGDNALRFSGNKGGSNAFSSRSRGRISMAVADNVSRFEGIPMAPPDPILGVSEAFKADNSDVKLNLGVGAYRTEELQPYVLNVVKKAENLMLERGQNKEYLPIEGLAAFNKATAELLLGADNPAIKQQRVATVQGLSGLVSLRLGAALIERYFPGAKVLISSPTWGNHKNIFNDARVPWSEYRYYDPKTVGLDFEGMIEDIKSAPEGTFVLLHGCAHNPTGIDPTPEQWEKIADVIEEKNHRPFFDVAYQGFASGSLDEDAASVRLLVARGIELFIAQSYSKNLGLYAQRIGAINVISSSPESAARLTSQLKRIARPMYSNPPVHGARIVADLVGNPLLFEEWKAFMEMMAGRIKNVRQLLYDSISSKDKSGKDWSFILKQIGMFSFTGLNKEQSDNMTNKWHVYMTKDGRISLAGLSLAKCEYLADAIIDSYHNVS

SEQ ID NO: 12920 - DNA, 1263 bp, Lupinus angustifolius
  CDS (1)..(1263)
atggcttccgttaatcaatccgtttccgtttctccaaccgcttcttctgattccgttttcgctcatcttcttcctgctcctgaagatcctattctcggggtgactgtggcttataacaaagatccaagcccagttaagctcaatttaggtgttggtgcttaccgaactgaggaaggaaaacctcttgttctgaatgtagtgaggcgtgttgaacagcaacttgtgaatgaagcgtcacgcaacaaggagtatcttccaattgttggggtcgccgatttcaacaaattgagtgctaggctcatttttggtgctgacagccctgctattcaagagaacagggtgaccactgttcaatgcttgtctggtactggttcattaagagttgggggtgaatttctagctagacactatcaccagaggactatatatattcctcaaccaacatggggtaatcacccaaagattttcaccttagctgggttatctgtcaaaacatatcgctattatgctccggcaacaagagggcttgactttgaaggacttctagaagatcttggttctgccccatctggatccattgttttgctacatgcatgcgcacataaccctactggtgttgatccaaccactgagcaatgggagcagattaggaagctgttgagatcaaaagctttgttacctttctttgacagtgcttatcaaggctttgctagtggaagtctagatatagatgcacaggctgttcgcttgtttgttgctgatgggggtgaattgctgcttgcccagagttatgctaagaacatgggtctatatggagaacgtgttggcgccctaagcattgtctccaagtcagctgatgttgcaagcagggttgagagccaggtgaaacttgtggttaggccaatgtactcaaaccctcccattcatggtgcatccattgtggctgccattctcagggaccgggatttgtacaatgagtggactattgagctgaaggcaatggctgatcgcattatcaaaatgcgccaacaactttttgatgctttgcaatccagaggcacacctggtgattggagtcacattatcaagcagattggaatgtttactttcacaggattgaatgctgagcaagtttccttcttaactaaggagtaccatatatacttgacatctgatgggaggattagcatggctggtctgagttccaaaacagttcctcatttggctgatgcaatacatgcagctgtaaccagagttgtctaa

SEQ ID NO: 12921 - protein, 420 aa, Lupinus angustifolius
MASVNQSVSVSPTASSDSVFAHLLPAPEDPILGVTVAYNKDPSPVKLNLGVGAYRTEEGKPLVLNVVRRVEQQLVNEASRNKEYLPIVGVADFNKLSARLIFGADSPAIQENRVTTVQCLSGTGSLRVGGEFLARHYHQRTIYIPQPTWGNHPKIFTLAGLSVKTYRYYAPATRGLDFEGLLEDLGSAPSGSIVLLHACAHNPTGVDPTTEQWEQIRKLLRSKALLPFFDSAYQGFASGSLDIDAQAVRLFVADGGELLLAQSYAKNMGLYGERVGALSIVSKSADVASRVESQVKLVVRPMYSNPPIHGASIVAAILRDRDLYNEWTIELKAMADRIIKMRQQLFDALQSRGTPGDWSHIIKQIGMFTFTGLNAEQVSFLTKEYHIYLTSDGRISMAGLSSKTVPHLADAIHAAVTRVV

SEQ ID NO: 12922 - DNA, 1753 bp, Lotus japonicus
  CDS (86)..(1342)
ggcacgagctttttcttcttcttcttcttccccaagcgatcgcagactcaacgttctcgcaggccacctcgttcacaacgatcaaatggattctcagaacatctctccttctccaaccgcctcttctggttccgtcttcgctcatctcgttcgtgctcccgaagatcctattctcggggtgactgtcgctttcaacaaagatcctagccctgttaagctcaacttgggtgttggtgcttaccgaactgaggaaggaaaacctcttgttttgaatgtggtcaggaaagctcaacaccaaatcgtgaatgatccgtcacgcaacaaggagtatcttccaattgtggggctcgctgattttaataaattgagtgccaagcttatttttggtgctgacagccctgctattcaagagaacaggattaccactgttcagtgcttgtctggtactggttcattaagagttgggggtgaatttttggctaaacactatcaccaacggattatatacttgccaaaaccaacttggggcaatcacacaaaggttttcaccttggcagggttatctgtcaaaacatatcgctactatgctccagcaacacgaggccttgactttcaaggacttctagaagatcttggttctgccccatctggatccattgttttgctacatgcatgcgctcataaccctactggtgttgatccaacccctgagcaatgggagcagattaggcagctgataagatcaaaggctttattacctttctttgacagtgcttatcagggttttgctagtggaaatctagatgcagatgcacattctgttcgttcatttgttgctgatgggggtgaattgctggcagcccagagttatgcaaagaacatgggtctttatggagaacgtgttggtgccttaagcattgtctccaagtcagctgatgttgcaagtttggttgagagtcagctgaagcttgtcatcaggcccatgtactcaaatcctccccttcatggtgcatccattgtagctacgattcttaaggaccgggatttgtacaatgagtggactattgagttgaagggaatggctgatcgtattatcagtatgcgccaacaactttttgatgctttacgttccagaggcacgcctggtgactggagtcacattatcaagagtatcggtatgttcactttcacaggattgaatcctgagcaggtttccttcatgactaaagagtaccatatatacctgacatccgatgggcggattagcatggctggtttgagttccaaaaccgtcccacatctggcggatgctatacatgcggctgtaacccgagcttcctgaacatgtttggaaagatatctcaaccatagatgaaaaaatcaactgttagatattaacaaatcatggatttgttgaaatatactcttgattttctcatcaaccattgagatacctttactttctccctttaaagctttagaggagccaaattctatgagcggcgcgattttcaactcacctagtaggacttccattttcaatgtaataatatcacatcaaacaatgaaaacttttttttgatgtgagaattagagacaacttttctgcccagggtgcctcggtctccgatcttggcattctaacattttcgccaagttttcctagtgtaagcatgatcaagtgcccccaagaaggaggctttctattttctaaataatttctgaaggataaaaaaaaaaaaaaaaaaaaaaa

SEQ ID NO: 12923 - protein, 418 aa, Lotus japonicus
MDSQNISPSPTASSGSVFAHLVRAPEDPILGVTVAFNKDPSPVKLNLGVGAYRTEEGKPLVLNVVRKAQHQIVNDPSRNKEYLPIVGLADFNKLSAKLIFGADSPAIQENRITTVQCLSGTGSLRVGGEFLAKHYHQRIIYLPKPTWGNHTKVFTLAGLSVKTYRYYAPATRGLDFQGLLEDLGSAPSGSIVLLHACAHNPTGVDPTPEQWEQIRQLIRSKALLPFFDSAYQGFASGNLDADAHSVRSFVADGGELLAAQSYAKNMGLYGERVGALSIVSKSADVASLVESQLKLVIRPMYSNPPLHGASIVATILKDRDLYNEWTIELKGMADRIISMRQQLFDALRSRGTPGDWSHIIKSIGMFTFTGLNPEQVSFMTKEYHIYLTSDGRISMAGLSSKTVPHLADAIHAAVTRAS

SEQ ID NO: 12924 - DNA, 1263 bp, Debaryomyces hansenii CBS767
  CDS (1)..(1263)
atgtcaaaatatttttcaagtattaaagaattacctccagatccattatttgggttgaaagctagatacacggccgatgaccgttcagataaagtagatttgggaatcggtgcttatagagataataacgggaagccatggatattaccagcggttagaaaggcagaagtgaagttggttaactcggaagaatacaaccacgagtatttatcgatttcggggtatcagccatttttgaccgagagtgctaaagttattttgggaaacaactcagctgccatcaaggaatcaagagtgaccagtcaacaatcgttgtctggtaccggggctttgcacttggctggagcctttttgaaggaatttttcaccactgaatcgaagaaagctccaacggtgtacttatcgaatcctacgtgggccaaccataaccaaattttcactagtttgggtttgcaggtagagaagtatccatactgggacaatgataccaaatcattgaacttgaaggggttcttgtcgactattcaagaagcacctaagaactcgatttttgtgttgcatgcgtgtgcccataatcctactggactcgatgccaccaaggagcaatgggaggaaattctcgaagcattggccaagaatgaacacttagcattatacgactctgcctaccaagggttcgctagtggtaacttggataacgatgggtttgctgtaagattggctgtcgactcgaagaagttgaaaaccccaattgttatctgtcaatcttttgcaaagaattgtggtatgtacggtgaaagagttggtgcaattcacgtcatcccagccgagaatgataagtcgttgaacaacgctataaagtcgcaattgaacaagctcaccaggtcggaaatttctaatcccccagcgtacggagccaaggttgttgcaaccattttgaccgactcagaattgagacagcaatgggaagacgacttggtcaccatgagttcgagaatcaacaaaatgagaaccaggttgagagatttgttgacaaaccaatacagcactcctggcaactgggatcacattgtctcccaatcaggtatgttctcgttcacaggattgaccccagatatggtgtccagattggaaaagaaccacggaatctacttggttagctccggtagagcctccgttgctggtttgaatgatggcaacgtcgaacaggtcgctaaggctatcgacgaagttgttcgtttctactccaagtccaagttataa

SEQ ID NO: 12925 - protein, 420 aa, Debaryomyces hansenii CBS767
MSKYFSSIKELPPDPLFGLKARYTADDRSDKVDLGIGAYRDNNGKPWILPAVRKAEVKLVNSEEYNHEYLSISGYQPFLTESAKVILGNNSAAIKESRVTSQQSLSGTGALHLAGAFLKEFFTTESKKAPTVYLSNPTWANHNQIFTSLGLQVEKYPYWDNDTKSLNLKGFLSTIQEAPKNSIFVLHACAHNPTGLDATKEQWEEILEALAKNEHLALYDSAYQGFASGNLDNDGFAVRLAVDSKKLKTPIVICQSFAKNCGMYGERVGAIHVIPAENDKSLNNAIKSQLNKLTRSEISNPPAYGAKVVATILTDSELRQQWEDDLVTMSSRINKMRTRLRDLLTNQYSTPGNWDHIVSQSGMFSFTGLTPDMVSRLEKNHGIYLVSSGRASVAGLNDGNVEQVAKAIDEVVRFYSKSKL

SEQ ID NO: 12926 - DNA, 1296 bp, Debaryomyces hansenii CBS767
  CDS (1)..(1296)
atgttatcaagggtacaattaaagcgcataccaaattgcagacagttttctgtgatgaacagggcttgcaaatggaacgatattccattagcaccaccggataaaatcttgggtatcagcgaagcatttgttaaggattccaacaccaagaaaatcaatttgggagttggtgcatacagaaacaactctggtaagccaattgtgttcgaatcggtcaaaaatgctgaggccaagttattagaaacagaaaccgaaaaggaatacactggtattatcggtaacaagaacttccaaaaagtggtcagaaactttattttcaacaacagcggtaaggacgccaatggggccagattgattgacgaaaacagaatcgtcaccagtcaaaccatttctggtaccggttctttgagggttattgctgatttcttacacagattcaacacggccaagaaaatatacgtgccaaagccaacctgggccaaccacattgctgttttcactgatgctggtatgagtaccgaatactacgattactacaataaggaaatcaacaacttggactacgataagttgaagcaatcgttgtctaacgccgaagaaggttctgtggtcttgttgcacgcttgttgccacaaccctactggtatggacttgtcatccgaacaatgggacgaagtcttagccatcgtccaacaaaagcaattgttcccattagttgatatggcctaccagggtttcgcgtccggtaacccatacaaggacattggattgattcgtagattgaacgagttagtcgtcaacggtgacatttccacctacgctttatgtcaatctttcgctaagaacatgggtttgtacggtgaaagaactggttctatctccattgtcaccgaatctgctgaacattccactgcgattgagtcccaattgaagaagttaatcagaccaatctactcgtcgcctccaatccacggttccaagattgtggaaaccatcttcgccgacgaatccttgtacaactcttggttaagtgacttggaccaagttgtttccagattaaacaccgtcagaaccaagttatacgagaaattggacaagtccaactacaactgggaccacttattaaaacaaagaggtatgttcgtttacactggtttatcagctgaacaagttattgaattgagagaaaagtactctgtttacgctactgaagacggtagattctccatttctggtatcaacgacaacaacgttgattacttggccgatgccatgaaccaagttgttaacaaataa

SEQ ID NO: 12927 - protein, 431 aa, Debaryomyces hansenii CBS767
MLSRVQLKRIPNCRQFSVMNRACKWNDIPLAPPDKILGISEAFVKDSNTKKINLGVGAYRNNSGKPIVFESVKNAEAKLLETETEKEYTGIIGNKNFQKVVRNFIFNNSGKDANGARLIDENRIVTSQTISGTGSLRVIADFLHRFNTAKKIYVPKPTWANHIAVFTDAGMSTEYYDYYNKEINNLDYDKLKQSLSNAEEGSVVLLHACCHNPTGMDLSSEQWDEVLAIVQQKQLFPLVDMAYQGFASGNPYKDIGLIRRLNELVVNGDISTYALCQSFAKNMGLYGERTGSISIVTESAEHSTAIESQLKKLIRPIYSSPPIHGSKIVETIFADESLYNSWLSDLDQVVSRLNTVRTKLYEKLDKSNYNWDHLLKQRGMFVYTGLSAEQVIELREKYSVYATEDGRFSISGINDNNVDYLADAMNQVVNK

SEQ ID NO: 12928 - DNA, 1212 bp, Debaryomyces hansenii CBS767
  CDS (1)..(1212)
atggtacaatacgaatttttcggagatttaactctagctcccaaagatgaaatgaatgatcttaagataaaacttgaaaattgtcaatccagtaaggttgatgtttccgcaggagtatatagaggggagaatggtgagtcgtatacattatcatcagtaaaagcagctaaaggagtattacatgcaaatgatcccgggcatgactataattttaccctaggtatcaaaaacttcaacctgatggctgctgatatcatatttgggaaagatatttctactggtggatatattgctacatgtcaaacaatatctggaaccggtgcttgcagtatagctattaaatttctagtggactgctgcaaacttaccaatttctatattggaacaccaacttggcccaattacgctccaatgattaaagcagccaatgctgaagtcgtggaatatgttcattacaatccgttgacaagaagtcttgattttgaaagcgttttagaagccatttctaaagctaagatgcattcagtattcatcctacaattatgttgtcataatcccaccggtactgatttttcaatagatcagtggaaaattttggctgataaaatgcaagaaaaaaaaatcatgccagtgtttgattctgcctatcaagggtttggttcaggtgacattgcggtggacgcaaaacctattagattatactatgctaaaggattgcaatttttggtctgtcaatcattctccaaaaacttggggttatatagcgaaagggttggtgcacttcacgtcgtagtatgtgaaaaaaaattagctgaaattgtctctgatcaattaagaagtatattcagaagagagtgttcaagtgcgccagcttatggggctaggttggctgtcattatagcaaacgacccaaaattaactgaacaatggagaaacgatttaagaacaatctataagagactagttgataaaagaattgagcttcatgatttattgataaagtatcaaactccaggcagcttcgatcatttgttaaatcagaatggtttattttggttcagtggtttgtctaaggtccaatgtaaattattggttgaagaatatcatatctttattccttcgaatggtcgcgttaatatagccggtttaaataatagtaatattcattactttgcgaaatcattttccgaagtaatcaagatctcagtatag

SEQ ID NO: 12929 - protein, 403 aa, Debaryomyces hansenii CBS767
MVQYEFFGDLTLAPKDEMNDLKIKLENCQSSKVDVSAGVYRGENGESYTLSSVKAAKGVLHANDPGHDYNFTLGIKNFNLMAADIIFGKDISTGGYIATCQTISGTGACSIAIKFLVDCCKLTNFYIGTPTWPNYAPMIKAANAEVVEYVHYNPLTRSLDFESVLEAISKAKMHSVFILQLCCHNPTGTDFSIDQWKILADKMQEKKIMPVFDSAYQGFGSGDIAVDAKPIRLYYAKGLQFLVCQSFSKNLGLYSERVGALHVVVCEKKLAEIVSDQLRSIFRRECSSAPAYGARLAVIIANDPKLTEQWRNDLRTIYKRLVDKRIELHDLLIKYQTPGSFDHLLNQNGLFWFSGLSKVQCKLLVEEYHIFIPSNGRVNIAGLNNSNIHYFAKSFSEVIKISV

SEQ ID NO: 12930 - DNA, 1296 bp, Yarrowia lipolytica CLIB99
  CDS (1)..(1296)
atgtcatactttgcatcagtccccgcagctcccgcagatgcccttttcggcctcatggccaagtacaaggccgataccttcgacaagaaggtcgacctcggagtcggagcctaccgagataacaccggaaaaccctgggtcctccctgtcgtctccaaggtcgattctctgattgtcgccgaccccactgccaaccacgagtacctccccatcactggtctgccagacttcaccaagtctgccgccaagctgattctggggcctgactctcctgccatcaaggagaaccgagttgcctcttgccagacaatctctggaactggagcaaaccatctgggatctctcttcctgtcgcggttcccctcctccgccgctccccccaagagcgtcttcctcagccgttctcccccttcccctggagcaaccggagatactcctccccgagctgctggcggccgaatctggatctccaaccccacctgggccaaccacaagcagatcttcgagaacgtcggtctgaccgttaagcagtacccctactgggaccccaagactctaggtctggacctcaagggcatgctcaacgctctggagaatgagacccgacccggagacattgttctgttgcacgcctgcgcacacaaccccaccggtgttgaccctgctcgagaggagtgggagaagattgccgctgtctgcaagtccaagaagctcttccccttcttcgactctgcctaccagggctttgcctccggtgatctcgagcgagacgcctgggcagtccagtactttgtttcccagggcctggagctgctcatctgccagtccttcgcaaagaactttggcctgtacggccagcgggccggatgcctgcacttcatcacccagaccgccaaggcgtcggagaacgtcaagtcacagcttgccttcctgcagcgatcagaaatctccaaccctcccatctacggtgcccgaattgtggcccgagttcttaacaaccccgagctcttcaatgagtggaaggaaaacctgctggagatggccaaccgaatcaagagcatgcgagatgcgctcaagagcgaactcatcaagcttgatactcccggtaactgggaccatatcactaaccagattggtatgttctctttcaccggtctgtcgccccagcaggtggaccgactggttaacgagttccacgtttacctgaccaagaacggccgaatttccatggctggtcttaacacacacaacgtcgcttacgtcgccaaggcctttgatgccgtcgttcgaggttaa

SEQ ID NO: 12931 - protein, 431 aa, Yarrowia lipolytica CLIB99
MSYFASVPAAPADALFGLMAKYKADTFDKKVDLGVGAYRDNTGKPWVLPVVSKVDSLIVADPTANHEYLPITGLPDFTKSAAKLILGPDSPAIKENRVASCQTISGTGANHLGSLFLSRFPSSAAPPKSVFLSRSPPSPGATGDTPPRAAGGRIWISNPTWANHKQIFENVGLTVKQYPYWDPKTLGLDLKGMLNALENETRPGDIVLLHACAHNPTGVDPAREEWEKIAAVCKSKKLFPFFDSAYQGFASGDLERDAWAVQYFVSQGLELLICQSFAKNFGLYGQRAGCLHFITQTAKASENVKSQLAFLQRSEISNPPIYGARIVARVLNNPELFNEWKENLLEMANRIKSMRDALKSELIKLDTPGNWDHITNQIGMFSFTGLSPQQVDRLVNEFHVYLTKNGRISMAGLNTHNVAYVAKAFDAVVRG

SEQ ID NO: 12932 - DNA, 1302 bp, Yarrowia lipolytica CLIB99
  CDS (1)..(1302)
atgctccgaaccatcgcccgaacccacgctgtggccgccaccaaggtcgtgcgagcctccactttttctgccacccccgccgcctcttttgtgcgattccagtccgtctgggccaaggtcccccagggtccccccgacgccattctcggaatcaccgaggcgttcaagaaggacgcctttgagcagaagatcaacctcggtgttggcgcctaccgagatgacggcggaaagcccttcgttcttccctccgtccgagaggccgagaaggaggtggtgaacaaggccctcgacaaggagtacgcccccatcaccggagtccccgccttcaccaaggctgctgccgagctcgcttacggcgccgactcccccgccgtcctcgaggaccgaattgccatcacccagaccatctccggtaccggtgctctgcgaatcggagccgagttcctcaacaagttctactcctccaagaagattctgctcccccagccttcttgggctaaccacaaggccgttttcaccgccgccggcctcgagcccgccacctaccggtactacgaccccaagaacattgccctcgactttgagggtctgctcgccgacctggaggctgcccccaacggaaccgccgtccttctgcacgcctgtgcccacaaccccaccggtgttgaccccactcccgagcagtggcgaaagattgaggaggtcgtcaaggccaagggccacttccccttcttcgacatggcctaccagggctttgccaccggtgacgtcaaccgagacgcctaccccatccgatactttgtcgagcagggccacgaggttgctctgtgccagtccttcgccaagaacatgggtctttacggtgagcgagtcggtgctttctctcttgtctgccaggacaccgccgagaagaaccgagttgactctcagctgaagattatcatccgacccttctactccaacccccccgtccacggtgcccgaatcgccgccaccatcctcaacaaccccgagctcaagaagcagtggctcggtgaggtcaagcagatggccgaccgaatgatcaagatgcgagctctgctcaaggagaacctcgagagacttggctcccagcagaactgggaccacgtcacctctcagattggtatgttctgctacaccggtctgtctcctgagcaggttgagcgacttgccaaggagttctccgtctacggaaccaaggacggccgaatctccattgccggaatcacctctcagaacgtcggccgactggcccaggctatctacgaggtgaccaaatag

SEQ ID NO: 12933 - protein, 433 aa, Yarrowia lipolytica CLIB99
MLRTIARTHAVAATKVVRASTFSATPAASFVRFQSVWAKVPQGPPDAILGITEAFKKDAFEQKINLGVGAYRDDGGKPFVLPSVREAEKEVVNKALDKEYAPITGVPAFTKAAAELAYGADSPAVLEDRIAITQTISGTGALRIGAEFLNKFYSSKKILLPQPSWANHKAVFTAAGLEPATYRYYDPKNIALDFEGLLADLEAAPNGTAVLLHACAHNPTGVDPTPEQWRKIEEVVKAKGHFPFFDMAYQGFATGDVNRDAYPIRYFVEQGHEVALCQSFAKNMGLYGERVGAFSLVCQDTAEKNRVDSQLKIIIRPFYSNPPVHGARIAATILNNPELKKQWLGEVKQMADRMIKMRALLKENLERLGSQQNWDHVTSQIGMFCYTGLSPEQVERLAKEFSVYGTKDGRISIAGITSQNVGRLAQAIYEVTK

SEQ ID NO: 12934 - DNA, 1266 bp, Kluyveromyces lactis NRRL Y
  CDS (1)..(1266)
atgtccagaaccatacttaacaacatccaagaattgccaggcgatgctttattcgctatcaaacaacgtttagctgaagaccctagatctgctaaggtcgatttgggtattggtgcctatagagatgaggatggtaaaccatgggtattaccagctgttcgtaaagctgaaacattgatccattctgacgcatctttcaaccatgaatatttgggtattgccggtttacctgctttgacttcaggtgcagccaaagtgatcttgggcgatgattcatctgctttggctgagaaaagagttgtttctgctcagtctctatccggtactggtgccttacacattgcagctaaattcatccaaaagttcttacctgggaagttgttgtatgtttctgatccaacctgggctaaccatgtctctatctttgagtcacaaggtgtcaaaactgctacgtatccttactgggatgctgctaccaaatctttggatttggaaggatttatcaaggctatagaatcaagtccaagaggctccgtgttcttgcttcatgcttgtgctcataatccaactggtttggatccaaccgaagctcaatgggagaaaattctcagtgcctgtgtgaagaatgatatcatcccattgttcgactctgcctaccagggtttcgcatctggtagtctaacgaatgatgcttttgccgtcagacttggtgtgaagaaattcgctgaatctgctccaattttcatctgtcaatcatttgccaagaatgttggtatgtacggtgaacgttgtggatgcattcatttgattgttccaagacaagaatctaacgttaatgtttccactattaccaaagctgttgcatctcaaatcagtaaaatcaccagatcagaggtttctaaccctcctgcttacggtgccaagatcgttgccaaaattttgaacaatgctgaattgactgaacaatggcataaggatatggttacaatgtctcaaagaatcaccaaaatgagacactccttacgtgacaagttactcgagttacagactccaggtaactgggatcacatcgtcaaccaatgtggtatgttctcttacaccggtttaacaaagccaatggtggaaagattagaaaaagaacatggtgtatacatggttgctagtggtagagcttccattgctgggttgaatgaaaagaacgttgaacatgtggctaaggctattaatgaagtcgttcgtcatttcaatgaatcatccaaattataa

SEQ ID NO: 12935 - protein, 421 aa, Kluyveromyces lactis NRRL Y
MSRTILNNIQELPGDALFAIKQRLAEDPRSAKVDLGIGAYRDEDGKPWVLPAVRKAETLIHSDASFNHEYLGIAGLPALTSGAAKVILGDDSSALAEKRVVSAQSLSGTGALHIAAKFIQKFLPGKLLYVSDPTWANHVSIFESQGVKTATYPYWDAATKSLDLEGFIKAIESSPRGSVFLLHACAHNPTGLDPTEAQWEKILSACVKNDIIPLFDSAYQGFASGSLTNDAFAVRLGVKKFAESAPIFICQSFAKNVGMYGERCGCIHLIVPRQESNVNVSTITKAVASQISKITRSEVSNPPAYGAKIVAKILNNAELTEQWHKDMVTMSQRITKMRHSLRDKLLELQTPGNWDHIVNQCGMFSYTGLTKPMVERLEKEHGVYMVASGRASIAGLNEKNVEHVAKAINEVVRHFNESSKL

SEQ ID NO: 12936 - DNA, 1257 bp, Kluyveromyces lactis NRRL Y
  CDS (1)..(1257)
atgagaataccaacgcgaagagggctgtcggccttgtcaagagtaactagggctcctgctgataagattctaggtttaacagagaagtttaacgttgacagacatccaaacaagataaatctgaccgttgggatctataaggacaaccggggccgtgtgaccaccttccctagtgtagcttctgcccaatcattacttgagacgagtctcgatctgaataatgatttatcgtatttgcctatcactgggtcgcaggattaccaaaacaatgtgttaaatttcttgtatcgagagtcaagtgacgggagtgaattattggagaacaacagaatcacgtttgtgcaaactttgagtggtaccggtgcattagctgtagcttcaaaactcttggcaacgtttgtgtcgaaaaccgtatggataccaaatccatcttgggctaatcattcgaacgttttccaatggaacggattcaatcagatcaaatattatacgtactacgaggatgggaaattgagtatcgataaatggctcaaggaactcaaggagagttgtagttctagggaccccgactggcccccctctatagtgttacacgcttgctgtcataatccaacaggagtggaccctacgttggaacaatggcaacagatattgccagtgatccatgatttaggaataactcccataatagacatggcgtaccaaggaatggaatcagggaaccttatacaggatgcttatctattaagaatgtgtctagaatacgaatggcccaacggtctatttgtgtgccaatcgtttgctaagaacatgggcttatacggtgaacgtgtaggttcgttaagtgtcgttgtcccaccaaatcccttggatctcaaatcaaccatcgactctcaactaaagaagattgtaagaggtatatactcttctccaccgggatatgggtctcgtgtagcgaacttggtgctaagcaatccaaaattgaagcagcaatggttcgtagacgttaagaatatgtctgatagactatggaacgttagaattcaaatgcatgagagattgaattggcccaatcttgttgattttaaaacacaacatgggatgttttattacacagggttaaacccatatcaggttcaaattctgcaggagaggtacggtatttatttaactgaagacggcaggatgtcgttatctggagttaacgacggtaatattgattatttatgcgattctttgcgccaagtggttcaataa

SEQ ID NO: 12937 - protein, 418 aa, Kluyveromyces lactis NRRL Y
MRIPTRRGLSALSRVTRAPADKILGLTEKFNVDRHPNKINLTVGIYKDNRGRVTTFPSVASAQSLLETSLDLNNDLSYLPITGSQDYQNNVLNFLYRESSDGSELLENNRITFVQTLSGTGALAVASKLLATFVSKTVWIPNPSWANHSNVFQWNGFNQIKYYTYYEDGKLSIDKWLKELKESCSSRDPDWPPSIVLHACCHNPTGVDPTLEQWQQILPVIHDLGITPIIDMAYQGMESGNLIQDAYLLRMCLEYEWPNGLFVCQSFAKNMGLYGERVGSLSVVVPPNPLDLKSTIDSQLKKIVRGIYSSPPGYGSRVANLVLSNPKLKQQWFVDVKNMSDRLWNVRIQMHERLNWPNLVDFKTQHGMFYYTGLNPYQVQILQERYGIYLTEDGRMSLSGVNDGNIDYLCDSLRQVVQ

SEQ ID NO: 12938 - DNA, 1194 bp, Erwinia carotovora subsp
  CDS (1)..(1194)
atgtttcaaaacgttgatacctatgccggagatcctatcctgtctctgatggaaaaattcaaacaggatccaagagcagataagatcaatttgagtatcgggctgtactacaacgagcagaatattatcccgcagttgcgatccgtcagcacagcggaaagcagcctacggcagcctgctcagagcgcgaattcctatctgccgatggaagggttacagccttaccgcacggctatccagcatttgttgttcggtgaaagccacgcggcgctggaagcaggtcgcatcgcgaccatccagacgttgggcggttccggtgcgctgaaagtcggtgcagatttcctgaaacgctacttcccagcgtcagaagtgtgggtcagcgatccaacatgggaaaaccatattgcgatcttcgagggcgcgggctttaacgttcacacctacccgtatttcgatagcgaaagtctgggcgtgaaatttgacgccatgctctccaccctgcaaacgctgccaacacgcagcattgtgctgctacatccgtgctgccataacccgactggttccgatctcaccaccgaacagtgggatcgcgtcattgaggttatcatccagcgtgagctgattccgtttatggacatcgcttatcagggctttggcctcggcatcgagcaggatgcgtatgcaattcgcgccgttgccagcgcaggcgttccggcactgatcgccaactcgttctccaagattttctcactgtatagcgagcgcgtcggtggcctttccgtggtgtgtgacgatgccgacagcgcgcagcgcgtattgggtcagttaaaagcgaccgtacgccgcaactactcttccccaccaaatttcggcgctcaggtggtttctaaagtcctgaacgacgtgcagttgaacgccgactggaaagcggaagtcgaagagatgcgcacgcgtattctaagcatgcgtcaggagttggtttccgcattgaaaaacgcactgccgaaccgcaacgtcgactacctgctcacccagcgcggtatgttcagttacacgggtttcagcccggaacaagttgaccgcctgcgtgaagaatttggcgtgtacctgatcgccagcggccgtatgtgtatggcgggactcaaccacagcaacgtccaacgcgtcgctgccgctttcgccgccattcagtaa

SEQ ID NO: 12939 - protein, 397 aa, Erwinia carotovora subsp
MFQNVDTYAGDPILSLMEKFKQDPRADKINLSIGLYYNEQNIIPQLRSVSTAESSLRQPAQSANSYLPMEGLQPYRTAIQHLLFGESHAALEAGRIATIQTLGGSGALKVGADFLKRYFPASEVWVSDPTWENHIAIFEGAGFNVHTYPYFDSESLGVKFDAMLSTLQTLPTRSIVLLHPCCHNPTGSDLTTEQWDRVIEVIIQRELIPFMDIAYQGFGLGIEQDAYAIRAVASAGVPALIANSFSKIFSLYSERVGGLSVVCDDADSAQRVLGQLKATVRRNYSSPPNFGAQVVSKVLNDVQLNADWKAEVEEMRTRILSMRQELVSALKNALPNRNVDYLLTQRGMFSYTGFSPEQVDRLREEFGVYLIASGRMCMAGLNHSNVQRVAAAFAAIQ

SEQ ID NO: 12940 - DNA, 1191 bp, Erwinia carotovora subsp
  CDS (1)..(1191)
atgtttgaaaatatctctgctgcaccggccgatcctattctcgggctgaccgatcttttccgcgccgatgaccgcgcggataaaatcaatctgggtattggtgtctataaagatgaaaccggcaaaactccggttctgaccagcgtaaaaaaagcagaacactatctgctggaaaatgaaaccaccaaaaactatctgggcattgacggtctgccagcattcggtcagtgcacgcaggaactgctgtttggcaagcagaatgccatcattgccgacaaacgtgctcgtacggcacaaaccccaggcggaaccggtgcgttgcgcgtagccgctgatttcattgcaaatcagacgtcagcaaaacgcatctggatcagtaacccaacctggccaaatcacaataacgtgttctctgctgccggtttggaagtttgccagtatgactattacgatgctgctaaccacgcactggattttgatggtttgctgaatagcctgaacgccgtagaagcgggtgacgtggtgctgtttcacggctgttgtcataacccaaccggtatcgatcctaccgctgagcagtgggctacgctggccgagctgtcggtagcaaaaggctggctgccgctgtttgacttcgcctatcagggctttgcccgtggtatcgaagaagatgcggaaggcctgcgactcttcgctgcgaagcacgctgaactgatcgtatgcagctcgtactctaaaaatttcggtctgtacaatgaacgtgtcggtgcctgtacgctggttgctgctgatgccgcaacagcagacaaggcattcagtcaggtgaaagccgccattcgcgcaaactactctaacccgccgtcacacggcgcgaccattgttgctaccatcttgggcaatgatgcgctgaaggccatttgggagcaggaattgacggcaatgcgggagcgtattcagcgtatgcgtcagctgttcgtgaataccttgcaggaaaaaggcgcacagcaggatttctccttcatcatcaaccagaatgggatgttctcattcagcggcttgaccaaggagcaggttctgcgtctgcgtgacgaattcggcgtttatgcggtgaattctggccgagtcaatgttgcaggaatgacgccagaaaacatggcgccactctgcgaagcgattgttgccgtgctctga

SEQ ID NO: 12941 - protein, 396 aa, Erwinia carotovora subsp
MFENISAAPADPILGLTDLFRADDRADKINLGIGVYKDETGKTPVLTSVKKAEHYLLENETTKNYLGIDGLPAFGQCTQELLFGKQNAIIADKRARTAQTPGGTGALRVAADFIANQTSAKRIWISNPTWPNHNNVFSAAGLEVCQYDYYDAANHALDFDGLLNSLNAVEAGDVVLFHGCCHNPTGIDPTAEQWATLAELSVAKGWLPLFDFAYQGFARGIEEDAEGLRLFAAKHAELIVCSSYSKNFGLYNERVGACTLVAADAATADKAFSQVKAAIRANYSNPPSHGATIVATILGNDALKAIWEQELTAMRERIQRMRQLFVNTLQEKGAQQDFSFIINQNGMFSFSGLTKEQVLRLRDEFGVYAVNSGRVNVAGMTPENMAPLCEAIVAVL

SEQ ID NO: 12942 - DNA, 1232 bp, Pseudomonas putida
  CDS (10)..(1206)
aaggtaacaatgagcctgttttccgctgtcgagctggcaccccgcgaccctatcctgggcctcaacgaagcattcaacgccgacccacgtaccgacaaggtcaacttgggcgttggcgtgtactgcaatgaggaaggccgcattccgctgctgcgcgccgtgatcgaagccgaaacccagcgtgccgcccagcacgcctcgcgcggctacctgccgatcgacggcatcgccacttacgaccaggccgtgcaaaaactgatcttcggcgccgagtcgccactgctggccgctggccgcgtggtcaccgtgcaggccgttggcggcaccggcgcgctgaagatcggcgccgacttcctcaagcgcctgtcgcccaatgccgtggttgccatcagtgacccgagctgggaaaaccaccgcgcactgttcgaaaccgccggtttcccggtacagaactaccgctactacgacgcgcctagcaacgacgtcaaccgtgccggcatgctcgaagacctgaacaacctgccgtccggctcgatcgtcgtgctgcatgcctgctgccacaacccgactggcgtcgacctgggcctggacgactggaaaaacgtcctggaagtggtcaaggccaagggccatgtgccgttcctcgacatggcctaccagggctttggtgacggtatcgccgaagacgccttcgccgtgcgcctgttcgccgagtcgggcctggagttcttcgtttccagctcgttctccaagtcgttctcgctgtacggcgagcgcgttggcgcactgtcgatcgtcaccggcaacaaagacgaaagcactcgcgtgctgtcgcaggtcaagcgcgtaatccgcaccacctactccaacccgccgacccacggcgcgaccatcgtcgctaccgtgctgaacagcgacgaactgcgccagatgtgggaagccgagctgggcgagatgcgccagcgcatccacggcatgcgccagcaaatggtcagcctgctggctgaatatggcgccaagcgcgacttcagcttcgttggccgccaggcgggcatgttctcctactcgggcctgaccgttgaacaagtggcgcgcctgaagaacgattttggcatctacgcgctggacaccggccgcatcgcggttgccgcgctgaaccagagcaacatccacgtggtgaccaaggccatcgtcgaagtgctgtaacctattgatttgcctgggagaggctt

SEQ ID NO: 12943 - protein, 398 aa, Pseudomonas putida
MSLFSAVELAPRDPILGLNEAFNADPRTDKVNLGVGVYCNEEGRIPLLRAVIEAETQRAAQHASRGYLPIDGIATYDQAVQKLIFGAESPLLAAGRVVTVQAVGGTGALKIGADFLKRLSPNAVVAISDPSWENHRALFETAGFPVQNYRYYDAPSNDVNRAGMLEDLNNLPSGSIVVLHACCHNPTGVDLGLDDWKNVLEVVKAKGHVPFLDMAYQGFGDGIAEDAFAVRLFAESGLEFFVSSSFSKSFSLYGERVGALSIVTGNKDESTRVLSQVKRVIRTTYSNPPTHGATIVATVLNSDELRQMWEAELGEMRQRIHGMRQQMVSLLAEYGAKRDFSFVGRQAGMFSYSGLTVEQVARLKNDFGIYALDTGRIAVAALNQSNIHVVTKAIVEVL

SEQ ID NO: 12944 - DNA, 1765 bp, Oryza sativa
  CDS (152)..(1450)
gatcaaagcgagacaccttttcttttggcctccttcctcgcgaaaaccaccaaaccaaaacccacacacccacagcttttctccccctcactgctttgctctccagtctccacctcctcctcctcgctgccgcgccgcccatccgccagccatggcgatgtcgtcgtcccgctcggcggccgcgatccgggggcggcgggtcggggcgctggcgagggcgaggaggcacgcgacgagggcgatggcgtcgctgttcggccacgtcgagccggcttccaaggaccccatcctcggcgtcaccgaggccttcctcgccgacccctcccccgacaaagtcaacgtcggcgtcggcgcctaccgggacgacaacggcaagcccgtcgtgctcgagtgcgtgcgcgaggccgagcgccggatcgccggcaacctcaacatggagtaccttccaatgggaggaagtataaagatgattgaagagtcactaaagctggcatatggtgaggattctgatttcatcaaagataagaggattgctgcggtgcaggctctttcaggcacaggtgcatgccggctctttgccgatttccagaggcgtttcttgccaaattcacagatctacatacctacacctacatggtccaatcatcataacatttggagggatgctcaagtacctcaaaggacattcacctattaccatccagagtcaagagggcttgatttcgcaggactgatggatgatattaagaacgctccaaatggttcattctttttgcttcatgcttgtgcccataatcctactggagttgatcctacagaagaacaatggagagagatatcctaccaattcaagataaagaatcatttcccattctttgacatggcataccaaggatttgccagcggtgatccagagagagatgctaaggcaatccgaatcttccttgaagatgggcatcaaattggatgtgctcagtcatatgcaaagaacatgggactgtatgggcaaagggcagggtgcttgagtattctgtgtgaggatgagatgcaagcagtttctgttaagagccaattgcaacagattgcaaggccaatgtacagcaacccacctgttcatggtgcactggttgtctccataatccttaatgatccagaattaaagagtttatggttgaaagaggtcaagggtatggctgatcgaatcattggaatgcggaaggcactccgggaaaatctcgaaggcctaggttcaccattgtcatgggatcacatcaccaatcagattggaatgttctgctacagtgggatgacacctgaacaggtggatcgcttaaccaatgaataccatatttacatgacccgtaatggcagaataagcatggctggtgtaacaacaggaaatgtggcgtatttggctaatgctattcatgaggtcactaaaacgaaatgaagctacttcctcttccctcttcggccaatgaaatgaggcttgcaagcggcggcgttttttttttggggggtggtctattgacctttaagatggttgtactagagaaataatccagtgaacatgctggtgtttctccaacttcggattttccctgtatggaggagagaactagaaacctacccaattttgagagctatagatgccgatcctgttatttcaatcgtcagatgttatgcctgtggcagcctggcaggtcacctcagaaacagagatatgtgaaagagaataaatgcaaatgagctgagcattttgacg

SEQ ID NO: 12945 - protein, 432 aa, Oryza sativa
MAMSSSRSAAAIRGRRVGALARARRHATRAMASLFGHVEPASKDPILGVTEAFLADPSPDKVNVGVGAYRDDNGKPVVLECVREAERRIAGNLNMEYLPMGGSIKMIEESLKLAYGEDSDFIKDKRIAAVQALSGTGACRLFADFQRRFLPNSQIYIPTPTWSNHHNIWRDAQVPQRTFTYYHPESRGLDFAGLMDDIKNAPNGSFFLLHACAHNPTGVDPTEEQWREISYQFKIKNHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKGMADRIIGMRKALRENLEGLGSPLSWDHITNQIGMFCYSGMTPEQVDRLTNEYHIYMTRNGRISMAGVTTGNVAYLANAIHEVTKTK

SEQ ID NO: 12946 - DNA, 1215 bp, Acinetobacter sp
  CDS (1)..(1215)
atgtttcaacatatcccaccgtatgcgggcgatccaatcttgtcgcttatggaacaattcaacgccgattcacgcgaagcgaaagttaatttgagcattggtctttattataatgaagacagtattgtgcctcagcttgacagcgtcattgaagcacaaaaacgcattgaaccacgtcaaaacaaggttaagccatacctgccaatggaaggttttaaaccttaccgtgatgcaattcaaaccttgctctttggtcacaatagcccagcagttaaagcagggcgtgccgtgaccattcagacgcttggtggctcaggtgcacttaaagtgggtgcagattttttaaaaaactatttcccagattcagaagtctgggtaagccagccaacctgggataatcatatcgccatttttaatggtgcaggatttaaaacgcatttttatccgtactttgatgcagaaacacgtggtctcgattttgaaggcatgttagcgacattaaaacagcttccaaagcacagcattgtgctactacatccatgctgtcataacccgactggtgttgatctggtaccggcacaatgggatcaggtcattgacgtattaaaagcaggccatctgattcctttcctcgacattgcctatcagggctttggtgatggcatggagcaagatgcttatgcaattcgtgcacttgatcagtctggtcttaattttattgtcagcaattcgttctccaaaatcttttcactgtatggcgaacgtgtaggcgggctcacctttgtttgtgatgatgccgaagcagctcaatgcacttttggccagttaaaagcgactgtacgtcgaatttattctagtccaccgactacaggtgcatggttggtcgatcaggtcttgaatgatgctgaactcagtcaacagtggcaaaatgaagttaaggagatgcgtgaacgtattctcaaaatgcgtatcattttacgtgatgaattgaccaaggctttaccagatcgtgactttaactatctggtcgatcaaaaaggcatgtttagctatacaggtttgactgcagatcaggtcgataccctgcgtgaagattatgccatctatctggttcgtagtggccgtatttgtgttgcgggtttaaacatgaataatgtctatattgtagccaaagcgatggctgaagtattagccaccgaagtgactcctgcttaa

SEQ ID NO: 12947 - protein, 404 aa, Acinetobacter sp
MFQHIPPYAGDPILSLMEQFNADSREAKVNLSIGLYYNEDSIVPQLDSVIEAQKRIEPRQNKVKPYLPMEGFKPYRDAIQTLLFGHNSPAVKAGRAVTIQTLGGSGALKVGADFLKNYFPDSEVWVSQPTWDNHIAIFNGAGFKTHFYPYFDAETRGLDFEGMLATLKQLPKHSIVLLHPCCHNPTGVDLVPAQWDQVIDVLKAGHLIPFLDIAYQGFGDGMEQDAYAIRALDQSGLNFIVSNSFSKIFSLYGERVGGLTFVCDDAEAAQCTFGQLKATVRRIYSSPPTTGAWLVDQVLNDAELSQQWQNEVKEMRERILKMRIILRDELTKALPDRDFNYLVDQKGMFSYTGLTADQVDTLREDYAIYLVRSGRICVAGLNMNNVYIVAKAMAEVLATEVTPA

SEQ ID NO: 12948 - DNA, 1362 bp, Candida glabrata CBS138
  CDS (1)..(1362)
atgactctgaactacgcgagtgtgcaatgtgtgctgaggatgcgaagcgccgtgatgttaggccgcaggcggttgtcgcggaaagcattaaaacaaagtactttatttgatatccccatggcgccaccggatggtgttttggggctgacggaaactttcaatgcagacgagaacccaaataagattaatttgacagttggggtatataaagatggatggggtcaggtgacaaccttcccttcagtggctcaagctcaaaagattatagacatggatgtgggaatgaacactgatctatcatatttaccgataagtgggtgtgaggatttcaagaagcatacaattaattttctgtatagggacagctgcccgcaagacggccctgcattgattaagaatgatcgaatcagttttatacaaacgctaagtggaactggtgcattagctgtcgcatctaggcttttatcatcttttatttcgagaaagatatggatacccaaaccgtcttggcctaatcacaccaatatatttacccaaaacggttttaccaatcctagattttatagctactatgacagaggcgatttgacgattggaagatggttacaggaattgaggcatgaagttggtaaagactcaaataccaaaacaccacattgtattgttttacatgcctgctgccataatccgaccggccttgatccgacaaaaaagcaatgggaggatataatggatactatttatgaattaggaatgattccaattatagacatggcataccaaggtttagaatcgggcaagctgatagatgacgcatatttactaagactatgtctggacaccagcaggtacaggtcctgggataacggtctatatctgtgccaatcttttgccaaaaacatgggattgtatggagaaagagttggatctttaagtattgtggcacctgaacatgttcctggtgtgaaagaggtcctggactcacaacttaaacagattatcagaagtatgtattcctcccctcctggatatggttcaagagtcgctaaattagtcttatcgaatgataagctcaagtatcaatggtattctgatgttgagacaatggtgaatagactaaaatcggtgagggaaatgatacatgagaggttacaatgggaagagatagttaattttgagcaacaacatggtatgttctatttcacaaaattaggacctgatattgtaaaaaaactcagggaacaatactctatatatttaacgaacgatggcagaatgtccttaagtggcgttaataagagcaatgttgactacttatgcaattccatcaaggctgtgacatctagtaaaacattactgtaa

SEQ ID NO: 12949 - protein, 453 aa, Candida glabrata CBS138
MTLNYASVQCVLRMRSAVMLGRRRLSRKALKQSTLFDIPMAPPDGVLGLTETFNADENPNKINLTVGVYKDGWGQVTTFPSVAQAQKIIDMDVGMNTDLSYLPISGCEDFKKHTINFLYRDSCPQDGPALIKNDRISFIQTLSGTGALAVASRLLSSFISRKIWIPKPSWPNHTNIFTQNGFTNPRFYSYYDRGDLTIGRWLQELRHEVGKDSNTKTPHCIVLHACCHNPTGLDPTKKQWEDIMDTIYELGMIPIIDMAYQGLESGKLIDDAYLLRLCLDTSRYRSWDNGLYLCQSFAKNMGLYGERVGSLSIVAPEHVPGVKEVLDSQLKQIIRSMYSSPPGYGSRVAKLVLSNDKLKYQWYSDVETMVNRLKSVREMIHERLQWEEIVNFEQQHGMFYFTKLGPDIVKKLREQYSIYLTNDGRMSLSGVNKSNVDYLCNSIKAVTSSKTLL

SEQ ID NO: 12950 - DNA, 1260 bp, Candida glabrata CBS138
  CDS (1)..(1260)
atggtaaaaatttcagctacggtgtacaacgatgtcgaaccgatcaagaccgacatattatttgcaacaaagcaaaggtacttgaaggataccagaggtttcaaagttgatttgggtgttggagcatatcgcgctgacaatggtaagccatggattcttccctcggtacgtaaggctgaaaggttggtacaagaggaagatgattatgaccacgaatatctaaatatttgtggtcttgacagtttaacaaacagcgctgctaaagttatacttggggaggattgtccagcattgagagaaagtagggttatctctgtacaatctctgtcaggtgcaggtgccttacatgtggctgctaaatttattaaaaagtacacacctgaaaagaaaatttacttgtcaaacccaacttggcctattcatcagtcaatatttgaaaatgtggatttagagactgattcctacccatattgggatgctaccaataaaagcttggattttgagggtttcataaaggcaattgatcatgccccaagaggatccatatttgttctgcatgcttgtgcacacaacccaacgggacttgatccaacgcaagagcaatggcatcaaattattgaatccattcagaaaggtgatcacatcccactatttgactctgcttatcaaggctttgcgtccggcgatcttgaaagagatgcatatgctatacgctacaccataaatcaattaagagactgtgcacctatatttgtagcacaatcatttgctaaaaatgttggaatgtatggtgagagagttggttgtctgcacttagttctaccggcgcagaaggaggatattgtaccaataaaggatgctataacctcccaactttcgagaattatcagaagtgaaatttcaactccaccagcatacggtgctaaggttgtatcaaaaatatttactacaccagaactgaaggagcaatggtatcaagatttggtgaccatgtcaagtagaatcatatcggttaggacacgtttacgtgacctattagctgagtacaatacacctggaaactgggatcatattgttcagcagtgtggtatgttctcatttacaggactaactcctgagatgaccaagcgattggaaactgaacatgcagtttatatggtgcctactggtagggcatctgttgcaggcctaaatactgggaatgtacaacatgttgctaaggctataaatgaagtggttaatcactttatgaaagattag

SEQ ID NO: 12951 - protein, 419 aa, Candida glabrata CBS138
MVKISATVYNDVEPIKTDILFATKQRYLKDTRGFKVDLGVGAYRADNGKPWILPSVRKAERLVQEEDDYDHEYLNICGLDSLTNSAAKVILGEDCPALRESRVISVQSLSGAGALHVAAKFIKKYTPEKKIYLSNPTWPIHQSIFENVDLETDSYPYWDATNKSLDFEGFIKAIDHAPRGSIFVLHACAHNPTGLDPTQEQWHQIIESIQKGDHIPLFDSAYQGFASGDLERDAYAIRYTINQLRDCAPIFVAQSFAKNVGMYGERVGCLHLVLPAQKEDIVPIKDAITSQLSRIIRSEISTPPAYGAKVVSKIFTTPELKEQWYQDLVTMSSRIISVRTRLRDLLAEYNTPGNWDHIVQQCGMFSFTGLTPEMTKRLETEHAVYMVPTGRASVAGLNTGNVQHVAKAINEVVNHFMKD

SEQ ID NO: 12952 - DNA, 1257 bp, Candida glabrata CBS138
  CDS (1)..(1257)
atgtctgccaccatatttaacaacatcgaagaacttcctgctgatgcccttttcggtatcaagcaaaggtacaatcaagataccagagccaccagagttgacttgggtattggtgcgtaccgtgatgaccaaggcaaaccatgggtgttgccttcggttagaatggctgaaagggcaatccaagaggatccaagctacaatcatgaatacttgggtatcaatggtcttccaagtttgtcttccgctgctgctaatgttatatttggtgaagactccccagctttgaaagaaggcagaaccatctcagttcaatctttgtctggtacaggtgctttgcacattgctgccaagtttatctctaagttcgctgctgacaagaagatttatttgtctcagccaacttgggctaaccacaacgccatcttcaaggcacaaggtttagagactgcttcttatccatactggaagagttctaccaagtcccttgacttggaaggtttcatctcagccatcgaaagtgcgccaaagggttctatattcctgctgcatgcatgtgcacacaacccaactggtttggacccatctgagaagcaatggcccgttatcctggatgctctggtcaagggcgatcacttggccttattcgactccgcttaccaaggttttgcctccggtgacttggacaaggacgcctttgctgtgcgtttgggtgtcgaaaagttggcctccacttcaccaatctttgtatgccagtctttcgccaagaacgtcggtatgtatggtgaaagagtcggttgtttccacttgatcctacctaagcagaatgccaatctcgcaccaatcaagtctgctatcacatctcaaatatctagtattatcagaagtgaagtgtccaactccccagcttatggtgccaagatcgtttctaagattttgaacacaccagagcttactaagcaatggcacgaagacatggttaccatgtcatctagaatcaaggagatgagaatcgcattgagagaccatctagttaagttgggaactccaggtacttgggaccacatcgtcgagcaatgcggtatgttctctttcacaggcttgaccccagagatggttaagagactggaggtccagcacgctgtctacttggtctccagtggtagagcctctattgccggcctaaactccggcaacgttgagtacaccgcaaaggccatcgacgaagtagtccgtcactactcaacttccaagttgtga

SEQ ID NO: 12953 - protein, 418 aa, Candida glabrata CBS138
MSATIFNNIEELPADALFGIKQRYNQDTRATRVDLGIGAYRDDQGKPWVLPSVRMAERAIQEDPSYNHEYLGINGLPSLSSAAANVIFGEDSPALKEGRTISVQSLSGTGALHIAAKFISKFAADKKIYLSQPTWANHNAIFKAQGLETASYPYWKSSTKSLDLEGFISAIESAPKGSIFLLHACAHNPTGLDPSEKQWPVILDALVKGDHLALFDSAYQGFASGDLDKDAFAVRLGVEKLASTSPIFVCQSFAKNVGMYGERVGCFHLILPKQNANLAPIKSAITSQISSIIRSEVSNSPAYGAKIVSKILNTPELTKQWHEDMVTMSSRIKEMRIALRDHLVKLGTPGTWDHIVEQCGMFSFTGLTPEMVKRLEVQHAVYLVSSGRASIAGLNSGNVEYTAKAIDEVVRHYSTSKL

SEQ ID NO: 12954 - DNA, 1287 bp, Staphylococcus aureus subsp
  CDS (1)..(1287)
atgaatcctttagcccaaagcttaaatgaacaacttcaacagtcaaatgcaactgcctttgcaatgttatctgacttaggtcaaaatatgttttatccaaagggcattttatctcaatctgctgaagcaaagagtacaacatataatgcaactataggtatggcgacaaataaagacggaaaaatgtttgcatcatctttagatgcaatgtttaatgatttaactccagatgaaatattcccttatgcgccaccacaaggcatcgaagaattacgtgatttatggcaacaaaaaatgttgcgtgacaatccagagctatcaatcgacaacatgtcacgaccaattgttacgaatgcattaacacatggtttatctctagttggcgatttatttgtaaatcaagatgacactatcttgttaccagagcataattggggtaattacaaacttgttttcaatacaagaaatggtgcaaaccttcaaacatatcctatctttgataaagacgggcattatactactgattcactagtagaagctttacaatcatacaataaagataaagtcattatgattttaaattatcctaataatccgacaggttacacacctacgcataaagaagtgactacgatcgtcgaagcaattaaagcattagctaataaaggtacaaaagttatagctgttgtggatgatgcatactatggtttattctatgaagatgtgtatactcaatcattatttactgcattaactaatttacattcaaatgcaatattacctattcgtttagatggggcaacaaaagaatttttcgcatggggattccgtgttggatttatgacatttggaacgtctgatcaaacaactaaagaagttttagaagccaaagtaaaaggtcttatacgaagcaacatttctagtggaccgcttccaacacaaagcgctgttaagcatgtattaaaaaataataaacaattcgataaagaaatcgaacaaaatattcaaacattaaaagaacgctatgaagtcactaaggaagttgtctatgctgatcaatatcattcacattggcaagcatatgactttaactctggatactttatggcaataaaagttcatgatgttgaccctgaagcattgcgcaagcatttaattgacaagtattctattggtgtcattgcacttaatgctacagatattcgtattgcgtttagttgtgtagaaaaagacgatatcccacatgtatttgattcaattgctaaagcaattgatgacttaagataa

SEQ ID NO: 12955 - protein, 428 aa, Staphylococcus aureus subsp
MNPLAQSLNEQLQQSNATAFAMLSDLGQNMFYPKGILSQSAEAKSTTYNATIGMATNKDGKMFASSLDAMFNDLTPDEIFPYAPPQGIEELRDLWQQKMLRDNPELSIDNMSRPIVTNALTHGLSLVGDLFVNQDDTILLPEHNWGNYKLVFNTRNGANLQTYPIFDKDGHYTTDSLVEALQSYNKDKVIMILNYPNNPTGYTPTHKEVTTIVEAIKALANKGTKVIAVVDDAYYGLFYEDVYTQSLFTALTNLHSNAILPIRLDGATKEFFAWGFRVGFMTFGTSDQTTKEVLEAKVKGLIRSNISSGPLPTQSAVKHVLKNNKQFDKEIEQNIQTLKERYEVTKEVVYADQYHSHWQAYDFNSGYFMAIKVHDVDPEALRKHLIDKYSIGVIALNATDIRIAFSCVEKDDIPHVFDSIAKAIDDLR

SEQ ID NO: 12956 - DNA, 1681 bp, Oryza sativa
  CDS (62)..(1438)
ctccactgcgcactgcaccagcaacgcccccccctgatccctctccacggctgcaccggagatggcttccgcccccttcgccgtctcctcctcaccggcggcttccgccgtggccgcgcgctccaaggtgttgcgaggagggaggagcgaggcgaggactggatgccgcctggggatcacgaggaagaattttggacgtgtcatgatggcccttgcagtagatgtctctcgttttgaaggagtgccgatggcccctccagacccaattctcggggtttcagaagcatttaaggcagatcaaaatgatctgaagctcaaccttggtgttggtgcctatagaacagaagagttacagccttatgtcctcaatgtggtcaagaaggctgaaactcttatgttggagaaaggagaaaacaaggagtatctgccaattgaaggcttagctgcatttaacaaagcaactgcagaactattgtttggagctgataatccagtactcaagcaaggacgtgttgctactcttcagtctctctcaggaaccgggtcgctgcgccttgctgcagcatttatacaaagatatttccctgaagcaaaagtactgatatcatctcccacttggggcaatcacaagaacattttcaatgatgcaaaggtaccttggtcagagtaccgttattacgaccccaagactgttggcttggattttgagggaatgatagctgacatacaggctgccccagatggatcttttgttctgctgcatggttgcgctcacaacccaactggaatagacccaactccggaacaatgggagaaaattgcagatgtcattcaagagaagaaacacatgcctttctttgatgttgcatatcagggttttgccagtggaagccttgatgaagatgcatcttctgtcaggctttttgttcaacggggactggaagtgtttgttgcgcagtcttatagcaaaaaccttggtttatatgcagaaagaattggagcaataaatgttgtctgctcaacacctgaagtcgcaaacagggtgaagagccagctgaaacgattggcacggcccatgtattcgaatccccctattcatggtgctaggatagttgccaacgttgttggggatccaaccatgtttggtgaatggaaacaggagatggaagaaatggcagggcgtatcaagaatgtaagacagaagctttatgatagtttgtctgcaaaggacgacagtggcaaggactggtctttcattctgaggcagataggcatgttctcctacacgggcttgaacaaaactcagagtgataatatgaccgacaaatggcacatatacatgacaaaggatgggagaatttcgttggctggattgtccctggctaaatgcgagtacctagctgacgccatcatcgactccttccataacgttagctagacgaggattcaggtcactgctattgtggttaatccttcaatatgctgggatttttggttccttccagcttgagttcttagccaggattgtatatccggcgctacgtaatttggagataataatgaattttgtctgtgcaacaaactttgcatatgctttgtcgaatgtacactggcactatgttagaagcttgaaatatcgaattgaataataatgagactagcaataagccaaactaattcc

SEQ ID NO: 12957 - protein, 458 aa, Oryza sativa
MASAPFAVSSSPAASAVAARSKVLRGGRSEARTGCRLGITRKNFGRVMMALAVDVSRFEGVPMAPPDPILGVSEAFKADQNDLKLNLGVGAYRTEELQPYVLNVVKKAETLMLEKGENKEYLPIEGLAAFNKATAELLFGADNPVLKQGRVATLQSLSGTGSLRLAAAFIQRYFPEAKVLISSPTWGNHKNIFNDAKVPWSEYRYYDPKTVGLDFEGMIADIQAAPDGSFVLLHGCAHNPTGIDPTPEQWEKIADVIQEKKHMPFFDVAYQGFASGSLDEDASSVRLFVQRGLEVFVAQSYSKNLGLYAERIGAINVVCSTPEVANRVKSQLKRLARPMYSNPPIHGARIVANVVGDPTMFGEWKQEMEEMAGRIKNVRQKLYDSLSAKDDSGKDWSFILRQIGMFSYTGLNKTQSDNMTDKWHIYMTKDGRISLAGLSLAKCEYLADAIIDSFHNVS

SEQ ID NO: 12958 - DNA, 1182 bp, Photobacterium profundum
  CDS (1)..(1182)
atgtttaagcagcttacacaagcacaacttgacccaattttgtcgctttctattgcctatcgtgcagatgatcgtgcagataaaatggatttaggtattggcgtatataaaaatagccaaggtgaaacgccaattatgcaagctgttcagcaggcgcaacagcaagtactagcaacacaaacaactaaatcttacgttggtcttgctggaagtgaagtcttcaaccaatcgatgatggatttgctgcttagtggtacatccgctcatagccgtgctgctgcagtccaaacaccaggggcgagtggtgcactgcgtatgttggctgatttgatgcacctcgcgcagccagatactactgtgtggttaacaaacccaagctatgttaaccataaacccgtaatggaagcggctggcttaaccgttaaatactacccgtattttgaccatgcaacgaagcaagtaaatagcgatgcaatgttggctgaattagcaaaagcaggccctaaagatgttgtattacttcatgggtgttgccataaccccacgggtgcagatatttcattttctgattggcaagctattactgcgctagcaaataagaatggttttttaccgtttgttgatattgcttatttaggttttggtgatggtttagagcaggatggtgctggtctaaagtacatggctgacaacgttgaagaaatgattgtagcggcatcatgctctaaaaactttggtttataccgagaacgtactggcgcagctattgttatcagtgattctttgccagaagcacaaaaagcgaaaggacgtatcctacaactggcgcgagcttcttatactatgccgcctgatcacggtgctgcattagttgctacaattttgacagatgatgcgttaaccgcaacatggaagcaagagcttgatcaaatgcataagcgtttacttagcttacgttctggtttaacaaaagctgtacgagcacaaggttcagatgcatttaatttcatcgagcagcataaaggtatgttctctgtaacgggtttaagcccagagcagatcgagcgtcttcgtgctgaatacggcatttatgcggtcggtgatggtcgaatcaatattgcaggcctgcaagagcagcaattagattatttagcaaatgcacttattacggtaacaaagtag

SEQ ID NO: 12959 - protein, 393 aa, Photobacterium profundum
MFKQLTQAQLDPILSLSIAYRADDRADKMDLGIGVYKNSQGETPIMQAVQQAQQQVLATQTTKSYVGLAGSEVFNQSMMDLLLSGTSAHSRAAAVQTPGASGALRMLADLMHLAQPDTTVWLTNPSYVNHKPVMEAAGLTVKYYPYFDHATKQVNSDAMLAELAKAGPKDVVLLHGCCHNPTGADISFSDWQAITALANKNGFLPFVDIAYLGFGDGLEQDGAGLKYMADNVEEMIVAASCSKNFGLYRERTGAAIVISDSLPEAQKAKGRILQLARASYTMPPDHGAALVATILTDDALTATWKQELDQMHKRLLSLRSGLTKAVRAQGSDAFNFIEQHKGMFSVTGLSPEQIERLRAEYGIYAVGDGRINIAGLQEQQLDYLANALITVTK

SEQ ID NO: 12960 - DNA, 1191 bp, Photobacterium profundum
  CDS (1)..(1191)
atgtttgaaaaaatcactgcagcgcctgccgaccctattcttggcttaactgatgagtttaaaaatgatactcgcccagagaaaattaacttgggtgtaggtatctataaagacgagtcaggaaacacgccagtacttgctacagtaaaaaaagcagaagctattttgctggaaaaagaaacgactaagtcgtacttaggcattccaggtacagcagagtacggtcttgccgttcagcagttattatttggtgctaacgctactattatttcagacaaacgagctcaaacagcacaagctccaggaggtacaggcgcactacgtgttgctgccgagtttattaaacgccaactaggcgatgtgaaagtatggatcagtaacccaacatgggctaaccacatcggtgtattcgcggctgcaggtttagaaacggcttcttactcttattacaatgcagaaactaaagacatcgattttgatgctgctttagctgatcttgcaaacgcaaatgaaggcgatattgttttgctacacggttgctgccacaacccaacaggtatcgaccctgttgaagctcagtggcaccagctagcggcgctgtgtgtagagaaaaagttactgccaatgttcgactttgcatatcaaggtttcgcagtaggcgttgaagaagatgcacaaggtttacgtattttcgccgagcagtgttctgaactattggtggcgagctctttctctaaaaactttggcctatacaacgaacgtgttggcgcgttcactcttgttggtaagaatgcagagcaagctgcaacagcatttagccaagtgaaaagtattgctcgtgttatttactcgaacccgccagcacacggtgcagcaatcgttaccctgattctaaatgatgaagcattgcgtaatgagtgggaacaagaagtagccgatatgcgcaatcgtattcaagaaatgcgcacacttttcgttcaaacattaaaagactgtggtgttgatgctgacttcagctttattgaacgtcaaaatggtatgttttcgttttctggtctaaacaaagaccaagtaaatcgcctaaaagaagagtttggcatttacattgttggttctggccgcattagtgttgctggtatgacaaagaacaacatgctgccattatgtaaaggtattgcagctgtgctataa

SEQ ID NO: 12961 - protein, 396 aa, Photobacterium profundum
MFEKITAAPADPILGLTDEFKNDTRPEKINLGVGIYKDESGNTPVLATVKKAEAILLEKETTKSYLGIPGTAEYGLAVQQLLFGANATIISDKRAQTAQAPGGTGALRVAAEFIKRQLGDVKVWISNPTWANHIGVFAAAGLETASYSYYNAETKDIDFDAALADLANANEGDIVLLHGCCHNPTGIDPVEAQWHQLAALCVEKKLLPMFDFAYQGFAVGVEEDAQGLRIFAEQCSELLVASSFSKNFGLYNERVGAFTLVGKNAEQAATAFSQVKSIARVIYSNPPAHGAAIVTLILNDEALRNEWEQEVADMRNRIQEMRTLFVQTLKDCGVDADFSFIERQNGMFSFSGLNKDQVNRLKEEFGIYIVGSGRISVAGMTKNNMLPLCKGIAAVL

SEQ ID NO: 12962 - DNA, 1221 bp, Parachlamydia sp
  CDS (1)..(1221)
atgtcatttgagataagggatcccatgcctttttttaataatatttctcttttgccaccagacccaattttaaatctttctatagacttctctcttgatcaaaatcctcaaaaaattaatttgagtgcaggaacttataaaactgcagatgggcattcgctagttttcaccagtgtccgaaaagcagaaattgatctgcttcaaaaacatctcaataaagattatcaaccgatagagggaaatagtgttttcctaaaaaattctttagagctgttatttggttcagaccacgctttgtttaccaataaaaaattttttgctgttcaaaccgttggaggaacaagcgctttaagattaggaggagagtttttaaataagcttacttgccaaaaaatttttatttctcaaccatcgtggccaaaccacaaacaggtttttgaaaaaacaggtttaaaaattgattcctatccttacttcgattttaatgcatacaaattaaatttttcagggatgtgccaagccatccgccaaatgccaactggaagcgttatccttctgcatggttgctgtcacaatccatcaggggtcgatccaacttttgaacaatggaaagagctttctcagcttattaaaaaacatgaactcattcctttttttgatatcgcttatcaaggatttgggaaagatttagaactcgatgcacaacctattcggtactttgctagtgaaggccatgaaatgttgatcgcttactctttttctaaaaattttggtttatacggggaacgagtaggttttttgactgttgtgacatctcaacaaaaacaaataccatctatagctagtcaattaaaggttttaattcgtgctaattactccaatcctcctcttcaaggagctcgaattgtttctacaatcttgagttcaccagaattaaccgaagaatggaaaatagaattaaaaaatatgcgtgaccgagttgttgaaatgcggaaaacatttattgcttctttgttagtcaaaggagaagataaaaatttaaactacttgcaacaacaaattggtttatttggtttttgtggattaaattattcccaagtcaatcgtttgcggaaagaatttgctatttatattcctagcgacggacgaatcaatattgcaggattaaacactcaaaatattgaatatgtagtcaatgcaatttcatctgttatggagtag

SEQ ID NO: 12963 - protein, 406 aa, Parachlamydia sp
MSFEIRDPMPFFNNISLLPPDPILNLSIDFSLDQNPQKINLSAGTYKTADGHSLVFTSVRKAEIDLLQKHLNKDYQPIEGNSVFLKNSLELLFGSDHALFTNKKFFAVQTVGGTSALRLGGEFLNKLTCQKIFISQPSWPNHKQVFEKTGLKIDSYPYFDFNAYKLNFSGMCQAIRQMPTGSVILLHGCCHNPSGVDPTFEQWKELSQLIKKHELIPFFDIAYQGFGKDLELDAQPIRYFASEGHEMLIAYSFSKNFGLYGERVGFLTVVTSQQKQIPSIASQLKVLIRANYSNPPLQGARIVSTILSSPELTEEWKIELKNMRDRVVEMRKTFIASLLVKGEDKNLNYLQQQIGLFGFCGLNYSQVNRLRKEFAIYIPSDGRINIAGLNTQNIEYVVNAISSVME

SEQ ID NO: 12964 - DNA, 1191 bp, Rhodopseudomonas palustris
  CDS (1)..(1191)
atgctcgatgcgaccaagacacaacgtgcgcgcggattgttgaccgcgtctgcccgcagcgacgtaccgccgttcatggtgatggacgtgatggccgcggccgaccggatcgaagcggcgggcggtcacgtcattcatatggaagtcggacagccatgggcgccggcgccgcgtgcagcgcttgccgccgcgcatgcggcgctcgacagcagccggatcgactacacgtccgcactcgggattccgtcgctgcgcgcacggatcgcgaagcattatcgcgaaacctatcgctgcgacgtcgatccggaccgcatcgtggtcaccaccgggtcgtcgggcgcgttcatcctatcgttcctggctctgttcgaaccgggcgatcgcgtcgcagtgacggtgccgggctatccgccgtatcgccacattctgaatgcgctcggctgtgtgccggtgccgatcgaaacccacagcgagacgcgtcatgcgctgaccggcgaggcgctgcttgccgcgcaccgcaaggcaccgctgaagggtgtgctggttggcagtcccgccaatccgaccggcacgatgatgacgcgcgaggcgctgaccgaattgatcgcggtcgccgaaagcgaaggcatccgcttcatctccgacgagatctatcacggtctcgactatgcattccccgcggtgaccgctgcggagctgtcaccgaacgcggtggtgatcaactcgttctcgaagtacttctgcatgaccggctggcgcgtcggctggatggtgctgccggagagcctggtgcgtccggtcgagcgtctgcagcagaatctggcgatctcggtgccgacgctgtcgcagatcgccgccgaggcggcgttcgacgggcgcgccgagatggaagcggtcaagcgtggttatgaagagaaccgcgcgatcctgatcgaagggctgccgaaggccggcttgaccgagttcctgccggccgacggcgcattctatctgtacgcggacgtctcggccttcacctccgacagctacgatttcaccaagcggatgctggaagaggcgagggtggcggcgaccccggggatcgatttcgacccggtgcgcggcaagagcttcgtgcggttttcctacgcccgctcggcggacgacatgcgcgaggcggtgcgccggatcacggcctggcttggtcgataa

SEQ ID NO: 12965 - protein, 396 aa, Rhodopseudomonas palustris
MLDATKTQRARGLLTASARSDVPPFMVMDVMAAADRIEAAGGHVIHMEVGQPWAPAPRAALAAAHAALDSSRIDYTSALGIPSLRARIAKHYRETYRCDVDPDRIVVTTGSSGAFILSFLALFEPGDRVAVTVPGYPPYRHILNALGCVPVPIETHSETRHALTGEALLAAHRKAPLKGVLVGSPANPTGTMMTREALTELIAVAESEGIRFISDEIYHGLDYAFPAVTAAELSPNAVVINSFSKYFCMTGWRVGWMVLPESLVRPVERLQQNLAISVPTLSQIAAEAAFDGRAEMEAVKRGYEENRAILIEGLPKAGLTEFLPADGAFYLYADVSAFTSDSYDFTKRMLEEARVAATPGIDFDPVRGKSFVRFSYARSADDMREAVRRITAWLGR

SEQ ID NO: 12966 - DNA, 1194 bp, Neisseria subflava
  CDS (1)..(1194)
atgtaccaacacgtcgaatactatcccggcgacccgattttgagcctagtcgaaaccttcaaaaacgaccagcgccccgaaaaagtcaatttgagcataggcatttatttcgacgacgaaggcaaaatgcccgtattggaatccgtgagccgcgccgaaaccgcccgcgccgccacgcctgcgccgtcgccctatctgccgatggaaggtttgaacacttaccgcagcgcggtgcagcatttattgttcggcaaagacaaccctgcgcttgcgcaaggacgcatcgttaccgtacaaaccttgggcggttcgggcgcgctcaaagtcggggcggatttcctgcaccgctggttccccgaagcgcgcgcctacgtcagcgacccaacttgggacaaccaccgcggcatttttgaaggcgcaggtttcgaggtcggcacttatccttattacgaccccgccaccgtcggcgtgaaattcgacgaaatgaccgcgtttttcaatactctgcccgaacacagcgccttaatcctacacccctgctgccacaacccgaccggcgtggatatgtcggaacagcaatgggacgaagtgttgcaaatcatcaaaacgcgcaagcttattccgtttatggacattgcctaccaaggcttcggcggcgatttggacagcgatgcctacgccatccgcaaagcggtggaaatggatttgcctctgttcgtcagcaattcattctcaaaaaacctgtcgctctacggcgagcgcgtcggcggtttgagcgtggtttgcccgaataaagaagaagcagaattggtgttcggacaactcaaattcaccgtccgccgcatctactccagcccgcccgcacacggcgcctacatcgccgccgatgtgatgaacaaccccgaactttacgccttgtggcaaaatgaagtctatgtcatgcgcgaccgcatccgcgccatgcggcagaaactttacgacgtcttgaccgcgcaaatccctgaccgcgatttcacttatttcatcaaacagcgcggcatgttcagttacacaggattgagcgtggaacaagtccgcaggctgcgcgacgaatttgccgtttacctgctggattccggcaggatgtgcgtcgccgggctgaatgcttcgaatatcgcctatgttgccgatgcgtttgccgaagtgctgaaataa

SEQ ID NO: 12967 - protein, 397 aa, Neisseria subflava
MYQHVEYYPGDPILSLVETFKNDQRPEKVNLSIGIYFDDEGKMPVLESVSRAETARAATPAPSPYLPMEGLNTYRSAVQHLLFGKDNPALAQGRIVTVQTLGGSGALKVGADFLHRWFPEARAYVSDPTWDNHRGIFEGAGFEVGTYPYYDPATVGVKFDEMTAFFNTLPEHSALILHPCCHNPTGVDMSEQQWDEVLQIIKTRKLIPFMDIAYQGFGGDLDSDAYAIRKAVEMDLPLFVSNSFSKNLSLYGERVGGLSVVCPNKEEAELVFGQLKFTVRRIYSSPPAHGAYIAADVMNNPELYALWQNEVYVMRDRIRAMRQKLYDVLTAQIPDRDFTYFIKQRGMFSYTGLSVEQVRRLRDEFAVYLLDSGRMCVAGLNASNIAYVADAFAEVLK

SEQ ID NO: 12968 - DNA, 1329 bp, Bacillus amyloliquefaciens
  CDS (1)..(1329)
atgaagggattgtcgtacatgaatgatgcagcaaaagagctgaacagaacattatctgaagaaaacccgcacgtgcttcatatgctttctgatttgggcagagagttgttttatccgaaaggggtgctgacacaatcggcggaagcgaaagccaaggccggaaagtataatgccacgatcggaatcgccacctcacagggcgagtccatgcacttttcccatattcaagagacactgtccgcctataaccccgatgatatctacgattatgctccgccgcagggaaaagagccgctcagacaggaatggctgaaaaaaatgcgtctcgaaaatccttcattagccggcaaagacatcagcacgccgatcgtgacaaacgctttaacacacgggctgagcatcgccgccgacttgttcgtcaatgaaggggatacgctgcttctgcctgataaatattggggaaattacaatttcattttcggtgtccggcgcaaggcatccattgagacgtacccgctttttcagcaggatgggcgttttaatgcggcggggctgtccgagctgctgaaaaagcaggaagaaaaggcgattgtcgtgctgaatttcccgaataatccgacaggctacacgccgggagaagaggaagcggcagaaatcgtcagcgtgatcctggaggcggcggaggccggcaaagagattgtcgtgctcgtagacgatgcgtattacaatctgttttacgatgaaacggccattcaggaatccatcttcagcaaactcgcccaagtgcacgaccgggtgctttgcgtaaaaatagacggcgcgacgaaggaaaattacgcgtggggtttccgcgtcggttttattacgtacagcacaaaaagcgaaaaagcgctgcgcgtgcttgaggaaaaaacaaaagggattatcaggggaacgatttcaagcgccccgcacccgtcccaaacgtttatgctgcgggcgatgcagtcaccggaatacgagaaagaaaaatcgctgaagtataacatcatgaaaaaacgggctgacaaagtgaaagccgttcttgcagaaaacaagcactatgaagacgtatggacgccttatccgtttaactcgggttatttcatgtgtgtccggctgaaagacataaacgccggcgaattgagagtatcgttgcttgaaaagagaggaatcgggacgatatccattaatgaaaccgatttgcgaatcgcattttcatgtgttgaagaagaacacatcgcggatctgttcgaagaaatttatcaagaagcaaagcagctgcagaaacaggcggaaatatcaggctga

SEQ ID NO: 12969 - protein, 442 aa, Bacillus amyloliquefaciens
MKGLSYMNDAAKELNRTLSEENPHVLHMLSDLGRELFYPKGVLTQSAEAKAKAGKYNATIGIATSQGESMHFSHIQETLSAYNPDDIYDYAPPQGKEPLRQEWLKKMRLENPSLAGKDISTPIVTNALTHGLSIAADLFVNEGDTLLLPDKYWGNYNFIFGVRRKASIETYPLFQQDGRFNAAGLSELLKKQEEKAIVVLNFPNNPTGYTPGEEEAAEIVSVILEAAEAGKEIVVLVDDAYYNLFYDETAIQESIFSKLAQVHDRVLCVKIDGATKENYAWGFRVGFITYSTKSEKALRVLEEKTKGIIRGTISSAPHPSQTFMLRAMQSPEYEKEKSLKYNIMKKRADKVKAVLAENKHYEDVWTPYPFNSGYFMCVRLKDINAGELRVSLLEKRGIGTISINETDLRIAFSCVEEEHIADLFEEIYQEAKQLQKQAEISG

SEQ ID NO: 12970 - DNA, 1260 bp, Ashbya gossypii
  CDS (1)..(1260)
atgtctttgactgcgtttaaccagctagaaatccttcctccggacgcactgttcgatgtcaagaagcggctaacccaagacacgcggtcgtttaaagttgacctcgggctcggggcataccgggacgaaaacgggaagccgtgggtgctaccgtgtgtgcgcgaagcggagaaacagttgatggcggaccccggatacaaccacgagtacctggggattgccgggctggaggagttccgcgcggccgcggcgcgtgtgctactcggcgaagacagcgaggcgctggccgagggccgggtggtgtcggtgcagtcgatttccggcaccggggcgctgcacgtggcggcgaagctacttgcgaagacggtgccagatgcgacggtgtacatgtcggaccccacgtggggcaaccactttgccgtgttcgagacacagggtctgcgcacggcgacgtacccatactgggatgcggcgacccgctcactggacatggagggcgttctgggcgcgctgggcgcggcgccgcgcgggtcggtcttcgtgctgcacgcttgtgcgcacaatccaacggggcttgaccccaacgaggagcaatgggtgcagatcctggacgcggtagccgcgcgcgagcacaccgtgctgttcgatagcgcctaccaggggtttgcgtcgggcagcctggctcgcgacgcgtacgcgctgcgcgccgggctgcggcgcctggccgaggtcacgccggtgcttgtgtgtcagtcctttgccaagaacattggcatgtacggtgagcgtgtgggcgctctgcatgttgtcctgccccgccagcctgccgagtcgctggcgcacgtcaaggctgccgtgctgtcgcagctgagccacatcacgcgctcggagctgtcgaacccgcccgcctacggcgccaagatcgtgaccaaggtcctcaccacccccgaactcgccgctcagtggaagaaggacatgatcaccatgtcgagccgcattgcgcgcatgcgccgcgtgctccgcgaccgtctggtcgagctcggtacacctggcaactgggaccacatcgtccaacagtgcggcatgttctcatacaccggtttgacgaaggagatggtcgcccgcatggaaaaggacttcgccatctacatggtctcctcgggccgcatttcgatagccggccttaacgacagcaatgtcggccacgttgccaacgcaattgacaatgctgttcgccacttctctacacccaagctgtga

SEQ ID NO: 12971 - protein, 419 aa, Ashbya gossypii
MSLTAFNQLEILPPDALFDVKKRLTQDTRSFKVDLGLGAYRDENGKPWVLPCVREAEKQLMADPGYNHEYLGIAGLEEFRAAAARVLLGEDSEALAEGRVVSVQSISGTGALHVAAKLLAKTVPDATVYMSDPTWGNHFAVFETQGLRTATYPYWDAATRSLDMEGVLGALGAAPRGSVFVLHACAHNPTGLDPNEEQWVQILDAVAAREHTVLFDSAYQGFASGSLARDAYALRAGLRRLAEVTPVLVCQSFAKNIGMYGERVGALHVVLPRQPAESLAHVKAAVLSQLSHITRSELSNPPAYGAKIVTKVLTTPELAAQWKKDMITMSSRIARMRRVLRDRLVELGTPGNWDHIVQQCGMFSYTGLTKEMVARMEKDFAIYMVSSGRISIAGLNDSNVGHVANAIDNAVRHFSTPKL

SEQ ID NO: 12972 - DNA, 1332 bp, Ashbya gossypii
  CDS (1)..(1332)
atgacacagacaaaccaggtcagagcaagcaccaaaggagtactgggcatgacaagaaatgtagtaggggcgttcacggctaactggcgctgccgcaggcagcaccaagcgcttggacgggtgccggaggcgatgccagaccagatattggggctcacggagcgattcaaccaggaccggaacccgcacaaggtgaacttgaccgtggggatctacaaggacgacaatggggaggtgacgagcttcccgtccgtggcgcgggcgcagcttatggtggaggggcagcggggcggcaggctggcgtacctgccaattgccgggtgtccgagctacggtgcgagggtcagcgactttttgtacagcgagtgtgcgccgcaggggcgggaattcctagccagcggatgcgtcagcttcatgcagacgctgagtgggacgggggcgctctcgctggcatccctgttcctctcgaacttcatctcgaagacgatctgggtgccgcagccctcgtgggccaaccacatgaatatcttcaagctaaacgggtttgaggaggtccgacggtaccgctactacgaggacggggcggtggacgtcgacagctggcttgcccagctagaacgcgcggccgccgaccggccatatccacagtgtattctgttgcatgcctgctgccacaaccccacgggcgttgaccccacgcgcgagcaatggtcccggatcttgagcgtaatcaacggacttggaatggtgcctatcgtggatatggcctaccaagggttggagtctggtgaccttcgtgccgatgcctacttgttgcggatgtgcctcgagcacagatgggacaacgggctttatgtgtgtcattcttttgcgaagaacatgggtctttatggcgaacgagtggggtccctcagtgtggtgcatccgctgggacaatttcaggctaaggccgcgacagattctcagttgaaatgtataatacgggcttcatactcatcaccgccttcatatggctctcgggtcgcaacgaccgtgctttctgtccccgaaatcaagcaacagtggcatgaagatgtacacgggatgtgcaatagactctggtctgtccgctgcatgttacatgagaaactacggtggcccaagttgatagacagtacctcgcaacacgggatgttttattataccggaattggccctgacgccgtggacaccctgagagagaaatattctgtttatttgaccaaggatggtcgattgtcgctagcaggaataaatactggcaatgttgattacgttgctagggcgcttcgtaacgtatctacatacccgtga

SEQ ID NO: 12973 - protein, 443 aa, Ashbya gossypii
MTQTNQVRASTKGVLGMTRNVVGAFTANWRCRRQHQALGRVPEAMPDQILGLTERFNQDRNPHKVNLTVGIYKDDNGEVTSFPSVARAQLMVEGQRGGRLAYLPIAGCPSYGARVSDFLYSECAPQGREFLASGCVSFMQTLSGTGALSLASLFLSNFISKTIWVPQPSWANHMNIFKLNGFEEVRRYRYYEDGAVDVDSWLAQLERAAADRPYPQCILLHACCHNPTGVDPTREQWSRILSVINGLGMVPIVDMAYQGLESGDLRADAYLLRMCLEHRWDNGLYVCHSFAKNMGLYGERVGSLSVVHPLGQFQAKAATDSQLKCIIRASYSSPPSYGSRVATTVLSVPEIKQQWHEDVHGMCNRLWSVRCMLHEKLRWPKLIDSTSQHGMFYYTGIGPDAVDTLREKYSVYLTKDGRLSLAGINTGNVDYVARALRNVSTYP

SEQ ID NO: 12974 - DNA, 1690 bp, Glycine max
  CDS (263)..(1522)
tcattcttcttacataataggggaaggagaagaaaaaaaatgaaataagaaaaactcaactttgtaattcgtggagggaatacttttccattacgcacgcactttaattacagacgagaaaattataattaatagtaatacagacagcagcatgcgcccaccggttattctcaaaactaccacctctcttttggattcttcttcttcttcaccaccctgtgatcgcagactcaacactctcgctagacacttccttccgcaaatggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggttctttaagagttgggggtgaatttttggctaaacactatcaccaacggactatatacttgccaacaccaacttggggcaatcacccgaaggttttcaacttagcaggcttgtctgtcaaaacataccgctactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatcgcatcatcagtatgcgccaagaacttttcgatgctttatgttccagaggcacacctggcgattggagtcacattatcaaacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaaaacatgttgacaacagttttcaacatgctccctagtccctataggagaacttccattatttttgtttaataattgtcaacatcaacaatgaaaccttttatttgatgtgagatttttaaaggaaacttttctgcctaccgggctccaaaaaaaaaaaaaaaaaaaaaa

SEQ ID NO: 12975 - protein, 419 aa, Glycine max
MASHDSISASPTSASDSVFNHLVRAPEDPILGVTVAYNKDPSPVKLNLGVGAYRTEEGKPLVLNVVRRVEQQLINDVSRNKEYIPIVGLADFNKLSAKLIFGADSPAIQDNRVTTVQCLSGTGSLRVGGEFLAKHYHQRTIYLPTPTWGNHPKVFNLAGLSVKTYRYYAPATRGLDFQGLLEDLGSAPSGSIVLLHACAHNPTGVDPTLEQWEQIRQLIRSKALLPFFDSAYQGFASGSLDADAQPVRLFVADGGELLVAQSYAKNLGLYGERVGALSIVCKSADVASRVESQLKLVIRPMYSSPPIHGASIVAAILKDRNLFNDWTIELKAMADRIISMRQELFDALCSRGTPGDWSHIIKQIGMFTFTGLNAEQVSFMTKEFHIYMTSDGRISMAGLSSKTVPLLADAIHAAVTRVV

SEQ ID NO: 12976 - DNA, 1197 bp, Vibrio vulnificus
  CDS (1)..(1197)
atgactttcatgttctctcaattaccaacaccagctttagatcctattctttctctaaccgttgcttttcgtaacgatccgcgtgaccaaaaagtagaccttggcattggcgtatacaaaaacaacaaaggcgaaacgccaatcatgcgtgcggtgtcccaagcgcaaaaaatcgttgctgatacacagacaaccaagtcgtacgtcggcctagcgggatgcgaagagtttaaccaatcgatggtgaatttattgcttgcgggtacttccgtacttgaccgagtgagtgcgattcaaacaccgggagccagtggcgcactgcgtatgctcggagatttgatgaaagtagcgcagccagacaccaccgtttggatctctaaccctagttatgtgaaccataagccagtgatggaagctgccgggttgaaagtgcgttattaccgctacttcagcccagaaacaaagcaagtcgacatcggccagatgttagatgatcttgctactgcaggtccaaaggatgtcgtactgcttcatggttgttgtcacaacccaacgggagcagacattgattttgctgcttggcaagccatcaccgatttggcagtaaagaacggtttcacaccctttgttgatattgcctaccaaggctttggtgatggccttgaagaagacgcaaaagggctgcagttcatggctgaccgtgttgaagaaatgctgattaccacttcatgttcgaagaattttggtctttaccgtgaacgtactggcgcggccattgtgattggcaaaaacgcaaaagaatcatcaaacgcgaaaggtaagttgctgacactcgcacgttcaacttacaccatgccgcctgatcacggtgctgcattggtcaaaacaatcctacaaaatgtcgaacttacaaccacttggaagcaagaattgtgtgaaatgcagcaacgtttgttaaacctgcgtcaaactttatgtaatgaattgagaaatcaacacaatacgtcacaattcgacttcattgaaagccacaagggtatgtttactgtgctaggctttacacctgagcaaatgggaacgctacgagatgaatatggaatttatggtgtaggtgacgggcgaattaacatcgctggccttacagaagctcacattccatacgtggcagacgcgatagtcaaagtctcacaacgttaa

SEQ ID NO: 12977 - protein, 398 aa, Vibrio vulnificus
MTFMFSQLPTPALDPILSLTVAFRNDPRDQKVDLGIGVYKNNKGETPIMRAVSQAQKIVADTQTTKSYVGLAGCEEFNQSMVNLLLAGTSVLDRVSAIQTPGASGALRMLGDLMKVAQPDTTVWISNPSYVNHKPVMEAAGLKVRYYRYFSPETKQVDIGQMLDDLATAGPKDVVLLHGCCHNPTGADIDFAAWQAITDLAVKNGFTPFVDIAYQGFGDGLEEDAKGLQFMADRVEEMLITTSCSKNFGLYRERTGAAIVIGKNAKESSNAKGKLLTLARSTYTMPPDHGAALVKTILQNVELTTTWKQELCEMQQRLLNLRQTLCNELRNQHNTSQFDFIESHKGMFTVLGFTPEQMGTLRDEYGIYGVGDGRINIAGLTEAHIPYVADAIVKVSQR

SEQ ID NO: 12978 - DNA, 1200 bp, Photorhabdus luminescens
  CDS (1)..(1200)
atgttccagaatgttgatgcttatgctggtgatccgattctttcgctggctgaagaatttaaaaaagatcctcgtgcggaaaaaattaatctgagcatcgggctttattacgatgagcagggagtgactccgcaattgcaggcagtggctaccgcagaagaacaacttagagcgttgtcacagactgcttctctttatctgccaatggagggattggaatcctatcgtcttgcggttcaggaactgttatttggtaaagatcatccggtgttgaaacagcgggtggtggcaacgattcaatcattaggtggttctggcgctcttaaaattggtgctgactttttgcatcgttatttccctgattcagaagtgtggtgcagtgatccaacttgggaaaaccacgcagctatttttgcgggggcaggtattaaggtgaactattacccttattttgatacacagaccaaaggggtaaaattcagtgaaatgctggaaacattcaggaaactgccggcaaaaagcattattgtgatgcacccttgttgccataacccaaccggatcggatctgacctatgatcaatgggatcaagttgttcaaattgttaaagagagagagctcctgccattccttgatattgcttatcaggggcttgcggatgggatggaaaaagatgcttatgccattcgtgctatggcgacagccggtttgccttgtctggtgagcaactctttctccaagatattttctatgtatggtgagcgagtgggtggcttgtctgttatttgtgatgatgagcagaccaaagaacgggtattggggcagttgaaagcaggtgtgcgtcgcgtttactctagcccaccgagttttggtgcacaggttgtggcgaaagtactgactgatcctgctttgaaggcacaatggttaacagaagttgagcatatgcgcttgcgtattttggaaatgcgcacggtgctggtggatgctctgaaaacggcattaccagagaaaaactttgagtattttctgaaacagcgcgggatgttcagctataccggttttagccagaaacaggtggatcgcttgcgccaagaatttgctgtttatctggtcggtaatggccgagtctgtatggcgggcgtcaaccatcgtaatgttgcacgtattgctgaaacatttgcggcggtaaataagtcataa

SEQ ID NO: 12979 - protein, 399 aa, Photorhabdus luminescens
MFQNVDAYAGDPILSLAEEFKKDPRAEKINLSIGLYYDEQGVTPQLQAVATAEEQLRALSQTASLYLPMEGLESYRLAVQELLFGKDHPVLKQRVVATIQSLGGSGALKIGADFLHRYFPDSEVWCSDPTWENHAAIFAGAGIKVNYYPYFDTQTKGVKFSEMLETFRKLPAKSIIVMHPCCHNPTGSDLTYDQWDQVVQIVKERELLPFLDIAYQGLADGMEKDAYAIRAMATAGLPCLVSNSFSKIFSMYGERVGGLSVICDDEQTKERVLGQLKAGVRRVYSSPPSFGAQVVAKVLTDPALKAQWLTEVEHMRLRILEMRTVLVDALKTALPEKNFEYFLKQRGMFSYTGFSQKQVDRLRQEFAVYLVGNGRVCMAGVNHRNVARIAETFAAVNKS

SEQ ID NO: 12980 - DNA, 1191 bp, Photorhabdus luminescens
  CDS (1)..(1191)
atgtttgagaaaatcaccgcagcgcctgccgaccctattcttggcttagccgatagtttccgttctgatcctcgtacaaataaaatcaaccttggtatcggtgtctataaagacgaaacaggaaaaaccccggttctgaccagtgttaaaaaagctgaacaatatttactggaaaacgaaacaacaaagaattatctgccgattagcggcttagccgaatttggccgcgtaactcaagaattactgtttggcaaagatcacccagttgtcacagataaacgcgcccgcacagcacaaagcccaggcggtaccggtgctttacgtattgctgcggatttcattgccaaacagactaatgctaaacgagtttggatcagcaacccaacctggccaaaccataaaaacgttttttccgccgctggtctggaagtctgtgaatataaatactatgacgctgaaaaacacgcgctgaatttcgaagacatgctggcaagcctgtccgaagctcaggctggtgatgttgttctgttccacggctgctgccacaatccgacaggcatcgatccaaccccggcacaatgggctaaactggcagaaatgtctgcggagaaaggctggttgcctatttttgatttcgcttaccaaggatttgccaagggcctaaacgaagatgcagagggcctacgtatttttgcgaaaaatcataatgaactgattgttgccagctcttactccaaaaactttggcctgtacaatgaacgtgtcggtgcctgtactattgttgctagtgacagtgatacagcagaaaaagcgttcagccaagctaaagcgattatccgtgctaactattccaacccacccgctcatggtgcatctattgtcactaccattttgtcaaatgaagacctgaaagcagcttgggaacaggaactgaccaccatgcgcgaacgtatccagcgtatgcgtcaactgtttgtcaataccttgcaggaaaaaggggcaaaacaggatttcagctttattattagccaaaatggtatgttctcattcagtggcctgacaaaagaacaagtagaacgtctgcgtgatgagtttggtatatacgctgtcagttccggtcgtattaacgtcgctggcttgacgttagaaaacatggctccactatgtgaagccattgttgcagtactctaa

SEQ ID NO: 12981 - protein, 396 aa, Photorhabdus luminescens
MFEKITAAPADPILGLADSFRSDPRTNKINLGIGVYKDETGKTPVLTSVKKAEQYLLENETTKNYLPISGLAEFGRVTQELLFGKDHPVVTDKRARTAQSPGGTGALRIAADFIAKQTNAKRVWISNPTWPNHKNVFSAAGLEVCEYKYYDAEKHALNFEDMLASLSEAQAGDVVLFHGCCHNPTGIDPTPAQWAKLAEMSAEKGWLPIFDFAYQGFAKGLNEDAEGLRIFAKNHNELIVASSYSKNFGLYNERVGACTIVASDSDTAEKAFSQAKAIIRANYSNPPAHGASIVTTILSNEDLKAAWEQELTTMRERIQRMRQLFVNTLQEKGAKQDFSFIISQNGMFSFSGLTKEQVERLRDEFGIYAVSSGRINVAGLTLENMAPLCEAIVAVL

SEQ ID NO: 12982 - DNA, 1209 bp, Chromobacterium violaceum
  CDS (1)..(1209)
atgacctcttcgatcttcgccggcgtggagctggcgccgcgcgaccccatcctcggactcaatgaggcgttcaacgccgatacccgcagcaccaaggtcaatcttggcgtgggcgtgtattccgacgacaacggcaagattccactgctggccgcggtgcaggcggccgagaaagctcgcctcgaagcattgccggcgcgcggctaccagccgatcgaaggccccgccgcttacgatgtcgccgtgcagaagctgctgttcggcgagagcagcgaactgctggccgccggccgcgtggtgaccgcccaggcgctgggcggcaccggcgcgctgaagatcggcgcggacttcctgaaacgcctgaatccggccgccaaggtgtacatcagcgacccgtcctgggaaaaccaccgcgcgctgttcgagtccgccggctttgccgtggaaaactacccgtattatcacgcagccagccgcggcgtggatttcgccgcgatgaaggcgcatttgtcctcgctggatgcgggctccatcatcgtgctgcatgcctgctgccacaatcccaccggcgccgacctgtccgccgcgcaatgggaagaagtggtgtcgatctgccgcgagcgcagcctggtgcccttcctggacatggcctaccagggcttcgccgacggcatcgacgccgatgcgctggcggtgcgcctgttcgccgcctcgaatctgcagttcttcgtcgccagctccttctccaagagcttctcgctgtacggagagcgtgtcggcgcgctgtccatcatcacggcagccaaggacgagtcggtccgcgtcttgtcccagctgaagcgcgtgatccgcaccaactactccaatccgcccatccatggcgcggccatcgtcgccgccgtgctgtccagcccggcgctgcgcgcgcaatgggaggaagagctggcgggcatgcgcgatcgcattcgcgacatgcgattggccttgctggaggcgatcaaggcgcaaggcgtggccgtcgacttttccttcatcacggcccagcgcggcatgttctcctacaccggcctgagcgccgcccaggtggaccgcctgcgcgaggagttcggcatttacgcggtatccactggccgcatctgcctggcggccctgaacagcaagaacgtaggctatgtggcctccgccatcgccaaggtggttcaggcctga

SEQ ID NO: 12983 - protein, 402 aa, Chromobacterium violaceum
MTSSIFAGVELAPRDPILGLNEAFNADTRSTKVNLGVGVYSDDNGKIPLLAAVQAAEKARLEALPARGYQPIEGPAAYDVAVQKLLFGESSELLAAGRVVTAQALGGTGALKIGADFLKRLNPAAKVYISDPSWENHRALFESAGFAVENYPYYHAASRGVDFAAMKAHLSSLDAGSIIVLHACCHNPTGADLSAAQWEEVVSICRERSLVPFLDMAYQGFADGIDADALAVRLFAASNLQFFVASSFSKSFSLYGERVGALSIITAAKDESVRVLSQLKRVIRTNYSNPPIHGAAIVAAVLSSPALRAQWEEELAGMRDRIRDMRLALLEAIKAQGVAVDFSFITAQRGMFSYTGLSAAQVDRLREEFGIYAVSTGRICLAALNSKNVGYVASAIAKVVQA

SEQ ID NO: 12984 - DNA, 1194 bp, Chromobacterium violaceum
  CDS (1)..(1194)
atgttccaacatgtagacgcctacgccggcgatcccatcctgtcgctggtggaagctttcggcaaagacccgcgcgagcagaaggtcaacctcagcatcggcctgtattacgacgaggcaggccgcatcccgcggctgaaggcggtggagcaggccgaggcgctgctggccagccagccgcagccgccgtgcacctatctgccgatggacggcatgccggcttaccgcagcgccatccagacgctactattcggcgccgagcatccggcggtgaaagacggccgcatcgccacgctgcagacgctgggcggctccggcgcgctgaaagtgggcgccgacttcctcaagcgctatttcccggcatccggcgtctgggtcagcgacccgacctgggacaaccacgtcgccatcttcgaaggcgcgggcctggccgtggagcgctacccgtatttcgacccggccacccgcggcgtggatttcccggccatgctggccaagctgcagacgctgccggccaagagcatcgtgctgctgcacccgtgttgccacaaccccaccggcgcggacctcaccgacgcgcagtgggaccaggtggtggaagtggccaaggcgcgccagctgattcccttcctggacattgcctaccagggcttcggcgccggtctggaggaagacgcctacgccatccgcgcgatggcagacgccggcatcgccttcctggtcagcaactccttctccaagatcttctcgttgtacggcgaacgctgcggcggcctgtccgtggtgtgcgaaaccgccgccgaggcggcgctggtgtccggccagctcaaggccaccgtgcgccgcaactactccagcccgccgacgcacggcgccagggtgatcgccaccgtgctgaacgatccggagctgaaggcgctgtgggtgtccgaggtgaacgagatgcgcgagcgcatccaggcgatgcgcggcgtgctggtgcaagtgctgaaggaagcgctgcccgagcgcgacttcggctacctggtgaaccagcgcggcatgttcagctacaccggcttcagccaggcgcaggtggacaagctgcgcgagcagttcgccgtctacctggtgggcagcggccgcatgtgcgtggccggcctcaacgccgccaacgcgccctacgtggcccaggccttcgcccaggtgcagtaa

SEQ ID NO: 12985 - protein, 397 aa, Chromobacterium violaceum
MFQHVDAYAGDPILSLVEAFGKDPREQKVNLSIGLYYDEAGRIPRLKAVEQAEALLASQPQPPCTYLPMDGMPAYRSAIQTLLFGAEHPAVKDGRIATLQTLGGSGALKVGADFLKRYFPASGVWVSDPTWDNHVAIFEGAGLAVERYPYFDPATRGVDFPAMLAKLQTLPAKSIVLLHPCCHNPTGADLTDAQWDQVVEVAKARQLIPFLDIAYQGFGAGLEEDAYAIRAMADAGIAFLVSNSFSKIFSLYGERCGGLSVVCETAAEAALVSGQLKATVRRNYSSPPTHGARVIATVLNDPELKALWVSEVNEMRERIQAMRGVLVQVLKEALPERDFGYLVNQRGMFSYTGFSQAQVDKLREQFAVYLVGSGRMCVAGLNAANAPYVAQAFAQVQ

SEQ ID NO: 12986 - DNA, 1233 bp, Plasmodium yoelii yoelii
  CDS (1)..(1233)
atggaaaaatatctttgtgaaataaaagagattgaagcagatgagattttgaaaagtattaacgaatataatgcagacccatctaataaaaaagtgaatctttctattggtgtttgtgcaggtaataatggtagtgttcagatatttaatagtgtattaaaagctgaacaaatcataacagaaaagtataaagaaaaaccatatttattaagtaatgggggggatgtatttagtttattaacacaaaaattaatatttggggaagattctaaatatataaaagaaaacagaataagcacaatacaaactataggaggaacaggagctatagctattgctttggaatttttaaaatgcttcaatatatgtaacccatcaatatatgttacaaatattccatatataaatcatgttaatatgataaaatcaaataaatttaatttaaaatatataaatttttttgataataatttaattgatataaattataatttatttttaaatgatttaaaaaatattgataatgaatcaattatatttttacaaccttcatgttataatccatgtagtataaatataaaatccgaatattttgaagaaattacaaatatagttttattaaaaaaacatataattgtttttgatattgcttatcaaggatttggaaatggagaaatagataatgatgtaattttaattagacaatttcaagaaaaaaatattccttttatagtttgtcaatcttttgcaaaaaatatgtcattatatggtgaacgtgcaggtgctttacatattgtgtgcaaaaatgaaaatgaaaaaaaaaaaattttaagtagcttgttaataataactcgtagattttattcatctcccactatacatacaaatagattagtttgtgaaattttacaaaatcctaatttaaaagaagaatggttaaatgaattaaaagaattatcacaccatatagctaatattaggaatttattttttgataaattacagcaaattcaaaataaatataatttagattatgattggagtgtgtataaaaaacaagtaggactattttcttatgtaccaattttttcagatatatttcaaagtctaaaaaatcatcatatttatattgttaaaactggacgaataaatgtgtcaggaataacaatggataacattgattatataacggaaaaaatttgtctttgcttatcagagcgagcagctagctaa

SEQ ID NO: 12987 - protein, 410 aa, Plasmodium yoelii yoelii
MEKYLCEIKEIEADEILKSINEYNADPSNKKVNLSIGVCAGNNGSVQIFNSVLKAEQIITEKYKEKPYLLSNGGDVFSLLTQKLIFGEDSKYIKENRISTIQTIGGTGAIAIALEFLKCFNICNPSIYVTNIPYINHVNMIKSNKFNLKYINFFDNNLIDINYNLFLNDLKNIDNESIIFLQPSCYNPCSINIKSEYFEEITNIVLLKKHIIVFDIAYQGFGNGEIDNDVILIRQFQEKNIPFIVCQSFAKNMSLYGERAGALHIVCKNENEKKKILSSLLIITRRFYSSPTIHTNRLVCEILQNPNLKEEWLNELKELSHHIANIRNLFFDKLQQIQNKYNLDYDWSVYKKQVGLFSYVPIFSDIFQSLKNHHIYIVKTGRINVSGITMDNIDYITEKICLCLSERAAS

SEQ ID NO: 12988 - DNA, 1449 bp, Neurospora crassa
  CDS (1)..(1449)
atggcgcctgcctcgactttattgcgcgctgccgctcccgctcctcacgcccacacttccttcccctcccaccacacaccaacgtcatcgccaaatcgcacaaccatcaccaacaccaaccctagtgccaactccacctcttctactcccctccaccgaatccagaccatcgccaaacacatggcgctgccacaaataacaagtttccccgccgaggtggtacctcaagcccccgaggatcctctctttgggttggcgagagcgttcaaggcggacccaagtccccaaaaagttgatttgggcatcggcgcgtacagagatgagaatgcgaagccgtgggtattaccagttgtcaagaaggccgatgaaattatacgaaatgaccctgaagccaaccacgaatatctccccatcgccggtctcgcttccctaaccagcaaagccgccgagctcgttgtcggtgcctctgctcccgccatcactgaggggcgcgtcgcctcgatccagaccatctccggcactggcgcctgccatctcggcggtctcttcctctcgcgcttctacaacccatacggcgacgcttccaagaagcccaccgtctacctcagcaatccaacatgggccaaccacaaccagatcttctccaacgtcggcctccccatcgcccaatacccttacttcgaccagaagaccaagggcctcgacattgacggcatgaagaaggccctctctgacgcccccgagcgctccatcatcctcctccacgcctgcgcccacaaccctaccggcgtcgaccctacgctcgcccagtggcgcgagatcgccgagatcatggccgccaagggccactttcccttcttcgacaccgcctaccagggtttcgcttcgggcgacctcgaccgggacgcctccgccatccggctcttcgtcgagctcggtttcgagctcgtagtcgcccagtccttcgccaagaactttggtctctacgggcaacgcgctggctgcttccacttcatctccgctccttcgcccgacgctgcgtccataaccacccgcgtggcctcgcagctcaccctactccagcgctccgagatttctaacccgcccatctacggcgccaaggtggcttcgatcgtcctcaacgaccccgcgctcttcgccgagtggaaggagaacctgcgtaccatgtcgggccgcatcatcgacatgaggaaagctctgcgggcaaagctcgaggagctgggcaccccgggcccgtggaaccacattaccgaccaaatcggcatgttctcatttaccgggttgaacgagaagcaggtggctaagctcagggaggagttccacatctacatgaccaagaacggccgcatcagcatggccggtctaaataagaagaacgtagattacgttgccagggcggtggacaaggttgtcagggaagtgcaatag

SEQ ID NO: 12989 - protein, 482 aa, Neurospora crassa
MAPASTLLRAAAPAPHAHTSFPSHHTPTSSPNRTTITNTNPSANSTSSTPLHRIQTIAKHMALPQITSFPAEVVPQAPEDPLFGLARAFKADPSPQKVDLGIGAYRDENAKPWVLPVVKKADEIIRNDPEANHEYLPIAGLASLTSKAAELVVGASAPAITEGRVASIQTISGTGACHLGGLFLSRFYNPYGDASKKPTVYLSNPTWANHNQIFSNVGLPIAQYPYFDQKTKGLDIDGMKKALSDAPERSIILLHACAHNPTGVDPTLAQWREIAEIMAAKGHFPFFDTAYQGFASGDLDRDASAIRLFVELGFELVVAQSFAKNFGLYGQRAGCFHFISAPSPDAASITTRVASQLTLLQRSEISNPPIYGAKVASIVLNDPALFAEWKENLRTMSGRIIDMRKALRAKLEELGTPGPWNHITDQIGMFSFTGLNEKQVAKLREEFHIYMTKNGRISMAGLNKKNVDYVARAVDKVVREVQ

SEQ ID NO: 12990 - DNA, 1290 bp, Neurospora crassa
  CDS (1)..(1290)
atgctttcctcggtcagacttgtcacgcgcagagctgctgtcagaagcgcttttgcttcccctggtcgcagcttgcttgctgtccgcgccgcctcgttctgggccaacgtcccccaaggtcctcctgatgccattctcggtatcacggaagctttcaaggccgacaccttcgacaagaagatcaatctcggtgtcggtgcctaccgcgatgacaagggcaagccttacgtcctcccctccgtccgcaaggccgaggacaaggtcatccactcccgcatgaacaaggagtacgcaggcatcactggtgtccccgagttcaccaaggccgccgccgttctcgcctacggcaaggacagctccgccctggaccgtcttgtcatcacccagtccatctcgggtaccggtgccctccgcattggtggtgaattcctcaaccgcttcttccccggagccaagaagatctacatccccaccccttcgtgggccaaccacggcgccgtcttccgcgactccggtctcgaggtcgcccagtatgcctactacgacaagaacaccatcggcctcgactttgagggtctgatccgcgacctcaaggctgcccccaacagctccatcttcctcttccacgcctgcgcccacaaccccaccggtgtcgaccccacccccgagcagtggaaggagatcgaggccgtcgtcaaggacaagggccactactccttcttcgacatggcctaccagggtttcgcttccggcgacatccacaaggacgcttttgctgttcgctactttgtcgagcagggccacaacatctgccttgcccagtccttcgccaagaacatgggtctctacggcgagcgtgttggtgccttctccattgtctgtgccgacgccgacgagaagaagcgcgttgactcgcaggtcaagattctggtccgccctctctactccaacccccccattcacggtgcccgcatcgccgccgagatcctcaacacccccgagctctacgagcagtggcttaccgaggtcaaggagatggctgaccgcatcatcaagatgcgcgccctcctcaaggagaacctcgagaagctcggcagcaagcacgactggagccacatcaccagccagatcggcatgtttgcctacaccggtctgacccccgagcagatggagaagctggccaaggagcacagcgtgtatgccaccaaggacggccgtatctctgtcgctggtatcactagcgagaacgttggccgtctcgccgaggccattttcaaggtcaagggttag

SEQ ID NO: 12991 - protein, 429 aa, Neurospora crassa
MLSSVRLVTRRAAVRSAFASPGRSLLAVRAASFWANVPQGPPDAILGITEAFKADTFDKKINLGVGAYRDDKGKPYVLPSVRKAEDKVIHSRMNKEYAGITGVPEFTKAAAVLAYGKDSSALDRLVITQSISGTGALRIGGEFLNRFFPGAKKIYIPTPSWANHGAVFRDSGLEVAQYAYYDKNTIGLDFEGLIRDLKAAPNSSIFLFHACAHNPTGVDPTPEQWKEIEAVVKDKGHYSFFDMAYQGFASGDIHKDAFAVRYFVEQGHNICLAQSFAKNMGLYGERVGAFSIVCADADEKKRVDSQVKILVRPLYSNPPIHGARIAAEILNTPELYEQWLTEVKEMADRIIKMRALLKENLEKLGSKHDWSHITSQIGMFAYTGLTPEQMEKLAKEHSVYATKDGRISVAGITSENVGRLAEAIFKVKG

SEQ ID NO: 12992 - DNA, 1451 bp, Mus musculus
  CDS (62)..(1276)
agcgctgccaaggttctggaagaaagaggcctgaaattattggcaccgcacgtgctcaactatgaccagtctttctgtgttcagggatgtacccacagcccagaagctagaaggcagcttactaaagatctacaggcaagatggctatcccagcaagttgttcctggcctacaaagtctgcatgaccgaagaaggccatccctgggtttctcttgtggtgcacaagacccgcctgcagattgcagaggacccctctctggactatgagtacttgcccctggtgggcctgaaatcattcatccagtcttctctggaactcctctttggaaagcacagcgaagccattgcggagaaaagggttgggggtgtgcacatcgttggtgagagtggagccttccagcttggggctcagttcctcaagacgtggcgaaagaatgtgaaaatcgtttgtatcgtctcatgtcaaaaagaacagtgtggactcatcttccaggacatgggctttatagtttatgagtactctatctggaacgccagtgatctctgctcagaccccagcatgttcgtggaagtactccagcatatcccggtcggcagcatccttgtgattgggaacatcactgattgcaagttcacacagaatcagtggacgaaactgatgtccatcattaagagcaagcagatattcccattctttgacattccctgtcaaggtttatccactggtgacctcgaggaagataccaaaatcttacagtactttgtgtccctaggcttggagttcttctgcagccaatctctgtccaagaattttggcatttatgatgaaggagtggggatcctagtagtggctgccctcagcaaccagcacctgctgtgtgtcctctcccagctgatggattatgtccaggccctgtggggaaaccctcctgccacgggtgctcggataatcacctccatcctctgcaaccctgctctgtttggagaatggaagcagagtctcaaaggtgtggtggagaacatgatgctgatcaaggagaaagtgaaggagaagctgcggctcctagggacccctgggtcgtgggatcacatcacccgacagagcgggacccatggttatctgggactcacctatcaacaggtggagtttctggtcaagaagaaacatatctacttgcccaaaactagccggatcaacttcacctgcatcaatgccaggaatatagactacatcactcagagcatccatgaggccgtgatgctaacagagggctgagagggtgtctgctcaaaactgcccctgactggaacgaaagctttacgctgtctttgaaaataaaaatcctggaggaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12993 - protein, 404 aa, Mus musculus
MTSLSVFRDVPTAQKLEGSLLKIYRQDGYPSKLFLAYKVCMTEEGHPWVSLVVHKTRLQIAEDPSLDYEYLPLVGLKSFIQSSLELLFGKHSEAIAEKRVGGVHIVGESGAFQLGAQFLKTWRKNVKIVCIVSCQKEQCGLIFQDMGFIVYEYSIWNASDLCSDPSMFVEVLQHIPVGSILVIGNITDCKFTQNQWTKLMSIIKSKQIFPFFDIPCQGLSTGDLEEDTKILQYFVSLGLEFFCSQSLSKNFGIYDEGVGILVVAALSNQHLLCVLSQLMDYVQALWGNPPATGARIITSILCNPALFGEWKQSLKGVVENMMLIKEKVKEKLRLLGTPGSWDHITRQSGTHGYLGLTYQQVEFLVKKKHIYLPKTSRINFTCINARNIDYITQSIHEAVMLTEG

SEQ ID NO: 12994 - DNA, 1194 bp, Rhodopirellula baltica
  CDS (1)..(1194)
atgcaccgattcgactccatctccgttgccccgcccgacgccattttgggactgaccgaagcgttcaaagccgatgaacgcgaaaccaaaatgaatttgtccgtgggcgtgtaccaagacgcttccggcaccacccccgtgcttcgctgcgtcaaagaagccgaaaaacggctgttggatacagaatcgaccaagggatacctctcgatcgacggcctgccggactaccgcgaagccgcccgccgattgatcttctccgaccaaatcgctgccgagcgagtggcagcggttcagacgccgggcggaaccggagccctccgtgtggcggcagaattcctggccactcagtgcggaccgctacgaattttcttgcccacgccaacctgggccaaccacaacgcgatcatggccgcggccggactgccggtggaaacgtattcctacctggcgtctgacaaaaagacgctggacttcgacgcactcatcgaagacctgaagaccaaacccaaggccggcgatgcggttctgctgcatgcgtgctgccacaacccaaccggagtcgacccgacaccggaacagtgggaacaaatcgcgagcgtggtctccgaaaagaaactgatcccattgctggactttgcctaccaagggttcggcgaaggcctggacgaagacgccatcggtgtgcgcacgattctgcgacagatggatgaagccatcgtctgctcgtcattcagcaaaaactttggcctgtacagcgaacgagttggaacagcgtgcttggtatccgggtcagccgaaacgaccaaagccgctctcagccaactcaaacgagtcgtccgagccaactacagcaacccacctcggcacggcggcgcgatcgtggccactgtgttggccgatgagggactgacccaaatgtggcacgaagagctcgccgaaatgcgaactcggatcgcctccctacgaaaacaattcgttgatggaatggccgcgacgggagtcgaccaagacttctcgttcttgctggaccaaaaaggcatgttctctttcagtggtttgtcaccgatgcaggtcgaccaactgcgaagcgaacatggcgtgtatctggtcggtagcggtcgaatcaacgtcgccggaatgaacgaatcgaagatggaatggttgtgcaatgccgtggcggcggtattgcgatag

SEQ ID NO: 12995 - protein, 397 aa, Rhodopirellula baltica
MHRFDSISVAPPDAILGLTEAFKADERETKMNLSVGVYQDASGTTPVLRCVKEAEKRLLDTESTKGYLSIDGLPDYREAARRLIFSDQIAAERVAAVQTPGGTGALRVAAEFLATQCGPLRIFLPTPTWANHNAIMAAAGLPVETYSYLASDKKTLDFDALIEDLKTKPKAGDAVLLHACCHNPTGVDPTPEQWEQIASVVSEKKLIPLLDFAYQGFGEGLDEDAIGVRTILRQMDEAIVCSSFSKNFGLYSERVGTACLVSGSAETTKAALSQLKRVVRANYSNPPRHGGAIVATVLADEGLTQMWHEELAEMRTRIASLRKQFVDGMAATGVDQDFSFLLDQKGMFSFSGLSPMQVDQLRSEHGVYLVGSGRINVAGMNESKMEWLCNAVAAVLR

SEQ ID NO: 12996 - DNA, 1191 bp, Haemophilus ducreyi
  CDS (1)..(1191)
atgttcaatcatatcgaggccgctctaaccgatccaattttaggtttaaatgatgccttccgagcagatattcgaaaaacaaaaactaatttgggcattggtgtgtatatgaatgccgaaggtcagacaccgattatgaatgccgtaaaattagcagaaacgcgtttacttgctgaagaatcacaaaagaattatcttcagattgatggtatcgcacactttaatagttatacgcaaaccttattatttgggcaagatgccgatgttattcaaacggggcgagtaaaaacagcacaaagtttaggtggcacaggcgcattacgtatagcaatggagtttattaagcgccaaactgacgcaaagactatttggatatcaaacccaacttggcctaatcataatgcaattgctgaagcggttggcttaacgataaaaaactaccgctattataatcccgaaactaacggcttagattgggataatctgttggctgacttgcaacaagctgaacgtggcgatgtagtgttattacacggttgttgccataacccgaccggtatcgatccaacagcagaacagtgggataaactcgctatactttcagctgaaaaaggctggttacctttatttgatttcgcttatcaaggattagccaatggcttagatgaagatgcttacggtttacgtgcatttgctaaaaaccataaagaattattaatcgcgagttcttattcaaaaaattttggtttatataatgaacgcgtgggcgcttttactttagtggcagaaaatgcagaaatagcaaataatgcatttactcaaattaaatcgattattcgagtgctctattctaatccagcggcacacggtgctcataccgtaaccaccgtattggctgatgatcaattacgcgcaaattggatcgctgaattaagtgagatgcgtgatcggattaaaacgatgcgaactaaaatggttcaattactagctgaaaaaggcgcgaaaaaagatttctcatttatttctgatcagaatggtatgttttcattcagcggtttaaccgctacacaagtcgaccgtttacgtgatgaatttgcaatttatgcggttcgttctgggcgaataaatgtagccggacttactgatgataatatcgaagcgttttgcgatgctgtagtaaaagtactttag

SEQ ID NO: 12997 - protein, 396 aa, Haemophilus ducreyi
MFNHIEAALTDPILGLNDAFRADIRKTKTNLGIGVYMNAEGQTPIMNAVKLAETRLLAEESQKNYLQIDGIAHFNSYTQTLLFGQDADVIQTGRVKTAQSLGGTGALRIAMEFIKRQTDAKTIWISNPTWPNHNAIAEAVGLTIKNYRYYNPETNGLDWDNLLADLQQAERGDVVLLHGCCHNPTGIDPTAEQWDKLAILSAEKGWLPLFDFAYQGLANGLDEDAYGLRAFAKNHKELLIASSYSKNFGLYNERVGAFTLVAENAEIANNAFTQIKSIIRVLYSNPAAHGAHTVTTVLADDQLRANWIAELSEMRDRIKTMRTKMVQLLAEKGAKKDFSFISDQNGMFSFSGLTATQVDRLRDEFAIYAVRSGRINVAGLTDDNIEAFCDAVVKVL

SEQ ID NO: 12998 - DNA, 1221 bp, Candidatus Blochmannia floridanus
  CDS (1)..(1221)
atgtttaaatcaatgataatggctccaccagacccaattcttggattatcaaaaatttatcattctgacactaaaaaaaacaaaattaatcttggtattggagtatatatagaaaaatttcatgcagctccaattttagaaagcgttaaacaagctgaagatttattactcaaaaaagaaattagtaaaaattatcttgctattgaaggttctaatgactttaataatgccaatcaaacattattatttggaccaaatgactcaataatatcaaaaaataggattagaactgttcaagctcctggaggaactggagcattgagaatagccgcggaatgtattgcaaaatatgataatactataaataaaaaaagacgaatatggattagcgaacctagctgggtaaatcataaaaatattttttttgctgctggattagaagtatgtacttatccatattatcaaaaatctacacactccattgaatttgataaactgattgatactttcaacaatatagtaaaacctggagatatagttttattacacggttgttgtcataatccaaccggaatggatcctactatagaacaatggaaaatgttatctgaatgtgcagaaaaaaatagatggatacctttgtttgatctggcatatcaaggatttgataatggattacaagaagacttgataggattacatatgttttgtaaaaacaatccagaattaatagtctgtaattcttactccaaaaattttggtttgtataacgaacgtgtaggagcatgtactataattactgaaaacaataatcatgctgattgtgtgctaagccaactacgagcgaccattagggcaatttattctaatccaccagcacatggagctgccattgtatctacaattttacaaaataaaacactacgtttcatttgggaaaaagaattaaaaaatatgagagatcatattaaaaatatgcgtaaattgttatttaatacactgaataaatataaaaatagtaaagtaataaatcaagattttagttttattaataatcaaaaaggtatgtttgcctatataggattaaactctaatcaagtaattaaattacgtgaagaattaggaatttatttagtagattctggtaggctaaacttagcaggtttatcacacaaaaatatcgattacatatgtaatgcaatatgtaacttatacatttaa

SEQ ID NO: 12999 - protein, 406 aa, Candidatus Blochmannia floridanus
MFKSMIMAPPDPILGLSKIYHSDTKKNKINLGIGVYIEKFHAAPILESVKQAEDLLLKKEISKNYLAIEGSNDFNNANQTLLFGPNDSIISKNRIRTVQAPGGTGALRIAAECIAKYDNTINKKRRIWISEPSWVNHKNIFFAAGLEVCTYPYYQKSTHSIEFDKLIDTFNNIVKPGDIVLLHGCCHNPTGMDPTIEQWKMLSECAEKNRWIPLFDLAYQGFDNGLQEDLIGLHMFCKNNPELIVCNSYSKNFGLYNERVGACTIITENNNHADCVLSQLRATIRAIYSNPPAHGAAIVSTILQNKTLRFIWEKELKNMRDHIKNMRKLLFNTLNKYKNSKVINQDFSFINNQKGMFAYIGLNSNQVIKLREELGIYLVDSGRLNLAGLSHKNIDYICNAICNLYI

SEQ ID NO: 13000 - DNA, 1203 bp, Bordetella bronchiseptica
  CDS (1)..(1203)
atgagcactcttttcgcttccgtcgaactcgcgccgcgcgaccccattcttggcctgaacgaacagtacaacgccgatacccgtcccggcaaagtgaacctgggcgtgggcgtgtactacgacgacgaaggccgcatcccgctgcttcaggccgtgcgcaaggccgaggtggcccgcatcgaagccgccgccgcccgcggctatctgccgatcgaaggcatcgcggggtacaacaagggtgcgcaggcgctgctgctgggcgccgactcgccgctggccgccgaaggccgcgtgctgaccgcgcaggccctgggcggcaccggcgcgctgaagatcggcgccgacttcctgcgccagctgctgccgcagtccaaggtcctcatcagcgaccccagctgggaaaaccaccgcgccctgttcgagcgcgccggcttcccggtcgagacctacgcttattacgatgccgccacccatggcctgaacttcgaagccatgctggccgccctgcaggccgcgcccgaacagaccatcgtggtgctgcacgcctgctgccacaacccgaccggcgtcgatcccacgccgcaacagtgggaacagatcgccgccgtggtcaaggcgcgcaacctggtgccgttcctcgacatcgcctaccagggcttcggcgaaggcctggagcaggacgccgccgtggtgcgcatgttcgccgcgctcgacctgaccatgttcatcagctcgtcgttctccaagtccttctcgctgtatggcgagcgggtcggggccctgaccgtggtggccggcagcaaggacgaggccgcccgcgtgctcagccagctcaagcgcgtgatccgcaccaactactccaacccgcccacccacggcggcaccgtggtgtccacggtcctgaacacacccgagctgttcgcgctctgggaaaatgaactggccggcatgcgcgaccgcatccgcctgatgcgcaaggagctggtcgagaagatcaaggcccagggcgtggcgcaggacttcagcttcgtgctggcgcagcgcggcatgttctcgtactcgggcctgaccgccgcccaggtcgatcgcctgcgcgaagagcacggcatctacgcggtctccagcggccgcatctgcgtggccgcgctcaacagccgcaacatcgacgcggtcgcggccggcatcgccgcggtgctgaagtag

SEQ ID NO: 13001 - protein, 400 aa, Bordetella bronchiseptica
MSTLFASVELAPRDPILGLNEQYNADTRPGKVNLGVGVYYDDEGRIPLLQAVRKAEVARIEAAAARGYLPIEGIAGYNKGAQALLLGADSPLAAEGRVLTAQALGGTGALKIGADFLRQLLPQSKVLISDPSWENHRALFERAGFPVETYAYYDAATHGLNFEAMLAALQAAPEQTIVVLHACCHNPTGVDPTPQQWEQIAAVVKARNLVPFLDIAYQGFGEGLEQDAAVVRMFAALDLTMFISSSFSKSFSLYGERVGALTVVAGSKDEAARVLSQLKRVIRTNYSNPPTHGGTVVSTVLNTPELFALWENELAGMRDRIRLMRKELVEKIKAQGVAQDFSFVLAQRGMFSYSGLTAAQVDRLREEHGIYAVSSGRICVAALNSRNIDAVAAGIAAVLK

SEQ ID NO: 13002 - DNA, 1200 bp, Bordetella bronchiseptica
  CDS (1)..(1200)
atgttcgagcacgttcaagcctatccgggcgaccccatcctcagcctgaacgaggatttccagaaagatccccgggccggcaaggtcaacctgaccatcggcatctatttcgacgaagccggccgcatccccgtcatggccgccgcccgcgaggccgaggccgcgctgctggccgacatcgggccgcgcccctacctgccgatggccggcctgccggcctatcgcgacctggtgcaggagctggtgttcggcgccggcagcgccgcgcgccgcgccggccgtatcgccacggtgcagacgctgggcgggtcgggcgcgctgaaagtgggcgccgacttcctcaagcgctattttcccaagtcggaagtctgggtcagcgacccgagctgggaaaaccatcgcaccattttcgagggcgccggcttcgcggtgcacacctatccctattacgacgacgccagcggcggcctgcgctttgacgaaatgctggccacggtgggcggcctgccggccggcagcgtcgtgctgctgcacgcctgctgccacaacccgaccggcgtggacctcgatcgcgcccagtgggacgcgctgattccggtgctgcgcgagcgcggcctgatcgccttcgtcgacatggcctaccagggcttcggcgatggcctggacgacgacgcctatgccgtgcgggccatcgccgaggcgggcgtgacctgtgtggtggccaactcgttctcgaagaatttctcgctgtacggcgagcgctgcggcgggctgagcgtggtgtgcgaaaccgccgagcaggctggctgcgtgctgggccagctgaccagcaccatccgcgccatctacagcaacccgcctacccatggcgcgcgcatcgtcgcccaggtgctgggcacgccggcgctgcggcaatcgtgggaggccgagctgggcgccatgcgcgagcgtatccaggcgatgcggcgcgccatccatgacggcctggccggccgcgtcgagccgcgcatgctgcagcgctacctgtcgcagcgcggcatgttcacctacaccggcctgggcgccgagcaggtcgagaccttgcggcgcgaccagggcgtgtatctgctgcgctcgggccgcatgtgcgtggcgggcctgaaccgcgacaacgtggcggtggccgccgacgccatcgccagcgtgctggcgcgcggctag

SEQ ID NO: 13003 - protein, 399 aa, Bordetella bronchiseptica
MFEHVQAYPGDPILSLNEDFQKDPRAGKVNLTIGIYFDEAGRIPVMAAAREAEAALLADIGPRPYLPMAGLPAYRDLVQELVFGAGSAARRAGRIATVQTLGGSGALKVGADFLKRYFPKSEVWVSDPSWENHRTIFEGAGFAVHTYPYYDDASGGLRFDEMLATVGGLPAGSVVLLHACCHNPTGVDLDRAQWDALIPVLRERGLIAFVDMAYQGFGDGLDDDAYAVRAIAEAGVTCVVANSFSKNFSLYGERCGGLSVVCETAEQAGCVLGQLTSTIRAIYSNPPTHGARIVAQVLGTPALRQSWEAELGAMRERIQAMRRAIHDGLAGRVEPRMLQRYLSQRGMFTYTGLGAEQVETLRRDQGVYLLRSGRMCVAGLNRDNVAVAADAIASVLARG

SEQ ID NO: 13004 - DNA, 1586 bp, Drosophila melanogaster
  CDS (1)..(1251)
atgtccatctacgccgacgttccaaaaggacccgccatcgaggtcttcgccctgacgcaggccttcaaggacgacagcaatcccaacaaggtcaatttgtcggtgggcgcttacaggacagatgctggagttccttgggttttgcctgtggtgcgcaagacggaaatcagcattgccagcgatgagcaggttaaccacgagtatttgccagtgactggactcgaaacattcaccaatgcggccactgaattggttctgggtgccgattccccagccatcaaggagaatcgcgcctttggagtgcagaccatttcgggcacgggtgccctgcgcgttgccgccgatttcctgcacacacaactgaatcgcaatgtggtttactactcgaaccccacctgggagaatcaccacaagatcttttgcgatgccggctttacgaccgttaaatcgtaccgctactgggaccaaaataaacgcgagttggacttcaagaacatgctggccgatctgaacgatgctccgcccggtgctgtgatcattctgcacgcctgtgcccacaatcccaccggcattgatcccacccaggagcagtggactgagctggccgatctgatggagaagaagaagttgttcccgctgttcgactcggcttaccagggctttgccagtggtgatcccgatcgcgatgcctgggccgctaggtacttcgtgcagcgtggcttcgagctcttcatctgccagtcgttcgccaagaactttggcctctactgcgaacgtaccggcaatctgactgtggtgcaaaagaatggtgctaccaaggcagcggttcactctcagctgacgctgctcattcgtggacagtactcgaatccgcccgcgtatggagctcgcatcgtttccaaagtcctaaacacaccggagttgcgcaaggagtggatggcctccatccaggcaatgtcgagccgcatccgcgagatgcgtacagctttgcgggacaagctggttgccttgggcacccccggcacctgggatcacattgtcaaccagatcggcatgttctcctacaccggtctgaacgagagccatgttcgtgtgctgatcgaccagtaccacatttacctgctgaagacgggacgcatcagcatgagtggcctgaataagggcaacgttgaatatgtggccaaggcgatccatgccgctgtcaccggatcaggagaaagtgcatcatgtccttgcgaaaacaaattgtaatcgtaccattggatcgcaccattggatagatacgtacaacgactagctatgtacatatattgggcatgcgatttagaaatcccaaagctggatcacagatgtctgcaccattggcatttaaatcaaaccaacaacaattgcaattactaaacgtttatacgcggcttttagatggatatacacatattatacaccggaaacgaatgttccacattaaagtaaaaactttacaaaaattacgcactattgaaagccgtcgaagattggttaaataatttaagcttacaacgtttattgacctgtgtgtagtaactaaataaatcgacaatatcatt

SEQ ID NO: 13005 - protein, 416 aa, Drosophila melanogaster
MSIYADVPKGPAIEVFALTQAFKDDSNPNKVNLSVGAYRTDAGVPWVLPVVRKTEISIASDEQVNHEYLPVTGLETFTNAATELVLGADSPAIKENRAFGVQTISGTGALRVAADFLHTQLNRNVVYYSNPTWENHHKIFCDAGFTTVKSYRYWDQNKRELDFKNMLADLNDAPPGAVIILHACAHNPTGIDPTQEQWTELADLMEKKKLFPLFDSAYQGFASGDPDRDAWAARYFVQRGFELFICQSFAKNFGLYCERTGNLTVVQKNGATKAAVHSQLTLLIRGQYSNPPAYGARIVSKVLNTPELRKEWMASIQAMSSRIREMRTALRDKLVALGTPGTWDHIVNQIGMFSYTGLNESHVRVLIDQYHIYLLKTGRISMSGLNKGNVEYVAKAIHAAVTGSGESASCPCENKL

SEQ ID NO: 13006 - DNA, 1191 bp, Chlamydophila caviae
  CDS (1)..(1191)
atgagttttttcaatcaattacccacgttctcacctgattctattttaggtttgcaaaaactatttttagaagatgagcgagaggaaaaggtgaatcttgttataggtgtctatgaagatcctagcaaggcatatggtggtttttctagcgtccgtaaggcgcaatttctttttttagaagatgagatgaataaggggtatttacccatcagtggcttatcttcttttaatcaagaaatggaaaagctggtttttggtgatgtaaattctagttttgttgttggtgctcaggcgctagggggaactggagctttgcatttaggggctaagattttttctatggcctatacctcaggcaaagtatacattcccgagcaaacttggggaaaccacgtaagaatatttgctcaacaaggtttagaggttcttaaatacccttattatagctcagaaagcaaaagtttgctttttgatgagatgctttctgtattgaaagccgctccaaaaaattctttggtgcttttgcagtgttgttgtcataatcctacgggaatggatcttaatgaagatatgtggacacgtcttgctgaagttatgaaagaacatcagcttcttccattttttgataccgcttatttaggttttgggcgaggcatcaaagaagataggcgtcctatagagattttcatagaagttggtaatcccgtatttgtagcagcatgcgcaagtaaaaatttttctctttatggagagagggtaggctacttcgcagttcatagcaaaattactgaggatttagataagatttctagctgtctcgaagagaaagcccgtggagaatattcttcacctcctagacatggagctaaaattgtttcaacgattttatccgacgcttctttgaagaaagaatggttgtcagaattagatacgattcgtagttctttagggaaaactcgcgcaagacttgttcaagctatgcgaaatcacgtcggtcattcgtttgactttatcttgtctcagaagggattttttggttatcccggattttctgtagaacaggtgctctttttaagatcagagaagggtatctatacgacgagtggagcaagatttaacttaaacggaattactgataaaaatatcgaccacgtctctcagagttttgctgaggcgtatcagttgtcttag

SEQ ID NO: 13007 - protein, 396 aa, Chlamydophila caviae
MSFFNQLPTFSPDSILGLQKLFLEDEREEKVNLVIGVYEDPSKAYGGFSSVRKAQFLFLEDEMNKGYLPISGLSSFNQEMEKLVFGDVNSSFVVGAQALGGTGALHLGAKIFSMAYTSGKVYIPEQTWGNHVRIFAQQGLEVLKYPYYSSESKSLLFDEMLSVLKAAPKNSLVLLQCCCHNPTGMDLNEDMWTRLAEVMKEHQLLPFFDTAYLGFGRGIKEDRRPIEIFIEVGNPVFVAACASKNFSLYGERVGYFAVHSKITEDLDKISSCLEEKARGEYSSPPRHGAKIVSTILSDASLKKEWLSELDTIRSSLGKTRARLVQAMRNHVGHSFDFILSQKGFFGYPGFSVEQVLFLRSEKGIYTTSGARFNLNGITDKNIDHVSQSFAEAYQLS

SEQ ID NO: 13008 - DNA, 1236 bp, Shigella flexneri
  CDS (1)..(1236)
atgtgttttaaccacctgcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaattgaaagccgtggcggaggcggaagcgcgcctgaatgcgcagccccatggcgcttcgctttatttaccgatggaagggcttaacagctatcgccatgccattgcgccgctgctgtttggtgcggaccatccggtactgcaacaacagcgcgtagcaaccattcaaacccttggcggctcaggggcattgaaagtgggcgcggatttcctgaaacgctacttcccggaatcaggcgtctgggtcagcgatcctacttgggaaaaccacgtagcaatattcgccggggctggattcgaagtgagtacttacccctggtatgacgaagtgactaacagcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttatcccattcctcgatattgcctatcaaggatttagtgccggtatggaagaggatgcctacgctattcgcgccattgccagtgctggattacccgctctggtgagcaattcgttctcgaaaattttctccctttacggcgagcgcgtcggcggactttctgttctgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaa

SEQ ID NO: 13009 - protein, 411 aa, Shigella flexneri
MCFNHLPVNLENHRVFQKVDAYAGDPILTLMERFKEDPRSDKVNLSIGLYYNEDGIIPQLKAVAEAEARLNAQPHGASLYLPMEGLNSYRHAIAPLLFGADHPVLQQQRVATIQTLGGSGALKVGADFLKRYFPESGVWVSDPTWENHVAIFAGAGFEVSTYPWYDEVTNSVRFNDLLATLKTLPARSIVLLHPCCHNPTGADLTNDQWDAVIEILKARELIPFLDIAYQGFSAGMEEDAYAIRAIASAGLPALVSNSFSKIFSLYGERVGGLSVLCEDAEAAGRVLGQLKATVRRNYSSPPNFGAQVVAAVLNDEALKASWLAEVEEMRTRILAMRQELVKVLSTEMPERNFDYLLNQRGMFSYTGLSAAQVDRLREEFGVYLIASGRMCVAGLNTANVQRVAKAFAAVM

SEQ ID NO: 13010 - DNA, 1203 bp, Xylella fastidiosa
  CDS (1)..(1203)
atgcccttatttacagatgtggaattggttccgggtgatcccattctgagcctcaacgatgcttataacgccgatacgcgtaccaacaaggtcaatttgggtattggtatttattgtgacgagagcggttgtatcccgctgttgcgggctgtccagcaggttgaagagcaacttgcgaagcatccgaaaccgcgcggttatctgccgattgatggtttgccagcctatatcaaagccacacaacaattgttgtttggagttgactccctcttgttgacggctggccgtgtggcgacttcacagactgttggaggttctggtgcattgcgggtggctgctgaggtactgaagcaggtgctaccgcatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccatgtatcgatctggcttaccaaggattcaatcagggcattgatgcggatgcttatgccatacgtttgcttgccgaagaaggtattagtaactatgtagttgccaactcgtactccaaatcgttctcgttgtatggcgagcgtgttggagggctgtcgatcgttgcttccaatactgagcaagcccaagcaatccagtcacaagtaaagcgtatcatccgtacgatttattccagtccgccggcacacggtgcctacttggtcgcgggtgtgctgaacagtcatgaattacgcacgctgtgggagcaggagttaactcagatgcgtgaacgtatccacgggttgcgtgcgggtttggttgctcgattgaaggcgctgggtgcgccggagtttgatttcatacaacgtcaagcaggcatgttttcgtattcggggttgagcaagatccaggtggatcgtttacgcgacgagttcgggatttatgcggtcagtagtggacgtatctgtgtggctgcgttgagtcagcacaaattggaatacgtggcccaggctgtggtgaaggtgcatcaaggctga

SEQ ID NO: 13011 - protein, 400 aa, Xylella fastidiosa
MPLFTDVELVPGDPILSLNDAYNADTRTNKVNLGIGIYCDESGCIPLLRAVQQVEEQLAKHPKPRGYLPIDGLPAYIKATQQLLFGVDSLLLTAGRVATSQTVGGSGALRVAAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPPAHGAYLVAGVLNSHELRTLWEQELTQMRERIHGLRAGLVARLKALGAPEFDFIQRQAGMFSYSGLSKIQVDRLRDEFGIYAVSSGRICVAALSQHKLEYVAQAVVKVHQG

SEQ ID NO: 13012 - DNA, 1197 bp, Vibrio parahaemolyticus
  CDS (1)..(1197)
atgactttcatgttttctaatctaccaactcccgtattagatccaattttatctttatccgttgcataccgtaacgatgaacgtccaaacaaggttgaccttggtattggcgtatacaaaaacagcgcaggcgaaacgccgatcatgaaagccattcaaatggctcaagatgtcgttgttgaaactcaaaaaaccaaatcttacgttggtcttgctggttgtgaagagttcaaccaaagcatgattgatcttctactgacgggaacgtcagcgatggatcgtgttgctgcaattcaaacgccaggagcaagtggtgcactgcgtatgctgggtgacctaatgaaggtcgcacaaccagatacaacggtttggatttcgaatccaagctatgtgaaccacaagccagtaatggaagctgctgggcttaaagttaagttctaccattatttctcgccagaaacgaaacaagtcgacaccgcaaaaatgctggatgatcttgctaaagcagggccgacagatgtggttctactgcatggttgttgtcacaacccaacaggcgcagacatcgacttttccgcatggcaagctattacagaactttctcaaaagaacggttttacgccatttgttgatatcgcgtatcaaggttttggtgacggcttagaagctgacgcaaaaggtcttcgttacatggcggataatgtcgaagagatgttgattacaacttcttgttctaaaaactttggcttgtaccgcgaacgtactggtgcagctattgttgtgggtaagaacacgcaagacatcactaacgcgaaaggcaaattgttaacgttagcgcgctctacgtacacgatgccacccgatcatggtgctgctttagtgaaaaccattctgcaagatgcgaacctgacttctgtctggaagcaagagttgagcgaaatgcaacaacgtttggtcagccttcgtcaaagtttgtgtaacgaattgagaaacaaccataatacagatcaatttgacttcattgagagtcacaaaggcatgtttactgtgctaggctttagtgaaaaccaaatggcgcaactgcgtgaagattatggcatttatggtgttggcgatggtcgaattaacatcgctggcttaaccgaaactcatattccatacgtagctgacgcaattaagaaaatatctcaaccttaa

SEQ ID NO: 13013 - protein, 398 aa, Vibrio parahaemolyticus
MTFMFSNLPTPVLDPILSLSVAYRNDERPNKVDLGIGVYKNSAGETPIMKAIQMAQDVVVETQKTKSYVGLAGCEEFNQSMIDLLLTGTSAMDRVAAIQTPGASGALRMLGDLMKVAQPDTTVWISNPSYVNHKPVMEAAGLKVKFYHYFSPETKQVDTAKMLDDLAKAGPTDVVLLHGCCHNPTGADIDFSAWQAITELSQKNGFTPFVDIAYQGFGDGLEADAKGLRYMADNVEEMLITTSCSKNFGLYRERTGAAIVVGKNTQDITNAKGKLLTLARSTYTMPPDHGAALVKTILQDANLTSVWKQELSEMQQRLVSLRQSLCNELRNNHNTDQFDFIESHKGMFTVLGFSENQMAQLREDYGIYGVGDGRINIAGLTETHIPYVADAIKKISQP

SEQ ID NO: 13014 - DNA, 1245 bp, Vibrio parahaemolyticus
  CDS (1)..(1245)
atgctgaaaggtataaatacgagcagaccccttcgattaacatggatgaagattatgtttgaaaaagtagttgccgctccggccgaccctatccttggccttactgaagaatttaaaaaagatcctcgcgctgaaaagattaaccttggcgttggtatttacaaaaacgaacaaggcgaaacacctgttcttgctaccgtaaagaaagccgaagcagcactgattgaaacggaaaaaaccaaatcatacctaaccatcgaagggactgctgagtacggtctggcggtacaaaaactacttttcggtgcagacgctgaaatcgtagcggaaaaacgcgcgaaaacagctcaagcgcctggtggtacaggtgcattacgcgtggcgggtgaatttattaaacgccaacttggtaacgtaaaaatctggatcagcaacccaacttgggcaaaccacaacggcgtgtttaccgctgcaggtctagaaacggctcaatacacttactacaacgcagaaactaaagacaaagacttcgatgcaatgctaaacgatcttcaagctgcatctgaaggtgacatcgttcttctacacggctgctgccacaacccaactggcatcgatccaactgctgaagaatgggaaacactagcgaagctgattgctgagaagaaactgcttcctctgttcgactttgcataccagggctttgctaagggtgtagaagaagacgcagctggcctacgtattttcgcgaaatacaacaaagaaattctcgttgcgagctcgttctcgaaaaacttcggcctatacaatgaacgtgtaggcgcattcacgcttgttgctgaatctgaagaagtggcaacaacagcattctctcaagtaaaagcgatcatccgctctatctactctaacccaccagctcacggtagtgctgttgttactcatattctaaacaacaaagaactgcgtgccgaatgggaagcggaagtacaagaaatgcgtgaccgtattcaagagatgcgcgagctgttcgtagcaactctgaaagaagaaggtgtggatgcagatttcagctttatcgaacgtcaaaacggcatgttctcgttctctggtctatctaaagagcaagttaaccgtctgaaagatgagttcgcaatttacatcgttggttctggccgtatcagcgtagctggtatgacaaaatcaaacatgggcccactatgtaaaggtatcgcagcggttctataa

SEQ ID NO: 13015 - protein, 414 aa, Vibrio parahaemolyticus
MLKGINTSRPLRLTWMKIMFEKVVAAPADPILGLTEEFKKDPRAEKINLGVGIYKNEQGETPVLATVKKAEAALIETEKTKSYLTIEGTAEYGLAVQKLLFGADAEIVAEKRAKTAQAPGGTGALRVAGEFIKRQLGNVKIWISNPTWANHNGVFTAAGLETAQYTYYNAETKDKDFDAMLNDLQAASEGDIVLLHGCCHNPTGIDPTAEEWETLAKLIAEKKLLPLFDFAYQGFAKGVEEDAAGLRIFAKYNKEILVASSFSKNFGLYNERVGAFTLVAESEEVATTAFSQVKAIIRSIYSNPPAHGSAVVTHILNNKELRAEWEAEVQEMRDRIQEMRELFVATLKEEGVDADFSFIERQNGMFSFSGLSKEQVNRLKDEFAIYIVGSGRISVAGMTKSNMGPLCKGIAAVL

SEQ ID NO: 13016 - DNA, 1200 bp, Pseudomonas syringae
  CDS (1)..(1200)
atgctagcccacgtggagtcgtacgccggtgatccgatcctttcgctgatggaagcctttggcaaggatccacgcgcagacaaggtcaatctgagcatcggtctgtattacgacgcgcagggacgtatcccgcagttggcatgcgtggcaactgcgcaacaacaattggccgaaggcgagcaggcggcttctgtctatttgccgatggaaggcctggcggcttaccggcaggcggtgcaaaccctgttgttcggcgccgaccatccgctggtgcaggccggtcgcgtggcgactatccaaaccgtgggcggctcgggcgcgcttaaagtgggggccgacttcctcaaatatgcattccccgattctcaggtgtgggtcagtgatccgacctgggaaaaccaccttgcgctgttcggcggtgcgggcttcaaggtcaatacttacccctacttcgatgcccagactggcggcgtcaggttcgaggctatgctcgacaccgtgcagggtctgccggcgcaaagcatccttttgctgcacccgtgctgccacaacccgactggcgcggatttgtccgtcgagcagtgggaccggttgatcgaagtgatcaaggatcgccagctcatcgcgtttctggatatcgcctatcagggcttcggcaaaggcatcgacgaagacgcctacgctatccgcgcgatggccgacgcgggcatcaccacgctggtcagcaactcgttctcgaaaatcttctcgctgtatggcgagcgggtcggcgggctatcggtggtctgcgaagacaccgcatcggccgccaatgtattcggccagctcaaggccacagtacgccgcaactattccagtccgcctgcgcatggcgcgtttctggtgtccagagtgctcaacacaccgcaactgcgtgatcagtggctgagcgaggtcgaaaccatgcgcctgcgcatcatcgacatgcgcagccgtctggtttcggtgctggcgcagaaagttgccgggcgcgatttcagctttatcctcaggcagagcggcatgttcagctacaccggattgacgccgcagcaggttgacgagctgaaagatgttcacggtatttacatgctgcgcagtggccgggtgtgcatggcgggcttgaatgaaagaaatatcgacaaggtgtgtgacgcgattgcgagcctctttgcccactaa

SEQ ID NO: 13017 - protein, 399 aa, Pseudomonas syringae
MLAHVESYAGDPILSLMEAFGKDPRADKVNLSIGLYYDAQGRIPQLACVATAQQQLAEGEQAASVYLPMEGLAAYRQAVQTLLFGADHPLVQAGRVATIQTVGGSGALKVGADFLKYAFPDSQVWVSDPTWENHLALFGGAGFKVNTYPYFDAQTGGVRFEAMLDTVQGLPAQSILLLHPCCHNPTGADLSVEQWDRLIEVIKDRQLIAFLDIAYQGFGKGIDEDAYAIRAMADAGITTLVSNSFSKIFSLYGERVGGLSVVCEDTASAANVFGQLKATVRRNYSSPPAHGAFLVSRVLNTPQLRDQWLSEVETMRLRIIDMRSRLVSVLAQKVAGRDFSFILRQSGMFSYTGLTPQQVDELKDVHGIYMLRSGRVCMAGLNERNIDKVCDAIASLFAH

SEQ ID NO: 13018 - DNA, 1197 bp, Pseudomonas syringae
  CDS (1)..(1197)
atgagcctgttctccgctgtcgaaatggcaccccgcgatccgatcctgggtatcaacgaagccttcaacgccgacacccgtaccaccaaggtcaaccttggcgtgggcgtctactgtgatgaagacgggcgcattcctctgctgcgtgccgtggctgaagctgaaaagattcgtgtcgcccagcacgcgccgcgcggctacctgccgatcgacggcattgccgcctacgaccaggccgtgcaaaaactgttgctgggtgccgattcaccgctgatcgcctcgggccgggtgctaaccactcaatcggtgggcggcacgggtgctttgaagatcggtgccgacttcctcaagcaactgctgcccaatgcggtggtggccatcagcgacccaagctgggaaaaccatcgcgcgctgttcgaaaccgccggtttcccggtgcagaactatcgttactacgacgccgccacgcatgacgtgaaccgcgccggcatgctcgaagacctgcacaacctgccgaacaactcggtggtggtgctgcacgcctgctgccacaacccgactggcgtcgatctgagcctggacgactggaaaaaagtgctggaagtggtcaaggccaagggccacgtaccgtttctggacatggcttaccagggctttggccaaggcattcaggaagacgcgctggcggtgcgcctgttcgccgagtcgggcctgaccttcttcgcttccagctcgttctccaaatcgctgtcgctgtatggcgagcgcgtcggtgcgctgtcgatcatcacagaatccaaggaagaaaccgcccgcgttctgtcgcaggtcaagcgtgtgatccgcaccaactactccaacccgccgacccacggcgcgatcatttccgccgccgtcctcaacgacccggccctgcgcgcgatgtgggaagaagaactcggcgagatgcgcgtgcgcattcagggcatgcgcaaggcgatggtcgagcgtctggccgacaacccggccggccaggatttcagcttcgtcggccgtcagtgcggcatgttctcctactccggcctgaccgccgcccaggcccagcgcctacgcagtgaattcggcatctacgcgctggacaccggccgtatctgcgtggccgcgctgaatcagaaaaatatcgatgcggtgtgtgaggcgatcaagaaggttctttaa

SEQ ID NO: 13019 - protein, 398 aa, Pseudomonas syringae
MSLFSAVEMAPRDPILGINEAFNADTRTTKVNLGVGVYCDEDGRIPLLRAVAEAEKIRVAQHAPRGYLPIDGIAAYDQAVQKLLLGADSPLIASGRVLTTQSVGGTGALKIGADFLKQLLPNAVVAISDPSWENHRALFETAGFPVQNYRYYDAATHDVNRAGMLEDLHNLPNNSVVVLHACCHNPTGVDLSLDDWKKVLEVVKAKGHVPFLDMAYQGFGQGIQEDALAVRLFAESGLTFFASSSFSKSLSLYGERVGALSIITESKEETARVLSQVKRVIRTNYSNPPTHGAIISAAVLNDPALRAMWEEELGEMRVRIQGMRKAMVERLADNPAGQDFSFVGRQCGMFSYSGLTAAQAQRLRSEFGIYALDTGRICVAALNQKNIDAVCEAIKKVL

SEQ ID NO: 13020 - DNA, 1197 bp, Pseudomonas putida
  CDS (1)..(1197)
atgttcaaacatgtcgatgcctatgccggcgacccgatcctctcgttgatggaaaccttcaaggccgacccgcgcgccgacaaggtcaacctgagtattggcctgtactacgatgaggccggcgtggtgccgcaactggcggcggtggatgcggtggaaaaacgcattgccggtcaggaccacgaagcctccctgtacctgccaatggaaggcctggccagctaccgccaagccatccaggcgctgctgttcggtgctgatcacccggccgtgaccggcggtcgtgtggccaccgtacagaccgtgggtggctccggcgccctgaaagtcggtgccgatttcctcaagcgctacttcccgcagtccgaagtctgggtcagcaacccgacctgggacaaccaccgcgccatcttcgaaggtgcaggcttcaaggtgcacacctatccgtactttgaccaggccacccgtggcgtggacttcgacggcatgctggccaccttgcagagcctgccggccaacagcgtggtactgctgcacccgtgctgccacaaccctaccggtgccgatctgcagcagcaccagtggcaacaagtggtcgaagtggtcaaggcacgccagctgatcccgttcctcgacatcgcttatcaaggcttcgccgaaggcctggtggaagatgcctacgccatccgcgaaatggcccgtgccggcgtgccgtgcctggtcagcaactccttctcgaaaatcttctcgctgtatggcgagcgggtgggcggcctgtcggtggtgtgcgatgacgaggccactgcccagagcgtgcttggccagctgaaggccaccgtgcgccgcaactactccagcccgcccaacttcggcgcccagctggttgccggcgtactgagcgatgctggcctgaatgcccagtgggccgaagaagtcgaagtgatgcgcaagcgtattctcgacatgcgccaggcgctggtcgatgccctggccgtgctgctgccgggccaggacttccagttcttcctgcgccagcgcggcatgttcagctacaccggctttagcgtcgagcaggtacgtcgcctgcgtgacgagttcggcgtgtacctgatcgacagcggccgtgtgtgcatgtccggcctgcgcccggccaacctgcaacgggttgccgaagcgttcgctgccgttcagaagtaa

SEQ ID NO: 13021 - protein, 398 aa, Pseudomonas putida
MFKHVDAYAGDPILSLMETFKADPRADKVNLSIGLYYDEAGVVPQLAAVDAVEKRIAGQDHEASLYLPMEGLASYRQAIQALLFGADHPAVTGGRVATVQTVGGSGALKVGADFLKRYFPQSEVWVSNPTWDNHRAIFEGAGFKVHTYPYFDQATRGVDFDGMLATLQSLPANSVVLLHPCCHNPTGADLQQHQWQQVVEVVKARQLIPFLDIAYQGFAEGLVEDAYAIREMARAGVPCLVSNSFSKIFSLYGERVGGLSVVCDDEATAQSVLGQLKATVRRNYSSPPNFGAQLVAGVLSDAGLNAQWAEEVEVMRKRILDMRQALVDALAVLLPGQDFQFFLRQRGMFSYTGFSVEQVRRLRDEFGVYLIDSGRVCMSGLRPANLQRVAEAFAAVQK

SEQ ID NO: 13022 - DNA, 1197 bp, Pseudomonas putida
  CDS (1)..(1197)
atgagcctgttttccgctgtcgagctggcaccccgcgaccctattctgggcctcaacgaagcattcaacgccgacccacgtaccgacaaggtcaacctgggcgtaggcgtgtattgcaatgaggaaggccgcattccgctgctgcgcgccgtgatcgaagccgaaacccagcgtgccgcccagcacgcttcgcgcggctacctgccgatcgacggcatcgccacctacgaccaggctgtgcagaagctgctgttcggcgccgagtcgccactgctggccgccggccgcgtggtcaccgtgcaggccgtcggtggtaccggcgcgctgaagatcggtgccgacttcctcaagcgcctctcgcccaatgccgtggttgccatcagcgaccctagctgggaaaaccaccgtgcgctgttcgaatcggccggcttcccggtgcagacctaccgctactacgatgcgccgaccaacgacgtcaaccgcgctggcatgctcgaagacctcaacgccctgccatccggttcgatcgtggtgctgcacgcctgctgccacaacccgaccggtgtcgacctgaacctggacgactggaagaacgtcctggaagtggtcaaggccaagggccacgtgccgttcctcgacatggcctaccagggctttggtgacggtatcgccgaagacgccttcgccgtgcgcctgttcgccgagtcgggcctggagttcttcgtttccagctcgttctccaaatcgttctcgctgtacggcgagcgcgtcggcgcactgtcgatcgtcaccgcctccaaggacgagagcacccgcgtgctgtcgcaggtcaagcgcgtgatccgcaccacctactccaacccgccaacccacggcgcaaccattgttgccaccgtgctgaacagcgcagaactgcgccagatgtgggaaaccgaactggccgaaatgcgcgagcgcatccacggcatgcgcaagcagatggtatcgctgctggccgaatacggtgcaaaccgcgacttcagcttcgttggccgccaggtcggcatgttctcctactcgggcctgaccgttgaacaggtcacccgcctgaagaacgacttcggcatctatgccctggacaccggccgtatcgcggtggccgcgctgaaccagagcaacatccacgtggtgaccaaagcgatcgtggaagtgctgtaa

SEQ ID NO: 13023 - protein, 398 aa, Pseudomonas putida
MSLFSAVELAPRDPILGLNEAFNADPRTDKVNLGVGVYCNEEGRIPLLRAVIEAETQRAAQHASRGYLPIDGIATYDQAVQKLLFGAESPLLAAGRVVTVQAVGGTGALKIGADFLKRLSPNAVVAISDPSWENHRALFESAGFPVQTYRYYDAPTNDVNRAGMLEDLNALPSGSIVVLHACCHNPTGVDLNLDDWKNVLEVVKAKGHVPFLDMAYQGFGDGIAEDAFAVRLFAESGLEFFVSSSFSKSFSLYGERVGALSIVTASKDESTRVLSQVKRVIRTTYSNPPTHGATIVATVLNSAELRQMWETELAEMRERIHGMRKQMVSLLAEYGANRDFSFVGRQVGMFSYSGLTVEQVTRLKNDFGIYALDTGRIAVAALNQSNIHVVTKAIVEVL

SEQ ID NO: 13024 - DNA, 1305 bp, Staphylococcus epidermidis
  CDS (19)..(1305)
aaagaggttaagacaatgatgaatccattagcccaaaaattgaatgatgaaataaagcaatcaagtccagaagtattagatatgatgtcacaattaggtaaagatatgttttatccaaaaggaattttatcgcaatctgccgaagcaaaacgcacaacatataatgctactattggtatggcaaccaaaaaagaaggtaaaatgtacgcaaattcacttaaccaaatgtttaatgaccttacaccggatgaaattttcccatatgcacctcctcaaggtgtagaggaattacgtgatttatggcagaaaaaaatgcttaaagaaaatcccgacttaaagtctaaatctatctctcgtcccatcgttacaaatgctctcacgcacggtctttctctagtagctgatttatttgtagatacagatgataccgtcttattaccgacacacaactggggcaattataaacttgtatttagcacacgtcacggtgctcatatcgatacgtattctatttttgataactcaggtcacttcactacatctgaacttgtaaaaacattaaaagaatataaaaaagacaaagtgattattattttaaattatcctaataacccaactggttacacaccaaataaagaagaagttaatactattgtaaatgcaattgaagaactagctaataaaggtactaaagtagtaactgttgtcgatgatgcatactatgggttattttatgaagaagtttaccaacagtcgattttcacggctttaacacaggtgaaatcttcaaaccttttaccagtgcgtttggatggagctactaaagaattcttctcttgggggttccgcgttggctttatgacgtttggaattgatcatgaaacgttaaaaaatgcgctagaagctaaagtaaaaggattaattcgtagcaatatttcaagttctccactaccttctcaaagtgcaatcaaacatgtacttaaacatcatgagcaatttgataaagaaatcgatcaaaatatcaatattttaaaagaacgctacgaagtaactaaacaagtagtgtatgataataaatatgccaaatattggcaagcctatgactttaattcaggatactttatgtcattgaaattaaatcaagtcgatccagaagaattacgtgaacatttaattaataactattcaattggtattattgctttaaatagcacagatattcgtattgcctttagttgtgtagaaaaagaagatattccttatgtctttgagtctattgctaatgcaattgatgatattaaataa

SEQ ID NO: 13025 - protein, 428 aa, Staphylococcus epidermidis
MNPLAQKLNDEIKQSSPEVLDMMSQLGKDMFYPKGILSQSAEAKRTTYNATIGMATKKEGKMYANSLNQMFNDLTPDEIFPYAPPQGVEELRDLWQKKMLKENPDLKSKSISRPIVTNALTHGLSLVADLFVDTDDTVLLPTHNWGNYKLVFSTRHGAHIDTYSIFDNSGHFTTSELVKTLKEYKKDKVIIILNYPNNPTGYTPNKEEVNTIVNAIEELANKGTKVVTVVDDAYYGLFYEEVYQQSIFTALTQVKSSNLLPVRLDGATKEFFSWGFRVGFMTFGIDHETLKNALEAKVKGLIRSNISSSPLPSQSAIKHVLKHHEQFDKEIDQNINILKERYEVTKQVVYDNKYAKYWQAYDFNSGYFMSLKLNQVDPEELREHLINNYSIGIIALNSTDIRIAFSCVEKEDIPYVFESIANAIDDIK

SEQ ID NO: 13026 - DNA, 1206 bp, Yersinia pestis
  CDS (1)..(1206)
atggaagcctctgacatgtttgaaaaaattactgctgcacctgcggatcctattttaggtttgaccgatatcttccgcgcggatgaccgcgctcataaaatcaatctggggatcggtgtctacaaagacgaaaccggtaaaaccccagtgctgaccagcgtgaagaaagctgagcagtatttactggaaaatgaagctaccaaaaattatctgggtattgacggcctgcctgtttttgccagttgcacccaagaactgctgttcggtgctaatagtgcaattattgcggataaacgtgctcgtaccgctcaaacgccaggtggtaccggtggtttgcgcattgccgctgattttatcgcccatcagaccagcgctaaacgtgtctgggtcagtaacccaagctggccaaaccataaaaacgtcttcgaagccgcagggctggaagtggtggagtacgcttattatgatgctgctaaccatgcattggacttcgatggcttgttaaatagcctgtcagaagctcaggcgggtgatgtggtgttgttccacggctgctgccataacccaacgggtatcgacccaacagaaactcagtggagccaactggcggagttatcggttgctaaaggctggttgccactgtttgatttcgcttatcaaggctttgccaacggtttggaagaagatgctcagggcctgcgtattttcgcggcaacacatcaagagttgatcgtttgcagctcttattcgaaaaactttggtttgtacaatgaacgtgttggggcttgtacccttgtcgccgccgacagtaacgttgccgataccgcattcagccaagttaaagcggttatccgagccaactactctaacccaccggcacatggtgcatcagtcgttgccactattctgagtaatgccgcactacgggcgatttgggaacaagaactgaccgatatgcgtcagcgcatccaacgtatgcgtcagttgtttgttaataccttgcaggaaaaaggcgctcaacaagattttagctttatcattaaccagaatgggatgttctcgttcagtggtctgaccaaagaacaagtgctgcgcctgcgtgatgagttcgccgtctatgcggtaaattctggccgggttaacgtggcggggatgacaccagacaatatggcgccgttatgtgaagctatcgttgcggtgctctaa

SEQ ID NO: 13027 - protein, 401 aa, Yersinia pestis
MEASDMFEKITAAPADPILGLTDIFRADDRAHKINLGIGVYKDETGKTPVLTSVKKAEQYLLENEATKNYLGIDGLPVFASCTQELLFGANSAIIADKRARTAQTPGGTGGLRIAADFIAHQTSAKRVWVSNPSWPNHKNVFEAAGLEVVEYAYYDAANHALDFDGLLNSLSEAQAGDVVLFHGCCHNPTGIDPTETQWSQLAELSVAKGWLPLFDFAYQGFANGLEEDAQGLRIFAATHQELIVCSSYSKNFGLYNERVGACTLVAADSNVADTAFSQVKAVIRANYSNPPAHGASVVATILSNAALRAIWEQELTDMRQRIQRMRQLFVNTLQEKGAQQDFSFIINQNGMFSFSGLTKEQVLRLRDEFAVYAVNSGRVNVAGMTPDNMAPLCEAIVAVL

SEQ ID NO: 13028 - DNA, 1197 bp, Wigglesworthia glossinidia brevipalpis
  CDS (1)..(1197)
atgtttgaattaacagagctttctcctttagatccagtattaggaatgatcgatattattaaaaatgataaaagagatggtttaataaatttaggaattggagtttataaagatataaaaggtaacactcctatattagatagtgtaaaaaaagcagaaaatattttaatagaatcagaaaaaacaaaaaattatttaaatattgaaggactagaatcatttatacaacattcaaaaagtttaatttttggcaaagaaaatttatctgagttaaatgattttattgcttcagtacaatgcccaggaggaacttctgctttaaaaattgctgcagagtttttaattagacatacaaaaatacgtaaaatttggatcagtgatccaagttggcctaatcatgaaaagttattttcatttgccggatttaaagtacataaatatccttattttaataaggaaaaaaatcaattagatttttataatatgaaaaaatgcttagaaaatattaaagatgactctgctgttatttttcacagctcttgtcataatccaacaggaatagatcctagttttgaacaatggttagaattagctaaaatttctagaaataaaaaatggattccaatatttgattctgcatatcaaggtttttccaatggattaaaagatgatgtatttggtataaaaatttttttaaaatatattaatgaatttgtagtttgcaattcattttctaaaaattttagtttgtataatgaaagagttgggacatgcaattttataacaaaaaacaaaaaacatgccagtaatgttttcagtcaattaagatctattatacgtgtaaattactctaatcctccagctcatggagcaaatattataaatgtaattttctctaaaaaagatttatttaatttatggaaatctgaattaaatgaaatgagaaatagaattaaacaaataagatctttatttgcagatacattatttaaaataaataataaaaaaaatttcaattttattaaaaatcagcatggaatgttttcttttattggattaaatagaaaaaatgtaatggatcttagaaataattttagaatatatgttattgattctggaagattaaatttcgcagcaataacaaataaaaatatttatgaggtgtgtagatcaattaattgtgttttaaataattga

SEQ ID NO: 13029 - protein, 398 aa, Wigglesworthia glossinidia brevipalpis
MFELTELSPLDPVLGMIDIIKNDKRDGLINLGIGVYKDIKGNTPILDSVKKAENILIESEKTKNYLNIEGLESFIQHSKSLIFGKENLSELNDFIASVQCPGGTSALKIAAEFLIRHTKIRKIWISDPSWPNHEKLFSFAGFKVHKYPYFNKEKNQLDFYNMKKCLENIKDDSAVIFHSSCHNPTGIDPSFEQWLELAKISRNKKWIPIFDSAYQGFSNGLKDDVFGIKIFLKYINEFVVCNSFSKNFSLYNERVGTCNFITKNKKHASNVFSQLRSIIRVNYSNPPAHGANIINVIFSKKDLFNLWKSELNEMRNRIKQIRSLFADTLFKINNKKNFNFIKNQHGMFSFIGLNRKNVMDLRNNFRIYVIDSGRLNFAAITNKNIYEVCRSINCVLNN

SEQ ID NO: 13030 - DNA, 1200 bp, Vibrio vulnificus
  CDS (1)..(1200)
atgaagattatgtttgaaaaagtagttgccgctcccgcggacccgattcttggcctaactgaagaattcaaaaaagaccctcgcgcagaaaaaattaaccttggcgtgggtatctacaaaacagaacaaggtgaaactcctgttcttgctacggtaaagaaagcggaagcagcgcttgttgaaaccgagaaaaccaaatcttacctaaccatcgaaggaacagcagaatacgcattagcggttcaaaaactactgtttggtgcggatgctgagctaatcaatgcgcaacgtgcaaaaacagcacaagcacctggcggtactggcgcactgcgcgttgcaggcgaattcatcaaacgccaactcggcgatgtaaaaatctggatcagcaacccaacttgggctaaccaccatggtgtgttccgcgcagcaggcctagaaacggttgagtacgcttactacaacccagaaaccaaagacaaagactttgccgctatgctggccgaccttgaaaaagcgtccgctggtgatgtggtactgctgcacggatgttgccataacccaacaggcatcgacccaacggcacaagagtgggaagcgcttgctaaactggttgccgacaagggcctacttccactatttgactttgcctaccaaggtttcgcgaaaggtgttgaagaagatgcgcaaggcctacgtaccttcgctaaattcaacaaagagatcctcgtagcaagttcattctcgaaaaactttggtctgtacaacgagcgtgtaggcgcattcacgttagtggctgaaagccaagagatcgcagaaacggcattctcacaagtgaaagcgatcattcgctctatctactcaaacccaccagcgcacggcagtgcggtagtgactcacatccttaacgatgccgcgcttcgtgcagagtgggaagcggaagtggcagagatgcgcgatcgcatccaagagatgcgcgaactttttgttacgacactgaaagaagaaggcgttgcggctgactttagctttatccaacgtcaaaacggcatgttctctttctctggcttgaacaaagatcaagtggctcgcctaaaagaagagtttgcgatctacatcgtcggttctggtcgcatcagcgttgcgggcatgaccaaatccaacatgggtccgctttgtaaagccatcgctgcggtactgtaa

SEQ ID NO: 13031 - protein, 399 aa, Vibrio vulnificus
MKIMFEKVVAAPADPILGLTEEFKKDPRAEKINLGVGIYKTEQGETPVLATVKKAEAALVETEKTKSYLTIEGTAEYALAVQKLLFGADAELINAQRAKTAQAPGGTGALRVAGEFIKRQLGDVKIWISNPTWANHHGVFRAAGLETVEYAYYNPETKDKDFAAMLADLEKASAGDVVLLHGCCHNPTGIDPTAQEWEALAKLVADKGLLPLFDFAYQGFAKGVEEDAQGLRTFAKFNKEILVASSFSKNFGLYNERVGAFTLVAESQEIAETAFSQVKAIIRSIYSNPPAHGSAVVTHILNDAALRAEWEAEVAEMRDRIQEMRELFVTTLKEEGVAADFSFIQRQNGMFSFSGLNKDQVARLKEEFAIYIVGSGRISVAGMTKSNMGPLCKAIAAVL

SEQ ID NO: 13032 - DNA, 1191 bp, Shewanella oneidensis
  CDS (1)..(1191)
atgtttaactcactcatcgcaatgcctgcggatccgatccttggcttgttgacccagtaccgcgaagacacacatccacagaaagtagacttaggtgtcggcgtttataaagatcccgcgggaaacacccccattctcaattgtgtaaaaaaagccgagaaatttcgtttagaaaccgagacgacaaaggtctatatcggtccaactggttcgcctcagtttaataccctgatgacagagttagcctttggcagtgatcatagcgcgattatcgctaaccgtattcgtactgtttccacacctggcggtacgggcgctctgcgtgttgcgggtgactttattaagcgttgcaatcctaatgcggtgttgtgggtaagcgatcccacatgggctaatcatacaggtttattcgaagctgctgggatcacagttaaaacttatccctattatgactacgatagtaaatcgttgaaatttgacgagatgcttgctgcattatcgcaagtgagtcctgatgacgtagtgttattacacgcctgctgccataacccaagtgggatggatttgaccactgatcaatgggataaagtcgtcaccctcaccaaagagcaaggttttaccccgcttatcgacatggcttaccaaggttttggtgacggtgtcgatatcgatgcctacggcgtgcgtaaaatggctgcagcggtcgataatatgatcctgtgtagctcttgctcgaagaacttcggtctgtaccgtgagcgtatcggttcctgctctgtggttgcaaaggatgcgaacacggcaaacattgcgcaatctgtactgctttatgtggttcgctgcctctactctatgccacctgcccatggcgcggcgattgttgagacgattttaggatcaaaagaattaacccaagaatggcttgatgagctcaaagtgatgcgcgaccgtatcaatggtaaccgcgcgattttagttgaaaaactcaaagccaatggtgttgctcgcgactttagctttattgctcgccaaaaaggcatgttctctttccttggtgtaaatcctgagcaagtggcgcgtctgcaaaaagaatttagcatctacatggtgggttcaagccggatcagtatcgcggggatcagtgaagataacgtcgattatctcgcccaatcgatcgccaaagtgctttga

SEQ ID NO: 13033 - protein, 396 aa, Shewanella oneidensis
MFNSLIAMPADPILGLLTQYREDTHPQKVDLGVGVYKDPAGNTPILNCVKKAEKFRLETETTKVYIGPTGSPQFNTLMTELAFGSDHSAIIANRIRTVSTPGGTGALRVAGDFIKRCNPNAVLWVSDPTWANHTGLFEAAGITVKTYPYYDYDSKSLKFDEMLAALSQVSPDDVVLLHACCHNPSGMDLTTDQWDKVVTLTKEQGFTPLIDMAYQGFGDGVDIDAYGVRKMAAAVDNMILCSSCSKNFGLYRERIGSCSVVAKDANTANIAQSVLLYVVRCLYSMPPAHGAAIVETILGSKELTQEWLDELKVMRDRINGNRAILVEKLKANGVARDFSFIARQKGMFSFLGVNPEQVARLQKEFSIYMVGSSRISIAGISEDNVDYLAQSIAKVL

SEQ ID NO: 13034 - DNA, 1194 bp, Shewanella oneidensis
  CDS (1)..(1194)
atgattttctctcaggtagtgctcgctccagcagatcccatccttggtttaaccgatacttttaaagctgatccacgtcaagataaagtcaaccttggtgtcggcatttataaggatgaagcagggcagactccggtattgcaatcggttaagaaagcagaagccatactgctagaacaagagaagactaaaaactatttaggcatagaaggggtccaaacctacaaccgcgttgtacaagagttgttatttggtgaaggtagtgagctagtggcttctggccgtgccgcaaccgcccaagcgcctggtggtacaggggcattgcgtatagccgccgagtttttattgagaaacacgccatctcgcactatttgggtaagtaatcccacttgggctaaccatcaaaatatttttgaaactgcagggttaacggttaaagagtttggatattacaacgccagtgctcacgatatcgatttcgatggcatgatgaccgatctcgccaatgcacaggcgggtgacattattctactgcacggctgctgtcataacccaacgggtattgacttgactttagcgcaatgggatttagtggctaacctctgtgctgacaaacaattagtgcctttgtttgactttgcttaccaaggttttggaacaggtattgaagaagatgctgcaggcctgcgtttagtcgcttcaaaagttcctgagctgttagtcgcaaattctttctctaaaaactttgggctttataatgaacgtatcggtgctgtgactgtggttgctcacaatgcagatgaagctgttcgcgcttttagccaagtgaaacgtacaattcgggcaaactattcaaatcccccagcccatggtgcgttaattgttagcaccattttaagtgatgcagctttgaaagccctttgggtacaagagctgaccgaaatgcgtgagcgtatagcccttatgcgtactctatttgtgcagagcttaaaagatgagggtgtgactcaagattttagctttatttcgcgccaaaatggtatgtttagcttctctggcttgaataagtcgcaagtggcccgtttaaaagacgaatttggagtttatattgtcggttctggtcgtattagtgtggcgggtatgacgaaagccaatatgcctgcgatctgtaaagcgattgctcaggtcgtataa

SEQ ID NO: 13035 - protein, 397 aa, Shewanella oneidensis
MIFSQVVLAPADPILGLTDTFKADPRQDKVNLGVGIYKDEAGQTPVLQSVKKAEAILLEQEKTKNYLGIEGVQTYNRVVQELLFGEGSELVASGRAATAQAPGGTGALRIAAEFLLRNTPSRTIWVSNPTWANHQNIFETAGLTVKEFGYYNASAHDIDFDGMMTDLANAQAGDIILLHGCCHNPTGIDLTLAQWDLVANLCADKQLVPLFDFAYQGFGTGIEEDAAGLRLVASKVPELLVANSFSKNFGLYNERIGAVTVVAHNADEAVRAFSQVKRTIRANYSNPPAHGALIVSTILSDAALKALWVQELTEMRERIALMRTLFVQSLKDEGVTQDFSFISRQNGMFSFSGLNKSQVARLKDEFGVYIVGSGRISVAGMTKANMPAICKAIAQVV

SEQ ID NO: 13036 - DNA, 1236 bp, Escherichia coli O6
  CDS (1)..(1236)
atgtgttttaaccaccagcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaactgaaagccgtggcggatgcggaagcgcgcctgaatgcgcagcctcatggtgcttcgctttatttaccgatggaagggcttaacagctatcgccatgccattgcgccgctgctgtttggtgcggaccatccggtactgcaacaacagcgcgtagcaaccattcaaacccttggcggctcaggggcattgaaagtgggtgcagatttcctgaaacgctacttcccggaatcaggcgtctgggtcagcgatcctacctgggaaaaccacgtagcaatattcgccggggctggattcgaagtgagcacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgaccagtgggattccgtgattgaaattctcaaagcccgcgagcttattccattcctcgatattgcctatcaaggatttggtgccggtatggaagaggatgcctacgccattcgcgccattgccagcgctggattacccgctctggtgagcaattcgttctcgaaaattttctccctttacggcgagcgcgtcggcggactttctgttctgtgtgaagatgccgaagccgcaggccgcgtactggggcaattgaaagcaaccgttcgccgcaactactccagcccgccgaattttggtgcgaaggtggtggctgcggtgctgaatgacgaggcattgaaagccagctggctggcggaagtagaagagatgcgaactcgcattctggcaatgcgtcaggaactggtgaaggtattgagcacagagatgccagagcgcaatttcgattatctgcttaatcagcgcggcatgttcagttataccggtttaagaaccgctcaggttgaccgactacgtgaagaatttggtgtctatctcatcgccagcggtcgcatgtgtgtcgccgggcttaacgcgcaaaatgtgcatcgcgtggcaaaggcgtttgctgcggtgatgtga

SEQ ID NO: 13037 - protein, 411 aa, Escherichia coli O6
MCFNHQPVNLENHRVFQKVDAYAGDPILTLMERFKEDPRSDKVNLSIGLYYNEDGIIPQLKAVADAEARLNAQPHGASLYLPMEGLNSYRHAIAPLLFGADHPVLQQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDSVIEILKARELIPFLDIAYQGFGAGMEEDAYAIRAIASAGLPALVSNSFSKIFSLYGERVGGLSVLCEDAEAAGRVLGQLKATVRRNYSSPPNFGAKVVAAVLNDEALKASWLAEVEEMRTRILAMRQELVKVLSTEMPERNFDYLLNQRGMFSYTGLRTAQVDRLREEFGVYLIASGRMCVAGLNAQNVHRVAKAFAAVM

SEQ ID NO: 13038 - DNA, 1797 bp, Phaseolus vulgaris
  CDS (176)..(1561)
gcacgaggaactgtcttctctttcttcacttcttctcatcgcccattgtttccttcttcaattctatctctctaagcttcttcaagtgtttcacaaaaacgaatctacttcatcgcatcatcgtcttttctacgcaactcaacttctacaacactcagatccgcacttcacagtgatggcttcttctgttctctccgcagctttgaactctctctctccctcttattctctctcctcgcgccaaacccacaaggggaagcccaagattggaggcaacgctttgagatttaacaagtccttcccaaatgcaaggtctagtggtcgggttatggctgttgcagttaatgggtctcggtttgagggcatacctatggctcctcctgatccaattcttggagtttctgaggcatttaaagcggacacaagtgatgtcaagctcaatcttggagtgggggcataccgaacagaagaactacagccgtatgtgcttaatgttgttaagaaggctgagaatcttatgctggagaggggggataacaaagagtatctctctattgagggtttagctgcgtttaacaaggcaactgcagagttgttacttggagcagacaacccagcaatcaaacagcaaagagttgccactgtccaaggtctttctggaactggttctctgcggctagctgcagctctgatagaaagatattttgctggggctaaagttttgatatcatctcctacctggggtaatcacaagaatattttcaatgatgctagagtgccatggtctgagtacagatattatgatcccaagacagttggcttggattttgagggcatgattgaagatataaagtcagctcctgaaggatcttttgtgcttctacatggatgtgctcataaccctactggtattgatccaacacctgagcaatgggaaaaaatagctgatttaattcaagaaaagaaccacattcccttttttgatgttgcttaccagggctttgctagtggaagccttgatgaagatgcagcttctgtgaggctttttgttgcacgtggtatggaggttcttgtagctcagtcatacagtaaaaatcttggtctctatgctgaaaggattggagcaatcaatgtgatttcatcatccccagaatctgcagcaagggtaaagagccagctgaaaaggctcgcccgaccaatgtactcaaatccacctgtacatggggctagaattgttgccgatgttgttggaaacccagttctctttaatgaatggagagcagaaatggaaatgatggctggaaggatcaagaatgttagacaacagctatacaatagtattacttcaaaagacaacagtggaaaagattggtcatttatacttaagcagataggcatgttctcattcactggcttgaacaaggaacagactgacaacatgacaaataagtggcatgtatacatgacaaaggacggaaggatttccctggcaggattgtcgttggctaaatgcgaataccttgcagatgctattatagactcgtatcataatgtcagctgaaactcggtgaaatatttttggtgagtgttatatccaatcggaaagattgtgagatacatgaaaataatttatgtatgcattaattaattgtcatacatatgtacctcaaagtaccttaggaaattttgtaaccttgttgaaacaaattgactctgtattgacgcataacaagtcggattgtctgacttaaagctagttgaatcagcaccgatttatagtaaaaaaaaaaaaaaaaa

SEQ ID NO: 13039 - protein, 461 aa, Phaseolus vulgaris
MASSVLSAALNSLSPSYSLSSRQTHKGKPKIGGNALRFNKSFPNARSSGRVMAVAVNGSRFEGIPMAPPDPILGVSEAFKADTSDVKLNLGVGAYRTEELQPYVLNVVKKAENLMLERGDNKEYLSIEGLAAFNKATAELLLGADNPAIKQQRVATVQGLSGTGSLRLAAALIERYFAGAKVLISSPTWGNHKNIFNDARVPWSEYRYYDPKTVGLDFEGMIEDIKSAPEGSFVLLHGCAHNPTGIDPTPEQWEKIADLIQEKNHIPFFDVAYQGFASGSLDEDAASVRLFVARGMEVLVAQSYSKNLGLYAERIGAINVISSSPESAARVKSQLKRLARPMYSNPPVHGARIVADVVGNPVLFNEWRAEMEMMAGRIKNVRQQLYNSITSKDNSGKDWSFILKQIGMFSFTGLNKEQTDNMTNKWHVYMTKDGRISLAGLSLAKCEYLADAIIDSYHNVS

SEQ ID NO: 13040 - DNA, 1179 bp, Ruegeria sp
  CDS (1)..(1179)
atgcttagtgaccttggcagcgtgccatcagatgaaatcctgacgctcatgcaaatgcaccgggaagatccccggcgcgacaagatcgaccagacggttggcgtctaccgcaatgaacttggccagacgccagtcatgcaggccgtcaaggcggcggaatacaagatctggcaggatcagacgagcaaatcctacaccggattgctgggggaccccgagtttctcgaggtcatgcaggcgctggtgcttggtccggaggcgccgccctgtaccgctgctgccgtgcccggcggctctggcgcgtgtcggcaggcctttgaactgatccgccaggccacgccgggggcccgtgtctacgtctccgatccgacttgggcaaaccacacgaccatgctggcgcataccgggctggcccgggaaacctaccgctttcgagacccggcgacggggggcttgaactttgacggcatgatgcaggatctcggaacggctcgggccggtgacgtggtcctgctgcacggctgctgtcacaatcccacgggcatttcgctgacccggacccagtggcgcgccctggcagaccgcatggcgaaaaacggcctggtcggcatgattgacctggcctacctgggctttggggacgggctcgaagaggacgcctggggcacgcgccatctagcggaaacgctggatgaatgcctgatcgccgtgtcctgttccaagaacttcggtctttaccgcgaaagggcaggcgccctgttggtcacggcacgcaacccggcgctgctggcccacacgcgtgaggtcctggcctatctcaatcgacaggcctactcctttccgcccgatcatggagcgcgcatcgtcaccagcatcctcaaggacccggccctgcgcgaagtctggacccaggagctgcatggcatccgcaattcgatcgcggccctgcgcctgcagctgtgcaatgcctttgccgagaaaaccgggacccggcggtttgactacatccgggagcacaaaggcatgttttcctgcctcggtgccacccccgagcaagtccggaccctgcgcgcgaaacacggcatctacatggtcacggacagccggttgaactttgccagtctgagccagcaaaacgtcgaacgcatcgtggacgcggtgaccgacgtaggaatttag

SEQ ID NO: 13041 - protein, 392 aa, Ruegeria sp
MLSDLGSVPSDEILTLMQMHREDPRRDKIDQTVGVYRNELGQTPVMQAVKAAEYKIWQDQTSKSYTGLLGDPEFLEVMQALVLGPEAPPCTAAAVPGGSGACRQAFELIRQATPGARVYVSDPTWANHTTMLAHTGLARETYRFRDPATGGLNFDGMMQDLGTARAGDVVLLHGCCHNPTGISLTRTQWRALADRMAKNGLVGMIDLAYLGFGDGLEEDAWGTRHLAETLDECLIAVSCSKNFGLYRERAGALLVTARNPALLAHTREVLAYLNRQAYSFPPDHGARIVTSILKDPALREVWTQELHGIRNSIAALRLQLCNAFAEKTGTRRFDYIREHKGMFSCLGATPEQVRTLRAKHGIYMVTDSRLNFASLSQQNVERIVDAVTDVGI

SEQ ID NO: 13042 - DNA, 1203 bp, Xanthomonas campestris
  CDS (1)..(1203)
atgtccttctttgcaaatgtagaacaggttccaggcgaccccatcctgggcctgaccgaggcctacaacgccgacagccgccccaacaaggtcaatctgggtgttggcatctattacgacgaaaacgggcgcatcccgctgttgcgtgccgtgcagaagatcgagcagcagctcgcgctggatgccaaaccgcgcggctacctgcccatcgacggcctggccgcctacgacaaggccacccaggagctgctgttcggcgccgagtcggcgctggtggcctccggccgcgtggcgacctcgcagaccgttggcggcagcggtgcgctgcgcgtgggcgcggacctgctcaagaagctgctgcccacctccaccatcgccatcagcaaccccagctgggaaaaccaccgcgcggtgttcggcgcggccggcttcgaggtggtggattacacctatttcgatgccgccagccacgggctgaacttcgacggcatgctggccgacctggccaagctggagccgggcacggtggtgctgctgcatgcctgctgccacaaccccaccggtgccgacctcagccgcgagcagtggaagcagctggccggcctgttgaaagaacgcaacctgttcccgttcgtggacatcgcctaccagggcttcgacaagggcatcgaggccgatgcgtacgcggtgcgcctgctggcggccgaaggcatcgacacctacgtggtggcgagctcgtactccaagtcgttctcgctgtatggcgagcgcgtgggcgcgctgtcggtggtctcggccacggccgccgaagccaaggcggtgcagtcgcaggtcaagcgcatcatccgcacgatctactccagcccgtccacgcacggcgccgccctggtggccggcgtgctgaccagcccggagctgcgcgatgtgtgggagcaggaactcaccgaaatgcgcgagcgcatccacgcgttgcgtgccggcctggtcgccaagctggccgcgctgggcgcaccggagttcgagttcatccagcgccaggccggcatgttttcgtactcgggcctgaccaagtcgcaggtggaccgcctgcgtgacgagttcgcgatctatgcggtcggcaccggccgcatctgcgtggccgcgctgagccagcgcaatctggactacgtggcccaggccgtggccacggtcagccgcggctga

SEQ ID NO: 13043 - protein, 400 aa, Xanthomonas campestris
MSFFANVEQVPGDPILGLTEAYNADSRPNKVNLGVGIYYDENGRIPLLRAVQKIEQQLALDAKPRGYLPIDGLAAYDKATQELLFGAESALVASGRVATSQTVGGSGALRVGADLLKKLLPTSTIAISNPSWENHRAVFGAAGFEVVDYTYFDAASHGLNFDGMLADLAKLEPGTVVLLHACCHNPTGADLSREQWKQLAGLLKERNLFPFVDIAYQGFDKGIEADAYAVRLLAAEGIDTYVVASSYSKSFSLYGERVGALSVVSATAAEAKAVQSQVKRIIRTIYSSPSTHGAALVAGVLTSPELRDVWEQELTEMRERIHALRAGLVAKLAALGAPEFEFIQRQAGMFSYSGLTKSQVDRLRDEFAIYAVGTGRICVAALSQRNLDYVAQAVATVSRG

SEQ ID NO: 13044 - DNA, 1203 bp, Xanthomonas axonopodis
  CDS (1)..(1203)
atgtccttctttgcaaacgtggaacaggttccaggcgaccccatcctgggcctgaccgaggcctacaacgccgacagccgccccaacaaggtcaacctgggcgtgggcatctattacgacgaaaacgggcgcatcccgctgttgcgcgccgtgcacaagatcgagcagcagctcgcgcaggacgccaaaccgcggggttatctgcccatcgacggcctggccgcgtacgacaaggccacccaggagctgctgtttggcgccgactctgcgctggtgacctccggccgcgtggcgacctcgcagaccgtcggcggcagcggcgcattgcgcgtgggcgcggacctgctcaagaagctgctgcccaccgccaccatcgccatcagcaaccccagctgggaaaaccatcgcgcggtgttcggcgcggccggcttcgaggttgtcgattacacctacttcgatgccgccatccatggcctgaacttcgacggcatgctcgccgacctggccaagctcgaaccgggcaccgtggtgctgctgcacgcctgctgccacaaccccaccggcgccgacctgagcaaggaacagtggaagcaggtggccggcctgttgaaggaacgcaacctgttcccgttcgtcgacatcgcctaccagggcttcgacaagggcatcgaggccgatgcctatgcggtgcgcctgctggctgccgaaggcatcgacagctacgtggtcgccagttcctattccaagtcgttctcgctgtatggcgagcgcgtgggcgcgctgtcggtggtctcggccaccgccgccgaagccaaggcggtgcagtcgcaggtcaagcgcatcatccgcacgatctactccagcccgtccacgcacggcgccgccctggtggccggcgtgctgaccagcccggagctgcgcgatctgtgggagcaggaactgaccgagatgcgcgagcgcatccattccctgcgcgccgggctggtggaaaaactcgccacgctgggtgcgccggagttcgacttcatccagcgccaggccggcatgttctcgtactcgggcctgaccaagacccaggtggaccgcctgcgcgacgagttcgcgatctacgcggtcggcaccggccgcatctgcgtggcagcactgagccagcgtaacctggactacgtggcccaggccgtggccactgtcagccgggtgtag

SEQ ID NO: 13045 - protein, 400 aa, Xanthomonas axonopodis
MSFFANVEQVPGDPILGLTEAYNADSRPNKVNLGVGIYYDENGRIPLLRAVHKIEQQLAQDAKPRGYLPIDGLAAYDKATQELLFGADSALVTSGRVATSQTVGGSGALRVGADLLKKLLPTATIAISNPSWENHRAVFGAAGFEVVDYTYFDAAIHGLNFDGMLADLAKLEPGTVVLLHACCHNPTGADLSKEQWKQVAGLLKERNLFPFVDIAYQGFDKGIEADAYAVRLLAAEGIDSYVVASSYSKSFSLYGERVGALSVVSATAAEAKAVQSQVKRIIRTIYSSPSTHGAALVAGVLTSPELRDLWEQELTEMRERIHSLRAGLVEKLATLGAPEFDFIQRQAGMFSYSGLTKTQVDRLRDEFAIYAVGTGRICVAALSQRNLDYVAQAVATVSRV

SEQ ID NO: 13046 - DNA, 1248 bp, Fusobacterium nucleatum
  CDS (1)..(1248)
atgttagcaaaaagatatacagggaaaaaattagtggacaacatatttgcaacaagtaaaaaagctaaacaagctattgtaaaatttggtaaagaaaatgtaatcaatgcaactatcggttctctttataatgaagatgaaaaattagctgtgtatgatgtagttgaaagtgtatatagaaatcttccaccagaagacttatatgcttatgccactaatgtaataggagaagatgactatcttgaagaagttataaaagcagttttttttgatgattataaagaagcattaaaagaattacacattgcttctattgcaacaacaggtggaacaggggctatatctaatactgttaaaaactatatggatacaggagataaagttttactaccaaattggatgtggggaacatataaaaatatagttattgaaaatggtggaaaaattgaaacttatcaattatttaatgaaaatggagattttaactttgaagatttcaaaaataaagttttagaattagcaaaaattcaaaaaaatgttgttcttatactaaatgaacctagtcacaatccaacaggattcagaatgacctatgaagaatgggtaaatcttttggacttctttaagagtataaaagatactaatataattgttataagagatgtagcttactttgaatatgatgatagaggcgaagaagaaacaaaaaaattaagaaaattattaattggtatgcctaagaatatattatttatgtatgcttttagcctatcaaaatctttatctatatatggaatgagaataggagcacaaattgcagtgtcatctgatgaagaagttatacaagagtttaaagatgctcttccattttcttgtagaacaacttggtctaatattccaaaaggtggaatgaaattatttgctactattatgaaaaatcctgaattaaaagctaatttcttaaaggaaaagcaaggttatatgaatttgttaaatgaaagagctaatatattcttaaaagaagctaaggaagaaaatttaaaagttttaccatataaaagtggtttttttgtaactgttccagttggagaaactgttgataaaattatagaagatttagaaagtaagaatatatttgttataaaatttgatacaggtataagaataggattatgtagtgttccaaaaagaaaaataaaaggacttgctaaaaaaataaaggactctattaataaatttaaaaattaa

SEQ ID NO: 13047 - protein, 415 aa, Fusobacterium nucleatum
MLAKRYTGKKLVDNIFATSKKAKQAIVKFGKENVINATIGSLYNEDEKLAVYDVVESVYRNLPPEDLYAYATNVIGEDDYLEEVIKAVFFDDYKEALKELHIASIATTGGTGAISNTVKNYMDTGDKVLLPNWMWGTYKNIVIENGGKIETYQLFNENGDFNFEDFKNKVLELAKIQKNVVLILNEPSHNPTGFRMTYEEWVNLLDFFKSIKDTNIIVIRDVAYFEYDDRGEEETKKLRKLLIGMPKNILFMYAFSLSKSLSIYGMRIGAQIAVSSDEEVIQEFKDALPFSCRTTWSNIPKGGMKLFATIMKNPELKANFLKEKQGYMNLLNERANIFLKEAKEENLKVLPYKSGFFVTVPVGETVDKIIEDLESKNIFVIKFDTGIRIGLCSVPKRKIKGLAKKIKDSINKFKN

SEQ ID NO: 13048 - DNA, 1197 bp, Ralstonia solanacearum
  CDS (1)..(1197)
atgtcgcttttttccgccgtcgagctggccccgcgcgaccccatcctggggctgaatgaagctttcaacgccgatgcccgcagcaccaaagtcaacctgggcgtgggcgtgtacttcaccgacgaaggaaaaatcccggtactgcgcgccgtgcaggaagccgagaaggcccgcctggccatggccgcgccgcgcggctacctgccgatcgaaggcatcgccgcctacgaccaggccgtgcagaagctgctgttcggcgccgattcgccgctgctggccgaaggccgcgtggtgacggcccaggcactgggcggcaccggcgcactgaagatcggcgccgatttcctcaaacgcctgtacccggacgccaaggtcgccatctccgacccgagctgggaaaaccaccgcgcgctgttcgaggccgccggcttcccggtcgtgaactatccgtactacgacgccccgacgcacggcctgaacttcgccgccatgctcgaagcgctcaacggctacgcgcccaacaccatcgtcgtgctgcacgcctgctgccacaacccgaccggcgtggacctgaccaccgagcagtggaagcaggtggtcgaagtcatcaaggccaagcagctgatcccgttcctcgacatggcctaccagggcttcgccgacggcatcgcccaggacggcctggccgtgagcctgttcgccgaatcgggcctgcagttcttcgtgtcgagctcgttctccaagtcgttctcgctgtacggcgagcgcgtcggcgctctgtcgatcgtcaccaccagcaaggacgaggcagcccgcgtgatgtcgcaggtcaagcgcgtgatccgcaccaactactccaacccgccgacgcacggcggcacggtggtcgccagcgtgctgaccagccccgagctgcgcgcgatgtgggagcaggaactgggcgagatgcgcgaccgcatcaagtcgatgcgccacgcgctggtcgacaagcttgccgccaagggcgtgaagaccgacttctcgttcgtgaaggcgcagcgcggcatgttctcgtattcgggcctgtccgccgcccaggtggaccgcctgcgcaacgagcacggcatctacgcggtgtcgaccggccgcatctgcgtggccgcgctgaactcgcacaacatcgacgccgtggtcaacgccatcgccgaagtgctctga

SEQ ID NO: 13049 - protein, 398 aa, Ralstonia solanacearum
MSLFSAVELAPRDPILGLNEAFNADARSTKVNLGVGVYFTDEGKIPVLRAVQEAEKARLAMAAPRGYLPIEGIAAYDQAVQKLLFGADSPLLAEGRVVTAQALGGTGALKIGADFLKRLYPDAKVAISDPSWENHRALFEAAGFPVVNYPYYDAPTHGLNFAAMLEALNGYAPNTIVVLHACCHNPTGVDLTTEQWKQVVEVIKAKQLIPFLDMAYQGFADGIAQDGLAVSLFAESGLQFFVSSSFSKSFSLYGERVGALSIVTTSKDEAARVMSQVKRVIRTNYSNPPTHGGTVVASVLTSPELRAMWEQELGEMRDRIKSMRHALVDKLAAKGVKTDFSFVKAQRGMFSYSGLSAAQVDRLRNEHGIYAVSTGRICVAALNSHNIDAVVNAIAEVL

SEQ ID NO: 13050 - DNA, 1369 bp, Brugia malayi
  CDS (23)..(1237)
cggcacgaggaggaatacaaaaatggcgtctttcttcgggaacatcgagattgcatctcctattgaagttttttatatgaacaaaatgtatcatgaggaaccagcggagtataaagttaacttaaccgttggagcatatcgtacggaagaaggtcaaccgtgggtattaccggtggtacgtgaagcagagaaacgacttgcagatgatattagccatgaatatttaccagtgcttggctatgaaccattctgtagtgcagcagtggaactagttcttgggaagaattcatcgactatcagagctggaaaagccataggtgtgcagtgtctttccggaacgggttcactaaaagctggagccgattttctcagttttgtcatgaaaatggaaacggtttatgtttccaaacctacttggggcaatcataaattgatatttgcaagagctggttttactgatatacgtgaatattattactgggattcaacaaatcgttgtattaatatgaaaaatatgttggccgatcttgagactgcacctgagaatgctgtagtggttttgcatggttgcgctcataatccaacgggtatggatccgactcgtgaccagtggaaacagattgcagaagtttttaagaggaggcatctatttcctttcttcgatcttgcttatcaaggttttgcaagtggtgatctggacgcggatgcctgggctgtacgatattttgttgagcaaggattggagatgttttgtgcgcagtcatttgctaagaattttggcctttataatgaacgagttggtaatctgacagttgtagcatcggatccattggtactagcaagtattaaatcacagatgtcattggttattcgatctaattggtctaatcctcccagtcatggggcaagaattgtgcacatgatattaacttcgccaagtatgtgcgctcagtggcatgatgctataaagacgatgtcttcgcgcataaaggatatgcgatatgcattgcgaaacaatctggaaaaacttggtactcctggaacatgggagcatattacacagcaaattggaatgttttcatttattggtcttaatacggaacaagttgatcaccttatcaagaagtataaagtgtttctgctgaagaatggacgaataaatgtttgtggattaaatccagaaaatgttgaatacgttgcgaaagcaatcaatgaaactatcaataacataaaataaatgggacgctaaattttgtgatttacagtaaagttctttgttaagtgggttaaagaataaagttacagatacaagattgcaaatagtcgcataaagtgtatatatttccgattatcgcctaatttccaaaaa

SEQ ID NO: 13051 - protein, 404 aa, Brugia malayi
MASFFGNIEIASPIEVFYMNKMYHEEPAEYKVNLTVGAYRTEEGQPWVLPVVREAEKRLADDISHEYLPVLGYEPFCSAAVELVLGKNSSTIRAGKAIGVQCLSGTGSLKAGADFLSFVMKMETVYVSKPTWGNHKLIFARAGFTDIREYYYWDSTNRCINMKNMLADLETAPENAVVVLHGCAHNPTGMDPTRDQWKQIAEVFKRRHLFPFFDLAYQGFASGDLDADAWAVRYFVEQGLEMFCAQSFAKNFGLYNERVGNLTVVASDPLVLASIKSQMSLVIRSNWSNPPSHGARIVHMILTSPSMCAQWHDAIKTMSSRIKDMRYALRNNLEKLGTPGTWEHITQQIGMFSFIGLNTEQVDHLIKKYKVFLLKNGRINVCGLNPENVEYVAKAINETINNIK

SEQ ID NO: 13052 - DNA, 1284 bp, Giardia lamblia
  CDS (1)..(1284)
atgtctgtcttctcagggtttcctgcttccccaccagatgctatcctgaatctcacggtactctacaacgccgatacctacccgaaaaaggtgaacctgggggttggcgcgtatcgtgacgagagcggtaaaccatggattctgccggccgtgaaggaggcagaggccattatatcttccgatctttcgaagtataataaggagtatcctccagtcgccggatttcctctgtttctggaggccgcccagttcctgatgttcggcaaggacagcaaggcagcccaggagggtcgcattgctagctgccagtctctctctggcaccggctctctccacatcgggtttgagttcctgcacctctggatgccaaaggcagagttttacatgccgagcacaacgtggcccaaccactacggaatatacgataaggtgttcaacaaattgaaggtgccatacaaggagtatacgtatcttcgtaaagacggagagcttgagatagacttttccaacacgaagaaggacatccagtcggctccagagaaaagcatattcctgttccacgcctgtgcccacaacccgtctgggatcgacttcactgaggctcagtggaaggagctccttccgatcatgaaggagaagaagcacattgccttttttgattcagcataccagggctttgctacgggctcctttgaggccgacgccttcgctgtgcgcatgtttgtcgatgcgggggtagaggtccttgtcgcccagagcttctccaagaacttcgggctctatggagagcgtatcggctgcctacatgttgtccatgcaggagtggaggggtccgtcgagaagaacaaggcgctttctgctgctatggtgagtggaatgactctccagatccgtaagacgtggtccatgtctgcgatccacggggcctatatcgtccaagtcatcgttcacgacaagcgccttctgcagatgttttatgacaatgtcaaggagatgagtgctcgcattcaccgaatgcgtagtctcctgcatgcctcccttgcgaagcgcaagactccaggccccggttccaaagggacctgggaccatatactgacagccatcggcatgttcactttcaccgggctcaccccagagcacgttgattatctgaaggagaagtggagtatctatcttgtgaaggcagggggacgcatgagtatgtgcgggctcactgagtctaattgtgactatgtggctgaggcgattcacgacgccgtcacgaagctcccgttcaagaaatga

SEQ ID NO: 13053 - protein, 427 aa, Giardia lamblia
MSVFSGFPASPPDAILNLTVLYNADTYPKKVNLGVGAYRDESGKPWILPAVKEAEAIISSDLSKYNKEYPPVAGFPLFLEAAQFLMFGKDSKAAQEGRIASCQSLSGTGSLHIGFEFLHLWMPKAEFYMPSTTWPNHYGIYDKVFNKLKVPYKEYTYLRKDGELEIDFSNTKKDIQSAPEKSIFLFHACAHNPSGIDFTEAQWKELLPIMKEKKHIAFFDSAYQGFATGSFEADAFAVRMFVDAGVEVLVAQSFSKNFGLYGERIGCLHVVHAGVEGSVEKNKALSAAMVSGMTLQIRKTWSMSAIHGAYIVQVIVHDKRLLQMFYDNVKEMSARIHRMRSLLHASLAKRKTPGPGSKGTWDHILTAIGMFTFTGLTPEHVDYLKEKWSIYLVKAGGRMSMCGLTESNCDYVAEAIHDAVTKLPFKK

SEQ ID NO: 13054 - DNA, 1173 bp, Trypanosoma brucei
  CDS (1)..(1173)
atggggaaaccggatcccatcctcggcctcgggcaggattttcgtatggatcccgccaaaaggaaggtgaatttgtctattggtgtgtaccgcgacgacgccgaccagccttttgtgctggaatgtgtgaaacaagccacattaggcaccaacatggactacgccccagtcacaggaattgcaagttttgtagaggaggctcaaaaactgtgttttggcccaacgtgtgcggcgcttcgggatggacgcattgcaagttgccaaacgcttggcggcacaggtgcgcttcggattggtggtgaccttctcaatcgctttgtggccaattgtaaccgcatttacggtcctgacgtcggttatccgaatcatgagagtatctttgctaaggcgggaatggaacttaccccatattcgtactatgatcctgccacaaaaggttttaaccttgcgggtatgctcgagtgcctagaccaagggcgcctgaggggctctgttaaaactcgttcaatgccagcgcaacacaatccaactggcgtcgatccaacacacgatgactggcgacaggtgtgcgatgtgataaagaggcgtaaccatattccgttcgtagacatggcttacccaagttttgctactggtcaattggattatgatgccttcgtgccacgccacctggtggatatggtgccaaacctgattgttgcgcagagtttctccaagaactttggcctgtacgggcatcgctgtggtgctcttcacctctcaacggcgagtgctgaagaggcgaagcgtttggtctcacaattggccctactgattcggcccatgtatagcaatccgcctctttatggtgcctgggtcgtaagttctattctaaaggacccgcagctgactgcactctggaagaaggaattgaagcaaatgtcatctcgcattgctgaggtgcgcaagcgtttggtttcagagctgaaagcatgcggctccgtccatgactggtctcacattgagcgccaagttggtatgatggcatacacaggcctaacaagggagcaggtggagttactgaggagcgagtaccacatatacatgacattaaatggtcgcgctgcggtgtccggacttaacagcacaaatgttgaatatgtttcacaagctattcacaacgttactaaatga

SEQ ID NO: 13055 - protein, 390 aa, Trypanosoma brucei
MGKPDPILGLGQDFRMDPAKRKVNLSIGVYRDDADQPFVLECVKQATLGTNMDYAPVTGIASFVEEAQKLCFGPTCAALRDGRIASCQTLGGTGALRIGGDLLNRFVANCNRIYGPDVGYPNHESIFAKAGMELTPYSYYDPATKGFNLAGMLECLDQGRLRGSVKTRSMPAQHNPTGVDPTHDDWRQVCDVIKRRNHIPFVDMAYPSFATGQLDYDAFVPRHLVDMVPNLIVAQSFSKNFGLYGHRCGALHLSTASAEEAKRLVSQLALLIRPMYSNPPLYGAWVVSSILKDPQLTALWKKELKQMSSRIAEVRKRLVSELKACGSVHDWSHIERQVGMMAYTGLTREQVELLRSEYHIYMTLNGRAAVSGLNSTNVEYVSQAIHNVTK

SEQ ID NO: 13056 - DNA, 1212 bp, Trypanosoma brucei
  CDS (1)..(1212)
atgtccaggccctttaaggacttagcacccgttccattggaccccgtctttggtctagcgagggctgcaaaggccgccccagaaccgaaggcggatctcgttattggtgcctaccgcgaccaaaacgggttgccgtatccattaaaagtagtgcggaaggctgagcggcgcattgtggacatgggccttgataaagagtacccacccatgactggtcttcttaactttgttgaagaagctgtaaaactcgcctacggcaatacggtgccattggagcgtatcgccgcctcgcagggtctcagcggcaccggctcgcttagccttggagccacgctcctcaggcaggttgtacctgaagatacccctgtgtatgtttcaaatcccacatggtcaaaccacgtatcaatattcggaattgtgggccacaaaaatatccgtgaataccgttactacagtcccagcacccatgagctggacttcgttggcctcattgaagatctgaacgtggcccctcaggggagtattattgtgctgcacgcatgtgcccataaccccactggtgtggatccaagcaaagatcagtgggcaaccatcgccgatgtatttgttgaacgtaaattgattcccttctttgactccgcctaccagggttttgcatccggcagtctcgacgaggacgcctacgccatccgccactttgcaaagagagggatggaaatgttacttgcacartccttttccaagaacatgggtttgtatgccgaacgtgttggtgtgatttctgctgtcgtttcggatgcttcaaggaaggaggccgtgcggagccgccttgaggtgatcgcccgttcctattactcaaccccacctgtacatggcgctcgcatcgctcacctcgtgatgagtgacaaagaactccgcgcagaatgggagcaggaactcaaggagatggtgaaccgcgttcgaagcatgcgtcaaggtgtttatgaagggctgatgaaactcggtactcccggcacttgggagcacatcatcaaccagaagggtatgttctcttatatgggactttcaaggcctcagtgcgaaaggttgtgcgagaagcgcgtttttgtgctgcctgtcggccgcgccaacctcgcagcgttaacgccctcaacaatggattttctggtcaagtcgattgacgatgttgtccgacacgtgcgtaacaagtag

SEQ ID NO: 13057 - protein, 403 aa, Trypanosoma brucei
MSRPFKDLAPVPLDPVFGLARAAKAAPEPKADLVIGAYRDQNGLPYPLKVVRKAERRIVDMGLDKEYPPMTGLLNFVEEAVKLAYGNTVPLERIAASQGLSGTGSLSLGATLLRQVVPEDTPVYVSNPTWSNHVSIFGIVGHKNIREYRYYSPSTHELDFVGLIEDLNVAPQGSIIVLHACAHNPTGVDPSKDQWATIADVFVERKLIPFFDSAYQGFASGSLDEDAYAIRHFAKRGMEMLLAQSFSKNMGLYAERVGVISAVVSDASRKEAVRSRLEVIARSYYSTPPVHGARIAHLVMSDKELRAEWEQELKEMVNRVRSMRQGVYEGLMKLGTPGTWEHIINQKGMFSYMGLSRPQCERLCEKRVFVLPVGRANLAALTPSTMDFLVKSIDDVVRHVRNK

SEQ ID NO: 13058 - DNA, 1218 bp, Crithidia fasciculata
  CDS (1)..(1218)
atgtctggatctccgaccgacaacttcgacggcctctccgcgctgccgccggactccatcttcttcacgtcgcaaaaggccaaggcggcgcagggtcccaaggccgacctcatcatcggcgcctaccgcgacgagcatggctgcccctacccgctcaagacagtgcgcaaggcggagcgcatactgctcgacatgaacctcgactacgagtacctgcccatgaccggctacaagcccttcgtggacgaggcaaccaagatcatctacgccgacagcgtggcaccggaccacctcgtagcggtgcagacgctcagcggcaccggcgccgtctacctcggtgccgccttcctcgccgaggtgtacgacccaaagaccacgcccatctaccttccgaacccgacgtggcccaaccacccgagcatcttgaagctgacgggctggaaggatatccgcacctacaactactacgaccccaagacggtagcactggacttcgaggggattaagaaggacattcaggaggcgccagagtgctcggtgttcctgctgcaccagtgcgcacacaaccccaccggcgtcgacccctcgcacgcgcagtgggaggagatcgctgatctgatgctggccaagaagcaccaggtgttcttcgactccgcctaccagggctacgcgagcggcagcctcgacgaggacgccttcgcggcgcgtctctttgtgaagaagggcgtccaattcattctcgcccagtccttctccaagaacatgggtctttacaacgagcgcaccggcaccctgtccgtcgtcctgcgcaacccggagcgtgcggcggccgtgaagacgcacctggatctgctcatccgtgccaactactcgaacccgccggcccacggtgcccgcctcgtgcacctcgtgctgagcgataaggagttgcggaaggagtgggaggccgagctggcggagatggcgaaccgcattcgcacgatgcgtcacaccgtctacgacgagctgaagcgcctcgggacgccgggcacgtgggagcacatcatcaaccagatcggcatgttctccttcctcggtctctccaaggagcagtgccagtactgccaggaccacaacgtcttcatcctgctctctggccgcgcgaacatggccgggctgacgcacgacacggcgctcatgctggccaggacaatcgatgaggcggttcgcacggtgtaa

SEQ ID NO: 13059 - protein, 405 aa, Crithidia fasciculata
MSGSPTDNFDGLSALPPDSIFFTSQKAKAAQGPKADLIIGAYRDEHGCPYPLKTVRKAERILLDMNLDYEYLPMTGYKPFVDEATKIIYADSVAPDHLVAVQTLSGTGAVYLGAAFLAEVYDPKTTPIYLPNPTWPNHPSILKLTGWKDIRTYNYYDPKTVALDFEGIKKDIQEAPECSVFLLHQCAHNPTGVDPSHAQWEEIADLMLAKKHQVFFDSAYQGYASGSLDEDAFAARLFVKKGVQFILAQSFSKNMGLYNERTGTLSVVLRNPERAAAVKTHLDLLIRANYSNPPAHGARLVHLVLSDKELRKEWEAELAEMANRIRTMRHTVYDELKRLGTPGTWEHIINQIGMFSFLGLSKEQCQYCQDHNVFILLSGRANMAGLTHDTALMLARTIDEAVRTV

SEQ ID NO: 13060 - DNA, 1185 bp, Rhizobium loti
  CDS (1)..(1185)
atgttcgaagacctgcagccagctcccgccgacaagatcctggccctcatcggcctctatcgcgccgatccgcgtcccaacaaggtcgacctcggcgtcggcgtctacaaggatcgcgacggcaagaccccagtgatgcgcgccgtgcgtgaggctgaaaagcggctgctgaacagccaggacaccaagacctatctcgggctcgccggcgacaccggcttcaacgcggtgatggccaagctcgccttcggcccgggcgcggacatgacgcgcattcgggcggcccaggcgcctggcggctccggtgcgcttcgcctggtggcggagctgctcaagcggacccgttcggacgccacgatctggctgtcggacccaacctggccgaaccatatgccggtgatgcgcgctgccggcctgcagatccgcgaatatccctatttcgacgcggcctccggtgctgttcgcttcgacgacatgctggcggcgttgcggacggccaagagcggcgacgtggtgctgctgcacggctgctgccacaatccaaccggcgccaatctggatgcggcgcagtggcaggccgtcaccgatctgatggtcgagcgcggcctgctgccattcgtcgacatcgcctatcagggctttggcgacggcctcgaggccgacgctcttggcctgcgcctgctggcggcgaaagttccggaaatggttgttgcctcgagctgctcgaagaatttcgccgtctaccgcgaccgtgtcggcgcagcgatggttttggccagggacagcgcgcaggctgacgtggcgatgagccagatgctgtcggcggcgcgcgccatgtattcgatgccgccggaccatggtgccgcggcggtgcgcatcgtgctcgaagacgcaagcctgcgcgccgactgggaagccgaattggaagagatgcgcctgcgcatgctgaggcttcgcgtggctttcgccgaggcgctgcgccggcagtccaactccgaccgcttcgacttcgtcgccagccaccgcggcatgttctcacggcttggcctgacggaagcgcaggtcgagcggctgcgcgccgagcacggcgtgtacatggtcggcgatagccgcatcaacgtcgctggactgccggaggatggcatggacgcgctcgccaaggcgatcgtctccgtgctcgactga

SEQ ID NO: 13061 - protein, 394 aa, Rhizobium loti
MFEDLQPAPADKILALIGLYRADPRPNKVDLGVGVYKDRDGKTPVMRAVREAEKRLLNSQDTKTYLGLAGDTGFNAVMAKLAFGPGADMTRIRAAQAPGGSGALRLVAELLKRTRSDATIWLSDPTWPNHMPVMRAAGLQIREYPYFDAASGAVRFDDMLAALRTAKSGDVVLLHGCCHNPTGANLDAAQWQAVTDLMVERGLLPFVDIAYQGFGDGLEADALGLRLLAAKVPEMVVASSCSKNFAVYRDRVGAAMVLARDSAQADVAMSQMLSAARAMYSMPPDHGAAAVRIVLEDASLRADWEAELEEMRLRMLRLRVAFAEALRRQSNSDRFDFVASHRGMFSRLGLTEAQVERLRAEHGVYMVGDSRINVAGLPEDGMDALAKAIVSVLD

SEQ ID NO: 13062 - DNA, 1191 bp, Pasteurella multocida
  CDS (1)..(1191)
atgtttgaaaatattaccgccgcgccagctgatccgattttaggtttaggggaatcatttaaagcggaaacgcgcgataataaaatcaatcttggcattggtgtatataaagatgcgaaaggcaatacaccaattatgcgtgcggtcaaagaggcagaaaagcgcttatttgatcttgaaatgagcaaaaattatttagctattgacggggtcgcagaattcaatgcctgtacgaaagaattgttatttggcgcagattcagagatagttaaacaaggtcgtgcaaaaaccgttcaaagtttaggtggtactggtgcattacgtatcgcagcagagtttattaaacgccaaactaaatcacaaaatgtttggattagcacaccaacttggccaaaccataatgcgatttttaatgctgtcggcatgacgattcgtgaataccgctattatgatgcagaaaataaatgcttagattgggataacttaattgctgatttaagcaatgcgggggaaggcgatgttgttttactacatggttgctgtcataacccgactggaattgaccctactccagcacaatggcaacaattagccaagatgtcggaagaaaaaggttggttaccgttatttgactttgcttaccaaggttttgcaaatggtctcgaagaagatgcgtttggtttacgtacctttgccaaaaatcataaagaattattagtcgcaagttcttattctaaaaactttggtctttatagcgagcgcgttggtgctttcacgttagtggcagaaacagagcaaatagccgcgacggcactcacgcaagtcaaaaccattattcgtacgctctattctaacccagcatcacatggcgcaacgacagtttctatggtattaaaagacagtcagttacgtgccgagtgggaaaacgaattaaccgaaatgcgtgaacgtattaagcaaatgcgtagccaatttgttgaattattgaaagcatttgcttcagaacaagattttagttttattattgatcaaaatgggatgttctctttctgtggcttaaatccagcacaaatggatcgtttaaaagaggaatttgccatttatgccgtgcgttctggtcggattaatgtcgcaggcattactgaacagaatattcgttatctgtgtgaaagtattgcgaaagtcctttaa

SEQ ID NO: 13063 - protein, 396 aa, Pasteurella multocida
MFENITAAPADPILGLGESFKAETRDNKINLGIGVYKDAKGNTPIMRAVKEAEKRLFDLEMSKNYLAIDGVAEFNACTKELLFGADSEIVKQGRAKTVQSLGGTGALRIAAEFIKRQTKSQNVWISTPTWPNHNAIFNAVGMTIREYRYYDAENKCLDWDNLIADLSNAGEGDVVLLHGCCHNPTGIDPTPAQWQQLAKMSEEKGWLPLFDFAYQGFANGLEEDAFGLRTFAKNHKELLVASSYSKNFGLYSERVGAFTLVAETEQIAATALTQVKTIIRTLYSNPASHGATTVSMVLKDSQLRAEWENELTEMRERIKQMRSQFVELLKAFASEQDFSFIIDQNGMFSFCGLNPAQMDRLKEEFAIYAVRSGRINVAGITEQNIRYLCESIAKVL

SEQ ID NO: 13064 - DNA, 1302 bp, Bacillus subtilis
  CDS (1)..(1302)
atgaatgatgcagcaaaagagctgaacagaacattatctgaagaaaacccgtacgtgcttcatatgctttctgatttgggcagagagttgttttatccgaaaggggtgctgacacaatcggcggaacgaaagcaaggccggaagtataatgccacgatcgggattgccacctcacaaggcgagtccatgcacttttcccatattcaagagacactgtccgcctataaccccgatgatatctacgattatgctccgccgcagggaaaagagccgctcagacaggaatggctgaaaaaaatgcgtctcgaaaatccttcattagccggcaaagacatcagcacgccgatcgtgacaaacgctttacacacgggctacattgccgccgacttgttcgtcaatgaaggggatgcgctgcttctgcctgataaatattggggaaattacaatttcattttcggtgtccggcgcaaggcatccattgagacgtacccgctttttcagcaggatgggcgttttaatgcggcggggctgtccgagctgctgaaaaagcagaaagaaaaggcgattgttgtgctgaatttcccgaataatccgacaggctatacgccgggggaagaggaagcgtcagaaatcgtcagcgtgattctggaggcggcggaggccggcaaagagattgtcgtgctcgtagatgatgcgtattacaatctgttttacgatgaaacggccattcaggaatccatcttcagcaaactcgcccaagtgcacgaccgggtgctttgcgtgaaaatagacggcgcgacgaaggaaaattacgcatggggattccgcgtcggttttattacgtacagcacaaaaagcgaaaagctgcgcgtgctcgaggaaaaaacaaaagggattatcaggggaacgatttcaagcgccccgcacccgtcccaaacattcatgcttcgggcgatgcagtcaccggaatacgagaaagaaaaatcgctgaaatataacatcatgaaaaaacgggctgacaaagtgaaagccgttcttgcagaaaacaagcattatgaagacgtatggacgccttatccgtttaactcgggctatttcatgtgtgtccggctgaaagacataaacgccggcgaattgagagtgtcgttgcttgaaaagagaggaatcggaacgatatccattaatgaaaccgatttgcgaatcgcattttcatgtgttgaagaagaacacatcgcggatctgttcgaagaaatttatcaagaagcaaagcagctgcagaaacaggcggaaatatcaggctga

SEQ ID NO: 13065 - protein, 433 aa, Bacillus subtilis
MNDAAKELNRTLSEENPYVLHMLSDLGRELFYPKGVLTQSAERKQGRKYNATIGIATSQGESMHFSHIQETLSAYNPDDIYDYAPPQGKEPLRQEWLKKMRLENPSLAGKDISTPIVTNALHTGYIAADLFVNEGDALLLPDKYWGNYNFIFGVRRKASIETYPLFQQDGRFNAAGLSELLKKQKEKAIVVLNFPNNPTGYTPGEEEASEIVSVILEAAEAGKEIVVLVDDAYYNLFYDETAIQESIFSKLAQVHDRVLCVKIDGATKENYAWGFRVGFITYSTKSEKLRVLEEKTKGIIRGTISSAPHPSQTFMLRAMQSPEYEKEKSLKYNIMKKRADKVKAVLAENKHYEDVWTPYPFNSGYFMCVRLKDINAGELRVSLLEKRGIGTISINETDLRIAFSCVEEEHIADLFEEIYQEAKQLQKQAEISG

SEQ ID NO: 13066 - DNA, 1203 bp, Chlamydia muridarum
  CDS (1)..(1203)
atgagtctttttgaacagttaccttctttctctccggattctattcttggtttagcacaagcttttcaagaagatcctcgtgaggataaaattaatttattactgggtacttacgagcgagaaaaaagccgatacggaggattctcaagcgtcagaaaggctcaaacagtgttttttggtgatgagaaagataaaaactatcttcccatcagaggatcctcagtttttttagaccagatggctgctctatgttttggcgagattgatgctaatcgatggactggagtgcaagctgttggtgggactggagccttacatttgggcgccttagtgtatgctaaatcttctcttgcaggtaaagtctatatcccagctcaaacttgggggaaccactctagaattttttctcgtctaggattgtccctagaacattatccctactatgatcaagaaaaaaaagatctcgatttgcaaggattaaaagcatctcttcgggatgctcctgaggcttctttaattcttttacattgttgttgtcataaccctacagggaaggatattcccctttctgaatggcctgaaattattgctattataaaggacagaggcctcattcctttctttgatatggcttatttaggttttgctaacggaatagtagaggatcgccgacctgttcggctttgcatagaggctggagttgctacttttgttgcaggaagttgtagtaaaaacttctcattatatggttctcgggtaggattttttggggttgttcaccaagataaaacggatttgagcaggatactttctttcttggaagagcagatccgtggggaatactcttctcctgctagagaaggtgttgcaatcgttacctctatattagagaatccctacttgcgacaagagtgggggcttgaactgaatggtattcgccagtctttggaagaaattcgagcgaattttgttattgcaatgagagaagtagcgggacattcttttgatttcatcgcgtctcagaaaggattttttgggtatccaggtttttcaaaagagcaggttgtgttccttagagaagagcttggtatttatacaacagctggtggaagattcaatttaaatggcattacagataaaaatataaatcgtgttatccacggttttgctaaggcctatgaatactctcggtccgtatcataa

SEQ ID NO: 13067 - protein, 400 aa, Chlamydia muridarum
MSLFEQLPSFSPDSILGLAQAFQEDPREDKINLLLGTYEREKSRYGGFSSVRKAQTVFFGDEKDKNYLPIRGSSVFLDQMAALCFGEIDANRWTGVQAVGGTGALHLGALVYAKSSLAGKVYIPAQTWGNHSRIFSRLGLSLEHYPYYDQEKKDLDLQGLKASLRDAPEASLILLHCCCHNPTGKDIPLSEWPEIIAIIKDRGLIPFFDMAYLGFANGIVEDRRPVRLCIEAGVATFVAGSCSKNFSLYGSRVGFFGVVHQDKTDLSRILSFLEEQIRGEYSSPAREGVAIVTSILENPYLRQEWGLELNGIRQSLEEIRANFVIAMREVAGHSFDFIASQKGFFGYPGFSKEQVVFLREELGIYTTAGGRFNLNGITDKNINRVIHGFAKAYEYSRSVS

SEQ ID NO: 13068 - DNA, 1191 bp, Aeromonas hydrophila
  CDS (1)..(1191)
atgtttgaaaaggttgttgccgccccaccggatccgatcctgggcctgaccgaagccttccgcgctgactctcgcagccacaagatcaatctgggggtcgggatctacaaggatgaaaccggtgccacccctatccttcactgcgtcaagaaagccgagcagaagctgctcaccgacgagaagaccaagaattatctcggtattgaaggcaatatcgaatacggccgcatagtgcagcaactgctgttcggacaggactccgccttgatcgccagtggccgcgccaagaccgcccaggcgccgggcggcaccggtgccctgcgcattgccgccgagttcgtggtgcgcaacgggctggccaagaccatctggatctccgatcccacctgggccaaccacgtcagcgtattccaggccgccggtttgaccgtcaagtggtacaagtactacgacgccgccaccaaggggctcgactttgccgccatgcaggcgtcgctcaatgacgtacaggctggtgagctggtgctgctgcacggctgctgccacaacccgaccggtatcgaccccaccgctgagcagtggcgcgccctggccaaacagagtgccgccgccggctggctgccgctgtttgacttcgcctatcagggctttgcccgtggcatcgaagaagatgccgagggtcttcgcatcttcgccgagtgtcacgacgagctgctggtggcgagctctttctccaaaaacttcggcctctacaacgagcgggtcggcgccttcaccctggtcagcgcgaccaaggcgatcgccgatgtggccttcacccaggtcaagaccgtcatccgtgccaactactccaacccgccgtcacacggcgctgccgtggtgacaaccatcgtcagtgacccggctctctatgtcgagtgggttgaagaagtggcggccatgcgggtgcgcattcgcgagatgcgcgagctgctggtggagaagctggcagccttgggtgtgagccaggatttcagctttatccgcgagcagaacggcatgttctccttctccggtctctccaaggatcaggttgagcagctcaagagcgagtttgccatctacatcgtcggttcaggccggatcagcgtggccgggatcacccgtgccaacatagatcccctgtgtgacgccatcgccaaggtactgtga

SEQ ID NO: 13069 - protein, 396 aa, Aeromonas hydrophila
MFEKVVAAPPDPILGLTEAFRADSRSHKINLGVGIYKDETGATPILHCVKKAEQKLLTDEKTKNYLGIEGNIEYGRIVQQLLFGQDSALIASGRAKTAQAPGGTGALRIAAEFVVRNGLAKTIWISDPTWANHVSVFQAAGLTVKWYKYYDAATKGLDFAAMQASLNDVQAGELVLLHGCCHNPTGIDPTAEQWRALAKQSAAAGWLPLFDFAYQGFARGIEEDAEGLRIFAECHDELLVASSFSKNFGLYNERVGAFTLVSATKAIADVAFTQVKTVIRANYSNPPSHGAAVVTTIVSDPALYVEWVEEVAAMRVRIREMRELLVEKLAALGVSQDFSFIREQNGMFSFSGLSKDQVEQLKSEFAIYIVGSGRISVAGITRANIDPLCDAIAKVL

SEQ ID NO: 13070 - DNA, 1574 bp, Drosophila melanogaster
  CDS (106)..(1380)
ttgtctttagtattctcttgaggccggcggcgattggcaacgtttattacagtttctaattgttattaacttaaagcttagtacaaccaccgagtgcatttagcaatgtcgcagatctgtaagcgcggtttgttgatcagcaaccgattggcgcccgccgccctccgctgcaaatcaacatggttctccgaggtgcagatgggcccacccgatgccatcttgggtgtcacggaagccttcaagaaggacaccaaccccaagaagatcaacttgggcgctggcgcctatcgcgatgacaacacccagcccttcgtgctccccagtgttcgggaggccgagaagagagtggtgagccgtagtctggacaaggagtacgccacaatcatcggcattcccgagttctacaacaaggccatcgagctggcattgggcaagggatccaagcgtttggcggccaagcacaacgtgaccgcccagtccatcagtggaactggagctctgcgcatcggagccgccttcctggccaagttctggcagggcaaccgcgagatctacatcccgtcgccatcgtggggcaaccatgtggccattttcgagcacgccggtctgccggtgaaccgataccgctactacgacaaggacacctgtgccctggactttggcggcctgatcgaggatctgaagaaaatccccgagaagagcattgttcttctgcacgcctgcgcccacaaccccactggagtggatcccactctggagcagtggcgtgagatctcggctctggtcaagaaacgcaatctgtatcccttcatcgacatggcctaccaaggcttcgccaccggagacattgaccgcgacgcccaggcggtccgcaccttcgaggccgatggccacgacttctgcctggcccagagtttcgccaagaacatgggattgtatggtgagcgcgctggcgccttcaccgtgctgtgctccgacgaggaggaggctgctcgcgtgatgtcccaagttaagatcctgatccgtggtctgtactccaatcccccggtgcacggagctcgtattgccgccgagatcctcaacaacgaggacttgcgcgcccagtggctgaaggatgtgaagctgatggccgaccgcatcatcgatgtgcgcaccaagctcaaggacaatctaattaagctgggatccagccagaactgggaccacattgtcaaccaaatcggcatgttctgcttcacgggcctgaagccggagcaggtgcagaagctgatcaaggatcacagcgtctatctcaccaacgatggacgtgtttcgatggcgggagtcaccagcaagaatgtcgagtacctggctgagagcatacacaaggttaccaagtaaggaggaccagtggagatcgaagtggagatggagtttctgtagtaccttctaatcggcacttgtacgaattttctagcaccaacgaaattgcgaagtctagataagccaatgcattttgcacactctctatccatatctctgtatataagctaaatgatctgccttttaaaaaataaagcatttaaaatgttagt

SEQ ID NO: 13071 - protein, 424 aa, Drosophila melanogaster
MSQICKRGLLISNRLAPAALRCKSTWFSEVQMGPPDAILGVTEAFKKDTNPKKINLGAGAYRDDNTQPFVLPSVREAEKRVVSRSLDKEYATIIGIPEFYNKAIELALGKGSKRLAAKHNVTAQSISGTGALRIGAAFLAKFWQGNREIYIPSPSWGNHVAIFEHAGLPVNRYRYYDKDTCALDFGGLIEDLKKIPEKSIVLLHACAHNPTGVDPTLEQWREISALVKKRNLYPFIDMAYQGFATGDIDRDAQAVRTFEADGHDFCLAQSFAKNMGLYGERAGAFTVLCSDEEEAARVMSQVKILIRGLYSNPPVHGARIAAEILNNEDLRAQWLKDVKLMADRIIDVRTKLKDNLIKLGSSQNWDHIVNQIGMFCFTGLKPEQVQKLIKDHSVYLTNDGRVSMAGVTSKNVEYLAESIHKVTK

SEQ ID NO: 13072 - DNA, 1535 bp, Arabidopsis thaliana
  CDS (96)..(1313)
tgtgaacaagattaaaaagacgacttctcttttaacttattcctcctctgcttcttcaagatccattgtctgcaatttcaatcccttgtctcgtcatggattccgtcttctctaacgttgctcgtgctcccgaagatcctattctcggtgtaactgttgcttacaacaatgatcctagtcctgttaagatcaatttgggtgtcggtgcctaccgaactgaggaagggaagcctcttgttcttgatgtggtgcgtaaggcagagcaacagctagtgaacgatccgtctcgggtcaaggaatacattcccattgttggtatttccgattttaacaagttaagcgccaagctcatcttaggtgctgacagtcctgcgattacagaaagtagagttactacagtccagtgcttgtctggtactggttcgttgagagttggggctgagtttctcaaaacacactaccaccaaagtgtcatttacattccaaaaccaacttgggggaaccatcccaaagttttcaacttggcaggcttgtctgtggagtatttccgctactatgatcctgcaacccgtggtcttgacttcaaaggcttgctcgaggatcttggcgctgcaccatctggagctattgtcttacttcatgcatgtgcacacaatcccactggagttgacccaacctctgaacagtgggaacagattcgacagctgatgagatctaaaagcttattacccttttttgatagtgcatatcagggttttgctagtggtagccttgacacagatgcacaatctgtccgtacatttgttgctgatggcggtgaatgcttgatagctcaaagttacgccaaaaatatgggactttatggggagcgtgttggtgcccttagcattgtctgcaagtcagcagatgtggctagtaaggttgagagccaggtgaagcttgttgtgcggcccatgtattcgagcccccctattcatggagcatcaattgttgccaccattctaaaaagcagtgatatgtacaacaactggaccatcgagctgaaagaaatggctgaccgtataaagagcatgcgccaacagttatttgaagctatacaagctagaggtacacctggtgactggagtcatattatcaaacagattgggatgtttacatttactggattgaacaaggagcaagttgaattcatgaccaaagagttccacatttacatgacctctgatgggagaataagcatggcaggtctaagttcgaagacagtgcctcaccttgccgatgctatgcatgctgcagtgacccgcctcggctaaactagcgaccatacatttttttgctgtttctacaaataaaatgggacaaaaaaaaagaacaccgtttttgttggcttatatactatggtttttttctgatggtaccatatgtttcctcatgtcttttgactaaagatggttgaaccaaaaccaaagtgaggattgtgacattgagatctaccgtttctaagaaaatattggttactttaatttgccaccaac

SEQ ID NO: 13073 - protein, 405 aa, Arabidopsis thaliana
MDSVFSNVARAPEDPILGVTVAYNNDPSPVKINLGVGAYRTEEGKPLVLDVVRKAEQQLVNDPSRVKEYIPIVGISDFNKLSAKLILGADSPAITESRVTTVQCLSGTGSLRVGAEFLKTHYHQSVIYIPKPTWGNHPKVFNLAGLSVEYFRYYDPATRGLDFKGLLEDLGAAPSGAIVLLHACAHNPTGVDPTSEQWEQIRQLMRSKSLLPFFDSAYQGFASGSLDTDAQSVRTFVADGGECLIAQSYAKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 13074 - DNA, 1490 bp, Arabidopsis thaliana
  CDS (48)..(1259)
aatgaattttggggtcaaattcatttcaactgattcaatcaattctcatgaattccatcttgtcaagcgtccttcctgctcccgaagatcctgttctcagtgtaatttttgcttgtagagatgatcctagtccggttaagttgaatttgagcgcaggtacctatcgaactgaggaaggaaagcctcttgttcttgatgttgtgagaagagcagagcaacagttagccaacgacctggacaaggaatatcttcccctcaatggacttcctgaatttaataaattaagtaccaagctcatcttaggtgatgatagtcctgcattgaaagagaatagagttgttacaacccaatgtttgtctggtactggttctttgagagttggagctgagtttctagcaacacacaacaaagaaagtgtcattttcgttccaaacccaacgtgggggaaccatccccgtatttttactttggcgggtttgtctgtccagtatttccgttattatgatccgaagagccgaggactcgacttcaaaggcatgctcgaggatcttggcgctgcacctcctggagctatagtggtacttcaagcttgtgcgcataaccccacaggagttgacccaacattcgaacaatgggaaaagattcgacgactagtgagatcgaaaagcttattacctttctttgatagtgcatatcagggttttgctagtggtagccttgacgcagatgcacaagcggttcgtatgtttgtagccgatggaggtgaatgtttgatagctcaaagttatgccaaaaatatgggcctttatggggagcgtattggctctcttacgatcgtatgcacatcagaagatgtcgctaagaaagttgagaaccaagtgctacttgttgtgaggcctatgtatcttacaccacctattcatggtgcatctattgttgccacaattctaaaaaacagtgatatgtacaatgactggaccattgagctgaaaggaatggctgaccgcataattagcatgcgtcaacagttatatgcagctctagaagctagaggaacacctggtgattggagtcacattattaaacatattgggatgtttacttttaccggattgagtgaggagcaagttcgcttgatggccaaagaatatcacatttacatgacttatgatgggaggataagcatggcaagtctaagttcgaagacagtgcctcaactcgctgatgctatacatgctgttgttactcgcatcgcctaattaaatttgcgattctgttcttttgttgtttaatttatgaacacaattagagaataaaactgcgttcttggtttacatttaataagatagcacaaagaagcaatattatggatgatattgtttctagttggtagtcaaacctaccaaaatgaggattgggacctttaaaccaacacagttttttatattttgttttcattttcaatttatataataaagattacatcaatt

SEQ ID NO: 13075 - protein, 403 aa, Arabidopsis thaliana
MNSILSSVLPAPEDPVLSVIFACRDDPSPVKLNLSAGTYRTEEGKPLVLDVVRRAEQQLANDLDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 13076 - DNA, 2001 bp, Sus scrofa
  CDS (54)..(1295)
gagcggctccgggcgcgaggtgaaagctcccggccgactcctgctctctagctatggcacctccatcagtctttgccgaggttcctcaggcccagccggtccttgtctttaagctcattgctgacttccgggaggatccggacccccgcaaggtcaacctaggagtgggagcttatcgcaccgatgattgccagccttgggttttgccagtcgtgaggaaggtggagcagaggattgctaatgacagcagcctaaaccacgagtacctgcccatcctgggcctggcagagttccggacctgtgcttcccgccttgcccttggagatgacagcccagctcttcaggagaagcgggtgggaggggtgcagtctttggggggaacgggtgcacttcgaattggagctgagttcttagcacgatggtacaatggaacgaacaacaaagacacgcctgtctacgtatcctcaccaacctgggaaaatcacaatggagtcttcactactgctggattcaaagacattcggtcctatcgctattgggataccgagaagagaggacttgatctccagggtttcctgagtgatctggagaacgctcctgagttctccatctttgtcctccacgcctgtgcccacaacccgacagggaccgacccaactccggagcaatggaagcagatcgcctctgtcatgaagcgccggtttctgttccccttctttgactcagcctatcagggcttcgcatctggcaacctagaaaaagacgcctgggccattcgctattttgtgtctgaagggttcgagctcttctgtgcccagtccttctccaagaacttcgggctctacaatgagcgcgtggggaacctgaccgtggttgcaaaagaacccgatagcatcctgcgagtcctttcccagatggagaagatcgtgcgagtgacgtggtccaatccccctgctcagggagcgagaatcgtggcccgtacgctctctgaccctgagctctttcatgaatggacaggtaacgtgaagacaatggctgaccgcattctgagcatgagatctgagcttagggcacgattagaagccctcaagacccctggaacctggaaccacatcacggaccagattggaatgttcagcttcactgggttgaaccccaagcaggttgaatatctgatcaacgaaaagcacatctatctgctaccaagtggtcggatcaacatgtgtggcttaaccaccaaaaatctagattatgtggccacctccatccatgaagctgtcaccaaaatccagtgaagcaacaccacccaagccagcgccacccaagcggtcctctgtctcgtgtgttccctgcctgcacaaacctggttctatacatcacaactgtattagaggctaccgagggacagaaaaggctgctctggtgaggtagctgctatttaaattggccccatgggaagagaacatctcttgaaaagaaatgggggccagggaatagagcccttttggaggccagagcaaattcaggcttttatttgaaaagaataaaaaggtcctttgatcatgagatgtagatgtcttgccccctcactagaagcaggagtattgcctgtgtcactcacgtgctcctgtgtgttttactctgtacaaagtctagtcccaaagatcaagttgtctgaagagcaaagtgtgattgtgggtattggctgtgtcattaacagttgtcctctggacccagagtgtctgtctccctgctctttctgcatggctctgtccctagccctaagcttgagttctttagggtggtcaaggtaggaaatatatttatattttacccacacgttaactgaaataaaagtttcacagagtcaaatttacccttactatgtggagtacattctggtattttcttttctattctattctattctattctattctattctattctattctattctgttgtttcactaaagaaataaaagtgctgattgagacccat

SEQ ID NO: 13077 - protein, 413 aa, Sus scrofa
MAPPSVFAEVPQAQPVLVFKLIADFREDPDPRKVNLGVGAYRTDDCQPWVLPVVRKVEQRIANDSSLNHEYLPILGLAEFRTCASRLALGDDSPALQEKRVGGVQSLGGTGALRIGAEFLARWYNGTNNKDTPVYVSSPTWENHNGVFTTAGFKDIRSYRYWDTEKRGLDLQGFLSDLENAPEFSIFVLHACAHNPTGTDPTPEQWKQIASVMKRRFLFPFFDSAYQGFASGNLEKDAWAIRYFVSEGFELFCAQSFSKNFGLYNERVGNLTVVAKEPDSILRVLSQMEKIVRVTWSNPPAQGARIVARTLSDPELFHEWTGNVKTMADRILSMRSELRARLEALKTPGTWNHITDQIGMFSFTGLNPKQVEYLINEKHIYLLPSGRINMCGLTTKNLDYVATSIHEAVTKIQ

SEQ ID NO: 13078 - DNA, 1194 bp, Salmonella typhimurium
  CDS (1)..(1194)
atgtttcaaaaagttgacgcctatgccggcgatccgattctttcactgatggagcgttttaaagacgactcccgtcacgacaaagtgaatctgagcattggcctgtattacaacgaagacgggattatcccacagcttaaaacggtggccgaagccgaagcccggcttaacgcgcagccgcatggcgcttcgctgtacctgccgatggaaggactcaatacttatcgccatactatcgcgcctttgctctttggcgccgatcacccggttcttcagcaacagcgcgtggccactatccagacattaggcggctccggcgcgctgaaagtaggcgcggatttcctgaagcgttatttccccgacgcaggcgtatgggtgagcgaccccacctgggaaaaccatattgcgatatttgccggggcaggattcgaagtgagtacttacccctggtatgacgacgcgactaacggcatccgttttaacgatctgctggccacgctgaatacgttacctgcgcgcagtatcgtgttgctgcacccctgttgtcacaacccgaccggggcggatttaacgccttcgcaatgggatgcggtgattgaaatagtgaaagcgcgcgatctgattccgtttcttgatattgcctatcaggggtttggcgcaggcatggacgatgatgcgtacgttattcgcgccattgccagcgctgggttacctgcgttagtcagtaattctttttcgaagattttctcgctgtacggcgagcgcgtcggcggcctgtccgtggtgtgtgaagatgctgaaatcgccgcgcgggttctgggacagctaaaagcgacggtgcgccgaatttactccagtccgccgtgtttcggcgctcaggtggtcgctacggtcctgggcgatgaggcgttaaaagcgggctggctggcggaagtcgacgcgatgcgtaaccgcattatatcgatgcgccagacgctggtgaaggagctgaaggcggagatgcctgaccgcaactttgattacttgttacagcagcgcggtatgttcagctataccgggttaagcgaggagcaggtcgatcggttgcgcgatgagtttggcgtttacctgattgccagtggccgcatgtgtgtcgccgggcttaatgcttcaaatgtacaccgcgtggcgaaggcatttgccgctgtcatgtaa

SEQ ID NO: 13079 - protein, 397 aa, Salmonella typhimurium
MFQKVDAYAGDPILSLMERFKDDSRHDKVNLSIGLYYNEDGIIPQLKTVAEAEARLNAQPHGASLYLPMEGLNTYRHTIAPLLFGADHPVLQQQRVATIQTLGGSGALKVGADFLKRYFPDAGVWVSDPTWENHIAIFAGAGFEVSTYPWYDDATNGIRFNDLLATLNTLPARSIVLLHPCCHNPTGADLTPSQWDAVIEIVKARDLIPFLDIAYQGFGAGMDDDAYVIRAIASAGLPALVSNSFSKIFSLYGERVGGLSVVCEDAEIAARVLGQLKATVRRIYSSPPCFGAQVVATVLGDEALKAGWLAEVDAMRNRIISMRQTLVKELKAEMPDRNFDYLLQQRGMFSYTGLSEEQVDRLRDEFGVYLIASGRMCVAGLNASNVHRVAKAFAAVM

SEQ ID NO: 13080 - DNA, 2032 bp, Xenopus tropicalis
  CDS (30)..(1265)
gttctgtgccaggtagttgctgcttagtgatggcttccatttttacctccgttcctcaggctccccctgtggctgtcttcaagcttactgcagatttccgcgctgaccctgacactaggaaggtcaaccttggagtgggagcatatcgtactgatgactctcagccatgggtcctgccagtggtgaaaaaggtggagcagatgattgcaaaagacagctctttgaaccatgaatatctgccaattttggggctgcctgaattccgttctagtgcttccagaattgctttgggggatgacagccctgcatttaaggagaatcgggtaggcggtgtgcaatccttgggtggaactggagctctgcgcattggagcagaatttctgaggcgctggtacaatggaaacaacaacacagctactcccatctatatttcttctccctcatgggaaaaccacaatgctgtgttcagtgacgctggatttaaggatatcagggcttatagttactgggatgctgctaaaaggggccttgatctcgagggattcctgcgggatttagagaatgcccccgagttctctatctttgtgttgcacgcatgtgcgcacaatcccactggtacagaccccacccctgatgagtggaaacagatagctgatgtcatgaagcggaggtctctctttcctttcttcgactcagcctatcaaggatttgcctctggcagcctagacaaggatgcatgggccgtgcgtttctttgtgtctcagggttttgagttgttctgtgctcagtctttttccaagaactttggcttgtacaatgagagagtaggaaacctaactgttgtagggaaagactgtgataacgttgcacgtgtcctgtctcagatggagaaaattgtccgtacaacctggtcaaatcctccatcgcaaggagctcgtattgttgccaccactctcaacactcctgaactatttgatgaatggagagataatgtaaagactatggcagagagagtcctgctgatgagagcagaactgaaatcccgactggaggctcttaaaactcctgggacatggaaccatattgtcaaccagataggaatgttcagctacacaggacttaaccctaagcaagtggagtatcttattaaagagaagcacatctacttgatggccagtggacgtataaatatgtgtgggctgacaacaaagaacctcgactatgtagcccagtctatttatgaagcagcaaccaagatccagtaaagaaaccccaagctttcagtagatgaaatagcagtgtaattatgtgttgttgtagtgcgtgtccccaagctcacagtcacaaagatatctgatcacctcattatctatggctttaacaggaaccaatgaagctgctgggagatgtgttacaagtgctagcatgtttgttccgtgggacaccatgctatatattgtgattctttgggcttttacactattttgcactcaagttgttttgttttttttaaatgtttcctaatgactgcattgacatcttaattctacgtattatttgttctgcatcatcttgtaaccctgtaatttatagaaaattagatataaccttcaaaaaccttcaaccataacaaattatgttttcgttgtcatagaaatcctgcatcaaggtgtccttggcagcaagctttaatgaattttgttatgctctagatatgcatggtatcacaactaaagtctatttggttgcaatagttaactatgcaaagagccccttctgcaggaatgatacgtagaaatatccagaaactgtatatagaacattggctagaacattaactctacatgtctgagcccattctcagatggtgcaatacagatcttagaactaaggtctccaaaatctagtcatcattgctagagtgcacaatggaaaaccaaaactattgtcttaaattgaacatgctaaagcggttaatttaatgtaataaacacattctgttgagtgcaaaaaaaaaaaaaaaaaaaaaaaa

SEQ ID NO: 13081 - protein, 411 aa, Xenopus tropicalis
MASIFTSVPQAPPVAVFKLTADFRADPDTRKVNLGVGAYRTDDSQPWVLPVVKKVEQMIAKDSSLNHEYLPILGLPEFRSSASRIALGDDSPAFKENRVGGVQSLGGTGALRIGAEFLRRWYNGNNNTATPIYISSPSWENHNAVFSDAGFKDIRAYSYWDAAKRGLDLEGFLRDLENAPEFSIFVLHACAHNPTGTDPTPDEWKQIADVMKRRSLFPFFDSAYQGFASGSLDKDAWAVRFFVSQGFELFCAQSFSKNFGLYNERVGNLTVVGKDCDNVARVLSQMEKIVRTTWSNPPSQGARIVATTLNTPELFDEWRDNVKTMAERVLLMRAELKSRLEALKTPGTWNHIVNQIGMFSYTGLNPKQVEYLIKEKHIYLMASGRINMCGLTTKNLDYVAQSIYEAATKIQ

SEQ ID NO: 13082 - DNA, 26 bp, Primer
atgaacaaaagaacacaggaatacaa

SEQ ID NO: 13083 - DNA, 28 bp, Primer
ttacaatttagcttcaatagtatagaag

SEQ ID NO: 13084 - DNA, 1518 bp, Saccharomyces cerevisiae; identical to SEQ ID NO: 2533
  CDS (1)..(1518)

SEQ ID NO: 13085 - protein, 505 aa, Saccharomyces cerevisiae; identical to SEQ ID NO: 2534

SEQ ID NO: 13086 - DNA, 1548 bp, Mus musculus (house mouse); identical to SEQ ID NO: 2535
  CDS (1)..(1548)

SEQ ID NO: 13087 - protein, 515 aa, Mus musculus (house mouse); identical to SEQ ID NO: 2536

SEQ ID NO: 13088 - DNA, 1593 bp, Fugu rubripes (Japanese pufferfish); identical to SEQ ID NO: 2537
  CDS (1)..(1593)

SEQ ID NO: 13089 - protein, 530 aa, Fugu rubripes (Japanese pufferfish); identical to SEQ ID NO: 2538

SEQ ID NO: 13090 - DNA, 1506 bp, Vibrio cholerae; identical to SEQ ID NO: 2539
  CDS (1)..(1506)

SEQ ID NO: 13091 - protein, 501 aa, Vibrio cholerae; identical to SEQ ID NO: 2540

SEQ ID NO: 13092 - DNA, 1470 bp, Pseudomonas aeruginosa; identical to SEQ ID NO: 2541
  CDS (1)..(1470)

SEQ ID NO: 13093 - protein, 489 aa, Pseudomonas aeruginosa; identical to SEQ ID NO: 2542

SEQ ID NO: 13094 - DNA, 1485 bp, Staphylococcus aureus; identical to SEQ ID NO: 2543
  CDS (1)..(1485)

SEQ ID NO: 13095 - protein, 494 aa, Staphylococcus aureus; identical to SEQ ID NO: 2544

SEQ ID NO: 13096 - DNA, 1488 bp, Streptococcus pneumoniae; identical to SEQ ID NO: 2545
  CDS (1)..(1488)

SEQ ID NO: 13097 - protein, 495 aa, Streptococcus pneumoniae; identical to SEQ ID NO: 2546

SEQ ID NO: 13098 - DNA, 1476 bp, Salmonella enterica subsp. enterica serovar Typhi; identical to SEQ ID NO: 2547
  CDS (1)..(1476)

SEQ ID NO: 13099 - protein, 491 aa, Salmonella enterica subsp. enterica serovar Typhi; identical to SEQ ID NO: 2548

SEQ ID NO: 13100 - DNA, 1476 bp, Agrobacterium tumefaciens; identical to SEQ ID NO: 2549
  CDS (1)..(1476)

SEQ ID NO: 13101 - protein, 491 aa, Agrobacterium tumefaciens; identical to SEQ ID NO: 2550

SEQ ID NO: 13102 - DNA, 1530 bp, Nostoc sp. PCC 7120; identical to SEQ ID NO: 2551
  CDS (1)..(1530)

SEQ ID NO: 13103 - protein, 509 aa, Nostoc sp. PCC 7120; identical to SEQ ID NO: 2552

SEQ ID NO: 13104 - DNA, 1386 bp, Agrobacterium tumefaciens; identical to SEQ ID NO: 2553
  CDS (1)..(1386)

SEQ ID NO: 13105 - protein, 461 aa, Agrobacterium tumefaciens; identical to SEQ ID NO: 2554

SEQ ID NO: 13106 - DNA, 1476 bp, Brucella melitensis; identical to SEQ ID NO: 2555
  CDS (1)..(1476)

SEQ ID NO: 13107 - protein, 491 aa, Brucella melitensis; identical to SEQ ID NO: 2556

SEQ ID NO: 13108 - DNA, 1458 bp, Zymomonas mobilis; identical to SEQ ID NO: 2557
  CDS (1)..(1458)

SEQ ID NO: 13109 - protein, 485 aa, Zymomonas mobilis; identical to SEQ ID NO: 2558

SEQ ID NO: 13110 - DNA, 1470 bp, Bacillus subtilis; identical to SEQ ID NO: 2559
  CDS (1)..(1470)

SEQ ID NO: 13111 - protein, 489 aa, Bacillus subtilis; identical to SEQ ID NO: 2560

SEQ ID NO: 13112 - DNA, 1401 bp, Mycobacterium tuberculosis; identical to SEQ ID NO: 2561
  CDS (1)..(1401)

SEQ ID NO: 13113 - protein, 466 aa, Mycobacterium tuberculosis; identical to SEQ ID NO: 2562

SEQ ID NO: 13114 - DNA, 1545 bp, Mycobacterium tuberculosis; identical to SEQ ID NO: 2563
  CDS (1)..(1545)

SEQ ID NO: 13115 - protein, 514 aa, Mycobacterium tuberculosis; identical to SEQ ID NO: 2564

SEQ ID NO: 13116 - DNA, 1320 bp, Chlamydia trachomatis; identical to SEQ ID NO: 2565
  CDS (1)..(1320)

SEQ ID NO: 13117 - protein, 439 aa, Chlamydia trachomatis; identical to SEQ ID NO: 2566

SEQ ID NO: 13118 - DNA, 1773 bp, Deinococcus radiodurans; identical to SEQ ID NO: 2567
  CDS (1)..(1773)

SEQ ID NO: 13119 - protein, 590 aa, Deinococcus radiodurans; identical to SEQ ID NO: 2568

SEQ ID NO: 13120 - DNA, 1467 bp, Pseudomonas aeruginosa; identical to SEQ ID NO: 2569
  CDS (1)..(1467)

SEQ ID NO: 13121 - protein, 488 aa, Pseudomonas aeruginosa; identical to SEQ ID NO: 2570

SEQ ID NO: 13122 - DNA, 1422 bp, Caulobacter crescentus; identical to SEQ ID NO: 2571
  CDS (1)..(1422)

SEQ ID NO: 13123 - protein, 473 aa, Caulobacter crescentus; identical to SEQ ID NO: 2572

SEQ ID NO: 13124 - DNA, 1437 bp, Borrelia burgdorferi (Lyme disease spirochete); identical to SEQ ID NO: 2573
  CDS (1)..(1437)

SEQ ID NO: 13125 - protein, 478 aa, Borrelia burgdorferi (Lyme disease spirochete); identical to SEQ ID NO: 2574

SEQ ID NO: 13126 - DNA, 1539 bp, Chlamydophila pneumoniae, Chlamydia pneumoniae; identical to SEQ ID NO: 2575
  CDS (1)..(1539)

SEQ ID NO: 13127 - protein, 512 aa, Chlamydophila pneumoniae, Chlamydia pneumoniae; identical to SEQ ID NO: 2576

SEQ ID NO: 13128 - DNA, 1476 bp, Escherichia coli; identical to SEQ ID NO: 2577
  CDS (1)..(1476)

SEQ ID NO: 13129 - protein, 491 aa, Escherichia coli; identical to SEQ ID NO: 2578

SEQ ID NO: 13130 - DNA, 1548 bp, Treponema pallidum subsp. pallidum (syphilis spirochete); identical to SEQ ID NO: 2579
  CDS (1)..(1548)

SEQ ID NO: 13131 - protein, 515 aa, Treponema pallidum subsp. pallidum (syphilis spirochete); identical to SEQ ID NO: 2580

SEQ ID NO: 13132 - DNA, 1476 bp, Buchnera sp; identical to SEQ ID NO: 2581
  CDS (1)..(1476)

SEQ ID NO: 13133 - protein, 491 aa, Buchnera sp; identical to SEQ ID NO: 2582

SEQ ID NO: 13134 - DNA, 1512 bp, Lactococcus lactis subsp. lactis; identical to SEQ ID NO: 2583
  CDS (1)..(1512)

SEQ ID NO: 13135 - protein, 503 aa, Lactococcus lactis subsp. lactis; identical to SEQ ID NO: 2584

SEQ ID NO: 13136 - DNA, 1572 bp, Drosophila melanogaster; identical to SEQ ID NO: 2585
  CDS (1)..(1572)

SEQ ID NO: 13137 - protein, 523 aa, Drosophila melanogaster; identical to SEQ ID NO: 2586

SEQ ID NO: 13138 - DNA, 1575 bp, Synechococcus sp; identical to SEQ ID NO: 2587
  CDS (1)..(1575)

SEQ ID NO: 13139 - protein, 524 aa, Synechococcus sp; identical to SEQ ID NO: 2588

SEQ ID NO: 13140 - DNA, 1485 bp, Haemophilus influenzae; identical to SEQ ID NO: 2589
  CDS (1)..(1485)

SEQ ID NO: 13141 - protein, 494 aa, Haemophilus influenzae; identical to SEQ ID NO: 2590

SEQ ID NO: 13142 - DNA, 1446 bp, Neisseria meningitidis; identical to SEQ ID NO: 2591
  CDS (1)..(1446)

SEQ ID NO: 13143 - protein, 481 aa, Neisseria meningitidis; identical to SEQ ID NO: 2592

SEQ ID NO: 13144 - DNA, 1278 bp, Helicobacter pylori; identical to SEQ ID NO: 2593
  CDS (1)..(1278)

SEQ ID NO: 13145 - protein, 425 aa, Helicobacter pylori; identical to SEQ ID NO: 2594

SEQ ID NO: 13146 - DNA, 1434 bp, Xylella fastidiosa; identical to SEQ ID NO: 2595
  CDS (1)..(1434)

SEQ ID NO: 13147 - protein, 477 aa, Xylella fastidiosa; identical to SEQ ID NO: 2596

SEQ ID NO: 13148 - DNA, 1296 bp, Aquifex aeolicus; identical to SEQ ID NO: 2597
  CDS (1)..(1296)

SEQ ID NO: 13149 - protein, 431 aa, Aquifex aeolicus; identical to SEQ ID NO: 2598

SEQ ID NO: 13150 - DNA, 1491 bp, Thermotoga maritima; identical to SEQ ID NO: 2599
  CDS (1)..(1491)

SEQ ID NO: 13151 - protein, 496 aa, Thermotoga maritima; identical to SEQ ID NO: 2600

SEQ ID NO: 13152 - DNA, 1494 bp, Kluyveromyces marxianus var. lactis, Candida sphaerica; identical to SEQ ID NO: 2601
  CDS (1)..(1494)

SEQ ID NO: 13153 - protein, 497 aa, Kluyveromyces marxianus var. lactis, Candida sphaerica; identical to SEQ ID NO: 2602

SEQ ID NO: 13154 - DNA, 2813 bp, Erwinia chrysanthemi; identical to SEQ ID NO: 2603
  CDS (322)..(1797)

SEQ ID NO: 13155 - protein, 491 aa, Erwinia chrysanthemi; identical to SEQ ID NO: 2604

SEQ ID NO: 13156 - DNA, 3244 bp, Plasmodium falciparum; identical to SEQ ID NO: 2605
  CDS (184)..(2916)

SEQ ID NO: 13157 - protein, 910 aa, Plasmodium falciparum; identical to SEQ ID NO: 2606

SEQ ID NO: 13158 - DNA, 1785 bp, Medicago sativa (alfalfa); identical to SEQ ID NO: 2607
  CDS (38)..(1585)

SEQ ID NO: 13159 - protein, 515 aa, Medicago sativa (alfalfa); identical to SEQ ID NO: 2608

SEQ ID NO: 13160 - DNA, 1689 bp, Solanum tuberosum (potato); identical to SEQ ID NO: 2609
  CDS (46)..(1581)

SEQ ID NO: 13161 - protein, 511 aa, Solanum tuberosum (potato); identical to SEQ ID NO: 2610

SEQ ID NO: 13162 - DNA, 1530 bp, Synechocystis sp; identical to SEQ ID NO: 2611
  CDS (1)..(1530)

SEQ ID NO: 13163 - protein, 509 aa, Synechocystis sp; identical to SEQ ID NO: 2612

SEQ ID NO: 13164 - DNA, 1953 bp, Nicotiana tabacum (common tobacco); identical to SEQ ID NO: 2613
  CDS (43)..(1824)

SEQ ID NO: 13165 - protein, 593 aa, Nicotiana tabacum (common tobacco); identical to SEQ ID NO: 2614

SEQ ID NO: 13166 - DNA, 1869 bp, Nicotiana tabacum (common tobacco); identical to SEQ ID NO: 2615
  CDS (22)..(1788)

SEQ ID NO: 13167 - protein, 588 aa, Nicotiana tabacum (common tobacco); identical to SEQ ID NO: 2616

SEQ ID NO: 13168 - DNA, 2058 bp, Solanum tuberosum (potato); identical to SEQ ID NO: 2617
  CDS (41)..(1774)

SEQ ID NO: 13169 - protein, 577 aa, Solanum tuberosum (potato); identical to SEQ ID NO: 2618

SEQ ID NO: 13170 - DNA, 2049 bp, Spinacia oleracea (spinach); identical to SEQ ID NO: 2619
  CDS (147)..(1871)

SEQ ID NO: 13171 - protein, 574 aa, Spinacia oleracea (spinach); identical to SEQ ID NO: 2620

SEQ ID NO: 13172 - DNA, 2359 bp, Petroselinum crispum (parsley); identical to SEQ ID NO: 2621
  CDS (172)..(1986)

SEQ ID NO: 13173 - protein, 604 aa, Petroselinum crispum (parsley); identical to SEQ ID NO: 2622

SEQ ID NO: 13174 - DNA, 1848 bp, Petroselinum crispum (parsley); identical to SEQ ID NO: 2623
  CDS (41)..(1528)

SEQ ID NO: 13175 - protein, 495 aa, Petroselinum crispum (parsley); identical to SEQ ID NO: 2624

SEQ ID NO: 13176 - DNA, 1957 bp, Petroselinum crispum (parsley); identical to SEQ ID NO: 2625
  CDS (74)..(1678)

SEQ ID NO: 13177 - protein, 534 aa, Petroselinum crispum (parsley); identical to SEQ ID NO: 2626

SEQ ID NO: 13178 - DNA, 1569 bp, Caenorhabditis elegans; identical to SEQ ID NO: 2627
  CDS (1)..(1569)

SEQ ID NO: 13179 - protein, 522 aa, Caenorhabditis elegans; identical to SEQ ID NO: 2628

SEQ ID NO: 13180 - DNA, 1779 bp, Streptomyces coelicolor; identical to SEQ ID NO: 2629
  CDS (1)..(1779)

SEQ ID NO: 13181 - protein, 592 aa, Streptomyces coelicolor; identical to SEQ ID NO: 2630

SEQ ID NO: 13182 - DNA, 1524 bp, Streptomyces coelicolor; identical to SEQ ID NO: 2631
  CDS (1)..(1524)

SEQ ID NO: 13183 - protein, 507 aa, Streptomyces coelicolor; identical to SEQ ID NO: 2632

SEQ ID NO: 13184 - DNA, 1422 bp, Schizosaccharomyces pombe; identical to SEQ ID NO: 2633
  CDS (1)..(1422)

SEQ ID NO: 13185 - protein, 473 aa, Schizosaccharomyces pombe; identical to SEQ ID NO: 2634

SEQ ID NO: 13186 - DNA, 1503 bp, Schizosaccharomyces pombe; identical to SEQ ID NO: 2635
  CDS (1)..(1503)

SEQ ID NO: 13187 - protein, 500 aa, Schizosaccharomyces pombe; identical to SEQ ID NO: 2636

SEQ ID NO: 13188 - DNA, 1428 bp, Schizosaccharomyces pombe; identical to SEQ ID NO: 2637
  CDS (1)..(1428)

SEQ ID NO: 13189 - protein, 475 aa, Schizosaccharomyces pombe; identical to SEQ ID NO: 2638

SEQ ID NO: 13190 - DNA, 1461 bp, Leuconostoc mesenteroides; identical to SEQ ID NO: 2639
  CDS (1)..(1461)

SEQ ID NO: 13191 - protein, 486 aa, Leuconostoc mesenteroides; identical to SEQ ID NO: 2640

SEQ ID NO: 13192 - DNA, 3038 bp, Corynebacterium glutamicum; identical to SEQ ID NO: 2641
  CDS (115)..(1659)

SEQ ID NO: 13193 - protein, 514 aa, Corynebacterium glutamicum; identical to SEQ ID NO: 2642

SEQ ID NO: 13194 - DNA, 1852 bp, Nicotiana tabacum; identical to SEQ ID NO: 2643
  CDS (102)..(1634)

SEQ ID NO: 13195 - protein, 510 aa, Nicotiana tabacum; identical to SEQ ID NO: 2644

SEQ ID NO: 13196 - DNA, 1821 bp, Nicotiana tabacum; identical to SEQ ID NO: 2645
  CDS (88)..(1623)

SEQ ID NO: 13197 - protein, 511 aa, Nicotiana tabacum; identical to SEQ ID NO: 2646

SEQ ID NO: 13198 - DNA, 1808 bp, Chlamydia trachomatis; identical to SEQ ID NO: 2647
  CDS (105)..(1643)

SEQ ID NO: 13199 - protein, 512 aa, Chlamydia trachomatis; identical to SEQ ID NO: 2648

SEQ ID NO: 13200 - DNA, 2750 bp, Plasmodium falciparum; identical to SEQ ID NO: 2649
  CDS (48)..(2258)

SEQ ID NO: 13201 - protein, 736 aa, Plasmodium falciparum; identical to SEQ ID NO: 2650

SEQ ID NO: 13202 - DNA, 1509 bp, Debaryomyces hansenii; identical to SEQ ID NO: 2651
  CDS (1)..(1509)

SEQ ID NO: 13203 - protein, 502 aa, Debaryomyces hansenii; identical to SEQ ID NO: 2652

SEQ ID NO: 13204 - DNA, 1503 bp, Candida glabrata; identical to SEQ ID NO: 2653
  CDS (1)..(1503)

SEQ ID NO: 13205 - protein, 500 aa, Candida glabrata; identical to SEQ ID NO: 2654

SEQ ID NO: 13206 - DNA, 1485 bp, Bacillus thuringiensis serovar konkukian str; identical to SEQ ID NO: 2655
  CDS (1)..(1485)

SEQ ID NO: 13207 - protein, 494 aa, Bacillus thuringiensis serovar konkukian str; identical to SEQ ID NO: 2656

SEQ ID NO: 13208 - DNA, 1554 bp, Oryza sativa; identical to SEQ ID NO: 2657
  CDS (1)..(1554)

SEQ ID NO: 13209 - protein, 517 aa, Oryza sativa; identical to SEQ ID NO: 2658

SEQ ID NO: 13210 - DNA, 1500 bp, Photobacterium profundum; identical to SEQ ID NO: 2659
  CDS (1)..(1500)

SEQ ID NO: 13211 - protein, 499 aa, Photobacterium profundum; identical to SEQ ID NO: 2660

SEQ ID NO: 13212 - DNA, 1551 bp, Parachlamydia sp; identical to SEQ ID NO: 2661
  CDS (1)..(1551)

SEQ ID NO: 13213 - protein, 516 aa, Parachlamydia sp; identical to SEQ ID NO: 2662

SEQ ID NO: 13214 - DNA, 1515 bp, Rhodopseudomonas palustris; identical to SEQ ID NO: 2663
  CDS (1)..(1515)

SEQ ID NO: 13215 - protein, 504 aa, Rhodopseudomonas palustris; identical to SEQ ID NO: 2664

SEQ ID NO: 13216 - DNA, 1650 bp, Corynebacterium diphtheriae; identical to SEQ ID NO: 2665
  CDS (1)..(1650)

SEQ ID NO: 13217 - protein, 549 aa, Corynebacterium diphtheriae; identical to SEQ ID NO: 2666

SEQ ID NO: 13218 - DNA, 1446 bp, uncultured bacterium 581; identical to SEQ ID NO: 2667
  CDS (1)..(1446)

SEQ ID NO: 13219 - protein, 481 aa, uncultured bacterium 581; identical to SEQ ID NO: 2668

SEQ ID NO: 13220 - DNA, 1602 bp, Nonomuraea sp; identical to SEQ ID NO: 2669
  CDS (1)..(1602)

SEQ ID NO: 13221 - protein, 533 aa, Nonomuraea sp; identical to SEQ ID NO: 2670

SEQ ID NO: 13222 - DNA, 1476 bp, Listeria monocytogenes; identical to SEQ ID NO: 2671
  CDS (1)..(1476)

SEQ ID NO: 13223 - protein, 491 aa, Listeria monocytogenes; identical to SEQ ID NO: 2672

SEQ ID NO: 13224 - DNA, 1485 bp, Bacillus cereus; identical to SEQ ID NO: 2673
  CDS (1)..(1485)

SEQ ID NO: 13225 - protein, 494 aa, Bacillus cereus; identical to SEQ ID NO: 2674

SEQ ID NO: 13226 - DNA, 1410 bp, Mycobacterium paratuberculosis; identical to SEQ ID NO: 2675
  CDS (1)..(1410)

SEQ ID NO: 13227 - protein, 469 aa, Mycobacterium paratuberculosis; identical to SEQ ID NO: 2676

SEQ ID NO: 13228 - DNA, 2454 bp, Mycobacterium paratuberculosis; identical to SEQ ID NO: 2677
  CDS (1)..(2454)

SEQ ID NO: 13229 - protein, 817 aa, Mycobacterium paratuberculosis; identical to SEQ ID NO: 2678

SEQ ID NO: 13230 - DNA, 1545 bp, Mycobacterium paratuberculosis; identical to SEQ ID NO: 2679
  CDS (1)..(1545)

SEQ ID NO: 13231 - protein, 514 aa, Mycobacterium paratuberculosis; identical to SEQ ID NO: 2680

SEQ ID NO: 13232 - DNA, 1449 bp, Lactobacillus johnsonii; identical to SEQ ID NO: 2681
  CDS (1)..(1449)

SEQ ID NO: 13233 - protein, 482 aa, Lactobacillus johnsonii; identical to SEQ ID NO: 2682

SEQ ID NO: 13234 - DNA, 1539 bp, Ashbya gossypii; identical to SEQ ID NO: 2683
  CDS (1)..(1539)

SEQ ID NO: 13235 - protein, 512 aa, Ashbya gossypii; identical to SEQ ID NO: 2684

SEQ ID NO: 13236 - DNA, 1734 bp, Oryza sativa; identical to SEQ ID NO: 2685
  CDS (1)..(1734)

SEQ ID NO: 13237 - protein, 577 aa, Oryza sativa; identical to SEQ ID NO: 2686

SEQ ID NO: 13238 - DNA, 1467 bp, Gluconobacter oxydans; identical to SEQ ID NO: 2687
  CDS (1)..(1467)

SEQ ID NO: 13239 - protein, 488 aa, Gluconobacter oxydans; identical to SEQ ID NO: 2688

SEQ ID NO: 13240 - DNA, 1581 bp, Vibrio vulnificus; identical to SEQ ID NO: 2689
  CDS (1)..(1581)

SEQ ID NO: 13241 - protein, 526 aa, Vibrio vulnificus; identical to SEQ ID NO: 2690

SEQ ID NO: 13242 - DNA, 1476 bp, Photorhabdus luminescens; identical to SEQ ID NO: 2691
  CDS (1)..(1476)

SEQ ID NO: 13243 - protein, 491 aa, Photorhabdus luminescens; identical to SEQ ID NO: 2692

SEQ ID NO: 13244 - DNA, 1539 bp, Gloeobacter violaceus; identical to SEQ ID NO: 2693
  CDS (1)..(1539)

SEQ ID NO: 13245 - protein, 512 aa, Gloeobacter violaceus; identical to SEQ ID NO: 2694

SEQ ID NO: 13246 - DNA, 1539 bp, Gloeobacter violaceus; identical to SEQ ID NO: 2695
  CDS (1)..(1539)

SEQ ID NO: 13247 - protein, 512 aa, Gloeobacter violaceus; identical to SEQ ID NO: 2696

SEQ ID NO: 13248 - DNA, 1479 bp, Chromobacterium violaceum; identical to SEQ ID NO: 2697
  CDS (1)..(1479)

SEQ ID NO: 13249 - protein, 492 aa, Chromobacterium violaceum; identical to SEQ ID NO: 2698

SEQ ID NO: 13250 - DNA, 2229 bp, Giardia lamblia ATCC 50803; identical to SEQ ID NO: 2699
  CDS (1)..(2229)

SEQ ID NO: 13251 - protein, 742 aa, Giardia lamblia ATCC 50803; identical to SEQ ID NO: 2700

SEQ ID NO: 13252 - DNA, 2850 bp, Plasmodium yoelii yoelii; identical to SEQ ID NO: 2701
  CDS (1)..(2850)

SEQ ID NO: 13253 - protein, 949 aa, Plasmodium yoelii yoelii; identical to SEQ ID NO: 2702

SEQ ID NO: 13254 - DNA, 1476 bp, Neurospora crassa; identical to SEQ ID NO: 2703
  CDS (1)..(1476)

SEQ ID NO: 13255 - protein, 491 aa, Neurospora crassa; identical to SEQ ID NO: 2704

SEQ ID NO: 13256 - DNA, 1524 bp, Synechococcus sp; identical to SEQ ID NO: 2705
  CDS (1)..(1524)

SEQ ID NO: 13257 - protein, 507 aa, Synechococcus sp; identical to SEQ ID NO: 2706

SEQ ID NO: 13258 - DNA, 1455 bp, Rhodopirellula baltica; identical to SEQ ID NO: 2707
  CDS (1)..(1455)

SEQ ID NO: 13259 - protein, 484 aa, Rhodopirellula baltica; identical to SEQ ID NO: 2708

SEQ ID NO: 13260 - DNA, 1524 bp, Prochlorococcus marinus subsp; identical to SEQ ID NO: 2709
  CDS (1)..(1524)

SEQ ID NO: 13261 - protein, 507 aa, Prochlorococcus marinus subsp; identical to SEQ ID NO: 2710

SEQ ID NO: 13262 - DNA, 1524 bp, Prochlorococcus marinus; identical to SEQ ID NO: 2711
  CDS (1)..(1524)

SEQ ID NO: 13263 - protein, 507 aa, Prochlorococcus marinus; identical to SEQ ID NO: 2712

SEQ ID NO: 13264 - DNA, 1521 bp, Prochlorococcus marinus; identical to SEQ ID NO: 2713
  CDS (1)..(1521)

SEQ ID NO: 13265 - protein, 506 aa, Prochlorococcus marinus; identical to SEQ ID NO: 2714

SEQ ID NO: 13266 - DNA, 1488 bp, Haemophilus ducreyi; identical to SEQ ID NO: 2715
  CDS (1)..(1488)

SEQ ID NO: 13267 - protein, 495 aa, Haemophilus ducreyi; identical to SEQ ID NO: 2716

SEQ ID NO: 13268 - DNA, 1497 bp, Candidatus Blochmannia floridanus; identical to SEQ ID NO: 2717
  CDS (1)..(1497)

SEQ ID NO: 13269 - protein, 498 aa, Candidatus Blochmannia floridanus; identical to SEQ ID NO: 2718

SEQ ID NO: 13270 - DNA, 1768 bp, Oryza sativa; identical to SEQ ID NO: 2719
  CDS (2)..(1768)

SEQ ID NO: 13271 - protein, 588 aa, Oryza sativa; identical to SEQ ID NO: 2720

SEQ ID NO: 13272 - DNA, 1548 bp, Bos indicus; identical to SEQ ID NO: 2721
  CDS (1)..(1548)

SEQ ID NO: 13273 - protein, 515 aa, Bos indicus; identical to SEQ ID NO: 2722

SEQ ID NO: 13274 - DNA, 1536 bp, Chlamydophila caviae; identical to SEQ ID NO: 2723
  CDS (1)..(1536)

SEQ ID NO: 13275 - protein, 511 aa, Chlamydophila caviae; identical to SEQ ID NO: 2724

SEQ ID NO: 13276 - DNA, 1524 bp, Streptomyces avermitilis; identical to SEQ ID NO: 2725
  CDS (1)..(1524)

SEQ ID NO: 13277 - protein, 507 aa, Streptomyces avermitilis; identical to SEQ ID NO: 2726

SEQ ID NO: 13278 - DNA, 1647 bp, Streptomyces avermitilis; identical to SEQ ID NO: 2727
  CDS (1)..(1647)

SEQ ID NO: 13279 - protein, 548 aa, Streptomyces avermitilis; identical to SEQ ID NO: 2728

SEQ ID NO: 13280 - DNA, 1491 bp, Nitrosomonas europaea; identical to SEQ ID NO: 2729
  CDS (1)..(1491)

SEQ ID NO: 13281 - protein, 496 aa, Nitrosomonas europaea; identical to SEQ ID NO: 2730

SEQ ID NO: 13282 - DNA, 1524 bp, Enterococcus faecalis; identical to SEQ ID NO: 2731
  CDS (1)..(1524)

SEQ ID NO: 13283 - protein, 507 aa, Enterococcus faecalis; identical to SEQ ID NO: 2732

SEQ ID NO: 13284 - DNA, 1464 bp, Tropheryma whipplei; identical to SEQ ID NO: 2733
  CDS (1)..(1464)

SEQ ID NO: 13285 - protein, 487 aa, Tropheryma whipplei; identical to SEQ ID NO: 2734

SEQ ID NO: 13286 - DNA, 2145 bp, Leishmania mexicana; identical to SEQ ID NO: 2735
  CDS (298)..(1986)

SEQ ID NO: 13287 - protein, 562 aa, Leishmania mexicana; identical to SEQ ID NO: 2736

SEQ ID NO: 13288 - DNA, 1494 bp, Dictyostelium discoideum; identical to SEQ ID NO: 2737
  CDS (1)..(1494)

SEQ ID NO: 13289 - protein, 497 aa, Dictyostelium discoideum; identical to SEQ ID NO: 2738

SEQ ID NO: 13290 - DNA, 1503 bp, Xylella fastidiosa; identical to SEQ ID NO: 2739
  CDS (1)..(1503)

SEQ ID NO: 13291 - protein, 500 aa, Xylella fastidiosa; identical to SEQ ID NO: 2740

SEQ ID NO: 13292 - DNA, 1506 bp, Vibrio parahaemolyticus; identical to SEQ ID NO: 2741
  CDS (1)..(1506)

SEQ ID NO: 13293 - protein, 501 aa, Vibrio parahaemolyticus; identical to SEQ ID NO: 2742

SEQ ID NO: 13294 - DNA, 1533 bp, Pseudomonas syringae; identical to SEQ ID NO: 2743
  CDS (1)..(1533)

SEQ ID NO: 13295 - protein, 510 aa, Pseudomonas syringae; identical to SEQ ID NO: 2744

SEQ ID NO: 13296 - DNA, 1470 bp, Pseudomonas syringae; identical to SEQ ID NO: 2745
  CDS (1)..(1470)

SEQ ID NO: 13297 - protein, 489 aa, Pseudomonas syringae; identical to SEQ ID NO: 2746

SEQ ID NO: 13298 - DNA, 1458 bp, Pseudomonas putida; identical to SEQ ID NO: 2747
  CDS (1)..(1458)

SEQ ID NO: 13299 - protein, 485 aa, Pseudomonas putida; identical to SEQ ID NO: 2748

SEQ ID NO: 13300 - DNA, 1506 bp, Pseudomonas putida; identical to SEQ ID NO: 2749
  CDS (1)..(1506)

SEQ ID NO: 13301 - protein, 501 aa, Pseudomonas putida; identical to SEQ ID NO: 2750

SEQ ID NO: 13302 - DNA, 1470 bp, Pseudomonas putida; identical to SEQ ID NO: 2751
  CDS (1)..(1470)

SEQ ID NO: 13303 - protein, 489 aa, Pseudomonas putida; identical to SEQ ID NO: 2752

SEQ ID NO: 13304 - DNA, 1485 bp, Lactobacillus plantarum; identical to SEQ ID NO: 2753
  CDS (1)..(1485)

SEQ ID NO: 13305 - protein, 494 aa, Lactobacillus plantarum; identical to SEQ ID NO: 2754

SEQ ID NO: 13306 - DNA, 1440 bp, Clostridium tetani; identical to SEQ ID NO: 2755
  CDS (1)..(1440)

SEQ ID NO: 13307 - protein, 479 aa, Clostridium tetani; identical to SEQ ID NO: 2756

SEQ ID NO: 13308 - DNA, 1512 bp, Bradyrhizobium japonicum; identical to SEQ ID NO: 2757
  CDS (1)..(1512)

SEQ ID NO: 13309 - protein, 503 aa, Bradyrhizobium japonicum; identical to SEQ ID NO: 2758

SEQ ID NO: 13310 - DNA, 1497 bp, Bacteroides thetaiotaomicron; identical to SEQ ID NO: 2759
  CDS (1)..(1497)

SEQ ID NO: 13311 - protein, 498 aa, Bacteroides thetaiotaomicron; identical to SEQ ID NO: 2760

SEQ ID NO: 13312 - DNA, 4583 bp, Mus musculus; identical to SEQ ID NO: 2761
  CDS (119)..(2488)

SEQ ID NO: 13313 - protein, 789 aa, Mus musculus; identical to SEQ ID NO: 2762

SEQ ID NO: 13314 - DNA, 1485 bp, Staphylococcus epidermidis; identical to SEQ ID NO: 2763
  CDS (1)..(1485)

SEQ ID NO: 13315 - protein, 494 aa, Staphylococcus epidermidis; identical to SEQ ID NO: 2764

SEQ ID NO: 13316 - DNA, 1590 bp, Yersinia pestis; identical to SEQ ID NO: 2765
  CDS (1)..(1590)

SEQ ID NO: 13317 - protein, 529 aa, Yersinia pestis; identical to SEQ ID NO: 2766

SEQ ID NO: 13318 - DNA, 1530 bp, Synechococcus elongatus; identical to SEQ ID NO: 2767
  CDS (1)..(1530)

SEQ ID NO: 13319 - protein, 509 aa, Synechococcus elongatus; identical to SEQ ID NO: 2768

SEQ ID NO: 13320 - DNA, 1473 bp, Shewanella oneidensis; identical to SEQ ID NO: 2769
  CDS (1)..(1473)

SEQ ID NO: 13321 - protein, 490 aa, Shewanella oneidensis; identical to SEQ ID NO: 2770

SEQ ID NO: 13322 - DNA, 1476 bp, Oceanobacillus iheyensis; identical to SEQ ID NO: 2771
  CDS (1)..(1476)

SEQ ID NO: 13323 - protein, 491 aa, Oceanobacillus iheyensis; identical to SEQ ID NO: 2772

SEQ ID NO: 13324 - DNA, 1344 bp, Corynebacterium efficiens; identical to SEQ ID NO: 2773
  CDS (1)..(1344)

SEQ ID NO: 13325 - protein, 447 aa, Corynebacterium efficiens; identical to SEQ ID NO: 2774

SEQ ID NO: 13326 - DNA, 1545 bp, Corynebacterium efficiens; identical to SEQ ID NO: 2775
  CDS (1)..(1545)

SEQ ID NO: 13327 - protein, 514 aa, Corynebacterium efficiens; identical to SEQ ID NO: 2776

SEQ ID NO: 13328 - DNA, 1668 bp, Bifidobacterium longum; identical to SEQ ID NO: 2777
  CDS (1)..(1668)

SEQ ID NO: 13329 - protein, 555 aa, Bifidobacterium longum; identical to SEQ ID NO: 2778

SEQ ID NO: 13330 - DNA, 1284 bp, Rhodococcus opacus; identical to SEQ ID NO: 2779
  CDS (1)..(1284)

SEQ ID NO: 13331 - protein, 427 aa, Rhodococcus opacus; identical to SEQ ID NO: 2780

SEQ ID NO: 13332 - DNA, 2879 bp, Leishmania guyanensis; identical to SEQ ID NO: 2781
  CDS (205)..(1893): n means a or g or c or t/u, s means g or c

SEQ ID NO: 13333 - protein, 562 aa, Leishmania guyanensis; identical to SEQ ID NO: 2782

SEQ ID NO: 13334 - DNA, 1689 bp, Leishmania mexicana; identical to SEQ ID NO: 2783
  CDS (1)..(1689): n means a or g or c or t/u, s means g or c

SEQ ID NO: 13335 - protein, 562 aa, Leishmania mexicana; identical to SEQ ID NO: 2784
  Xaa in position 76-148 and 492-510 is unknown

SEQ ID NO: 13336 - DNA, 2916 bp, Leishmania amazonensis; identical to SEQ ID NO: 2785
  CDS (207)..(1895): n means a or g or c or t/u, y means t/u or c

SEQ ID NO: 13337 - protein, 562 aa, Leishmania amazonensis; identical to SEQ ID NO: 2786
  Xaa in position 462 and 481 is unknown

SEQ ID NO: 13338 - DNA, 1440 bp, Chlorobium tepidum; identical to SEQ ID NO: 2787
  CDS (1)..(1440)

SEQ ID NO: 13339 - protein, 479 aa, Chlorobium tepidum; identical to SEQ ID NO: 2788

SEQ ID NO: 13340 - DNA, 2187 bp, Methylobacterium extorquens; identical to SEQ ID NO: 2789
  CDS (640)..(2187)

SEQ ID NO: 13341 - protein, 515 aa, Methylobacterium extorquens; identical to SEQ ID NO: 2790

SEQ ID NO: 13342 - DNA, 1476 bp, Bartonella henselae; identical to SEQ ID NO: 2791
  CDS (1)..(1476)

SEQ ID NO: 13343 - protein, 491 aa, Bartonella henselae; identical to SEQ ID NO: 2792

SEQ ID NO: 13344 - DNA, 2266 bp, Toxoplasma gondii; identical to SEQ ID NO: 2793
  CDS (169)..(1851)

SEQ ID NO: 13345 - protein, 560 aa, Toxoplasma gondii; identical to SEQ ID NO: 2794

SEQ ID NO: 13346 - DNA, 1923 bp, Xanthomonas campestris; identical to SEQ ID NO: 2795
  CDS (1)..(1923)

SEQ ID NO: 13347 - protein, 640 aa, Xanthomonas campestris; identical to SEQ ID NO: 2796

SEQ ID NO: 13348 - DNA, 1431 bp, Xanthomonas campestris; identical to SEQ ID NO: 2797
  CDS (1)..(1431)

SEQ ID NO: 13349 - protein, 476 aa, Xanthomonas campestris; identical to SEQ ID NO: 2798

SEQ ID NO: 13350 - DNA, 1839 bp, Xanthomonas axonopodis; identical to SEQ ID NO: 2799
  CDS (1)..(1839)

SEQ ID NO: 13351 - protein, 612 aa, Xanthomonas axonopodis; identical to SEQ ID NO: 2800

SEQ ID NO: 13352 - DNA, 1431 bp, Xanthomonas axonopodis; identical to SEQ ID NO: 2801
  CDS (1)..(1431)

SEQ ID NO: 13353 - protein, 476 aa, Xanthomonas axonopodis; identical to SEQ ID NO: 2802

SEQ ID NO: 13354 - DNA, 1458 bp, Thermoanaerobacter tengcongensis; identical to SEQ ID NO: 2803
  CDS (1)..(1458)

SEQ ID NO: 13355 - protein, 485 aa, Thermoanaerobacter tengcongensis; identical to SEQ ID NO: 2804

SEQ ID NO: 13356 - DNA, 1762 bp, Oryza sativa; identical to SEQ ID NO: 2805
  CDS (41)..(1558)

SEQ ID NO: 13357 - protein, 505 aa, Oryza sativa; identical to SEQ ID NO: 2806

SEQ ID NO: 13358 - DNA, 1305 bp, Encephalitozoon cuniculi; identical to SEQ ID NO: 2807
  CDS (1)..(1305)

SEQ ID NO: 13359 - protein, 434 aa, Encephalitozoon cuniculi; identical to SEQ ID NO: 2808

SEQ ID NO: 13360 - DNA, 2125 bp, Drosophila melanogaster; identical to SEQ ID NO: 2809
  CDS (158)..(1738)

SEQ ID NO: 13361 - protein, 526 aa, Drosophila melanogaster; identical to SEQ ID NO: 2810

SEQ ID NO: 13362 - DNA, 1470 bp, Ralstonia solanacearum; identical to SEQ ID NO: 2811
  CDS (1)..(1470)

SEQ ID NO: 13363 - protein, 489 aa, Ralstonia solanacearum; identical to SEQ ID NO: 2812

SEQ ID NO: 13364 - DNA, 1521 bp, Enterococcus mundtii; identical to SEQ ID NO: 2813
  CDS (1)..(1521)

SEQ ID NO: 13365 - protein, 506 aa, Enterococcus mundtii; identical to SEQ ID NO: 2814

SEQ ID NO: 13366 - DNA, 2230 bp, Homo sapiens; identical to SEQ ID NO: 2815
  CDS (54)..(1601)

SEQ ID NO: 13367 - protein, 515 aa, Homo sapiens [sequence omitted]

SEQ ID NO: 13368 - DNA, 1470 bp, Rhizobium loti; identical to SEQ ID NO: 2817
  CDS (1)..(1470)

SEQ ID NO: 13369 - protein, 489 aa, Rhizobium loti; identical to SEQ ID NO: 2818

SEQ ID NO: 13370 - DNA, 1428 bp, Rhizobium loti; identical to SEQ ID NO: 2819
  CDS (1)..(1428)

SEQ ID NO: 13371 - protein, 475 aa, Rhizobium loti; identical to SEQ ID NO: 2820

SEQ ID NO: 13372 - DNA, 3584 bp, Plasmodium berghei; identical to SEQ ID NO: 2821
  CDS (370)..(3222)

SEQ ID NO: 13373 - protein, 950 aa, Plasmodium berghei; identical to SEQ ID NO: 2822

SEQ ID NO: 13374 - DNA, 1491 bp, Pasteurella multocida; identical to SEQ ID NO: 2823
  CDS (1)..(1491)

SEQ ID NO: 13375 - protein, 496 aa, Pasteurella multocida; identical to SEQ ID NO: 2824

SEQ ID NO: 13376 - DNA, 1470 bp, Pseudomonas putida; identical to SEQ ID NO: 2825
  CDS (1)..(1470)

SEQ ID NO: 13377 - protein, 489 aa, Pseudomonas putida; identical to SEQ ID NO: 2826

SEQ ID NO: 13378 - DNA, 1566 bp, Trypanosoma brucei; identical to SEQ ID NO: 2827
  CDS (1)..(1566)

SEQ ID NO: 13379 - protein, 521 aa, Trypanosoma brucei; identical to SEQ ID NO: 2828

SEQ ID NO: 13380 - DNA, 1904 bp, Triticum aestivum; identical to SEQ ID NO: 2829
  CDS (153)..(1682)

SEQ ID NO: 13381 - protein, 509 aa, Triticum aestivum; identical to SEQ ID NO: 2830

SEQ ID NO: 13382 - DNA, 2098 bp, Solanum tuberosum; identical to SEQ ID NO: 2831
  CDS (27)..(1775)

SEQ ID NO: 13383 - protein, 582 aa, Solanum tuberosum; identical to SEQ ID NO: 2832

SEQ ID NO: 13384 - DNA, 1924 bp, Dunaliella bioculata; identical to SEQ ID NO: 2833
  CDS (68)..(1840)

SEQ ID NO: 13385 - protein, 590 aa, Dunaliella bioculata; identical to SEQ ID NO: 2834

SEQ ID NO: 13386 - DNA, 1976 bp, Cyanidium caldarium; identical to SEQ ID NO: 2835
  CDS (46)..(1848)

SEQ ID NO: 13387 - protein, 600 aa, Cyanidium caldarium; identical to SEQ ID NO: 2836

SEQ ID NO: 13388 - DNA, 2106 bp, Drosophila melanogaster; identical to SEQ ID NO: 2837
  CDS (28)..(1746)

SEQ ID NO: 13389 - protein, 572 aa, Drosophila melanogaster; identical to SEQ ID NO: 2838

SEQ ID NO: 13390 - DNA, 1777 bp, Mesembryanthemum crystallinum; identical to SEQ ID NO: 2839
  CDS (39)..(1589)

SEQ ID NO: 13391 - protein, 516 aa, Mesembryanthemum crystallinum; identical to SEQ ID NO: 2840

SEQ ID NO: 13392 - DNA, 1542 bp, Mus musculus; identical to SEQ ID NO: 2841
  CDS (1)..(1542)

SEQ ID NO: 13393 - protein, 513 aa, Mus musculus; identical to SEQ ID NO: 2842

SEQ ID NO: 13394 - DNA, 1485 bp, Actinobacillus actinomycetemcomitans; identical to SEQ ID NO: 2843
  CDS (1)..(1485)

SEQ ID NO: 13395 - protein, 494 aa, Actinobacillus actinomycetemcomitans; identical to SEQ ID NO: 2844

SEQ ID NO: 13396 - DNA, 1473 bp, Buchnera aphidicola; identical to SEQ ID NO: 2845
  CDS (1)..(1473)

SEQ ID NO: 13397 - protein, 490 aa, Buchnera aphidicola; identical to SEQ ID NO: 2846

SEQ ID NO: 13398 - DNA, 1473 bp, Buchnera aphidicola; identical to SEQ ID NO: 2847
  CDS (1)..(1473)

SEQ ID NO: 13399 - protein, 490 aa, Buchnera aphidicola; identical to SEQ ID NO: 2848

SEQ ID NO: 13400 - DNA, 2049 bp, Ceratitis capitata; identical to SEQ ID NO: 2849
  CDS (60)..(1640)

SEQ ID NO: 13401 - protein, 526 aa, Ceratitis capitata; identical to SEQ ID NO: 2850

SEQ ID NO: 13402 - DNA, 1524 bp, Chlamydia muridarum; identical to SEQ ID NO: 2851
  CDS (1)..(1524)

SEQ ID NO: 13403 - protein, 507 aa, Chlamydia muridarum; identical to SEQ ID NO: 2852

SEQ ID NO: 13404 - DNA, 2062 bp, Drosophila melanogaster; identical to SEQ ID NO: 2853
  CDS (303)..(1877)

SEQ ID NO: 13405 - protein, 524 aa, Drosophila melanogaster; identical to SEQ ID NO: 2854

SEQ ID NO: 13406 - DNA, 1536 bp, Emericella nidulans; identical to SEQ ID NO: 2855
  CDS (1)..(1536)

SEQ ID NO: 13407 - protein, 511 aa, Emericella nidulans; identical to SEQ ID NO: 2856

SEQ ID NO: 13408 - DNA, 1957 bp, Leuconostoc mesenteroides; identical to SEQ ID NO: 2857
  CDS (206)..(1666)

SEQ ID NO: 13409 - protein, 486 aa, Leuconostoc mesenteroides; identical to SEQ ID NO: 2858

SEQ ID NO: 13410 - DNA, 2055 bp, Macropus robustus; identical to SEQ ID NO: 2859
  CDS (94)..(1641)

SEQ ID NO: 13411 - protein, 515 aa, Macropus robustus; identical to SEQ ID NO: 2860

SEQ ID NO: 13412 - DNA, 1530 bp, Nostoc punctiforme; identical to SEQ ID NO: 2861
  CDS (1)..(1530)

SEQ ID NO: 13413 - protein, 509 aa, Nostoc punctiforme; identical to SEQ ID NO: 2862

SEQ ID NO: 13414 - DNA, 1476 bp, Rhizobium meliloti; identical to SEQ ID NO: 2863
  CDS (1)..(1476)

SEQ ID NO: 13415 - protein, 491 aa, Rhizobium meliloti; identical to SEQ ID NO: 2864

SEQ ID NO: 13416 - DNA, 2853 bp, Homo sapiens; identical to SEQ ID NO: 2865
  CDS (273)..(2648)

SEQ ID NO: 13417 - protein, 791 aa, Homo sapiens; identical to SEQ ID NO: 2866

SEQ ID NO: 13418 - DNA, 1970 bp, Arabidopsis thaliana; identical to SEQ ID NO: 2867
  CDS (60)..(1790)

SEQ ID NO: 13419 - protein, 576 aa, Arabidopsis thaliana; identical to SEQ ID NO: 2868

SEQ ID NO: 13420 - DNA, 2112 bp, Arabidopsis thaliana; identical to SEQ ID NO: 2869
  CDS (142)..(1932)

SEQ ID NO: 13421 - protein, 596 aa, Arabidopsis thaliana; identical to SEQ ID NO: 2870

SEQ ID NO: 13422 - DNA, 2161 bp, Arabidopsis thaliana; identical to SEQ ID NO: 2871
  CDS (90)..(1967)

SEQ ID NO: 13423 - protein, 625 aa, Arabidopsis thaliana; identical to SEQ ID NO: 2872

SEQ ID NO: 13424 - DNA, 1936 bp, Arabidopsis thaliana; identical to SEQ ID NO: 2873
  CDS (136)..(1686)

SEQ ID NO: 13425 - protein, 516 aa, Arabidopsis thaliana; identical to SEQ ID NO: 2874

SEQ ID NO: 13426 - DNA, 1959 bp, Arabidopsis thaliana; identical to SEQ ID NO: 2875
  CDS (194)..(1741)

SEQ ID NO: 13427 - protein, 515 aa, Arabidopsis thaliana [sequence omitted]

SEQ ID NO: 13428 - DNA, 1503 bp, Xenopus laevis; identical to SEQ ID NO: 2877
  CDS (1)..(1503)

SEQ ID NO: 13429 - protein, 500 aa, Xenopus laevis; identical to SEQ ID NO: 2878

SEQ ID NO: 13430 - DNA, 2004 bp, Arabidopsis thaliana; identical to SEQ ID NO: 2879
  CDS (51)..(1850)

SEQ ID NO: 13431 - protein, 599 aa, Arabidopsis thaliana; identical to SEQ ID NO: 2880

SEQ ID NO: 13432 - DNA, 23 bp, Primer
atgagtgaaggccccgtcaaatt

SEQ ID NO: 13433 - DNA, 25 bp, Primer
ctaattatccttcgtatcttctggc

SEQ ID NO: 13434 - protein, 266 aa, consensus; identical to SEQ ID NO: 1303
  MISC_FEATURE (1)..(266): consensus for the disclosure of Xaa see table VIII

SEQ ID NO: 13435 - protein, 89 aa, consensus; identical to SEQ ID NO: 1304
  MISC_FEATURE (1)..(89): consensus for the disclosure of Xaa see table VIII

SEQ ID NO: 13436 - protein, 125 aa, consensus; identical to SEQ ID NO: 1305
  MISC_FEATURE (1)..(125): consensus for the disclosure of Xaa see table VIII

SEQ ID NO: 13437 - protein, 622 aa, consensus; identical to SEQ ID NO: 1306
  MISC_FEATURE (1)..(622): Xaa in all Positions is any amino acid

SEQ ID NO: 13438 - protein, 65 aa, consensus; identical to SEQ ID NO: 1307
  MISC_FEATURE (1)..(65): consensus for the disclosure of Xaa see table VIII

SEQ ID NO: 13439 - protein, 150 aa, consensus; identical to SEQ ID NO: 2917
  MISC_FEATURE (1)..(150): consensus for the disclosure of Xaa see table VIII

SEQ ID NO: 13440 - protein, 44 aa, consensus; identical to SEQ ID NO: 2918
  MISC_FEATURE (1)..(44): consensus for the disclosure of Xaa see table VIII

SEQ ID NO: 13441 - protein, 97 aa, consensus; identical to SEQ ID NO: 2919
  MISC_FEATURE (1)..(97): consensus for the disclosure of Xaa see table VIII

SEQ ID NO: 13442 - protein, 1277 aa, consensus; identical to SEQ ID NO: 2920
  MISC_FEATURE (1)..(1277): Xaa in all Positions is any amino acid

SEQ ID NO: 13443 - protein, 55 aa, consensus; identical to SEQ ID NO: 6162
  MISC_FEATURE (1)..(55): consensus for the disclosure of Xaa see table VIII

SEQ ID NO: 13444 - protein, 49 aa, consensus; identical to SEQ ID NO: 6163
  MISC_FEATURE (1)..(49): consensus for the disclosure of Xaa see table VIII

SEQ ID NO: 13445 - protein, 52 aa, consensus; identical to SEQ ID NO: 6164
  MISC_FEATURE (1)..(52): consensus for the disclosure of Xaa see table VIII

SEQ ID NO: 13446 - protein, 20 aa, consensus
  MISC_FEATURE (1)..(20): consensus for the disclosure of Xaa see table VIII
XXXXXXXSXXXXEXXEXXXK

SEQ ID NO: 13447 - protein, 23 aa, consensus
  MISC_FEATURE (1)..(23): consensus for the disclosure of Xaa see table VIII
XXXLPXPXXXXXXXXXXXXXXXX

SEQ ID NO: 13448 - protein, 27 aa, consensus
  MISC_FEATURE (1)..(27): consensus for the disclosure of Xaa see table VIII
XXXXXXXXXXXXXXXXXXXXXXXLXXX

SEQ ID NO: 13449 - protein, 16 aa, consensus
  MISC_FEATURE (1)..(16): consensus for the disclosure of Xaa see table VIII
XXXXXXXXXFXXXRXX

SEQ ID NO: 13450 - protein, 45 aa, consensus; identical to SEQ ID NO: 2913
  MISC_FEATURE (1)..(45): consensus for the disclosure of Xaa see table VIII

SEQ ID NO: 13451 - protein, 31 aa, consensus; identical to SEQ ID NO: 2914
  MISC_FEATURE (1)..(31): consensus for the disclosure of Xaa see table VIII

SEQ ID NO: 13452 - protein, 43 aa, consensus; identical to SEQ ID NO: 2915
  MISC_FEATURE (1)..(43): consensus for the disclosure of Xaa see table VIII

SEQ ID NO: 13453 - protein, 24 aa, consensus
  MISC_FEATURE (1)..(24): consensus for the disclosure of Xaa see table VIII.
HXXXXXXXXXXXXXXXXXXXXXXX

SEQ ID NO: 13454 - protein, 76 aa, consensus; identical to SEQ ID NO: 2897
  MISC_FEATURE (1)..(76): consensus for the disclosure of Xaa see table VIII

SEQ ID NO: 13455 - protein, 39 aa, consensus; identical to SEQ ID NO: 2898
  MISC_FEATURE (1)..(39): consensus for the disclosure of Xaa see table VIII

SEQ ID NO: 13456 - protein, 84 aa, consensus; identical to SEQ ID NO: 2899
  MISC_FEATURE (1)..(84): consensus for the disclosure of Xaa see table VIII

SEQ ID NO: 13457 - protein, 31 aa, consensus; identical to SEQ ID NO: 2900
  MISC_FEATURE (1)..(31): consensus for the disclosure of Xaa see table VIII

SEQ ID NO: 13458 - protein, 101 aa, consensus; identical to SEQ ID NO: 1322
  MISC_FEATURE (1)..(101): consensus for the disclosure of Xaa see table VIII

SEQ ID NO: 13459 - protein, 642 aa, consensus; identical to SEQ ID NO: 2902
  MISC_FEATURE (1)..(642): Xaa in all positions is any amino acid

SEQ ID NO: 13460 - protein, 48 aa, consensus; identical to SEQ ID NO: 9104
  MISC_FEATURE (1)..(48): consensus for the disclosure of Xaa see table VIII

SEQ ID NO: 13461 - protein, 63 aa, consensus; identical to SEQ ID NO: 9105
  MISC_FEATURE (1)..(63): consensus for the disclosure of Xaa see table VIII

SEQ ID NO: 13462 - protein, 346 aa, consensus; identical to SEQ ID NO: 9106
  MISC_FEATURE (1)..(346): Xaa in all positions is any amino acid

SEQ ID NO: 13463 - protein, 16 aa, consensus
  MISC_FEATURE (1)..(16): consensus for the disclosure of Xaa see table VIII
GXXXXLXXXXXXXXXX

SEQ ID NO: 13464 - protein, 101 aa, consensus
  MISC_FEATURE (1)..(101): consensus for the disclosure of Xaa see table VIII
XXXXEKPXXXXXXXXXXXXXXXXXXXXXXXXXXXXDHXLGXXXXXXXXXXXXXNXXXXXXXXXXXXXXXXXXXXXEXXXXXXXXXXXXXXGXXXXDXXXXX

SEQ ID NO: 13465 - protein, 26 aa, consensus
  MISC_FEATURE (1)..(26): consensus for the disclosure of Xaa see table VIII
XXXXXPXXXXXXKXXXXXXXXXXXXX

SEQ ID NO: 13466 - protein, 534 aa, consensus
  MISC_FEATURE (1)..(534): Xaa in all positions is any amino acid
GXXGDLXXXKXXPXXXXLXXXXXLXXXXXXXXGXXRXXXXXXXXXXXXXXXXXXXXXXXXXXXXXXXXXXXXXXXXXXXXXYXXXXXXXXXXXXXLXXXXXXXXXXXXXXXXXXXXXXYXXXXPXXXXXXXXXXXXXXXXXXXXXXXXXXXRXXXEKPXGXDXXSXXXLXXXXXXXXXEXXXXRIDHYLGKEXVXNXXXXRFXNXXXXXXXWXXXXXXXXXXXXXEXXGXXXRXXYXXXXGXXXRDXXQNHXXQXXXXXAMEXPXXXXXXXXXRXEKXKVLXXXXXXXXXXXXXXXXXGQYXXXXXXXXXXXXXXYXXXXXXXXXXXXSXXXTXXXXXXXXXNXRWXGVPFXXXXGKXXXXXXXXXXXXFXXXXXXXXXXXXXXXXXXXXXXXXXXXXXXNXXXXXXQPXEXXXXXXXXKXPGXXXXXXXXXXXXXXXXXXXXXXXXXXXXXXXAYEXLXXDXXXGXXXXFXXXXEXXXXWXXXXXXXXXXXXXXXXXXXXXXYXXGXXGPXXXXXXXXXXXXXXXXXXXXXXW

SEQ ID NO: 13467 - protein, 96 aa, consensus
  MISC_FEATURE (1)..(96): consensus for the disclosure of Xaa see table VIII
XXXXXXXGXGXXXXPXXXXXXXXXXXXXXXXXXXXXXXXXXXXXXXXXXXXXXXXXXXXXXXXXXXXXXXXXXXXXXXXXXXXXXXXXXAYXXXXX

SEQ ID NO: 13468 - protein, 49 aa, consensus
  MISC_FEATURE (1)..(49): consensus for the disclosure of Xaa see table VIII
XXGXXXXXXXXXXXXXXXXXXXXXXXXXXGXXXXXXXYXXWXXXXXGXX

SEQ ID NO: 13469 - protein, 85 aa, consensus
  MISC_FEATURE (1)..(85): consensus for the disclosure of Xaa see table VIII
FXXXAXXXSXXXXXXXXXXXXXXXXXXXXXXXXXXXXXXXXXXXXPXXXXXXXPXXXXXXXXXXXXXXXXXXXXXXPXXXXXXXR

SEQ ID NO: 13470 - protein, 477 aa, consensus
  MISC_FEATURE (1)..(477): Xaa in all positions is any amino acid
XXXXXXXXXXXXXXXXXXXXXXXXXXXXXXXXXXXGXXXXXXGTXXGAGMXXXPXXXXXXXFXXXXXXXXXXWXXXXXXXXXXXEXXXXXXXXXXXXXXXXXXXXXLGXXXXXXXXXXXXXXXYXLXXAYXXXXGXXXXXXXXXXXXXXXXXXXXXXXXXXXXFXXXXXXXXXXXXXXVXXXXXXXXXXXXXXXXXXXXXXXXXXXXXXLXXXXXXXXXXXXXXXXXXXXXXXPXXXXSFGXHXXXPXXXXYXXXXXXXXXXXXXXXGXXXXLXXYXXWXXXXXGXXXXXXXXXXXXXXXXXXXXXXXXXXXXXXXXXXXXXXXXXXFXXXAXXXSFXGVXLGXXDXXXDXXXXXXXXXXXRXXXXXXTFXPPXXXXXXXPXXFXXAXXXAXXXXXXXXXXXXPXXXXXXXRXXXXXXXXXXXXXXXXXGGXXXXXXXXXXXXXXXXXXXXXXXXXXXXXXXXXXXXXXXXXXXXXX

SEQ ID NO: 13471 - protein, 54 aa, consensus
  MISC_FEATURE (1)..(54): consensus for the disclosure of Xaa see table VIII
XXXXXRXDXNXPXXXXXXXXXXXXXXXXXXXXXXXXXXXXXXXXXXXXXXHXXX

SEQ ID NO: 13472 - protein, 11 aa, consensus
  MISC_FEATURE (1)..(11): consensus for the disclosure of Xaa see table VIII
XXXXXXXNXRX

SEQ ID NO: 13473 - protein, 15 aa, consensus
  MISC_FEATURE (1)..(15): consensus for the disclosure of Xaa see table VIII
XXXDXFXXXHRXXXX

SEQ ID NO: 13474 - protein, 61 aa, consensus
  MISC_FEATURE (1)..(61): consensus for the disclosure of Xaa see table VIII
GXXXXXEXXXXXXXXXXXXXXPXXXXXXGXKXXXXXXXXXXXXXXXXXXXXXXXGXXXXXF

SEQ ID NO: 13475 - protein, 85 aa, consensus
  MISC_FEATURE (1)..(85): consensus for the disclosure of Xaa see table VIII
XXXXGPXGXXEXXXXXXXXXXXXXXXXXXXXXXXXXXXXXGGGXXXXXXXXXXXXXXXXXXXXSTXGGAXXXXXXXXXXXXXXXX

SEQ ID NO: 13476 - protein, 554 aa, consensus
  MISC_FEATURE (1)..(554): consensus for the disclosure of Xaa see table VIII
KXVXXRXDXNVPXXXXXXXXXXXXXXRIXXXXPTIXXXXXXXXXXXXXXSHLGRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXPXXXXLXXXLXXXXXXXVXXXXXXXXXXXXXXXXXXXXGXXXXLENXRFXXXEXXXXXXXXXXXXXXXXXXXXXXXXXXXXXXXXXXXXXXXXXXXXVXDAFGXAHRXXXSXXGXXXXXXXXXXXXXXGXLXXXEXXXXXXXXXXXPXXPXXXIXGGXKVXXKXXXXXXXXXXXXXXXXXXGGXXXXTFXXXXXXXXXXXGXSXXXXXXXXXXXXXXXXXXXXXXXXXXXXXXXXXXXXPXDXXXXXXXXXXXXXXXXXXXXXXXXXXXXXXXXXXXXXXDXGXXXXXXXXXXXXXXXXXXXXXXXXXXWNGPXGVFEXXXXFXXGTXXXXXXXXXXXXXXXXXXXXGGGDXXXXXXXXXXXXXXXXXXXSTGGGAXLEXXEGKXLPXXXXL

SEQ ID NO: 13477 - protein, 80 aa, consensus
  MISC_FEATURE (1)..(80): consensus for the disclosure of Xaa see table VIII
XXXGXRFXEXYXWDXXXXXXGLXXXXXXXXXXXXXXXXXXXXXXXXXXXXXXXXXXXXXXXNXXRXXXXXRXQPXXXXXX

SEQ ID NO: 13478 - protein, 57 aa, consensus
  MISC_FEATURE (1)..(57): consensus for the disclosure of Xaa see table VIII
XXXXXXXXXXGXDXXXRXXXXXXXXXXXXXXXXXXXXXXXXXXXXXNXXXXXXXXXX

SEQ ID NO: 13479 - protein, 119 aa, consensus
  MISC_FEATURE (1)..(119): consensus for the disclosure of Xaa see table VIII
QWDXXXXWXPXXXXXXXXXXXXXXXXXXXXXXXXXXXXXXXXXXXXXXXXXXXXXXXXXXXXXXXXXXXXXXXXXXXXXXEKXXXXXXXXXXXXXXXXXXXXXXXXXXXXXXXGFGWXX

SEQ ID NO: 13480 - protein, 518 aa, consensus
  MISC_FEATURE (1)..(518): Xaa in all positions is any amino acid
PGGRFXEXYXWDSYXXXXGLXXXXXXXXXXXXXXXXXXXXXXXXXXNXXXXXXXXGXXXNXXRXYYXXRSQPPXXXXMXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXESGXDXXXRXXXXXXXXXXXXXXXXXXXXXXXXXXXDLNXXLXXXXXXXXXXXXXXXXXXXXXXXXXXXXXXXXXXXXXXXXXXXXXXXXXXXXXXXXXWXXXXXXXXDYXXXXXXXXXXXXXXXXXXXXXXXXXXXXXXXXXXXXXXXXXLXXXXXXXXXXXXXXXXXXXXXXXXXXXXXXXXXXXGXXXXXXXXXXXXXQWDXPXXWXPXXXXXXXGLXXXXXXXXXXXXXXXXXXXXAXXXXXXXXXXXXXXXXXXXXXXXXXXXXXXXXXXXXXXXXEKYXXXXXXXXXXXXXXXGXXGXXXXXXXXXXXGFGWXN

SEQ ID NO: 13481 - protein, 26 aa, consensus
  MISC_FEATURE (1)..(26): consensus for the disclosure of Xaa see table VIII
XXXGXXXMGXNXXXXXXXXXXXXXXX

SEQ ID NO: 13482 - protein, 85 aa, consensus
  MISC_FEATURE (1)..(85): consensus for the disclosure of Xaa see table VIII
XXXPXXXXXXXXXXXXXXXXXXXXXXXXXXXXXXDXXXXXGNXXXXXXXXXXXXXXXXXXXXXXXXGXSGGXXGXXXGXXXXXGG

SEQ ID NO: 13483 - protein, 28 aa, consensus
  MISC_FEATURE (1)..(28): consensus for the disclosure of Xaa see table VIII
XXGXXXKXXHNXXEYXXXXXXXEXXXXX

SEQ ID NO: 13484 - protein, 88 aa, consensus
  MISC_FEATURE (1)..(88): consensus for the disclosure of Xaa see table VIII
WXXXXXXXXXXXXXXXXXXXXXXXXXXXXXXXXXXXXXXXXXXXXXXXXXXXXXXXXXGXGXWXXXXXXXXXXXXXXXXXXXXXRXXX

SEQ ID NO: 13485 - protein, 582 aa, consensus
  MISC_FEATURE (1)..(582): consensus for the disclosure of Xaa see table VIII
GXXGLXXMGXNXXXNXXXXGXXXXXXNRXXXXXXXXXXXXXXXXXXXXXXXXXXXXXXXXXXXLXXPRXXXXXVXAGXXXDXXXXXIXXLXXXLXXGDXXIDGGNXXXXDXXRRXXXXXXXXGXXXXGXGXSGGXXGAXXGPXXMXGGXXXXXXXXXXXXXXXXAXXXXXXXXXXXXXXXXXXXXXXXXCXXXXGXXXXXXXXXXXXXXXXXXXXXXXXXXXXXXXXXXXXXXXXXXGXGHXVKMVHNGIEYXXMQXIXEXYXXXXXXXXXXXXXXXXXXXXXXXXXXXXXXXXXXXXXFXXWNXXXXXLXSXLXXITXXXXXXXXXXXXXXXXXXXXXXXXXXXXXXXXXXXXDXXXXKGTGXWTXXXAXXXXXXXXXIXXXXXXRXXSXXXXXRXXXXXXXXXXXXXXXXXXXXXXXXXXXXXXXXXXXXXXXXXXXXXXXXXQXXXXXXXXXXXXXXXXXXXXXXXXXXXXGCIXXXXXLXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXDXFGXH

SEQ ID NO: 13486 - protein, 68 aa, consensus
  MISC_FEATURE (1)..(68): consensus for the disclosure of Xaa see table VIII
XXXXXXXXXXXXXXAXXXXXXXXXXXXXXXXXXXXXXXXXXXXXXXXXXXXXXXXXXXXXXXXXXXXK

SEQ ID NO: 13487 - protein, 69 aa, consensus
  MISC_FEATURE (1)..(69): consensus for the disclosure of Xaa see table VIII
GXXXXXKXXXXXXXXXXXXXXXXXXXGXPXXXXXXXXXXXXXXXXXXXXXXXXXXXXXXTGXXXXXXXX

SEQ ID NO: 13488 - protein, 44 aa, consensus
  MISC_FEATURE (1)..(44): consensus for the disclosure of Xaa see table VIII
EXGXXXXXXXXXXXXXXXXXXXXXXXXXXXXXGXXCXXXXXXXX

SEQ ID NO: 13489 - protein, 28 aa, consensus
  MISC_FEATURE (1)..(28): consensus for the disclosure of Xaa see table VIII
XXXXXPXXXXXXXXXXXXXXXEXFXPXX

SEQ ID NO: 13490 - protein, 52 aa, consensus
  MISC_FEATURE (1)..(52): consensus for the disclosure of Xaa see table VIII
XXLXXXXXXXXXXXXXXXXXXXXXXXXXXXXXXXXXXXXXXXXXXXXGXXXX

SEQ ID NO: 13491 - protein, 475 aa, consensus
  MISC_FEATURE (1)..(475): Xaa in all positions is any amino acid
AXXXXXXXAXXXAXXXXXXXXXXXWXXXXXXXRXXXXXXXAXXXXXXXXXXXXXXXXXXXGKXXXXXXXXXXXXXXXXXXXXXXXXXXXXXXXXXXXXXXXXXXXXXXXXXXXXGXXXXXXPXNXXXXXXXXXXXXXXXXGNXXXXKPXXXXXXXXXXXXXXXXXAGXPXXXXXXXXGXXXXXXGXXXXXXXXXXXXXFTGSXXXXXXXXXXXXXXXXXXXXXXXXXXXXEXGGXXXXXXXXXAXXXXXXXXXXXXXXFXXXGQXCSAXXXXXXXXXXXXXXXXXXXXXXXXXXXXXGXXXXXXXXXXXXXXXXXXGPXXXXXXXXXXXXXXXXXXXXXXXXXXXXXXXXXXXXXXXXXXXGXXXXPTXXXXXXXXXXXXXXEXFGPXXXXXXXXXXXXXXXXXXXXXXXNXXXYGLXXXXXXXXXXXXXXXXXXXXXXXXXXXXXXXXXXXXXXXXXPFGGXXXSXXGXXXXXG

SEQ ID NO: 13492 - protein, 55 aa, consensus
  MISC_FEATURE (1)..(55): consensus for the disclosure of Xaa see table VIII
XXXXXXXXXXXXXXXXXXXXXXXXXXXXXXXXXXXXXXXXXXXXXXXXXXXXXXX

SEQ ID NO: 13493 - protein, 93 aa, consensus
  MISC_FEATURE (1)..(93): consensus for the disclosure of Xaa see table VIII
XXXXXXXNPXGXXXXXXXXXXXXXXXXXXXXXXXXXXXXXDXAYXGXXXXXXXXXXXXXXXXXXXXXXXXXXXXXXXXXXXXKXXXXXXXRXG

SEQ ID NO: 13494 - protein, 120 aa, consensus
  MISC_FEATURE (1)..(120): consensus for the disclosure of Xaa see table VIII
XXXXXXXXXXXXXXXXXXXXXXXXXXXXXXXXXXXXXXXXXXXXXXXXXXXXXXXXXXXXXXXXXXXXXXXXXXXXXGXFXXXXXXXXXXXXXXXXXXXXXXXXXXXXXXXXXRXXXXXX

SEQ ID NO: 13495 - protein, 437 aa, consensus
  MISC_FEATURE (1)..(437): Xaa in all positions is any amino acid
DXXXXXXXXXXXXXXXDXXXXKXNLXXGXYXXXXXXXXXXXXVXXAXXXXXXXXXXXXXXXYXXXXGXXXXXXXXXXLXXXXXXXXXXXXXXXXXXRXXXXQXXXGXGALXXXXXXXXXXXXXXXXXXXXXXXXXXXPXWXNHXXXFXXXGXXXXXXYXYXXXXXXXXXXXXXXXXXXXXXXXXXXXXXXXXXXXLHXCXHNPTGXDXXXXXWXXXXXXXXXXXXXXXXXXXXXDXAYQGFXXGXXXXDAXXXRXXXXXXXXXXXXXXXXXXXSXXKXXXLYXERXGXXXXXXXXXXXXXXXXXXXXXXXXXXXXXXXXXXXXRXXXSXPPXXGXXXXXXXLXXXXXLXXXWXXXXXXMXXRXXXXRXXXXXXLXXXXXXXXXXXXXXXXXXXQXGMFXXXGXXXXQXXXXXXXXXXXXXXYXXXXGXXXXRXXXXG

SEQ ID NO: 13496 - protein, 48 aa, consensus
  MISC_FEATURE (1)..(48): consensus for the disclosure of Xaa see table VIII
XXXXXXXXXXXXXXXXXXXXXXXXXXXXXXXXXXXXXXXXXXXXXGGX

SEQ ID NO: 13497 - protein, 48 aa, consensus
  MISC_FEATURE (1)..(48): consensus for the disclosure of Xaa see table VIII
GXXXXXXXXXAXXXXXXXXXXXXXXXXXXXXXXXXXXXXXXXXXXXXD

SEQ ID NO: 13498 - protein, 41 aa, consensus
  MISC_FEATURE (1)..(41): consensus for the disclosure of Xaa see table VIII
XXXXXXXXXXXXXGXXXGXXXXXXXXXXXXXXXXXXXXXXG

SEQ ID NO: 13499 - protein, 287 aa, consensus
  MISC_FEATURE (1)..(287): Xaa in all positions is any amino acid
RXIPXLDXXXXXXXXXXXXXXXXXXGXXVXXXXXXXXXXXXXXXXXXXXGXPXXXAXXXXXXGADEXXXXDXXXXXXXXXXXXXXXXXXXXXXXXXXXPXXVGGGXXXXXXXXXXXXXXXXXXXXXXXXXGXDKXXXXXXAXXXPXXXXXXXXXXXXXXXXXXXXXXXGXQXXVXXXDXXXXXXXXXXXXXXXXXXXXXXXXXXXXXXXXXXXXXXXXXXXGXXXXXXXXXXXXXXXXXXXXXXGAGEIXXXXXXXDGXXXGXXXXXXXXXXXXXXXXPXIASGGXG

SEQ ID NO: 13500 - protein, 108 aa, consensus
  MISC_FEATURE (1)..(108): consensus for the disclosure of Xaa see table VIII
XXXXRXXXPXXXXXXXXXXVXXXXXXXXXXXXXXXXXXXXXXDXXXXXXXGXXXXXXXGXXXXXXXXXXXXXXXXXXXXXXXXTXXXXXXXXXXXXGXXXXXXXXXXX

SEQ ID NO: 13501 - protein, 79 aa, consensus
  MISC_FEATURE (1)..(79): consensus for the disclosure of Xaa see table VIII
XXXXNXXXXXXXGXXXGXDXXXXGXXXXXXXXXXXXXXXXXXXVXXXXXXXSXXGXXXXXXXXXXAXXXXXXXXXXKXX

SEQ ID NO: 13502 - protein, 103 aa, consensus
  MISC_FEATURE (1)..(103): consensus for the disclosure of Xaa see table VIII
XXXXXXXXXXGXXRXXXXXXXXXGXXXXEXFXXXGXGXXXXXXXXXXXXRXAXXXDXXXXXXXXXPLEXXGXLXXRXXXXXXXXXXXXXXXXXXXXXXXCXAX

SEQ ID NO: 13503 - protein, 76 aa, consensus
  MISC_FEATURE (1)..(76): consensus for the disclosure of Xaa see table VIII
XEXAXXXXXXXXXXXXXGXXXXXXXXXXXXXXXXXXXFXLXTXXXXWFXXXGFXXXXXXXXPXXXXXXXXXXXRXX

SEQ ID NO: 13504 - protein, 528 aa, consensus
  MISC_FEATURE (1)..(528): consensus for the disclosure of Xaa see table VIII
VXXFRXXXPYXXXHRXXTFVXXXXGXXXXXXXXXXXXXXXXXDXXLLHXLGXXXVXVXGXRXQIXXXLXXXXXXXXYXXXXRXTDXXXLXXXXXAXGXXXXXIXAXLSXXXXXXXXXXXXXXXPXXXXXXXVXSGNFXXAXPXGVXXGXDXXXXGXXRXIDXXXIXXXLXXXXIVLXXPXXXSXTGEXFNLXXEXXATXXAXXLXAXKXIXXXXXXGXXXXXGXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXAXXACXXGVXRXHXXXXXXDGXLLXELFXXXGXGTXXXXXXXXEXXRXAXXXDXXGXXXLIXPLEXXGXLVXRXREXLEXXXXXFXXXEXDXXXIXCAALXPXXXXXXXXXXXEXACXAVXPXXRXXXXGXXLLXXXXXXAXXXGXXXLFXLTTXXXXWFXXXGFXXXXXXXLPXXXXXXYNXXXRXSXXXXXXL

SEQ ID NO: 13505 - protein, 50 aa, consensus
  MISC_FEATURE (1)..(50): consensus for the disclosure of Xaa see table VIII
RXEXDXXGXXXXXXXXXXGXXXXRXXXNXXXXXXXXXXXXXXXXXXXXXK

SEQ ID NO: 13506 - protein, 57 aa, consensus
  MISC_FEATURE (1)..(57): consensus for the disclosure of Xaa see table VIII
XXGXGTXXXMNXNEVXXNXXXXXXXXXXXXXXXXXPXXXXNXXQSXNXXXXXXXXXX

SEQ ID NO: 13507 - protein, 56 aa, consensus
  MISC_FEATURE (1)..(56): consensus for the disclosure of Xaa see table VIII
XXXXRTXXXDXXPXXXGXXFXXXXXXXXXXXXXXXXXXXXXXXXXXXGXXXXGTXX

SEQ ID NO: 13508 - protein, 105 aa, consensus
  MISC_FEATURE (1)..(105): consensus for the disclosure of Xaa see table VIII
XXXXDXRXXXSGPXXXXXXXXXXXXXXGSSIMPXKXNPXXXEXXXXXXXXXXXXXXXXXXXXXXXXXXLNXXXPXXXXXXXXXXXXXXXXXXXXXXXXXXXXXXX

SEQ ID NO: 13509 - protein, 550 aa, consensus
  MISC_FEATURE (1)..(550): Xaa in all Positions is any amino acid
XXXXXXXXXXXXXXXXXXXXXXXXXXXXXXXXXXXXXXXXXXXXXXXXXXXXXXXXXXXXXXXXXXXXRXEXDXXGXXXXPXXXYXGXXTXRAXXNFXIXXXXXXXXXXXXXXXXXXKXAXAXXNXXXXXXXXXXXXXIXXAXXXXXXXXXXXXXXFXXDXXQGGAGTSXNMNXNEVXANXAXEXXGXXXGXYXXXXPNXXVNXXQSTNDXXPTXXXXXXXXXXXXXLXXXXXXLXXXXXXKXXEFXXXXKXGRTXLQDAVPXXXGQEFXXXXXXXXXXXXXXXXXXXXXXXXXNXGXTAXGTGXNXXXXYXXXXXXXLXXXXXXXXXXAXXLXXATXXXXXXXXXXXXLKXXAXXXXKXXNDLRLLXSGPRXGXXEXXLPXXQXGSSIMPXKVNPVXXEXXNQXXXXVXGNDXXXXXAXXXGQLXLNXXXPXXXXXXXXSXXXXXXXXXXXXXXCXXGIXXNXXXXXXXXXXSXXXXTXLNPXXGXXXXXXXXXXXXXXGXXXXXXXXXXXXXXLXXXXXXXXXXXXXXXXPXXXXXXXXXXXXXXXXX

SEQ ID NO: 13510 - DNA, 1818 bp, Escherichia coli
  CDS (1)..(1818)
atgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcataatcgtggcacgggtggtgcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgccgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccctggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcaacgtgtactggtggcaatcaaccgtggcgaggcctgtgaagtggtgctacccgcgtcaccgtttctcaatgccgtgcaatggcaatgcaaagaagggcatgggcaactgactgacgggattctggctttgcctgccatttcggctacggtatggatgaactaa

SEQ ID NO: 13511 - protein, 605 aa, Escherichia coli
MMLNAWHLPVPPFVKQSKDQLLITLWLTGEDPPQRIMLRTEHDNEEMSVPMHKQRSQPQPGVTAWRAAIDLSSGQPRRRYSFKLLWHDRQRWFTPQGFSRMPPARLEQFAVDVPDIGPQWAADQIFYQIFPDRFARSLPREAEQDHVYYHHAAGQEIILRDWDEPVTAQAGGSTFYGGDLDGISEKLPYLKKLGVTALYLNPVFKAPSVHKYDTEDYRHVDPQFGGDGALLRLRHNTQQLGMRLVLDGVFNHSGDSHAWFDRHNRGTGGACHNPESPWRDWYSFSDDGTALDWLGYASLPKLDYQSESLVNEIYRGEDSIVRHWLKAPWNMDGWRLDVVHMLGEAGGARNNMQHVAGITEAAKETQPEAYIVGEHFGDARQWLQADVEDAAMNYRGFTFPLWGFLANTDISYDPQQIDAQTCMAWMDNYRAGLSHQQQLRMFNQLDSHDTARFKTLLGRDIARLPLAVVWLFTWPGVPCIYYGDEVGLDGKNDPFCRKPFPWQVEKQDTALFALYQRMIALRKKSQALRHGGCQVLYAEDNVVVFVRVLNQQRVLVAINRGEACEVVLPASPFLNAVQWQCKEGHGQLTDGILALPAISATVWMN

SEQ ID NO: 13512 - DNA, 1665 bp, Mesorhizobium loti MAFF303099
  CDS (1)..(1665): transl_table=11
atgcaatccgctttgaaagccagttcgaaccccgacctcgccatcgatcgcgactggtggcgaggtgctgtcatctaccagatctacccgcgcagctaccaggattcgaacggcgacggcatcggcgacctcaagggcatcatcgaacggctgccctacatcgcagcgctcggtgcggacgccatctggatctcgcccttcttcaaatcgccgatgaaggatttcggctacgacgtctcggactattgcgacgtcgacccgatgttcggcacgctggccgatttcgacgcgctgacggcggaggcgcaccggctgggtctcaaggtgatgatcgacgaagtgctgtcgcacacggccgacatccatccctggttcaaggaaagccggtcgagccgcagcaatcccaaggccgactggtatgtctgggcggacgcccggcccgacggcaccccgcccaacaactggctgtcgatcttcggcgggtccgcctggcagtgggacaccagccgccagcaatattacctgcacaatttcctggccgagcagcccgacctcaacttccacaaccgcgaagtccaggacgcgctgctcgacgtcacccgcttctggctggaacgcggcgtcgacggcttccgcctcgacacgatcaatttctactttcacagccagggcctggaaaacaatccgccgctgccgccggaagaacgcaacgaccagaccgcgccggcggtcaatccctacaactaccaggaccatctctacgacaagagccgtccggaaaacctcggcttcctcgaacgcttccgcgctttgctcgacgaatatccggcaaccgccgctgtcggcgaggtcggcgattcgcagcgtgggctggaagtcgtggcagcctacactgccggcggcaagcgcgtgcatatgtgttattccttcgacttcctggcgccggaaaagatcagcgccgccaaggtgcgttcggtgctggaggccttcggcaaggtcgccagcgacggctggtcgtgctgggcgttttccaatcatgacgtgatgcgtccggcctcgcgctgggccgccggcgaagccgaccctgtcgcctatctcaaggtcatctcggccttgctgatgtcgctgcgcggctcggtctgcatctaccagggcgaggaactcgggctgggcgaggccgaattgcgcttcgaggatctgcaggatccctatggcatccgcttctggccggaattcaagggccgcgacggctgccgcacgcccatggtgtgggatggcgacgccaagaatggcggcttctcccaggccaagccctggctgccggtgccggccaagcatctggcgcaagcggtcaatgtccagcagggtgaccaggcttcactgctcgagcactatcggcgcttcctcagcttccgccgcgcccatccggcgctggccaagggcgacatcaccttcatcgaaagcgagggcgacaccgtcgccttcacgcgccgcgccggcaacgagcaggttgtctgcgtcttcaacctcggcgccaagccggccaaggttgaccttggcagccgatccctgcaacctttgccgggacacgggttttccgggcaggcgaggcccggttcgatcgagcttggcggttacggcgcctggttcgggcgcatcgactga

SEQ ID NO: 13513 - protein, 554 aa, Mesorhizobium loti MAFF303099
MQSALKASSNPDLAIDRDWWRGAVIYQIYPRSYQDSNGDGIGDLKGIIERLPYIAALGADAIWISPFFKSPMKDFGYDVSDYCDVDPMFGTLADFDALTAEAHRLGLKVMIDEVLSHTADIHPWFKESRSSRSNPKADWYVWADARPDGTPPNNWLSIFGGSAWQWDTSRQQYYLHNFLAEQPDLNFHNREVQDALLDVTRFWLERGVDGFRLDTINFYFHSQGLENNPPLPPEERNDQTAPAVNPYNYQDHLYDKSRPENLGFLERFRALLDEYPATAAVGEVGDSQRGLEVVAAYTAGGKRVHMCYSFDFLAPEKISAAKVRSVLEAFGKVASDGWSCWAFSNHDVMRPASRWAAGEADPVAYLKVISALLMSLRGSVCIYQGEELGLGEAELRFEDLQDPYGIRFWPEFKGRDGCRTPMVWDGDAKNGGFSQAKPWLPVPAKHLAQAVNVQQGDQASLLEHYRRFLSFRRAHPALAKGDITFIESEGDTVAFTRRAGNEQVVCVFNLGAKPAKVDLGSRSLQPLPGHGFSGQARPGSIELGGYGAWFGRID

SEQ ID NO: 13514 - DNA, 1635 bp, Mesorhizobium loti MAFF303099
  CDS (1)..(1635): transl_table=11
gtgatggccgacgacaatgcggggcagggggccgactggtggcgcggctgcgtcatctaccaagtctatccgcgttccttccaggacacgaccggcgacggcagcggcgatcttaggggtatcaccacgcggcttggccacatcgcttcgctcggcgtcgatgccgtctggctgtcgcccttcttcaagtcgccaatggccgacatgggctatgacgtttcggattatcgcgacgtcgatccgatgttcggttcacttgaggatttcgacgctctggtcaccgaggcgcaccggttgggcctgaaggtcgtcatcgaccaggtcttgtcgcactcatccgacaagcacgaatggttcgtccaaagccgcgccagccgcgacaatcccaaggctgactggtacgtctgggccgatacgaaacccgacggcaacgcgcccaacaactggctgtccgtcttcggcggcccggcctgggagtgggattcgacccgccggcaatattacatgcacaatttcctcgcctcgcagcccgatctgaatttccacaatccagaggtccaggatgcgctgctggacacggtgcgcttctggctggagcgtggcgtcgacggttttcggctcgatacggtcaactactatgtccacgaccgctggctgcgcagcaatccgccgctggcgtcgagcgtcgccggcaccaatggcgagaccaacacctacctctaccaggagcatctgttcgacaagacgcagccggaaaacctggctttcctcaggcgtttccgggggttgctagacgaatatcccgaccgcgccgccgtcggcgaaatcggcgatgagggccgctcgctgcagacgctggctgcctacacctccggcggcgacaagctgcagatgtgctacaccttcgacctgctcggcccgcagttttcggcggcgcatgtgcgcggctgcgtcgaggccttcgaacaagcggttaccgacggctgggtctgctgggcgttttccaaccatgacgtggtgcgccatgtcagccgctggactgggccggacggcgatgccgatgcggtagccagattctcgatcatgctgctcgcctgcctgcgcggctcgatatgcctctatcagggcgaggagctcggcctggaggaggcggagcttgcctatgaggatctgcgcgatcccgtcggcatccgcttctggcccggcatgaagggcagggatggctgccgcacgccgatggtctgggaagccggcgccgacaatgcgggtttctcgacggccaggccctggctgccggtcccggccagccatcgcgcccgcgccaccgacgtgcagaacggcagcgagcaatcggtgctgtccgcctaccgctcgacgcttgccttgcgcaggcggcatccggcgctggtcagcggctcgatccgctttctcgacgccgaaggcgatgtgctggccttcatccgcgaaggcgacgggcagaggctgctctgcgtcttcaatttcgccggggagccggggaattggcccttgccaccggatattggcgtcgctgctgtcctggctggcgccgctgttgtcgaggaagaagcgctctcgctgccggctctcggttgcttccttggccggctcgactga

SEQ ID NO: 13515 - protein, 544 aa, Mesorhizobium loti MAFF303099
MMADDNAGQGADWWRGCVIYQVYPRSFQDTTGDGSGDLRGITTRLGHIASLGVDAVWLSPFFKSPMADMGYDVSDYRDVDPMFGSLEDFDALVTEAHRLGLKVVIDQVLSHSSDKHEWFVQSRASRDNPKADWYVWADTKPDGNAPNNWLSVFGGPAWEWDSTRRQYYMHNFLASQPDLNFHNPEVQDALLDTVRFWLERGVDGFRLDTVNYYVHDRWLRSNPPLASSVAGTNGETNTYLYQEHLFDKTQPENLAFLRRFRGLLDEYPDRAAVGEIGDEGRSLQTLAAYTSGGDKLQMCYTFDLLGPQFSAAHVRGCVEAFEQAVTDGWVCWAFSNHDVVRHVSRWTGPDGDADAVARFSIMLLACLRGSICLYQGEELGLEEAELAYEDLRDPVGIRFWPGMKGRDGCRTPMVWEAGADNAGFSTARPWLPVPASHRARATDVQNGSEQSVLSAYRSTLALRRRHPALVSGSIRFLDAEGDVLAFIREGDGQRLLCVFNFAGEPGNWPLPPDIGVAAVLAGAAVVEEEALSLPALGCFLGRLD

SEQ ID NO: 13516 - DNA, 1851 bp, Thermoplasma volcanium GSS1
  CDS (1)..(1851): transl_table=11
atggtagaggtaaaaataattaaatcagatgggttctttaatgaagtgcttatttcttcggacaaaaaaattcactttgacactgcttatgcggaaggtgattttaattgttttggggaagggagtattgtctccgaaacaacagatgatttaaagtttaaaattgcaaatcttatacctggaaagtaccatttcaagatagctatcgatcagtataaaatccttagagaagctgagaatagatccggctcatactcgttttcaatatggttggaaaaaccttatcacaatccagattatgcacagttttgcgcgattattgacaaaaaacttatggacgttcgaatagcagtaccaaaacacagcatttccgtatctatttttacgaaagatactttaaaacctgtatattcccgaagagcatcttttgatacttttgatgcagttgagtatgtttttgatggtatgtcagattattattttgaagtagataattccaggttacctaaggaaggatatttctcaccaaaagtgcacatcgaacacgaaggcggatcaaagatcatttatcacatatttccagataggttttttagagtaggcccgcatctgccaacactatcaagatggggagataaacctactttttcaagcttctttggaggaaatttgagggggataaccgaaaaaataggttatattaaggccctcaatgttgatacgatataccttaatccagtatataaaagcaagtcgaatcataggtacgatgttgacgattacttctctatagacggattgcttggcggtgaacaggattttatcgagttagtcaacgaagctcatgaaaacggtattaaaatagttgcagacatggtgttcaaccatacctcaacggatttcccctattttttggatgcccttaagaacggaaagaactctaaatactggaattggtacatatttcatggtgaaggcgcagcagtatttgatggtagagcaaaaggaaaaacaaaaccattatacgaaacttttatgggagttgggcgcatgcctaagttaaatcacaagaatgcagaggtaaggaagttctgcatagacgttatgaaatactacaagaacaaatttggagtagatggctttagatacgatgttgcacactcaatctaccctgaattctttttagaagctgtcaaagaatttggaaatgagatgctgcacataggggaagcatggtgtcttccatcaatgttcatgctatctggatactggaatagctttacaaattattatctaagaaatgcgattataaagtttgtccgtgaagaaataaatataaccgagttttataatatgattcaaaatatgataatatcttatggtccgcttattcagcagaatgttatgaatatacttgattcacatgatactgaaaggatattaagggcattcaagggaaataaaaaaaaggtcaagcttgcctattcaatattatttatgttcgatggatttgctacgatttactatggggatgaagttggtcttgacgggggccgagatcctgatgacagaagatgttttccttgggacaatatggatgaagatatgcttcaattcctaaaaaaacttggagaaatcagaagaatgtatcacacaggtagtgccggaataataactgtagaagagactcaggaatgcaaatatataactaggttaagcggtgaatcgataataaaggttgcaattgccaagaagccagttactttagaaggtgaaataatcttgagcagttgtggagaaaagacaatttatgagggagattttgctttgtctatagcgaaatatgcatga

SEQ ID NO: 13517 - protein, 616 aa, Thermoplasma volcanium GSS1
MVEVKIIKSDGFFNEVLISSDKKIHFDTAYAEGDFNCFGEGSIVSETTDDLKFKIANLIPGKYHFKIAIDQYKILREAENRSGSYSFSIWLEKPYHNPDYAQFCAIIDKKLMDVRIAVPKHSISVSIFTKDTLKPVYSRRASFDTFDAVEYVFDGMSDYYFEVDNSRLPKEGYFSPKVHIEHEGGSKIIYHIFPDRFFRVGPHLPTLSRWGDKPTFSSFFGGNLRGITEKIGYIKALNVDTIYLNPVYKSKSNHRYDVDDYFSIDGLLGGEQDFIELVNEAHENGIKIVADMVFNHTSTDFPYFLDALKNGKNSKYWNWYIFHGEGAAVFDGRAKGKTKPLYETFMGVGRMPKLNHKNAEVRKFCIDVMKYYKNKFGVDGFRYDVAHSIYPEFFLEAVKEFGNEMLHIGEAWCLPSMFMLSGYWNSFTNYYLRNAIIKFVREEINITEFYNMIQNMIISYGPLIQQNVMNILDSHDTERILRAFKGNKKKVKLAYSILFMFDGFATIYYGDEVGLDGGRDPDDRRCFPWDNMDEDMLQFLKKLGEIRRMYHTGSAGIITVEETQECKYITRLSGESIIKVAIAKKPVTLEGEIILSSCGEKTIYEGDFALSIAKYA

SEQ ID NO: 13518 - DNA, 1422 bp, Thermotoga maritima MSB8
  CDS (1)..(1422): transl_table=11
atgatgtacccgatgccgtcttgggtttacgacagtgtcgtgtatcagatctttccagatagatttttcatcggaaagggaaaaacggtggaagacaaaaaggatctgtacctgaagcggggaggagtcatagagaaatggggagttcctccccgcaaacttcccggtgctcagcacgtgaagatcttctacggaggagatctgtggggaatagccgagaaggtcgattattttgaagaacttggaatcaacgttctgtacctcactcctatctttttgtccgataccaatcacaagtacgacacgatcgattacttcagggtggatccacagttcggcggaaagagggcttttctgcaccttttgagggttctccatgagaggagtatgaaactcattctcgatggtgtgttcaaccacgttgggagtcagcatccgtggttcaaaaaagcgaagaaaaacgatccagagtacgtgaacagatttttcctttacaaagataggcacagatcgtggttcgacgttggaagccttcccgagctgaacgtggaagtcgaagaagtgaaggaatacattttgaaagttgtcgagcactacctgaaactggggatagacggttggaggctggattgtggccacgatcttggacctaccgtcaacctgtggatcaacatgaaagtgaaagagttctcagcggaaaagtacctcgtgagtgagatatggacttacccggcaggatgggatatggttgatggtctgatgaattacaacttcagaaaccttgtgcttagttatgtgaacggcgagacggattccataggttttcacctggaaagagcttacagggagacgaagaacatattcggttgctggaacatgcttgacagtcacgacaccccgagactcgccacaatggttcccgacagagacctgagaaaactcgctgtagttcttcagttcacttatcccggtgttccgctcgtttactatggaacagagataggtctcacaggtggagaagatccagagtgtcgtgccaccatggaatggaacagagagaaatgggatgttgatctgttcgagttctacaagaagatgatcagactgagaaggacggatccaggtttgcgctttggagagtttgtcttgctgaacgactcacctctcgcgtttctcagaaaggctcctcatcctcttcaaaacaccatcgtggtggtgaacccaggagaagagaaggtgctggttctctccattcccgacgggaaaattatgaacaccactccccttgtcgatgtgttcagcggagaaagattccacgttgacggcggggttgtgaagcttccccttctagcgagatctttcagaattctcaagcccgaggatctgagagtgggtaagtacagattgtacaagagagtttga

SEQ ID NO: 13519 - protein, 473 aa, Thermotoga maritima MSB8
MMYPMPSWVYDSVVYQIFPDRFFIGKGKTVEDKKDLYLKRGGVIEKWGVPPRKLPGAQHVKIFYGGDLWGIAEKVDYFEELGINVLYLTPIFLSDTNHKYDTIDYFRVDPQFGGKRAFLHLLRVLHERSMKLILDGVFNHVGSQHPWFKKAKKNDPEYVNRFFLYKDRHRSWFDVGSLPELNVEVEEVKEYILKVVEHYLKLGIDGWRLDCGHDLGPTVNLWINMKVKEFSAEKYLVSEIWTYPAGWDMVDGLMNYNFRNLVLSYVNGETDSIGFHLERAYRETKNIFGCWNMLDSHDTPRLATMVPDRDLRKLAVVLQFTYPGVPLVYYGTEIGLTGGEDPECRATMEWNREKWDVDLFEFYKKMIRLRRTDPGLRFGEFVLLNDSPLAFLRKAPHPLQNTIVVVNPGEEKVLVLSIPDGKIMNTTPLVDVFSGERFHVDGGVVKLPLLARSFRILKPEDLRVGKYRLYKRV

SEQ ID NO: 13520 - DNA, 1671 bp, Thermotoga maritima MSB8
  CDS (1)..(1671): transl_table=11
gtgaaggttgtgaagaagccttttttactgcttgcttttgtgtttttactcttcctcacctcctgctttcaaacgtctatgagtcaatccctcgtttcaagtaatccacattcaaacagcacaaacacagatggtactagctccaaccttgaagaagtaaaataccccgtcgtctacgaaattttcattcgctctttttacgacagagacgggaacggagtgggagatttaaacggtgtttctcagaaagttgattatctgaaggaactcggcgttgacgctgtgtggtttatgcccttcaacgaggctgtttcataccatggatacgacataacagactactacaacgtcgagaaagactacggcaccatggaagatctcgaaaacatgatccaggtgctccatgagaacggaataaaggtaataatggatctcgtgatcaaccacacatccgatgagcatccctggttcaaagacgccgtggaaaacacgaccagctctccgtactgggactactacataatgagtcttgaagatcattctggtcaggatcactggcactggaagatcaactcaaagggtcaaaaagtctggtatttcggactttttggctataacatgccggatctgaaccacgacagtcagaaagtgagagaagaagtaaagaaaatcgtggatttctggatttccaaaggtgttgatggattcagaatagatgctgcaaagcacatatatggctggtcctgggacgatgggatacaggagtcggccgaatattttgaatggttcagagattatgtgctttccaaaaagcccgatgccatacttgtgggagaggtgttcagcggaaacacgtacgatctttctctatatccaattcccgttttcaatttcgccctcatgtacagtataaggaactacccagaagggcaggatggaatgatagaaaacaactgggttgaggagtctttcctgtttcttgagaatcacgatctccacaggttcttctcccatcttcaagaacattacaaaaagttctccgagtccgactacgagttcatcaaaaaacgtgctgctctctggtattttctgatattcacactgaaaggatctcctgttatctactacggcggtgaaattggaacgagaggtttcaagtggcacggtcctgtatatgacgagccggtgagagagccgatgcagtggtacgcaagcggtacaggagaaggtcaaaccttctggacaaaggaagtctacaaaaacgcggggataacctttggaaacgctgatgttgacggatgtatctatgacgatccttacgatggcttttctgtcgaagaacaggaaagcgatccgaagagtcttttgaatttcatcagattcattctcaacttcagaaaagatcacgacgccattttgaatggagatcaaacgatcttcagggactggaaaaacctcatagcgttctacagagaatcctccaacgaaaagctgttggtggtcttgaatccggatccagtctggcaaaacagcttcacttttgaagaaaacatgacgatgattctcgaggtagattttgaaaacttcatctggaacgagtcaaacgtgtctttttcagcgggtgaatccttcactgtggatcccatgaaagcgtacattttcaaaaagtga

SEQ ID NO: 13521 - protein, 556 aa, Thermotoga maritima MSB8
MKVVKKPFLLLAFVFLLFLTSCFQTSMSQSLVSSNPHSNSTNTDGTSSNLEEVKYPVVYEIFIRSFYDRDGNGVGDLNGVSQKVDYLKELGVDAVWFMPFNEAVSYHGYDITDYYNVEKDYGTMEDLENMIQVLHENGIKVIMDLVINHTSDEHPWFKDAVENTTSSPYWDYYIMSLEDHSGQDHWHWKINSKGQKVWYFGLFGYNMPDLNHDSQKVREEVKKIVDFWISKGVDGFRIDAAKHIYGWSWDDGIQESAEYFEWFRDYVLSKKPDAILVGEVFSGNTYDLSLYPIPVFNFALMYSIRNYPEGQDGMIENNWVEESFLFLENHDLHRFFSHLQEHYKKFSESDYEFIKKRAALWYFLIFTLKGSPVIYYGGEIGTRGFKWHGPVYDEPVREPMQWYASGTGEGQTFWTKEVYKNAGITFGNADVDGCIYDDPYDGFSVEEQESDPKSLLNFIRFILNFRKDHDAILNGDQTIFRDWKNLIAFYRESSNEKLLVVLNPDPVWQNSFTFEENMTMILEVDFENFIWNESNVSFSAGESFTVDPMKAYIFKK

SEQ ID NO: 13522 - DNA, 1737 bp, Bacillus halodurans C-125
  CDS (1)..(1737): transl_table=11
ttgaaagctacaatctaccatcgaccaaaaagtgaagacgcttatgcttatgataaaagcacgatgcacattcgtcttcgcacaggtaagaatcacgtgcgaaaagtgaacctgatttatggtgatccttatgactggacgaaaaaccaatgggtaacttctaaaaaagagatgactccaacaggatctgatgcacagcatgatttctggttcgtagaggtgactcctccttatcgacggttgcgttatggtttcgaaattataacaaaaactgaaacgatctactatggagaaagtgggtttctcgatacaccatcaaaagatacgagcgactatttctgctttccatttatgaatccagctgatttgttttcaccacctgagtgggtaaaagacaccgtatggtatcaaatttttcccgaacgctttgcaaatggggatccgagccgtaatcctgaaggtaccttaccgtggggaagcgctgccccaactccaaccaaccatttcggtggagaccttcaagggatcatcgaccatctcgattacttgcaagagttagggattaatggaatctatttaacaccgatctttgaagcgtcttctaatcataaatacgacacgattgattatttaaaagtggaccctcactttggtgataaaacaacatttaaacgtcttgtagatgagtgccacaaacggggaattcgcatcatgcttgatgccgttttcaatcatgcaggcttctactttccaccgtttcaagatgtgctcaaaaaccagcaacactcaaaatatagtgattggtttcatttgcgtgactttcctgttcgtgctgaagagccgcccaactacgatacgtttgccttcacgccatttatgccaaagttcaatacggaaaacgaggaagtgagggaatacttactgaatgtggcaacgtattggatcaaagagtttgacattgacggctggcggttagacgtagctaatgaagtcgatcatgccttctggcgagaatttcgtaaaagagttaaagcattaaagcctgacttatacatccttggtgaagtatggcacaactcccttccttggcttgccggcgatcaatttgatgcggtcatgaattatccactgactaatgcgatcatcgattttgccggaaaacaaaagataggtcaacagcgattcgagcatgtcataacccaattgacgcacatgtacccaattcacgtccaacaagtagcctttaatttgctcggtagtcatgataccccgcgaatattgacgcaaacggacaatgatgtggcacgtgttaaacttcagtttctcttgctcttttcgcagcgcggaacaccgtgtatttattacggtgatgagattggcatgacgggtgggcaagatcctggatgtcgtaaatgcatggtttgggaagaagaagaacaaaatcaagagttactctcctttgtcaaaaggctcattcaacttcgcaagcaagagaaagctttcggaaccgaaggggatttgacgtttgtggagaatgattcttctcttctcatctatcaaaagacatacgaaaatcaacagctcttgtttgtcatcaattcaacagatcaaccagacagtgttcagttacctgttagctggacaaatcgtaacgcaaatgacttgctaacaggtgaaactttctcgctcgcaacagaaattgtcatcccggctaaatccgcgatggttcttaaatag

SEQ ID NO: 13523 - protein, 578 aa, Bacillus halodurans C-125
MKATIYHRPKSEDAYAYDKSTMHIRLRTGKNHVRKVNLIYGDPYDWTKNQWVTSKKEMTPTGSDAQHDFWFVEVTPPYRRLRYGFEIITKTETIYYGESGFLDTPSKDTSDYFCFPFMNPADLFSPPEWVKDTVWYQIFPERFANGDPSRNPEGTLPWGSAAPTPTNHFGGDLQGIIDHLDYLQELGINGIYLTPIFEASSNHKYDTIDYLKVDPHFGDKTTFKRLVDECHKRGIRIMLDAVFNHAGFYFPPFQDVLKNQQHSKYSDWFHLRDFPVRAEEPPNYDTFAFTPFMPKFNTENEEVREYLLNVATYWIKEFDIDGWRLDVANEVDHAFWREFRKRVKALKPDLYILGEVWHNSLPWLAGDQFDAVMNYPLTNAIIDFAGKQKIGQQRFEHVITQLTHMYPIHVQQVAFNLLGSHDTPRILTQTDNDVARVKLQFLLLFSQRGTPCIYYGDEIGMTGGQDPGCRKCMVWEEEEQNQELLSFVKRLIQLRKQEKAFGTEGDLTFVENDSSLLIYQKTYENQQLLFVINSTDQPDSVQLPVSWTNRNANDLLTGETFSLATEIVIPAKSAMVLK

SEQ ID NO: 13524 - DNA, 1704 bp, Streptococcus pyogenes M1 GAS
  CDS (1)..(1704): transl_table=11
atgaatgttgccggaatgctccatattcctgattcgaggtattgctttgccatatctcaaaaggaacttgtcatccgattacgcgtggccaaagaagatagaggtattactgttaatttggtccacgggcctaaatatggttatcatgaattccaagaagaattggaaatgtcagttgcctatacagaccatacgcatgcttattatgaaactactttaacattagacgatgtgaggttggcctacatttttaaaattgaagaagaaggtcaaacctattattttagtgaagatgggttaactactagttacgatttttcaaatgggttttataatttcttccaaatgccttatatcaatgctgttgatgttcatcaagtcattccttggacaaaagacgcggttttttatcaaatctttgttgatcgctttaaccgtggggattgggaaaaaggtgacagttatgtcaacatgggttggttagaaaaaccgactcctaaaagttttgctggtggagatttaaagggaattacagaaaaattagattacctcaaagatttagggattactgtcatctatttaacgccaatttttcaatccattagtaatcacaaatatgatattagtgattactacgctattgatccacaatttggaactaaatatgatttgcaagaattgattgatttagctcacaaaatgggaatcaagattattctagacgctgtctttaaccatgccagcagtgatgccgtggaatttcaggatgtcttgagatacggtaaagagtctaagttttttgattggtttatgactcatgatgaacacccatccatggacctagtaaactatgaaacctttgctggatgtaactatatgcccaaatggaatacctcaaatagagacgtgcaagactatctgattgagattgggcgatactggattaaagaattttgtatcgatggttggcgcctagatgtttctgatgaagtatctcatgatttttggcgacgtttccgtcaggcggttaaagcggaaaaagcagatgccattttaattggggagaactggcatgatgcctatccttatttggcaggggatcagtatgatgggataatgaattatgctttcaccaaagcctgtttggattactttgcttttgaaaccatgacatcaaaacaattggctgagaaattaagcaacattttgatgcgaaacacttggcaagtcaatcgcatgaacttgaatcttttggattctcatgatacgcatcgtttcttcactcaagttaagggttccaaagataaattgttagctgctttagcattgctctttatctttatgggcattccttgcttgtattatgggacagaagtggcaatggaagggggttacgaccctgattcgcgtcgcggttttccttgggatgatgctgagcgggacaaggatttctttagcaaagtaaaagcgattattgctcttcgccaacagccagctcttcaagaaggagctattagcattgattatgacgaagactgcctcattctgaaacgcagcttaggtgagcaaagcatttcacttgttcttaacaatggtgagagtgcttattctattaaggaaggaggacagattttgacaagcaatggggtaactaaaaacaaaaaacaattactccaggatggatatattgtgtttagtaactaa

SEQ ID NO: 13525 - protein, 567 aa, Streptococcus pyogenes M1 GAS
MNVAGMLHIPDSRYCFAISQKELVIRLRVAKEDRGITVNLVHGPKYGYHEFQEELEMSVAYTDHTHAYYETTLTLDDVRLAYIFKIEEEGQTYYFSEDGLTTSYDFSNGFYNFFQMPYINAVDVHQVIPWTKDAVFYQIFVDRFNRGDWEKGDSYVNMGWLEKPTPKSFAGGDLKGITEKLDYLKDLGITVIYLTPIFQSISNHKYDISDYYAIDPQFGTKYDLQELIDLAHKMGIKIILDAVFNHASSDAVEFQDVLRYGKESKFFDWFMTHDEHPSMDLVNYETFAGCNYMPKWNTSNRDVQDYLIEIGRYWIKEFCIDGWRLDVSDEVSHDFWRRFRQAVKAEKADAILIGENWHDAYPYLAGDQYDGIMNYAFTKACLDYFAFETMTSKQLAEKLSNILMRNTWQVNRMNLNLLDSHDTHRFFTQVKGSKDKLLAALALLFIFMGIPCLYYGTEVAMEGGYDPDSRRGFPWDDAERDKDFFSKVKAIIALRQQPALQEGAISIDYDEDCLILKRSLGEQSISLVLNNGESAYSIKEGGQILTSNGVTKNKKQLLQDGYIVFSN

SEQ ID NO: 13526 - DNA, 1614 bp, Streptococcus pyogenes M1 GAS
  CDS (1)..(1614): transl_table=11
atgaacaaccactggtggcataaagctacgatttatcagatttacccaaggtcctttaaagacaccagcggcaatggtattggtgatttaaaaggcattaccagtcaactggactacttgcaaaaacttggcattacagccatttggttatctcctgtttaccaaagtccaatggatgacaatggttatgacatctctgactatgaagcgattgctgatgtttttggagacatggcagatatggatgagctcttagcagcagctaatgagcgaggcattaagattatcatggacttggtggtcaaccatacgtctgatgagcatgcttggtttgttgaagctagagaaaatcccaatagtcctgagcgtgattactatatttggcgtgacgagccaaacaacctcatgtctattttttcaggatctgcttgggaattggatgaggcatcaggacaatattacctgcatttgtttagcaagaaacagcctgatttgaactgggaaaatgctcagctgcgccaaaaaatttacgatatgatgaatttctggattgccaaaggcatcggtggttttcgtatggatgtgattgacctgattgggaaggttcctgacttggagatcacgggtaacgggccgcgcttacacgattacctcaaagaaatgaatcaagcaacctttggcaaccatgacgtgatgacagtcggtgagacttggggagcaacgcctgaaattgctcgccagtattctcgccctgaaaacaaagagttatccatggtcttccaatttgagcatgtgggtcttcaacataaacctgacgctcccaagtgggattatgccaaagaattagacgtgcctgctctgaaagctatttttagcaagtggcagacagaattaaagttaggagaaggctggaattcgcttttttggaataaccatgacttgccacgggtcttatccatttggggcaatgacagcacttaccgagaaaaatcagccaaggctttagctattttactgcatttgatgcgaggaaccccttacatttaccaaggagaagagattggcatgaccaattatccttttaaagacttaaccgaggttaatgatattgagtcccttaactatgctaaggaagctatgggaaatggagtgtcagctgcgcgtgtgatggatagcatccgtaaggtaggacgagacaatgctagaacgccgatgcagtggtctaaggacacacatgctggcttttctgaagcaaaagagacttggttgccggtcaaccccaactaccaagacatcaatgtggccgatgcccttgctgatccagactctattttttacacctaccaaaaattgattgccttgcgtaaggagcaagactggctagttgaagcggattatcacctcttgccaacagctgataaagtgtttgcttatcagcgtcagcttggagaagagacgtatgtgattgttgtcaatgtgtctgatgaggagcaagtctttgccacagacttagcaggtgcacaagtgatcatcgccaatacagatgtggacacggtattagagaccaagcacttacaaccttgggatgccttttgtctcaaactgaaggcctag

SEQ ID NO: 13527 - protein, 537 aa, Streptococcus pyogenes M1 GAS
MNNHWWHKATIYQIYPRSFKDTSGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDYYIWRDEPNNLMSIFSGSAWELDEASGQYYLHLFSKKQPDLNWENAQLRQKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAKELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSEAKETWLPVNPNYQDINVADALADPDSIFYTYQKLIALRKEQDWLVEADYHLLPTADKVFAYQRQLGEETYVIVVNVSDEEQVFATDLAGAQVIIANTDVDTVLETKHLQPWDAFCLKLKA

SEQ ID NO: 13528 - DNA, 1974 bp, Deinococcus radiodurans R1
  CDS (1)..(1974): transl_table=11
ttgaccgcgctgcccttttcccccacactggcttgcaaatccaaaggcaacgcttgccccctccggcacgacctcccagcgcgactttgcgcggcaggccgtgccggagcttcgttttgccccctcatccaaggagttcttatgtaccccaccgccaccctgagtgcccagcacgaccacacccccggttacaccgaacgcctcggtgcgctcctcggcgggcacgtccgcgtgcggctgcggaccaccctgccggtcctgggcgtgcggctcaaagtcgtgcagatcggtgaaatcgagactcttcccgcccgcgaggtgacgggcttgcagggcgaaggccgctggttcgaggccgacctgccgctgcacgaggcccgcgtgcgctacgcctggcacctcgacctgcctggcgaccacctcaacctgacccggctggggctgcaccacgcgcgccggggctttcgctcgtggtttcagtacctcgcgggctatcaggcgcccgagtgggcctggaagtcggtcttttatcagattttccccgaccgctttcgcaacggtgattccacgaacgacgtgcagaccggcgaatacttgtacgaaggccgcccggtggaaaaggtggagtggacgcacccggttgacgcctggggcgatattcacgggcactacggcggcgacctcgcgggcatcacgcaggcggtgccgtatttgcaggcgctcggcgtgaccgggctgtggctcacgccgattttcacctcgccgagcaaccaccgctacgacatcaccgattaccgcgccattgacccccacctcggcggggacgccgcgtgggacgcgctggtgcaggcgacggacgcggcgggcatccgcatcgtccttgacggggtgttcaaccatatgggcaacgaaaacgcgctgtttcaggccgcgctcgctgccgaggacgcccccgagcgggccatgttcacctggcgcgatacgccgggcaagccgccctaccactcctttttcgacgtggcgacgctgcccaaaatcgactacgccaacgagcgggcggtggaggagtttttcagcggcgagcgcagtgtggtccggcactggctgcggcgcggcgcggcgggctggcggctggacgtggcgcacatgctcggcaagggcggcaccgaggaagacaatctggcgctgcaccgcgtgctcaaggcggcggcgcggcaggaaaaggccgacgcctacgtgttcggcgagcgcttctacgaccccgaactcgcgctcgacgggcagggcgaagacggcgcgatgaactaccacggttttggcctcccggtgatgcagtggctggcgggcgcgacctatttcaacgaaccgagccgcctggacggcactgaactcgccgaaattctctgggatgcgtaccacgcgctgccaccgcaggccgcgctgaacatgttcaacctgctcgaatcgcacgacatcgggcgggcgctgtggcggctggggggcgaccgcaccaagtaccgcgccgcactcacgctgctgctcgcctacgcgggcgtgccgtgcctgtactacgggagcgaaatcggcctctcgcagtcgcgcgacggcaacatgccgtggtgccgcgagccgatgccctgggacgaggcgaggtgggacatggagctgctcgcccatgtcaaagctctggtgaaggttcgccgcgagacgcccgtgttgcacaccggggcccttcagttcatccacgccgagccggacgccctcgccttcctgcgcgaagtgaccgggccggacggcgcggcggagcgggtggtcgccctcgccagccgccgggccggggcacatccggtgaccttcaccctcccggcgggcgagtggcaagacgccctgagcggcgagcggctcggcgggggagaggtcacgctggacgcggcgggcgggcagttgctgctcagtttgcctctcagtcgctga

SEQ ID NO: 13529 - protein, 657 aa, Deinococcus radiodurans R1
MTALPFSPTLACKSKGNACPLRHDLPARLCAAGRAGASFCPLIQGVLMYPTATLSAQHDHTPGYTERLGALLGGHVRVRLRTTLPVLGVRLKVVQIGEIETLPAREVTGLQGEGRWFEADLPLHEARVRYAWHLDLPGDHLNLTRLGLHHARRGFRSWFQYLAGYQAPEWAWKSVFYQIFPDRFRNGDSTNDVQTGEYLYEGRPVEKVEWTHPVDAWGDIHGHYGGDLAGITQAVPYLQALGVTGLWLTPIFTSPSNHRYDITDYRAIDPHLGGDAAWDALVQATDAAGIRIVLDGVFNHMGNENALFQAALAAEDAPERAMFTWRDTPGKPPYHSFFDVATLPKIDYANERAVEEFFSGERSVVRHWLRRGAAGWRLDVAHMLGKGGTEEDNLALHRVLKAAARQEKADAYVFGERFYDPELALDGQGEDGAMNYHGFGLPVMQWLAGATYFNEPSRLDGTELAEILWDAYHALPPQAALNMFNLLESHDIGRALWRLGGDRTKYRAALTLLLAYAGVPCLYYGSEIGLSQSRDGNMPWCREPMPWDEARWDMELLAHVKALVKVRRETPVLHTGALQFIHAEPDALAFLREVTGPDGAAERVVALASRRAGAHPVTFTLPAGEWQDALSGERLGGGEVTLDAAGGQLLLSLPLSR

SEQ ID NO: 13530 - DNA, 1497 bp, Deinococcus radiodurans R1
  CDS (1)..(1497): transl_table=11
gtgagccgcccacccgctatcctgcgccccgccatgtccgagcccgtctctgccgttcccctgtctgctcccgtcacccccgagtgggtcgccgacgccgtcttctaccagattttccccgaccgcttcgcccgctcgggccgcgtgaccggcctgcaccttcagccctggggcagcgcgccgaccattcacggctacatgggcggcgacctgtggggcgtggccgagcggctgggcgaccttgccggcctcggcgtgaatgcgctgtatttctgcccggtgtttcagtcggcctccaaccaccgctaccacacccacgactattttcaggtggaccccatgctcggcggcaacgcggcgctgcggcacctgctcgatgaggcgcacgcgcgcggcatccgggtggtgctcgacggggtgttcaaccatgccagccggggcttttttcagttcaacgacctgctcgaacacggtgaggcgagtgcgtaccgcgactggtttcatgtgaccggctggccgctgagcgcctacgacgaggaccgccccgccaactacgcggcgtggtggggcatccgggcgctgcccaagttcaacaccgaccaccccgaggtgcgcgagtttctgctgagcgtggccgaatactggatgcacttcggcatcgacggctggcggctcgacgtgccgaacgagattgacgacgacgccttctggcaggagtttcgccgccgggtcaaggcgattaaccccgacgcctacatcgtgggcgaaatctggggcgacgccggacgctggctggcgggcgaccagttcgacgcggtgatgaactaccacttcacccgcccctgcctgggctttttcggggcgcggacgctcgaccatccgatgaacgaacgcagcggcaccgggcgggtggagccgctggacgccgccgcttttgccgtgcgggtggaagaagtcacccgcatgtaccaccccgccgtcgtgcgcgcgcagctcaatctgctcgactcgcacgacaccgcccgcttcctgacggcggtgggcggcgacgcctcggcgcagcggctcgcgctcgtgtttcagttcagctatgtgggcgcgccctgtctgtactacggcgacgaaatcgggctgcccggcggcgtggaccctgactgccgccgcgcttttccctgggacgagccgcagacctgggaccacgacaccctgaccctcgtgcgcgagttgacggcggcgcggcaccgttcggcggcactgcggcgcggcgactttacggtgctgcacgcgcagggcgagcaggtgtcgttcgctcgcaagcatgacggagaggcggcgtatgtggccttcaactgcgcgctggatgccgccccggttccggtgcccgccacatcgggccgttaccgcgacatgctgacgggcgcggtgcatgacctgaacgaaagctcggtgctgacgctgcctgcccggacggcggcgttgctgctgtgcgaggggtaa

SEQ ID NO: 13531 - protein, 498 aa, Deinococcus radiodurans R1
MSRPPAILRPAMSEPVSAVPLSAPVTPEWVADAVFYQIFPDRFARSGRVTGLHLQPWGSAPTIHGYMGGDLWGVAERLGDLAGLGVNALYFCPVFQSASNHRYHTHDYFQVDPMLGGNAALRHLLDEAHARGIRVVLDGVFNHASRGFFQFNDLLEHGEASAYRDWFHVTGWPLSAYDEDRPANYAAWWGIRALPKFNTDHPEVREFLLSVAEYWMHFGIDGWRLDVPNEIDDDAFWQEFRRRVKAINPDAYIVGEIWGDAGRWLAGDQFDAVMNYHFTRPCLGFFGARTLDHPMNERSGTGRVEPLDAAAFAVRVEEVTRMYHPAVVRAQLNLLDSHDTARFLTAVGGDASAQRLALVFQFSYVGAPCLYYGDEIGLPGGVDPDCRRAFPWDEPQTWDHDTLTLVRELTAARHRSAALRRGDFTVLHAQGEQVSFARKHDGEAAYVAFNCALDAAPVPVPATSGRYRDMLTGAVHDLNESSVLTLPARTAALLLCEG

SEQ ID NO: 13532 - DNA, 1695 bp, Deinococcus radiodurans R1
  CDS (1)..(1695): transl_table=11
ttgaatcccgtgtcttctatttcatataaaaaatattttccggcgtcgcaattctcatctgaaacgattcagtccaccctaaacttgagcatgacttccctgcaaggcgagctgaaatggtggcaaagcggcatcatttaccagatttacccacgttcctatcaggacagcaacggcgacggcgtgggcgacctgcccggtatcacggcgcggctgccgtatgtcgcgagtctgggggtgcaggcggtgtggctctcccccattttcaaaagcccgatgcgcgatttcggatacgacgtggcggattactgcgacattgacccggtgttcggcacgctggagcagttcgatgcgttggtggccgaggcgcaccggctggggctgaaggtcatgctcgactacgtgcccaaccacaccagcagcgaccacgcctggttccaagaggcgctcacgggcaaggccagcgccaaacgcgactggtacgtatggcgcgaccctgccccggacggcgggctgccgaacaactggaaatccttcttcggcggcccggcatggacgctggacgaggcgagcgggcagtattacctgcaccagtttttgccctcacagccggacctcaactggcgcaatcccgacgtgcgggcggcgatgtttgatgtgctgcggttctggatgcgccggggcgtggacggcttccgggtggacgtcatctggctgctggccgaggacgagcggtttctggacgagccggaaaaccccgacgccgaccgcgaagtcgttggcgggcagatcgaacacagtacgctgctgcacatctacacgcaggaccagcccgagacgcacgactatgtgcgcgagatgcgccgggtgatcgacgagttcgacgaccggatgatggtcggtgaaatctacctgccgctcgacaaactgctgccctactccggcacgcccgaggcgccgatggtgcatctgccgttcaactttcacctgattctgctgccgtgggacgcgcaaaccatccggcagttcgccgacgagtacgacgcagcgagcaacgcggcgggggcgtggcccaattgggtgcttggcaaccacgaccagcaccgcttcaagacgcgggtgggcgcggcgcagtaccgggtcgcgcaaacgctgctgctcacgctgcgcggcacgccgacggtgtactacggcgacgagatcggtatggaaaatgtgcccgttcccccggagaagatggtggacccctccggcctgcaacagcccgacagcccggacgccgggcgcgaccccgagcgcaccccgatgcagtgggaggcggcgccgggcgcaggatttacggcggcaggcaccgagccctggctgccgctcaccgacaacttcgcgcaggtgaacgtgcaagttcaggagcaggactcgcagagcgacctgaactacttccgcgccctgacccgcctgcgccaggagcagccggccctggtgggcggcagctaccgcagcctggacagcgggcacgccgacgtatttgccttcgagcgtgaactgaacggcgagcggttgacggtgtggctgaatttccgcggtgaggaacgcgcggtggccgccacggggcaaacgcttctgagcagccgtggcgatcagcccgccgcccaatcgccgctgcgcgggcacgaggcgcgggtggtgctgggttga

SEQ ID NO: 13533 - protein, 564 aa, Deinococcus radiodurans R1
MNPVSSISYKKYFPASQFSSETIQSTLNLSMTSLQGELKWWQSGIIYQIYPRSYQDSNGDGVGDLPGITARLPYVASLGVQAVWLSPIFKSPMRDFGYDVADYCDIDPVFGTLEQFDALVAEAHRLGLKVMLDYVPNHTSSDHAWFQEALTGKASAKRDWYVWRDPAPDGGLPNNWKSFFGGPAWTLDEASGQYYLHQFLPSQPDLNWRNPDVRAAMFDVLRFWMRRGVDGFRVDVIWLLAEDERFLDEPENPDADREVVGGQIEHSTLLHIYTQDQPETHDYVREMRRVIDEFDDRMMVGEIYLPLDKLLPYSGTPEAPMVHLPFNFHLILLPWDAQTIRQFADEYDAASNAAGAWPNWVLGNHDQHRFKTRVGAAQYRVAQTLLLTLRGTPTVYYGDEIGMENVPVPPEKMVDPSGLQQPDSPDAGRDPERTPMQWEAAPGAGFTAAGTEPWLPLTDNFAQVNVQVQEQDSQSDLNYFRALTRLRQEQPALVGGSYRSLDSGHADVFAFERELNGERLTVWLNFRGEERAVAATGQTLLSSRGDQPAAQSPLRGHEARVVLG

SEQ ID NO: 13534 - DNA, 1452 bp, Deinococcus radiodurans R1
  CDS (1)..(1452): transl_table=11
atgcaccacctcatcctcccggcgctgctgctcgcctccgccgccagcgcccaggctgcgcctacatcaaccggccccagctttgaaggccagatcatctatcaggtcatgcccgaccgtttcttcgacggtgacccttccaacaatgccggggtggaccgtgccaacctccgcgcctggcacggcggcgacctcgcggggctgacgcaaaagctgccttacatccagaaacttggggcgacggccatctggatgacgccgatctaccgccagcagaccgccaaatccttcgacaccgccgcttatcacggctactggcccgccgatttccggcaggtggacccgcacttcggctcgatggcgaccttcgatacgttcatgaaggcagcgaaaggcgcggggatgaaggtggtccttgaccaggtcatcaatcactacggctacgaggccccagcggtgaaggccaatccgggctggttcaacggcaaggcgcagtgcgacgcgaccaagaacaaggacgtggactgtcccctcgccggcctacccgacctgcgccagagcgtgcccgccgtgcgccagcagttgttcgggaacggcgacttctggcgggcgcgaggggtggacggcttccgttacgacgcgatcaagcatgtggagcggcctttcctgctcgacctgctgaaaaaagaccgcgccgccggcacctggacgctcggcgagtggtacgacgccgacgcgggcacggtggccgagtggcaaaagcaggggtttgacagcctgtttctcttcagcttgcaagcggcgatgcgcggcagcgtgatgggcgcgtccagcctggtcaacgtgcgcgaggtgctgcgccgctcggacgaacttgcccggcccggcgaggtggcactgtttctcgacaaccacgacgtgccgcgtttctcgcagggcagctttttcgaggacgaagggcaggcccgcaccaaatacggcctgcgggcgctgctcacgctgcggggcgtgccggtcctctaccagggcaccgaaattgccatgcgcggcggagccgaccccgacaaccggcgcgacatgcgctttgaaagccagtggacgcccgccgaaaaagccgtatacaacgtggcccgcgacgccattgccgtccgcaaggcgagcccgcccctcagtcggggcacccagacgctgcttcccgtccccgaccggcaggccgacgacctgctgctgctgacccgcgagcagggcggacagcgggtgctggtggcctggcacaacgggttgaaacgccagagctactcgctgaagctcagtaccctgggaatcaaggcgaacgctcaggatgtgaccaagacgctgtttgccgggcaggacgccaaagtgagcgtgaagggcgggtatttgcacctgagcctaccgcctaaggacgcggcggcgttcgttttgcggtga

SEQ ID NO: 13535 - protein, 483 aa, Deinococcus radiodurans R1
MHHLILPALLLASAASAQAAPTSTGPSFEGQIIYQVMPDRFFDGDPSNNAGVDRANLRAWHGGDLAGLTQKLPYIQKLGATAIWMTPIYRQQTAKSFDTAAYHGYWPADFRQVDPHFGSMATFDTFMKAAKGAGMKVVLDQVINHYGYEAPAVKANPGWFNGKAQCDATKNKDVDCPLAGLPDLRQSVPAVRQQLFGNGDFWRARGVDGFRYDAIKHVERPFLLDLLKKDRAAGTWTLGEWYDADAGTVAEWQKQGFDSLFLFSLQAAMRGSVMGASSLVNVREVLRRSDELARPGEVALFLDNHDVPRFSQGSFFEDEGQARTKYGLRALLTLRGVPVLYQGTEIAMRGGADPDNRRDMRFESQWTPAEKAVYNVARDAIAVRKASPPLSRGTQTLLPVPDRQADDLLLLTREQGGQRVLVAWHNGLKRQSYSLKLSTLGIKANAQDVTKTLFAGQDAKVSVKGGYLHLSLPPKDAAAFVLR

SEQ ID NO: 13536 - DNA, 1659 bp, Deinococcus radiodurans R1
  CDS (1)..(1659): transl_table=11
atgacccaggcacacccggagtggtacaagagcgctgtcttctacgaactgtccgtgcggacctttcaggacggcaacggcgacggcaagggcgattttcccggcctgacctcgcggctggactacctgaaaaacctcggcgtggactgcctgtggttgctgccctggtttcccagcccactgcgcgacgacgggtacgacgtggccgactaccgggggattcaccctgacctcggcacgctcgacgacttcaaggtctttctgcgcgaagcccacgcccggggcctgcgggtcatcggcgacctggtgaccaaccacacgtccagcgaccacccctggtttcaggcggcgcggcgcggcccgaccctgcccgacggctcgcccaacgagtaccacgactactacgtctggagcgacgagggcaaggaatacgccgacacccgcatcatcttcaccgacaccgaggtcagcaactggacgctcgacgagcaggcaggcaagtattactggcaccgctttttcgccagccagccggacctgaactacgacaacccgaaagtggtggaagaacttcacggcgccgcccgcttctggctcgacctcggcctcgacgggttccgggtggacgccgtgccctacctcatcgagcgcgagggcacgagctgcgagaatctgcccgaaacacacgagattctcaagggcttccgggcgatggtggaccgcgagtatccggggcggctgctgcttgccgaggcgaaccagtggcccgaggaagtcgtcgagtacttcggcaccgaagccgagcccgagttccacatgtgcttcaacttcccggtgatgccccggctgtacatgagcctgaaaagggaggacacctccagcatccgcgagatcatgggccgcctgccgaaaatcccgagtttcggccagtggtgcaccttcctgcgcaaccacgacgaactgacgctggaaatggtcaccgacgacgagcgcgccttcatgtatgccgcctacgcgcccgacgcccgcatgaaaatcaacgtgggcatccgccgtcgcctcgcgccgctgctcgacaacgaccggcgccgcatcgagctgctgaacactgtgctcctcgccctgcccggcagccccatcctgtactacggcgacgaaatcggcatgggcgacgacctcggcctgcccgaccgcaacggcgtgcgcaccccgatgcagtggaacgcgggcaccagcggcggtttttccactgcgcagccctccgactgctttttcccgccgattcaggacccggtgtacggcttcgggcgcgtcaacgtgcagagccagctccaagaccccagcagcctgctgaagtggaccgcccggcaactcgaactgcgccgcgcccaccccgcctttgcgcacggcgacctcaccttcatcgaaaccggcaaccccgccatcctcgcctttacccgccagtacgacggcgaaacgctgctcatcgtcagcaacttcgcgggcaacgcccaggccgggctgctcgatctcgcgcccttcgtgggccgcgccccggtcacactttccggggccagcccgctgccggtggtcactggaaacggccagtacccggtggtgatgggcaagtacgactattactggctgcggttgaattga

SEQ ID NO: 13537 - protein, 552 aa, Deinococcus radiodurans R1
MTQAHPEWYKSAVFYELSVRTFQDGNGDGKGDFPGLTSRLDYLKNLGVDCLWLLPWFPSPLRDDGYDVADYRGIHPDLGTLDDFKVFLREAHARGLRVIGDLVTNHTSSDHPWFQAARRGPTLPDGSPNEYHDYYVWSDEGKEYADTRIIFTDTEVSNWTLDEQAGKYYWHRFFASQPDLNYDNPKVVEELHGAARFWLDLGLDGFRVDAVPYLIEREGTSCENLPETHEILKGFRAMVDREYPGRLLLAEANQWPEEVVEYFGTEAEPEFHMCFNFPVMPRLYMSLKREDTSSIREIMGRLPKIPSFGQWCTFLRNHDELTLEMVTDDERAFMYAAYAPDARMKINVGIRRRLAPLLDNDRRRIELLNTVLLALPGSPILYYGDEIGMGDDLGLPDRNGVRTPMQWNAGTSGGFSTAQPSDCFFPPIQDPVYGFGRVNVQSQLQDPSSLLKWTARQLELRRAHPAFAHGDLTFIETGNPAILAFTRQYDGETLLIVSNFAGNAQAGLLDLAPFVGRAPVTLSGASPLPVVTGNGQYPVVMGKYDYYWLRLN

SEQ ID NO: 13538 - DNA, 1824 bp, Mycoplasma pulmonis UAB CTIP
  CDS (1)..(1824): transl_table=4
atgtataaaaaaatatttatctttttaacaccacttttgttacttactcaaacaataactatttcttgtattaataaaaatgaaaaaaattgaggtgacaaaaattttaaaaaaaatattgaaaaagaaaatttaaataatttaacttatgttgataaatcactagaggcaaaaaatgaagcaccttttattgaaaaacaaaaatcaaatgtaatttatcaactaactgtttattcttttgcagatggaaataatgatggaattggtgattttataggacttaaaaataatattgactattttgtaaaacttggaatcaatacactctatctttctcccattcatcctgctagttcatatcatggttatgatgtaattgattatcttgatgttgcccctgaacttggtggtatggaggcttttaaagaatttttaaaagtatctcatgcaaatggtattaaagttgtaatggatttagtgtttaatcactcttcttttgagcatccatgatttcaagaagcactaaatggaaacactaagtatcaaaattattattattttttagatgaaaatatttcaaaggatacacaaggtcttggaattgatagtcaagatctaagaaatcaatttaaaaatcttaaaaataaacaagcaagcaataaaaaatatgttgcacatttttgaccaggaatgcctgatttaaatttaaataattctgatttaattaaagagttaaaagctattcaaagatattgatcaaaaattggagttgatggttttcgttatgatgctttttatcatttttttgatagtaataatcaacataaaccaagagaaaatggtaatcaaaaaattaattcaatttttcaaaaattaagatcaactaataaagaagcaataaatgataatactcaaagatcatctaaagaaccatttttatttggtgagtgatgaaaatctccttttgaagcaaatgactatcttgatattaaaaatcaaggattagatagtgtcattgatggacgtaattgaaaagataatattaatgtttcaattaatgcaaaagaacaaagagcattattggaatttttaaacaaaaataattcaacttgaatgccttttttagacaaccatgatgttgaaagatgaattaacaaagtaagaagacaaattaataaaaatgtagcatcagttgataagcttagtgaattagaaatttcactaatgaaatatgctcttgtatctttgctttcaagagctggaagcccaatcttatataacggaaatgagcttaatttacatggaggacccaaacaagctggagatcattttgtaagagaggcttttccttgaaaagatagaacaaaacaagttgatttttatgaattaagatcaggaaaagaaaatagtagaatttttttgaatttatctaaaaatgaagaaaaaatagaagatgccataaaaaatgaaaattcaacttttaatcttgttaaacaactaaatgaaattagaaataaatatcaatatgttgtttctcaagatcccaatacaattgctgatttagaagagattttgagtgaaagtgaaattagaaaatatcaaaacaacttaaatttaagaaaaaacaatcaaggagaatatttactttatatttttggatgaggaaacaatgatatttcttttaaaatcaaaaacaattttaaaattgatcaaatcttattgcaaaaaaatataaatataaatactcaaacaagagaaatttcttctagtggaataggtacttatgctgttttaaaaattaataaaaaaagtgaggcaatttaa

SEQ ID NO: 13539 - protein, 607 aa, Mycoplasma pulmonis UAB CTIP
MYKKIFIFLTPLLLLTQTITISCINKNEKNWGDKNFKKNIEKENLNNLTYVDKSLEAKNEAPFIEKQKSNVIYQLTVYSFADGNNDGIGDFIGLKNNIDYFVKLGINTLYLSPIHPASSYHGYDVIDYLDVAPELGGMEAFKEFLKVSHANGIKVVMDLVFNHSSFEHPWFQEALNGNTKYQNYYYFLDENISKDTQGLGIDSQDLRNQFKNLKNKQASNKKYVAHFWPGMPDLNLNNSDLIKELKAIQRYWSKIGVDGFRYDAFYHFFDSNNQHKPRENGNQKINSIFQKLRSTNKEAINDNTQRSSKEPFLFGEWWKSPFEANDYLDIKNQGLDSVIDGRNWKDNINVSINAKEQRALLEFLNKNNSTWMPFLDNHDVERWINKVRRQINKNVASVDKLSELEISLMKYALVSLLSRAGSPILYNGNELNLHGGPKQAGDHFVREAFPWKDRTKQVDFYELRSGKENSRIFLNLSKNEEKIEDAIKNENSTFNLVKQLNEIRNKYQYVVSQDPNTIADLEEILSESEIRKYQNNLNLRKNNQGEYLLYIFGWGNNDISFKIKNNFKIDQILLQKNININTQTREISSSGIGTYAVLKINKKSEAI

SEQ ID NO: 13540 - DNA, 1806 bp, Mycobacterium tuberculosis CDC1551
  CDS (1)..(1806): transl_table=11
atgaacgaggcagaacacagcgtcgagcaccctcccgtgcagggcagtcacgtcgaaggcggtgtggtcgagcatccggatgccaaggacttcggcagcgccgccgccctgcccgccgatccgacctggtttaagcacgccgtcttctacgaggtgctggtccgggcgttcttcgacgccagcgcggacggttccggcgatctgcgtggactcatcgatcgcctcgactacctgcagtggcttggcatcgactgcatctggttgccgccgttctacgactcgccgctgcgcgacggcggttacgacattcgcgacttctacaaggtgctgcccgaattcggcaccgtcgacgatttcgtcgccctggtcgacgccgctcaccggcgaggtatccgcatcatcaccgacctggtgatgaatcacacctcggagtcgcacccctggtttcaggagtcccgccgcgacccagacggaccgtacggtgactattacgtgtggagcgacaccagcgagcgctacaccgacgcccggatcatcttcgtcgacaccgaagagtcgaactggtcattcgatcctgtccgccgacagttctactggcaccgattcttctcccaccaaccggatctgaactacgacaaccccgccgtgcaagaggcgatgatcgacgtcatccgcttttggctcggcttgggcatcgacgggtttcggttggacgcggtgccctatctctttgaacgtgagggcaccaactgcgagaacctgccggaaacacacgcttttctcaagcgagtccgcaaggtggtggacgacgaattccccggccgggtgctgctagccgaagccaatcagtggccgggcgatgtcgtcgaatatttcggtgatcccaacaccggtggcgacgagtgccacatggcctttcacttcccgctgatgccgcgcatcttcatggccgtgcgccgggagtcccgttttccgatctcggagatcatcgcccagaccccaccaatccctgacatggcgcaatgggggatatttctgcgcaaccacgacgagctgacgttagaaatggtcaccgacgaagagcgcgactacatgtacgccgagtacgccaaggatccacggatgaaggcgaatgtcggaatccgtcgtcggcttgcgccgctgctcgacaacgaccgcaaccagatcgagctgttcaccgcgctgctgctgtcgctgcccggctcgccggtcctctactacggcgacgagatcgggatgggcgacgtgatctggttgggtgatcgcgacggcgtgcgcatcccgatgcagtggacaccggaccgcaacgcgggtttctccaccgccaacccgggtcggctgtacctgccgcccagccaggacccggtttacgggtatcaggccgtcaacgtcgaggcgcaacgcgacacctcgacgtcgctgctcaacttcactcgcaccatgctggccgtgcgtcgccgacaccccgcgtttgcggtcggcgcattccaggaattgggcgggtccaacccgtcggtgctggcctacgtgcgtcaggtggccggcgatgacggcgacaccgtgctctgtgtcaacaacctgtcgcgattcccgcagcccatcgaattggacttgcagcaatggaccaactacacgccggtcgagctgaccgggcacgtggagtttccacgcatcggccaggtgccctatctgctgacgctgccaggacacgggttctactggttccagttgaccacacatgaggtgggggcacctcccacttgcgggggagagcggcgcctatga

SEQ ID NO: 13541 - protein, 601 aa, Mycobacterium tuberculosis CDC1551
MNEAEHSVEHPPVQGSHVEGGVVEHPDAKDFGSAAALPADPTWFKHAVFYEVLVRAFFDASADGSGDLRGLIDRLDYLQWLGIDCIWLPPFYDSPLRDGGYDIRDFYKVLPEFGTVDDFVALVDAAHRRGIRIITDLVMNHTSESHPWFQESRRDPDGPYGDYYVWSDTSERYTDARIIFVDTEESNWSFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPGDVVEYFGDPNTGGDECHMAFHFPLMPRIFMAVRRESRFPISEIIAQTPPIPDMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRIPMQWTPDRNAGFSTANPGRLYLPPSQDPVYGYQAVNVEAQRDTSTSLLNFTRTMLAVRRRHPAFAVGAFQELGGSNPSVLAYVRQVAGDDGDTVLCVNNLSRFPQPIELDLQQWTNYTPVELTGHVEFPRIGQVPYLLTLPGHGFYWFQLTTHEVGAPPTCGGERRL

SEQ ID NO: 13542 - DNA, 1641 bp, Mycobacterium tuberculosis CDC1551
  CDS (1)..(1641): transl_table=11
atggaccaacaccagcgaccggatccaatgggccccggctctcctcgcgccagcgctcgtcgaccggagccagatccgatgggcgagccgtggtggtcgcgagccgtgttctaccaggtctatccccgatcgttcgccgacagcaacggcgacggggtgggcgacctggacgggttggcgagccggcttgaccacctgcaacagctcggtgtcgacgcgatctggatcaacccggtcaccgtctcgccgatggcagaccacggatacgacgtcgccgatccccgcgacatcgacccactcttcggcgggatgccggcgttcgaacggttggtcgctgcggcacaccggcagggcatcaaagtcaccacggacgtggtgcccaaccacaccagttcggcgcacccatggtttcaggccgcgctggctgacctcccgggtagcccggcgcgggatcgctatttctttcgcgacgggcggggccccgacgggtcgctgccgccgaacaactgggagtcggtgttcggcgggccggcctggacccgagtgcgcgaaccggacggcaacccgggccagtggtacctgcaccttttcgacaccgaacagccggacctgaactgggacaacccggaaatccttgacgacttcgagaaaacactgcgcttctggctggaccgcggcgtggatggcttccgcatcgacgtggcgcacggcatggccaagcccccgggcctgccggactcaccggacctgggcatcgaggtgctgcaccaccgcgatgacgacccgcgcttcaaccacccgaatgtgcacgcgattcaccgcgacatccgcacggtgatcgacgagtaccccggagcggtaaccgtcggcgaggtgtgggtacacgacaacgcccgctgggcggagtatctgcggcccgacgaactgcatctcggcttcaatttccggctggcgcgaaccgagttcgacgccgccgagatccgcgacgcggtggcgaactccctggccgccgcggcgctgcagaacgcgaccccaacctggacgctggccaatcacgatgtgggacgggaggttagccgctacggcggcggcgagatcgggctgcgccgggccaaggcgatggcggtggtgatgctcgccctgccgggcgtggtcttcctctacaacggccaggaactgggtttgcccgacgtggacctgcccgacgaggtgctgcaggatccgacgtgggaacgctcgggacgcaccgaacgcggtcgcgatggctgccgggtgccgattccctggtcgggcaacattcccccgttcgggttctcgacgtgtccagacacctggttgccgatgccgccggaatgggcggcgctgaccgccgaaaaacaacgcgctgatgccggctcgaccttgtcgttttttcgacttgcactcagattacgtagggaacgaaatgaattcgacggcgacgtcgactggctggccgcgcccgacgatgcgctgatattccggcgtcacggcgggggtttggtgtgcgcgctcaacgccgctgagcgtccgctggcgctgccggcaggtgaacccatcctggccagcgcaccgttgaccgacgccacgttgccacccaatgccgcggcctggctggtgtag

SEQ ID NO: 13543 - protein, 546 aa, Mycobacterium tuberculosis CDC1551
MDQHQRPDPMGPGSPRASARRPEPDPMGEPWWSRAVFYQVYPRSFADSNGDGVGDLDGLASRLDHLQQLGVDAIWINPVTVSPMADHGYDVADPRDIDPLFGGMPAFERLVAAAHRQGIKVTTDVVPNHTSSAHPWFQAALADLPGSPARDRYFFRDGRGPDGSLPPNNWESVFGGPAWTRVREPDGNPGQWYLHLFDTEQPDLNWDNPEILDDFEKTLRFWLDRGVDGFRIDVAHGMAKPPGLPDSPDLGIEVLHHRDDDPRFNHPNVHAIHRDIRTVIDEYPGAVTVGEVWVHDNARWAEYLRPDELHLGFNFRLARTEFDAAEIRDAVANSLAAAALQNATPTWTLANHDVGREVSRYGGGEIGLRRAKAMAVVMLALPGVVFLYNGQELGLPDVDLPDEVLQDPTWERSGRTERGRDGCRVPIPWSGNIPPFGFSTCPDTWLPMPPEWAALTAEKQRADAGSTLSFFRLALRLRRERNEFDGDVDWLAAPDDALIFRRHGGGLVCALNAAERPLALPAGEPILASAPLTDATLPPNAAAWLV

SEQ ID NO: 13544 - DNA, 1356 bp, Clostridium acetobutylicum ATCC 824
  CDS (1)..(1356): transl_table=11
atgccttggtttaaaaaagcaattttttatcacatctatcctcttggtttatgcggagcacctttaagtaatgacttcacttctaaaccaataccaagacttaaggagatagaaaactggataccttatttaaaatcattaggaataactgctttatatcttggacctgtttttgaatccacatctcatggttatgatacagcagattactatacagtagatagaagactcgggacaaatgacactttaaaaaaacttataaataagcttcataaaaatggcatcaaggtagttttagatggtgtattcaatcatgttggaaggaacttcccccaatttatggatttgattataaataagcaaacttccagctttgctacttggttttctggtgttgattttaacagtaaaagtccttataatgatgatttttcctacgatacctggaatggttgttatgatttagtcaaactaaactttaacaataatgaggtgaaaagttttattttaaatgcaataaacttttggataagtgaattcaagatagatggtatccgccttgatgctgctgactgcatagatataaactttctaagagaaatatccaacttctcaaaaagcatatcagatgatttcttccttttaggggaaattatatttggtgattatacacgctttgcaagtaaaaatatattggactctgttaccaactacgagtgttacaagggactctattcaagtcataattcattaaattactttgagatagcttactctttaaatagacaatttggcgatggcggtatatataaaaatattccattatacaattttgttgataatcatgatgttaaccgtattgccagcactttaattgatgcagctaatatttatcctatatatactattttgtttacaatacctggtatcccatcaatttattacggaagtgattttggtataactggtgtaaaacaaaataactctgataagtatttaagacctagactaaaaattaatgaattaaaaaactctaaagaaaacaaacctttgaataattttataaaaaagctttgccatattcgaataaattctgaagcattaacagaaggtttatacaaacaacttttcatttcaaataaactatttgcttttttaagatataccgatagtgaaaaaataatagtagctttaaattgttctaaagaatgttctcaaatagagttctcaaatgatatgaatgctacttctttatttgatcttatagagaaaaaaagcttaaagctagaacctaatggaactataagtataaccttacaggaaaaccaagcaagaatatttaaagtaagtttctaa

SEQ ID NO: 13545 - protein, 451 aa, Clostridium acetobutylicum ATCC 824
MPWFKKAIFYHIYPLGLCGAPLSNDFTSKPIPRLKEIENWIPYLKSLGITALYLGPVFESTSHGYDTADYYTVDRRLGTNDTLKKLINKLHKNGIKVVLDGVFNHVGRNFPQFMDLIINKQTSSFATWFSGVDFNSKSPYNDDFSYDTWNGCYDLVKLNFNNNEVKSFILNAINFWISEFKIDGIRLDAADCIDINFLREISNFSKSISDDFFLLGEIIFGDYTRFASKNILDSVTNYECYKGLYSSHNSLNYFEIAYSLNRQFGDGGIYKNIPLYNFVDNHDVNRIASTLIDAANIYPIYTILFTIPGIPSIYYGSDFGITGVKQNNSDKYLRPRLKINELKNSKENKPLNNFIKKLCHIRINSEALTEGLYKQLFISNKLFAFLRYTDSEKIIVALNCSKECSQIEFSNDMNATSLFDLIEKKSLKLEPNGTISITLQENQARIFKVSF

SEQ ID NO: 13546 - DNA, 1785 bp, Agrobacterium tumefaciens str. C58
  CDS (1)..(1785): transl_table=11
ttgtcaccatcatcgtgccgcttggcgtcttcttcgcccttcaacgttatctcgtgcgtggcctgctcgcgggctccgtcaagggaggctgatcattccatgaacgcccataccagacaggacacttccatgaccgcttcggtgacttccgctttgacgcctaacaaggactggtggcgtggtgcggtgatctatcagatctacccgcgctcctatcaggactccaatggcgacggcatcggcgatctcaagggcattaccgaccgtctgcatcacatcgccggtctcggtgccgatgcgatctggatttcgccctttttcacctcgccgatgaaggatttcggctacgacgtctcgaactatgtcgatgtcgatccgatgttcggcacgcttgccgatttcgacgggctgattgccgaagcccaccggcttggcatccgcgtgatgatcgacctcgttctgtcgcacacgtctgaccagcatccgtggttcgtggaaagccgcgccagccgcaacaatccgaaatcggactggtatgtctggtcggaagcgaagcccgatggcacaccgcctaacaactggctgtcgatcttcggcggttccggctggcagtgggatcccacccgcatgcaatattacatgcacaacttcctgacctcgcaaccggacctcaacctgcataaccctgaagtgcaggaggaactgcttaatatcacccgcttctggctgaagcgcggcgtcgatggtttccgcctcgacactatcaacttctatttccatgatctggaattacgagacaacccggcgctggcaccggagcgccgcaatgcctcgaccgcgcctgcagtcaatccctacaatttccaggaacatctctacgataagaaccgcccggaaaacatcgccttcctgaagcgcttccgcgcggtgctggacgaattccccgatatcgccgccgttggcgaagtgggcgacagccagcgcggtctcgaaatcgtcggtgaatacacctccggcgatgacaagatgcagatgtgctatgccttcgaattcctcgcacccgatgcgctcaccccccagcgcgttgccgatgtgcaggcggattttgcgcgcgcagcaccagagggctgggcctgctgggccttctccaaccatgatgtcgtgcgccatgtcagccgctggggcgagcatgtcgaggacaaggatgccttcgcgaagctgctgtcggcactgctgatgacgcagcgaggctccgtctgcatctatgagggcgaggaactgggcctcactgaagccgatattgctttcgaggacttacaggacccctatggcatccagttctggccggaattcaagggtcgcgatggttgccgcacgccgatggtgtgggatgcgggccatgcgcaggccggcttttcgacttcggacaagatctggctgcccattccggccgagcacaagcagcgcgccgtcagcgcccagcagggcaacgaggcgtcggtgctggagcattaccgccgcttcctcgccttccgcaaacagcacccggctttcgccaagggcggcatcgaattccagccgcttgagggagacgtgctgagctacacccgcaagctgggcaacgaaaccattctgtgccttttcaatctgtccgcaacgccggcaaatgccacgctgccgaaagggaactgggaggttctcgaaggccatggctttgcaagcggccttgaaggcacaagcgtagaacttccggcatggggcgctttcttcgcccgttacgcctga

SEQ ID NO: 13547 - protein, 594 aa, Agrobacterium tumefaciens str. C58
MSPSSCRLASSSPFNVISCVACSRAPSREADHSMNAHTRQDTSMTASVTSALTPNKDWWRGAVIYQIYPRSYQDSNGDGIGDLKGITDRLHHIAGLGADAIWISPFFTSPMKDFGYDVSNYVDVDPMFGTLADFDGLIAEAHRLGIRVMIDLVLSHTSDQHPWFVESRASRNNPKSDWYVWSEAKPDGTPPNNWLSIFGGSGWQWDPTRMQYYMHNFLTSQPDLNLHNPEVQEELLNITRFWLKRGVDGFRLDTINFYFHDLELRDNPALAPERRNASTAPAVNPYNFQEHLYDKNRPENIAFLKRFRAVLDEFPDIAAVGEVGDSQRGLEIVGEYTSGDDKMQMCYAFEFLAPDALTPQRVADVQADFARAAPEGWACWAFSNHDVVRHVSRWGEHVEDKDAFAKLLSALLMTQRGSVCIYEGEELGLTEADIAFEDLQDPYGIQFWPEFKGRDGCRTPMVWDAGHAQAGFSTSDKIWLPIPAEHKQRAVSAQQGNEASVLEHYRRFLAFRKQHPAFAKGGIEFQPLEGDVLSYTRKLGNETILCLFNLSATPANATLPKGNWEVLEGHGFASGLEGTSVELPAWGAFFARYA

SEQ ID NO: 13548 - DNA, 1608 bp, Streptococcus pneumoniae R6
  CDS (1)..(1608): transl_table=11
atgcaagaaaaatggtggcataatgccgtagtctatcaagtctatccaaagagttttatggatagtaatgaagatggagttggtgatttgccaggaattaccagtaagttggactatctagccaagctaggaatcacagcaatttggctttctcccgtttatgacagccctatggatgataatggctatgatattgctgattatcaagcgattgcggctatttttggaaccatggaggacatggatcagctgattgcagaagctaagaagcgtgatatccgtatcatcatggacttggtggtcaatcatacctcggatgagcatgcctggtttgtagaggcctgtgaaaatcctaatagccctgagcgagactactatatctggcgggatgagcctaacgatttagattctatttttagtggatctgcttgggaatacgatgaaaaatctggtcaatactatctccactttttcagcaagaaacagccggatctcaattgggaaaatgaaaaacttcgccagaaaatttatgagatgatggacttctggattgataaaggtattggtggtttccgtatggatgttattgacatgattggcaaaattcctgacgagaaggtagtcaataatggtcctatgctccatccctatctcaaggaaatgaatcaggcgacctttggagataaggatctcttgacagtaggggagacttggggagcaacgccagagattgccaagctctactctgatccaaaggggcaagaattgtctatggtcttccagtttgaacatatcggtcttcagtatcaggaaggtcagcctaaatggcactatcaaaaagagctgaatatcgctaagttaaaagaaatcttcaacaaatggcagacagagttaggagttgaggacggttggaattccctcttctggaacaatcatgacctccctcgtattgtctcaatctggggaaatgaccaagaataccgcgaaaaatctgccaaagcctttgcaatcttgcttcatcttatgagaggaactccttatatctaccaaggtgaggagattgggatgaccaactatccgtttgaaacactggatcaagtagaagatattgaatctctcaactatgcgcgtgaggctcttgaaaaaggtgttccgattgaagaaatcatggacagtatccgtgttattggacgtgacaatgcccgtacccctatgcaatgggacgagagcaaaaacgctggtttctcaacaggtcaaccttggttggcggttaatccaaattacgagatgatcaacgtccaagaagcgctggcaaatccagattctattttctatacctatcagaaactggtccaaattcgcaaggagaatagctggctaattcgagctgactttgaattgcttgatacggctgataaggtctttgcttatatacgtaaggatggcgaccgtcgcttcctagttgtggctaacttgtccaatgaagagcaagacttgacagtagaaggaaacgtcaaatctgtcttgattgaaaacaccctagctcaagaagtctttgaaaaacaaatcttagttccatgggatgctttctgtgtggaattactataa

SEQ ID NO: 13549 - protein, 535 aa, Streptococcus pneumoniae R6
MQEKWWHNAVVYQVYPKSFMDSNEDGVGDLPGITSKLDYLAKLGITAIWLSPVYDSPMDDNGYDIADYQAIAAIFGTMEDMDQLIAEAKKRDIRIIMDLVVNHTSDEHAWFVEACENPNSPERDYYIWRDEPNDLDSIFSGSAWEYDEKSGQYYLHFFSKKQPDLNWENEKLRQKIYEMMDFWIDKGIGGFRMDVIDMIGKIPDEKVVNNGPMLHPYLKEMNQATFGDKDLLTVGETWGATPEIAKLYSDPKGQELSMVFQFEHIGLQYQEGQPKWHYQKELNIAKLKEIFNKWQTELGVEDGWNSLFWNNHDLPRIVSIWGNDQEYREKSAKAFAILLHLMRGTPYIYQGEEIGMTNYPFETLDQVEDIESLNYAREALEKGVPIEEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGNVKSVLIENTLAQEVFEKQILVPWDAFCVELL

SEQ ID NO: 13550 - DNA, 1764 bp, Streptococcus pneumoniae R6
  CDS (1)..(1764): transl_table=11
atgaatactttaggagacaaattgatggaattgagtgctatttaccatgggcctgagtcggagtatgcctatctttataaggataagaaactccatattcgaattcgaactaagaaaggggacattgaaagcatcaacttgcactatggggacccttttatctttatggaggagttttatcaggatacaaaagaaatggtcaagataacttctggtaccttatttgaccattggcaggttgaagtgtcagttgactttgcacgtatccagtatctctttgagctcagagatacagaaggtcaaaatattttgtatggcgataaagggtgtgtggaaaattctctagaaaatcttcatgcaattgggaatggatttaagttgccttatcttcatgagattgatgcctgcaaggttcctgactgggtttcaaatacggtatggtatcagatatttcctgaaagatttgccaatggcaatgctctattaaacccagaagggactttagactgggattcatctgtcacacctaagagcgatgatttctttggtggtgatttacaggggattattgatcatatggattacttgcaagacttgggtattactggactatatctttgtcccatctttgaatctacaagcaatcacaagtacaatacgacagattactttgaaattgaccgtcattttggagacaaggagacctttcgggaactggtggatcaagcgcatcatcgtggcatgaaagtcatgctggatgcggtatttaatcatattgcttcgcaatctcttcaatggaaaaatgtcgtcaaaaatggtgaacagtctgcttataaggattggttccatattcaacaattcccagtgacaactgaaaagctagttaataagagagacttaccctatcatgtttttggtttcgaggactatatgcctaagctaaatacagccaatccagaggtcaagaattatcttttaaaggttgcgacttattggattgaagagtttaatatcgatgcttggcgtttggatgtggctaatgagattgaccatcagttctggaaggattttcgtaaggcagttttagctaaaaatcctgatctttatatcctaggagaagtctggcatacatctcagccttggctaaatggagatgagttccatgccgtcatgaattatcctttatctgatagtatcaaggactatttcttacgaggaattaagaagacagaccagttcatcgatgaaatcaatggagagtctatgtattacaagcagcagatttcagaggtcatgtttaatctcttggattcacatgatacagagcgaatcctgtggacggccaatgaagatgttcaactggttaaatcagccttagcctttctctttttacaaaaaggaacaccgtgcatttattacgtaaccgagctagccttgactggaggaccagatccagattgtcgtcgttgtatgccttgggaacgtgtatcaagtgacaatgatatgctgaactttatgaagaggctgattaagattcggaaatacgcgtcagtaatcatttcgcatggcaagtatagccttcaagaaatcaactctgatctagtagctctggaatggaaatacgaaggacggatcctcaaagcaatattcaaccaatcaacagaagattatcttttagagaaagaagcagtagcactagcaagcaattgccaagaattggataatcagcttgtcatctctccagatggatttatgattttctaa

SEQ ID NO: 13551 - protein, 587 aa, Streptococcus pneumoniae R6
MNTLGDKLMELSAIYHGPESEYAYLYKDKKLHIRIRTKKGDIESINLHYGDPFIFMEEFYQDTKEMVKITSGTLFDHWQVEVSVDFARIQYLFELRDTEGQNILYGDKGCVENSLENLHAIGNGFKLPYLHEIDACKVPDWVSNTVWYQIFPERFANGNALLNPEGTLDWDSSVTPKSDDFFGGDLQGIIDHMDYLQDLGITGLYLCPIFESTSNHKYNTTDYFEIDRHFGDKETFRELVDQAHHRGMKVMLDAVFNHIASQSLQWKNVVKNGEQSAYKDWFHIQQFPVTTEKLVNKRDLPYHVFGFEDYMPKLNTANPEVKNYLLKVATYWIEEFNIDAWRLDVANEIDHQFWKDFRKAVLAKNPDLYILGEVWHTSQPWLNGDEFHAVMNYPLSDSIKDYFLRGIKKTDQFIDEINGESMYYKQQISEVMFNLLDSHDTERILWTANEDVQLVKSALAFLFLQKGTPCIYYVTELALTGGPDPDCRRCMPWERVSSDNDMLNFMKRLIKIRKYASVIISHGKYSLQEINSDLVALEWKYEGRILKAIFNQSTEDYLLEKEAVALASNCQELDNQLVISPDGFMIF

SEQ ID NO: 13552 - DNA, 1851 bp, Thermoplasma acidophilum DSM 1728
  CDS (1)..(1851): transl_table=11
atgattgatattgaaatcggcggagatgcgccatttttcaggaagatcaaggtgcatctaggcaaaatagatgcaagtaccgcttatgtcgaaggtacgttcaactgtcagggcgagggcagcatagtcctggaggggaacagcgaatcgacagatgaagtggatggcctcgttccagataaatacgaatttaggatagctctcgatcagtaccggtttctgaggaatagccagtcaagatctaacatgttccaggtatcattatggcttgatgctgtgtatcacgatcctgatctttctcaattttcctgcatacttgacgataggttgatggatattaggatagctgtgcccaagcaggtggtctcggttcgtattttaactgaatcggaggttaaggtggtctattccagaagatcatcccaggcgacctacgacattgttgaatttgttatttcaggagtatctgggtatgcctttgaggtggatcaggtgagatatccggatcatggatactacagatcaaccaaaaggataaactcagagggtaactcgaagataatgtaccatatattcccagatcgtttccatcgttatggtgaagatcgtccgggcctcataaaatggggcgagaagccgtctcgcgactcattcttcggcggtaatctggaaggtataaggcagaagatccagtatatcaaggatctcagggtggatcacatatacctgaatcctctattcaaaagcaaatccaatcacaggtacgatgttgatgattattacagcatcgatgagttgttgggtacggatcaggatctgaagaatctcgtatcagatgcccatgcaagcggtataaaaatagttcttgatatggtcttcaatcacacttcaaccgacttcccggccttcagagatgtaatagagaagggcaggaattcaccttattacagatggtacatattccacagggatgaattcacagtattcaggggaagaggaaagagaggtagttatccgtcctatgagacgttcatggggtacggaggcatgccgaagcttgatcacagaaatcctgaggtgaggcgatactgcataaatgtcctgaaatattatgtgcagaagttcgatgtagatggattccgctacgatgtggcgcattccatatacagcaaattcttcgaggaggtcttcagtgagatcggtaccggaattttgcacataggggaggcgtggtgcctgcccacctaccttgtgaacggatcagcatggcagagctatacaaattatttcctaggcggatccatcatcgattttttgaagggatcgataacgctgggagaattctacgatagggtgcagagaatgctgatcgtcaatggtatagagaaacagcaggccatgatgaatgttttggattctcatgataccccaaggatcttaaggatcctgaatggagacaggaagaaggttaagctggcctactcgatactctatctgttcgatggtatagcaacaatctactatggcgatgaggttggtctggatggcggaaaggatccggacgacaggagatgcttcccgtgggattctatggatgaagatatgcacagcttcttcatgaacttgggtgatctgagagaaaaatacagtcttggatcagctggcgtgataacggtctttgaggacgaagcatcattcgtcatagagaaggtcaaggctggcagatccatatccgtacatatggcaaagaatgggcgcatgaaatttccgaaagactcattaatcgctgtgagggagaatcagaaagaagtcaagccatgggatttctatatatatctccgtacagtctaa

SEQ ID NO: 13553 - protein, 616 aa, Thermoplasma acidophilum DSM 1728
MIDIEIGGDAPFFRKIKVHLGKIDASTAYVEGTFNCQGEGSIVLEGNSESTDEVDGLVPDKYEFRIALDQYRFLRNSQSRSNMFQVSLWLDAVYHDPDLSQFSCILDDRLMDIRIAVPKQVVSVRILTESEVKVVYSRRSSQATYDIVEFVISGVSGYAFEVDQVRYPDHGYYRSTKRINSEGNSKIMYHIFPDRFHRYGEDRPGLIKWGEKPSRDSFFGGNLEGIRQKIQYIKDLRVDHIYLNPLFKSKSNHRYDVDDYYSIDELLGTDQDLKNLVSDAHASGIKIVLDMVFNHTSTDFPAFRDVIEKGRNSPYYRWYIFHRDEFTVFRGRGKRGSYPSYETFMGYGGMPKLDHRNPEVRRYCINVLKYYVQKFDVDGFRYDVAHSIYSKFFEEVFSEIGTGILHIGEAWCLPTYLVNGSAWQSYTNYFLGGSIIDFLKGSITLGEFYDRVQRMLIVNGIEKQQAMMNVLDSHDTPRILRILNGDRKKVKLAYSILYLFDGIATIYYGDEVGLDGGKDPDDRRCFPWDSMDEDMHSFFMNLGDLREKYSLGSAGVITVFEDEASFVIEKVKAGRSISVHMAKNGRMKFPKDSLIAVRENQKEVKPWDFYIYLRTV

SEQ ID NO: 13554 - DNA, 1527 bp, Synechocystis sp. PCC 6803
  CDS (1)..(1527): transl_table=11
gtgccccaccattacgacagggtaaatattaacaaattattaacaaggactagaatcaccatggttacaaccccagattgggtgaaaaaagccgttttctatcaaatttttcctgaccgttttgccatcggccaacaacaggcgatcgccgtcgctcaacaaccaaagctagaaccatgggaggccccgccaacggtgcagggttataaggggggcaacctgtggggagtgatcgaacatttggattatctccaggattcgggcattaccgctttatacttgacccccattttccagtccgcctgtaatcaccgttatcacacccatgactattaccaagtggatcctctactggggggcaacgaggcgttgcaggctttactaacccaggcccaccgccgggagatgaaagtagtcttggatggagtgtttaaccatgccagcaggggtttctactttttcaacgacattttggaaaatggcccccattctccttggttagattggtttcacattgaagattggcccctatcagcctatgacggttctctgccagctaactatcggggctgggtagatttgcgggccctgccccagtttaaccatgaccatcccgacgtacgggaatatttgatgcgggtgggggagtattggattgcccagggcattgatggttggcgtttggatgtgcccgattgtgtcaaagcggaaggtttttggcaagaattccgctgcagggtcaaggccattaatccagaagcctacattgtgggggaaatttggtgtgatgctagcccctggttagccggagatcaattcgatggggtgatgaactatcgctttaccgaacctaccgtagcttttgccattggcgatcgcctgcaaaaagaacatctacggggggaagaatatcgtccttacccagccctaactgcagaagcctatggggaaagaattagccaactgctgcaacaacatccctgggaaattcagttaacccaattaaatttactcaacagccacgacaccgcccgcttattaaccctagccaatggcgatcggcccagcgttaacctcgctcttttactgatgtttactttccccggtgctccctgtgtttactacggagacgaagtgggtttgcctggggaggccgaccccgattgtcgccgagtttttcctgctaaaactgactgggacttggattgttgggaattctaccgccaattgattgccctgcgccatcgctatcaatgtttgcaattgggggattacaaaattatcgccacggcaggtatgggctatgtttttcaacggcaatacggcgatgaaaccctaatggttgccgttaatagtggtgacaacataatagaaattatattatctccagacataataaatttggataaaatagacatagctgaacctgtatttagcgctaatggtgagaccgtaattgaccggaacaccgcagggttacttttgaccatggcccctcaatcaggagcagctttcgccatcatttga

SEQ ID NO: 13555 - protein, 508 aa, Synechocystis sp. PCC 6803
MPHHYDRVNINKLLTRTRITMVTTPDWVKKAVFYQIFPDRFAIGQQQAIAVAQQPKLEPWEAPPTVQGYKGGNLWGVIEHLDYLQDSGITALYLTPIFQSACNHRYHTHDYYQVDPLLGGNEALQALLTQAHRREMKVVLDGVFNHASRGFYFFNDILENGPHSPWLDWFHIEDWPLSAYDGSLPANYRGWVDLRALPQFNHDHPDVREYLMRVGEYWIAQGIDGWRLDVPDCVKAEGFWQEFRCRVKAINPEAYIVGEIWCDASPWLAGDQFDGVMNYRFTEPTVAFAIGDRLQKEHLRGEEYRPYPALTAEAYGERISQLLQQHPWEIQLTQLNLLNSHDTARLLTLANGDRPSVNLALLLMFTFPGAPCVYYGDEVGLPGEADPDCRRVFPAKTDWDLDCWEFYRQLIALRHRYQCLQLGDYKIIATAGMGYVFQRQYGDETLMVAVNSGDNIIEIILSPDIINLDKIDIAEPVFSANGETVIDRNTAGLLLTMAPQSGAAFAII

SEQ ID NO: 13556 - DNA, 1818 bp, Salmonella typhimurium LT2
  CDS (1)..(1818): transl_table=11
atgttgaatgcctggcacttaccggttgccccatttgtgaagcaacataacgataaattaaccattacgctgtggctgagcggagaaaatccgccgtctcgcgtgacgttgcgctcagaattcgataatgaagaaatctcactggcgatgcgcaaacagcgccgccagccgcagccgggcgtgacggcgtggcgagcgacgctcaatatcgcgttagggcaaccccgtcgccgttacagctttaaattgctttggcatgaccgccagctttggtttacgccacagggatttagccgttttccgcctgcgcgtctggaacaatttgcggttgatgtgccggatagcggcccgcagtgggtcgccgatcaaattttttatcagatcttcccggatcgttttgcccgcagccagtctcgtgaagccgggcaggaccgggtgtactaccatcatgccgcaggtcaggagattgtgctgcgcgactgggacgatcctttaaccccccaggcgggcggttccaccttttacggcggctgtctgaatggcatttgtgagaagctgccgtatctgaaaaaactgggcgtcacagcgctatatctgaatccggtatttaccgcgccgagcgtccataagtacgatacggaagattatcgccatgtcgatccgcaatttggcggcgatcgggcgctgctacgcctgcggcgtaaaacccaggtgcagggcatgaggctggtgctggatggcgtgtttaatcatagcggcgactcgcatgtgtggtttgacaggcataaccgcagcactggcggcgcgtgccatcacccggactcgccgtggcgcgactggtactccttttcaccacaaggcgtggcgctggactggctgggttatccgagcctgccgaaactcgattatcaatcagaaacgctggtcgatgagatctatcgcggtgaggacagtatcgttcgtcactggctaaaggctccgtggaatatggacggctggcggctggatgtcgtacatatgctgggcgaggcgggcggggcgcgtcataatttgcagcacgtcgccggtattacccgggcggcaaaagaggcgcagcccgaagcctatattgtgggggaacatttcggcgatgcgcggcagtggctacaggccgatgcggaagatgccgccatgaattatcgcggcttcaccttcccgctatggggatttctcgccaatactgatatcgcttacgaaccacagcatattgatgcccggacctgtatcgcgtggatggataactaccgcgccgggctgtcacatcagcaacaactgcgcatgtttaatcaactcgacagccatgatactgcgcgctttaaaactctgctgggtaaagacgcggcgcgcctgccgctggcggtggtctggctgtttacctggcccggcgtgccatgtatttattacggcgatgaagtcggcgtggacggcgcaaatgaccccatgtgccgcaaaccgttcccatgggatgaacgcaagcaggacggcaacttgctggcgctgtaccagcgtatggcgaaactgcgccagagcagtctggcgctgcgtcgtggcggatgccaggcgctgtatgccgaaggtgacgtagtggtattcgtgcgagtttatcagcagcagcgggcgctggtggcgattaaccggggcgaggcctgtgaagtggcgctggaagcgttgccgttgctgaacgtggccggatggcaatgtaaaacgggaagcggtgatatccgcgagggaagacttagtttacccgcgatttccgcgacggtatggatgaatcgttga

SEQ ID NO: 13557 - protein, 605 aa, Salmonella typhimurium LT2
MLNAWHLPVAPFVKQHNDKLTITLWLSGENPPSRVTLRSEFDNEEISLAMRKQRRQPQPGVTAWRATLNIALGQPRRRYSFKLLWHDRQLWFTPQGFSRFPPARLEQFAVDVPDSGPQWVADQIFYQIFPDRFARSQSREAGQDRVYYHHAAGQEIVLRDWDDPLTPQAGGSTFYGGCLNGICEKLPYLKKLGVTALYLNPVFTAPSVHKYDTEDYRHVDPQFGGDRALLRLRRKTQVQGMRLVLDGVFNHSGDSHVWFDRHNRSTGGACHHPDSPWRDWYSFSPQGVALDWLGYPSLPKLDYQSETLVDEIYRGEDSIVRHWLKAPWNMDGWRLDVVHMLGEAGGARHNLQHVAGITRAAKEAQPEAYIVGEHFGDARQWLQADAEDAAMNYRGFTFPLWGFLANTDIAYEPQHIDARTCIAWMDNYRAGLSHQQQLRMFNQLDSHDTARFKTLLGKDAARLPLAVVWLFTWPGVPCIYYGDEVGVDGANDPMCRKPFPWDERKQDGNLLALYQRMAKLRQSSLALRRGGCQALYAEGDVVVFVRVYQQQRALVAINRGEACEVALEALPLLNVAGWQCKTGSGDIREGRLSLPAISATVWMNR

SEQ ID NO: 13558 - DNA, 1662 bp, Listeria monocytogenes EGD-e
  CDS (1)..(1662): transl_table=11
atgaaagaaaaagattggtggaaaaaaagcgtagtgtaccaaatctatccaaagagttttaatgattcgaatggtgatggagttggtgatattcaaggaattatcgagaaattagattatttaaaagagcttggtgtagacgttatctggttgtccccggtgtacgattcgccgcaagatgacaatggttacgatattcgcgattatcaaaaaatttacgaagaatatggtgacatggcgacttttgatcaattgcttcaaggtttacacgaccgcgatatgaaactcgtgatggacttagttgttaaccatacttctgatgaacataagtggtttgaagaatctcggaaatccaaagataacccatatcgcgattactatttctggcgcgaggaaaacgaaatcaacaactggggttccattttcagcggtccagcatgggaattagacgaaaaaacaggcgagtactatttacacctgttctccaaaaaacaacctgatttaaactgggaaaaccctaaattacgccaagatgtatataatatgatgaaattctggctagataaaggcattgatggtttccgcatggacgtaattaattttatttccaaaaacaccgatttcccagatggtccagtgccagatggtcaaatttacggcgatgctggcaatgatttctgcaatggaccgcggattcatgagttcttgcaagaaatgaaccaagaagttacttccaaatacgatgtgatgactgttggtgaaatgcctggtgctagtacaactgacgcgcagatttatacgaatccagcaaataacgaagtcgatatgatttttacatttgaacatatgaacttagattccgatagcgacaataaatgggatttgaaaccaatttacttaccagatttaaaagaaaacatgtccgaatggcaagtggcgcttcaagaaaatggctggaacagcttatactggaacaatcatgaccaaccacgaatcgtttctcgcttcggaaatgacaatcgtttccgcgttcgttcagcgaaaatgctcgcaacttgtctgcatatgatgaaaggaacgccgtacatttatcaaggtgaagaaatcgggatgacgaatgttcattttgaaacgctagatgattatcgtgatatcgaaacgctaaacatgtacaaagaacgcaaagagcaaggccacagtcacgaaagtatcatgcagtcgatttacacaaaaggtcgcgacaatgcgagaaccccttatcagtgggataatagcgagaatgctggcttcacaaccggaacgccttggcttaaagtcaacccgcgctatacagaaatcaacaacgaagaagcgctgaaaaacccagattccattttctactactaccaaaatcttattaagttacgaaaaacgactgaaatcatcacaacaggtaattatcgcctgttattacctaaagatgaagcgattttcgcatatgaacgctacacagaaaatgaaaaattagttgttttatgtaatttcacagaagaagaacaagttatttctgatgaaaccattttgaacgaaatccaaaaaggttccgttcttgtaaacaatgttcctaatattatagaaggaactttacgaccttacgaagcaatcgtttatcaaatcaagtaa

SEQ ID NO: 13559 - protein, 553 aa, Listeria monocytogenes EGD-e
MKEKDWWKKSVVYQIYPKSFNDSNGDGVGDIQGIIEKLDYLKELGVDVIWLSPVYDSPQDDNGYDIRDYQKIYEEYGDMATFDQLLQGLHDRDMKLVMDLVVNHTSDEHKWFEESRKSKDNPYRDYYFWREENEINNWGSIFSGPAWELDEKTGEYYLHLFSKKQPDLNWENPKLRQDVYNMMKFWLDKGIDGFRMDVINFISKNTDFPDGPVPDGQIYGDAGNDFCNGPRIHEFLQEMNQEVTSKYDVMTVGEMPGASTTDAQIYTNPANNEVDMIFTFEHMNLDSDSDNKWDLKPIYLPDLKENMSEWQVALQENGWNSLYWNNHDQPRIVSRFGNDNRFRVRSAKMLATCLHMMKGTPYIYQGEEIGMTNVHFETLDDYRDIETLNMYKERKEQGHSHESIMQSIYTKGRDNARTPYQWDNSENAGFTTGTPWLKVNPRYTEINNEEALKNPDSIFYYYQNLIKLRKTTEIITTGNYRLLLPKDEAIFAYERYTENEKLVVLCNFTEEEQVISDETILNEIQKGSVLVNNVPNIIEGTLRPYEAIVYQIK

SEQ ID NO: 13560 - DNA, 1776 bp, Listeria monocytogenes EGD-e
  CDS (1)..(1776): transl_table=11
atggaaaaagcagggatttaccatcaaccggcgagtagctatgcatatagttatgacgctaaaacactacatattcggattagaactaaacgcttggatattagcaaggttactctaattgctgccgacccttacttatggaaagatggaaaatggcaaagtgaatcgtatacaatgcgcaaaatcgcagaaacagaagagcatgattattggttttttgcaattacaccagaacatagacgccttcaatatggatttttattaaccgatactgaaggagaaacaacattttatggcggacgtggtttttttgagccgaccgaggcgaatttagctacgatggattattactttaaatttccgtttatccatgcagtagatacatttgaggcacctgaatgggttagaaataccatttggtaccaaattttcccagaacgttttgcgaatggtaatccagctatttctccggaaaataccttgccgtgggggagtaaagatccgaatacaacagacttttttggtggagatattgaagggattatcgagcacttagattatttagcagagcttggtatcaatggggtttatttaacgcctgtttttgaagcaccgaccaaccacaaatacgacacaattgattataaaaaaattgatccgcactttggagacaaggaaacttttagaaaattagttaaagaagcgcataaacgtggtattcgcattatgctagatgcggtgttcaatcatattggggatacttctccagagtggcaagatgttgttgaaaaagaagaaaaatcagcgtatcgcgactggttccatattcatagtttcccagttcgtcaaaatgaaaatggcaatatcgaaggagaaccaacactttcttatgatacatttgctttcacaacgcatatgccaaaattaaatacggctaacccagaagttcagaagtatttactggatattgcgacttactggattcgtgagtttgatattgacggttggcgtttagacgttgctaatgaagtggatcacgctttttggaaagagtttaagaaggcggctcaagcggaaaaagaagacatttatattcttggtgaaatttggcatgattcatggatttggctacttggagatgaattccacgccgtaatgaattatccatttacacaaacgattattgagaactttattgaagaaaaaattaccccagagcaaatggtttctggcattaatgaacaatatatgcgctacccaaatcaagtgaatgaagtgatgtttaacatgcttgatagccatgatacagcgcgtattttaacacgtgctaataacgatgaggataaagtgaaacaagcgcttgccttcatgttcgcgcacactggttcgccgtgtatttattatggaacagaaatcggcatggacggcggaaatgacccaggttgccgtaagtgtatggaatgggacgaagcaaaacaaaatcaagatatgctagcatttacaaaacaactaatcgctctaagaaaagataatcaagctattatcacatccggtgagttaacttggttagaggcaagcagcgaaacgggcattactgcattttctaaagaattaaatggtgaaaaactacatttccttttcaatcaaacgaaaaaagatcaggatttcacaatttcatttgctaataccgcgatagatatttggaataaccaagctgtatctgataatctaactatcccggcaaaaggatttcttgttattaaagaaaacagctaa

SEQ ID NO: 13561 - protein, 591 aa, Listeria monocytogenes EGD-e
MEKAGIYHQPASSYAYSYDAKTLHIRIRTKRLDISKVTLIAADPYLWKDGKWQSESYTMRKIAETEEHDYWFFAITPEHRRLQYGFLLTDTEGETTFYGGRGFFEPTEANLATMDYYFKFPFIHAVDTFEAPEWVRNTIWYQIFPERFANGNPAISPENTLPWGSKDPNTTDFFGGDIEGIIEHLDYLAELGINGVYLTPVFEAPTNHKYDTIDYKKIDPHFGDKETFRKLVKEAHKRGIRIMLDAVFNHIGDTSPEWQDVVEKEEKSAYRDWFHIHSFPVRQNENGNIEGEPTLSYDTFAFTTHMPKLNTANPEVQKYLLDIATYWIREFDIDGWRLDVANEVDHAFWKEFKKAAQAEKEDIYILGEIWHDSWIWLLGDEFHAVMNYPFTQTIIENFIEEKITPEQMVSGINEQYMRYPNQVNEVMFNMLDSHDTARILTRANNDEDKVKQALAFMFAHTGSPCIYYGTEIGMDGGNDPGCRKCMEWDEAKQNQDMLAFTKQLIALRKDNQAIITSGELTWLEASSETGITAFSKELNGEKLHFLFNQTKKDQDFTISFANTAIDIWNNQAVSDNLTIPAKGFLVIKENS

SEQ ID NO: 13562 - DNA, 1467 bp, Nostoc sp. PCC 7120
  CDS (1)..(1467): transl_table=11
atgcaaattcaaacaccaaactgggtgaaaaacgctgtattctaccaaatcttccccgatcgttttgctagaagtaaacagccccacaagcgcctgttgcgtgatgcgcgttgggaagactgggatgcgatgcctacgctacaaggatacaaaggcggtgatttatggggcatcatggagcagttagactacattcaagacttaggcattgatgccatttactttacacccatctttcaatctgccagcaatcaccgctatcatacccacgactattatcaagtagacccgatgttgggtgggaatgccgcttttaaggaattactagacgcatcccacgaacgcaatattaaagttgtcctcgatggcgtatttaatcattccagtcgaggatttttctttttccacgacgttttggaaaatggccctcattccccttgggtaaattggttcaagattgaaggctggcctctggcaccatatacaggtgagttgccggcaaattatgtaggttgggctgataatcgcgccttgccagtatttaatcatgacaacccagaagtgcgggaatatattatggaaattgccgaatattggattaaattcggcatcgacggctggcggttggatgtaccatttgaaattaaaactcctggcttttggcaagaattccgcgatcgcgttaaagccattaaccccgaagcttatattgtgggggaagtgtggggagattccagcgagtggctagatgggacgcaattcgacggtgtgatgaattacttatttgccgggccgaccattgcctttgccgcaggcgatcgcgtagtcttagaacaagtccaaagccgcgattatcaaccatatccgcccctattcgctgccgaatacgccaccaaaattcaggaagtactgcaactttacccttgggacattcaacttacccaactcaacttattagcgagtcacgatacagcccgactcctgaccattgctggcggtgatcaagccagtatacaattagctaccctattactacttacctttcctggcgcgccaagtatctactacggcgatgaagtgggtttaccaggaggtatcgaccccgattctcggcggggctttcctttagaagctaactgggatagagaaatttatcagacccaccgtcaattaatagccttacgccgtacttacccagccttacgcacaggtgactatcaagttatttgggcgcaaggtgcattgtatatttttgcccgcaccttaggcaaagaagaattaattattgccgtaaatgtaggtacagcaacagcccaggctaatgtagatgttgctagtttgcagactcagccaaataaaatcctgtacggtcaagcagaatttcactggcacaatacagaagaaacaaaacaactgttcttaagtctccccccacgtagtggctgcattctgggtttaggggattag

SEQ ID NO: 13563 - protein, 488 aa, Nostoc sp. PCC 7120
MQIQTPNWVKNAVFYQIFPDRFARSKQPHKRLLRDARWEDWDAMPTLQGYKGGDLWGIMEQLDYIQDLGIDAIYFTPIFQSASNHRYHTHDYYQVDPMLGGNAAFKELLDASHERNIKVVLDGVFNHSSRGFFFFHDVLENGPHSPWVNWFKIEGWPLAPYTGELPANYVGWADNRALPVFNHDNPEVREYIMEIAEYWIKFGIDGWRLDVPFEIKTPGFWQEFRDRVKAINPEAYIVGEVWGDSSEWLDGTQFDGVMNYLFAGPTIAFAAGDRVVLEQVQSRDYQPYPPLFAAEYATKIQEVLQLYPWDIQLTQLNLLASHDTARLLTIAGGDQASIQLATLLLLTFPGAPSIYYGDEVGLPGGIDPDSRRGFPLEANWDREIYQTHRQLIALRRTYPALRTGDYQVIWAQGALYIFARTLGKEELIIAVNVGTATAQANVDVASLQTQPNKILYGQAEFHWHNTEETKQLFLSLPPRSGCILGLGD

SEQ ID NO: 13564 - DNA, 3483 bp, Ralstonia solanacearum GMI1000
  CDS (1)..(3483): transl_table=11
atgacgcgcaacccgaccgtgctgctggtggacgacgcgctctggtacaaggacgcggtcatctatcagctgcacgtcaaatcgttctgcgactcggacaacgacggcgtaggggacttcccgggcctgatctccaagctcgactacatcgccgagctgggcgtggatgcgatctggctgctgccgttctacccctcgccgcgccgcgacgacggctacgacatcgccgaataccgcggcgtgcaccccgactacggcaccatggccgacgcgcgccgcttcattgccgaggcgcacgcgcgcggcctgcgcgtcattaccgagctggtcatcaaccacacctcggaccagcacccgtggttccagcgcgcgcggcgcgccaaggcgggctccgcgctgcgcgacttctacgtgtggtcggaccacgacaagaaatacgccggcacgcgcatcatcttcatcgacaccgagccctccaactggacctgggacccggtggccgacgcctactactggcaccgcttctattcgcaccagcccgacctgaacttcgacaacccgcgcgtgctcaaggccgtgctgggcgtgatgaagttctggctcaacctgggcgtggacggcctgcggctcgatgccgtgccctacctggtggagcgcgagggcaccgccaacgagaacctgcccgagacgcacgccgtgctgcgcaagatccgcgcggcgatggacgcggaattcaagaaccgcctgctgctggccgaagccaaccagtggcccgaagacacacaggaatacttcggcaacggcgacgagtgccacatggccttccactttccgctgatgccgcgcatgtacatggcgatcgcgcgggaggaccgcttcccgatcaccgacatcatgcggcagacgcccgaggtgccgcccacctgccagtgggccatcttcctgcgcaaccacgacgagctgacgctggagatggtgaccgacgcggagcgcgactacctgtgggaggtctacgccagcgaccgccgcgcgcggctcaatctcggcatccgccggcgcctggcgccgctgctggagcgcgaccgccgccgcgtggagctgatgaacagcctgctgttctcgatgcccggcacgccggtgatgtattacggcgacgagatcggcatgggcgacaacatccacctgggcgaccgcgacggcgtgcgcacgccgatgcagtggtcgcccgaccgcaacggcggcttctcgcgcgccgatccggagcagctggtgctgccggccatcatgggctcgctgtacggctatgaatcggtcaacgtggaggcgcagacgcgcgacgcgcattcgctgctgaactggacgcgccggctgctggccacgcgcaagcgccaccgcgtgttcgggcgcggcagcatccagttcctgcagccggccaaccgcaaggtgctggcctatgcgcgcgcgctggaaggcgaggcccccatcctgtgcgtggcgaatctgtcccgggcctcgcaggcggtggagctggacctggccgcctatgcgcagcgcgtgccggtggagttgatcggcgggacggccttcccgccgatcggccagttgccctatctgctgacgctgccgccctatgcgttctactggctggagctgcgcgagaacgagcccggcccgtcgtgggcgcagccggccgcggagcagttgcccgagttcaccacgctggtgctgcgcgcggggctcgatgcgctggccgacacacgccagcgcgaggcgcaccgccagctggtcgagcgcgagatcctgccgacctacctgcccaagcgccgctggttcgcggccaaggacagcgtgctgcgcggcgcgcacttcgcctggggcaccgagctgccggtggatgcggcctccaccaaccggccgctggcgggggcgacccggcccgaggtgttcatcaacgagatcgccgtcacgctgggcgacgcggacggcaccgagcgcaccgagcgctacctgctgccgctgtcgatcgcgtgggagagcgccacgctgcccgcgctgccgatccagctggcgctggcgcgcgtgcggcgcggccgccatgtcggctacctgaccgatgccttcaccaccgagaccttcgcccgtgtgctgctggccaacctggtgcgcggcgtcacgctggaggccagcgacggccgcgtgcatttcgagcccgagccgcacctggccgaactggccgagccgccggtggccgccgaaaccgcggcggtgcgcccggcgccgctgccgctggcgcccgacgcgccggtgcagtggctggcggcggagcagtccaacagctcgctggtgatcggcgaatcggtcatcgtcaagctgatccgccgggtggcggcgggtgtgcatccggaagtggagatgacgcgccacctcacgcgcatcggctatgccaacacggccgcgctgatcggcgagatcgcgcacgagggcgcggacggcgagcgcagcacgctggccgtgctccagagcttcgtgcccaaccagggcgatgcgtggacatgggcactcgactacctgcgccgcaccattgatgagctggcggtgctgacggaggccgtctcggccggcgacggcgacgcggcgcccaccgccgtctcggaagcgcgcaccgataccgacgaagcgctggcgggctacctggccttcatcggcgcgatcggcacgcggctaggcgagctgcacgtcgcgctggccgggccgtcggacgatccggccttcggcacccgcgccgccgacgccgacgacgcagccttctggaccgcgcgcgtggacgaggagctggcccgcgcgctcgaccacctcgcggcatggcaggcggccaacggaccgcgcgccgaggtcggctggctgctgtcgcagcgcgatgccctgctggaagccgcccgcgaacgcgcacagggcggcctgggcgcgatgctggcgcgcgtccacggcgacttccacctcggccaggtgctggtggcgcagggcgatgcctacctgatcgacttcgagggcgagccgtcgcggccggtggacgagcgccggcgcaagaccagcccgctgcgcgacgtggccgggctggtgcgctcgctcgactacgtggtgggcgccatgcggcagggccccgagcatgtggccggaccggcgcaggagcggcgcgaccagctgctcgaacgcttccgcaatgcgtccaccgagcgcttcctggaggcctacgcggccgccatcctggcctccggttccgatgacggcgcctgcatgctcgatctggacctgctcgacctgttcctgttggagaaggcggcctacgaggtcaactacgaagcggccaaccggccgacgtggctgccgatcccgctggcgggcctggcgcgggtggcgcgccggctgctgccagcggacgtggcaccgcccgtggcgcgggatccgctcggaggcccgccgtga

SEQ ID NO: 13565 - protein, 1160 aa, Ralstonia solanacearum GMI1000
MTRNPTVLLVDDALWYKDAVIYQLHVKSFCDSDNDGVGDFPGLISKLDYIAELGVDAIWLLPFYPSPRRDDGYDIAEYRGVHPDYGTMADARRFIAEAHARGLRVITELVINHTSDQHPWFQRARRAKAGSALRDFYVWSDHDKKYAGTRIIFIDTEPSNWTWDPVADAYYWHRFYSHQPDLNFDNPRVLKAVLGVMKFWLNLGVDGLRLDAVPYLVEREGTANENLPETHAVLRKIRAAMDAEFKNRLLLAEANQWPEDTQEYFGNGDECHMAFHFPLMPRMYMAIAREDRFPITDIMRQTPEVPPTCQWAIFLRNHDELTLEMVTDAERDYLWEVYASDRRARLNLGIRRRLAPLLERDRRRVELMNSLLFSMPGTPVMYYGDEIGMGDNIHLGDRDGVRTPMQWSPDRNGGFSRADPEQLVLPAIMGSLYGYESVNVEAQTRDAHSLLNWTRRLLATRKRHRVFGRGSIQFLQPANRKVLAYARALEGEAPILCVANLSRASQAVELDLAAYAQRVPVELIGGTAFPPIGQLPYLLTLPPYAFYWLELRENEPGPSWAQPAAEQLPEFTTLVLRAGLDALADTRQREAHRQLVEREILPTYLPKRRWFAAKDSVLRGAHFAWGTELPVDAASTNRPLAGATRPEVFINEIAVTLGDADGTERTERYLLPLSIAWESATLPALPIQLALARVRRGRHVGYLTDAFTTETFARVLLANLVRGVTLEASDGRVHFEPEPHLAELAEPPVAAETAAVRPAPLPLAPDAPVQWLAAEQSNSSLVIGESVIVKLIRRVAAGVHPEVEMTRHLTRIGYANTAALIGEIAHEGADGERSTLAVLQSFVPNQGDAWTWALDYLRRTIDELAVLTEAVSAGDGDAAPTAVSEARTDTDEALAGYLAFIGAIGTRLGELHVALAGPSDDPAFGTRAADADDAAFWTARVDEELARALDHLAAWQAANGPRAEVGWLLSQRDALLEAARERAQGGLGAMLARVHGDFHLGQVLVAQGDAYLIDFEGEPSRPVDERRRKTSPLRDVAGLVRSLDYVVGAMRQGPEHVAGPAQERRDQLLERFRNASTERFLEAYAAAILASGSDDGACMLDLDLLDLFLLEKAAYEVNYEAANRPTWLPIPLAGLARVARRLLPADVAPPVARDPLGGPP

SEQ ID NO: 13566 - DNA, 1821 bp, Clostridium perfringens str. 13
  CDS (1)..(1821): transl_table=11
atgggaaaagcttatatttatcatgattctcaagataccttttatagggaaccttttggagctgtttctataggttctaaggtaagtttaagattagaatgcgaagagtgtggagaagtttttatagaggtaataaagtttgatggaagtagatattcaatacctatgacaattgaagagcgaagaaatgaatgcataatttataaagggattatagacactacaaactccttaggagtaataaattattactttaaatacattaaggacggatttactaagtattatggaaataatgatgaatgtttaggaggagagggaaagatatattatgattttcctaattattatcaaataacagtttatgaagataataaaattcctagttggtataaggaaggtattatttatcaaatatttgtggatagattttttaatgggaataagaatagtgtgatattaaataaaaagaaaaatagctttatatatggtaattggtatgatgagccaatgtatataagagataataatggaagtattaaacggtggggtttttatggaggtaatttaaggggagtaattgaaaaattagattatataaaatctttaggtgtaaatattatatacatgaatccaatctttgatgctgtgagttgtcataaatatgatactggagattatgaaaatattgataagatgtatggaactaacagtgattttaaggaattgtgccaaaaagctgaggaaaaaggtataaggataatattagatggagtttttagtcatacaggatcagatagtaggtactttaataaatacggaaactatggagagcttggagcctatgaatctaaatactctaaatattataagtggtataggttttatgactatcctaatagttatgaatgttggtgggggtttgaaaatcagcctaatgtagaggaattagaaaagacatattcagattatatagttaatagtgaaaattcaataatagcaaagtggcttagattaggagcaagtggttggaggctagatgtagcagatgaacttccggatgaattcatacaaatgattaaggaaaggatgaaaaatgagaaagaagatagtgtgcttataggagaggtttgggaagatgcttcaaataaggttagctattcaaaaagaagaaaatatttattaggagatgaattagattctgtaacaaattacccttatagagatataatttctaattttttaaatgaagaaataagttcaaaggatttttataaagtaataatgagcataaaagaaaattatccaagagaaaacttttatgcaaatatgaatattctagggaaccatgacacagaaagaatacttacagtattaaaagagaatttaaataagttaaaattagctctatgtcttcaaatgactttacctggagttcccttaatttattatggcgatgaggcaggacttttaggaaataaggatcctgaaaatagaaagacctatccttggggacgagaaaataaggaaatattaagttattatagctttttcggaaactttagaaagaatgaagaggttttaagaaagggagatttttatatttttaaggatacacctgaggatgttattgcttttaagagagtttataaagataaagaaatgataattatagtaaacaggagtaattctagaaaaaccataaccttagatagcgagaaaggaagatataaagataaattttctaaggaagaattttatggtgatggtagcattactttagaagtagaaagagaaaattataaaattttaactaattag

SEQ ID NO: 13567 - protein, 606 aa, Clostridium perfringens str. 13
MGKAYIYHDSQDTFYREPFGAVSIGSKVSLRLECEECGEVFIEVIKFDGSRYSIPMTIEERRNECIIYKGIIDTTNSLGVINYYFKYIKDGFTKYYGNNDECLGGEGKIYYDFPNYYQITVYEDNKIPSWYKEGIIYQIFVDRFFNGNKNSVILNKKKNSFIYGNWYDEPMYIRDNNGSIKRWGFYGGNLRGVIEKLDYIKSLGVNIIYMNPIFDAVSCHKYDTGDYENIDKMYGTNSDFKELCQKAEEKGIRIILDGVFSHTGSDSRYFNKYGNYGELGAYESKYSKYYKWYRFYDYPNSYECWWGFENQPNVEELEKTYSDYIVNSENSIIAKWLRLGASGWRLDVADELPDEFIQMIKERMKNEKEDSVLIGEVWEDASNKVSYSKRRKYLLGDELDSVTNYPYRDIISNFLNEEISSKDFYKVIMSIKENYPRENFYANMNILGNHDTERILTVLKENLNKLKLALCLQMTLPGVPLIYYGDEAGLLGNKDPENRKTYPWGRENKEILSYYSFFGNFRKNEEVLRKGDFYIFKDTPEDVIAFKRVYKDKEMIIIVNRSNSRKTITLDSEKGRYKDKFSKEEFYGDGSITLEVERENYKILTN

SEQ ID NO: 13568 - DNA, 1665 bp, Clostridium perfringens str. 13
  CDS (1)..(1665): transl_table=11
atgaataaaaagtggtggaaagaattaattgcttaccagatttaccctaagagctttatggattctaatggtgatggtataggtgatattcaaggtataatatctaaattagattatttaaaagatttaggtattgatttaatctggttatgtccaatgtataaatcaccgaatcatgataatggttatgacattagtgattataaagatatcttagatgaatttggaactatggatgattttaatgaattgcttaatgaggttcataatagagggatgaagcttattatagatttagtaataaatcacactagtcatgaacatccatggtttatagaatcaagatcttctagggataatcctaaaagagattggtatatttggagagaaggtaaaggggatgaggaacctaataactgggaaagtatatttaaaggttcagcttgggaattctgtgagaatagtgaagagtattacctacatttatttgctaaagagcaaccagatttaaactgggagaataaagaggtaagaaatgaactatataaaatgataaactggtggcttgataagggtattgatgggtttagagttgatgccataagtcacataaaaaaagaagagggtcttaaggatatggataatccagagggacttaaatatgtttcatcctttgaaaagcatatgaatgtagagggaataaattctcatcttaaagaactaaaagaagaaactttttcaaagtataatatagttacagttggagaagcaaatggagttagtgccaatgaagctgatcactgggtagctgaagatgagggaacatttaatatgatattccaatttgagcatcttaatctttggaattatgaagagggacaaggatttgatgtgaaggcatacaaagatgttttaacaaattggcaaaattctttagaaggtaaaggatggaatgcacttttcattgaaaatcatgatatacctagagttgtttcaacttggggaaatgacaaggaatatttaactgaatgtgcaaaagcttttggagcaatttatttcttacaaaagggaacccctttcatataccaagggcaagaacttggtatgacaaatgttaaatatcatagcatatctgagtataatgatgttaaaactataaatacttacaatgaaagaattgaaagtggtgtttcagaggaaatagcattaaaagaagcttgggtaacttcaagagataattcaagaacacctatgcaatggaattcaagtgagaatgcagggtttacttgtggaaaaccttggataggagttaatgaaaattataaaacaataaatgtagaagttgaagaaagggatgaaaattcagttttaaacttctataaaaagcttataaaacttaaaaagtctaatgaagctttaatctatggtgtatatgatttaatccttgaagaggatgaaaatatctttgcttatacaagaactttaaataatgaaaagttcttgataatggctaatttaactggagaaaatgccaagtacatgtatgagaaagaaaaacttaattctaaggatttaattcttaacaattatgaggtttgtgaacataaaaacttaacagagtttacattaaaaccttatgaatgcagagtatataagctttcttaa

SEQ ID NO: 13569 - protein, 554 aa, Clostridium perfringens str. 13
MNKKWWKELIAYQIYPKSFMDSNGDGIGDIQGIISKLDYLKDLGIDLIWLCPMYKSPNHDNGYDISDYKDILDEFGTMDDFNELLNEVHNRGMKLIIDLVINHTSHEHPWFIESRSSRDNPKRDWYIWREGKGDEEPNNWESIFKGSAWEFCENSEEYYLHLFAKEQPDLNWENKEVRNELYKMINWWLDKGIDGFRVDAISHIKKEEGLKDMDNPEGLKYVSSFEKHMNVEGINSHLKELKEETFSKYNIVTVGEANGVSANEADHWVAEDEGTFNMIFQFEHLNLWNYEEGQGFDVKAYKDVLTNWQNSLEGKGWNALFIENHDIPRVVSTWGNDKEYLTECAKAFGAIYFLQKGTPFIYQGQELGMTNVKYHSISEYNDVKTINTYNERIESGVSEEIALKEAWVTSRDNSRTPMQWNSSENAGFTCGKPWIGVNENYKTINVEVEERDENSVLNFYKKLIKLKKSNEALIYGVYDLILEEDENIFAYTRTLNNEKFLIMANLTGENAKYMYEKEKLNSKDLILNNYEVCEHKNLTEFTLKPYECRVYKLS

SEQ ID NO: 13570 - DNA, 1833 bp, Clostridium perfringens str. 13
  CDS (1)..(1833): transl_table=11
atgggtaaaattacaagagaggcaatacatcatatagctcaaagcaattattcttatggatatgataatgaaactttgcatttaagagttaagactaaaaaaggtgaagttaataaagtggaaataagaattggagatccttacatatgggatgaaggtggttgtgatggaggaaatatgaatgccactggaggacgatggacaggtggaaaaagttatcctatgagaaaggaatgcgaaacaaaatactttgatcactggatagtagggtataaaccattaaccaaacgttcaagatatggatttatattatatggagatgaggaaactcttttatgcacagaaaaaagaatagaggagttagatggaaagtatgatgaagaaaaattaagtgctataggaaacttttattgttttccatatttaaatgccatagatgttgctaaaacaccacaatgggtaaaggatactgtttggtatcaaatattcccagatagattttgcaatggagataaatcaatagatccagaaaatgttgagccatgggggacagagcctactagggataattttatgggaggagatttacagggagttttagataaattagattacttatgcgatcttggaattaatggactatatttttgtccagtatttgaagctactgagaatcataggtatgaaactatagattattttaaagtagatccagcacttggtgggaatgaagtctttaaaaaacttgtaagtgaagctcacaaaagaggcatgaaaataatgttagatgcagtatttaatcatataggttatttttcaccaaaatggcaagatgtattaaagaataatgaaaaatcaagatataaggattggttttgtataaagaagttcccagtgcttgaaaatggcttagaaaatgttgatggaaataatttgaattatgaaacctttggaagaatagccacaatgcctaaactaaatactgaaaacccagaggttgtagaatatttattaaaagtcgctaagttctgggttgaagaaatggatatagatggttggagacttgatgtatgtaatgaagtagaccatgtattttggagaaaatttagggaagtagtaaagggaactaataaagaagtttatatattaggagaagtttggcatgatggacttccatggcttatgggagatcagtttgattcagttatgaattaccctgttacagatgcagtaaaagaatatttttgtttaaatcaatctaatccagaagattttaaatatatgatagaagctaataaggttagctatttaagacaaataggagaaacaatatttaacttgttagatagtcatgatactccaagaatattaactgtagctggaggaaataaggataagatgaaactagcttatctgtttatgtttactcaagctggctctccatgtatatattatggagatgaagttggtatggaaggaaatcaaggaatgggtatggaattccatagaagatgtatgatttgggatgaaaataaacaagacaaagatatgcttaagtttatgaaacaaataataaaaataagaaaagaaaataaggaattaaatttattagataataattggataagagctaataaggatgaaaatatacttatttattcaaaggaaaatatatttataattatgaacaattcagagaatgaagaaaagatatatttacctaaggagcttaaaaataataagattaatgatttatttgaagaaaaaattgaactcttaaaagaagatatagacttaaagccctttgcatttaaagtttataaaaagctttaa

SEQ ID NO: 13571 - protein, 610 aa, Clostridium perfringens str. 13
MGKITREAIHHIAQSNYSYGYDNETLHLRVKTKKGEVNKVEIRIGDPYIWDEGGCDGGNMNATGGRWTGGKSYPMRKECETKYFDHWIVGYKPLTKRSRYGFILYGDEETLLCTEKRIEELDGKYDEEKLSAIGNFYCFPYLNAIDVAKTPQWVKDTVWYQIFPDRFCNGDKSIDPENVEPWGTEPTRDNFMGGDLQGVLDKLDYLCDLGINGLYFCPVFEATENHRYETIDYFKVDPALGGNEVFKKLVSEAHKRGMKIMLDAVFNHIGYFSPKWQDVLKNNEKSRYKDWFCIKKFPVLENGLENVDGNNLNYETFGRIATMPKLNTENPEVVEYLLKVAKFWVEEMDIDGWRLDVCNEVDHVFWRKFREVVKGTNKEVYILGEVWHDGLPWLMGDQFDSVMNYPVTDAVKEYFCLNQSNPEDFKYMIEANKVSYLRQIGETIFNLLDSHDTPRILTVAGGNKDKMKLAYLFMFTQAGSPCIYYGDEVGMEGNQGMGMEFHRRCMIWDENKQDKDMLKFMKQIIKIRKENKELNLLDNNWIRANKDENILIYSKENIFIIMNNSENEEKIYLPKELKNNKINDLFEEKIELLKEDIDLKPFAFKVYKKL

SEQ ID NO: 13572 - DNA, 1938 bp, Pyrococcus furiosus DSM 3638
  CDS (1)..(1938): transl_table=11
atgtataagctcgtcagtttcagagatagcgagatctttggaagagttgcagaggtggaattttccctaataagagaaggaagctatgcatacctccttggtgactttaatgcatttaatgagggaagttttagaatggagcaagaaggaaagaattggaagattaaaatcgcccttccagaaggggtatggcactatgctttttcaatagatgggaaattcgtcttagatccagataatcctgaaagaagagtatatactagaaagggttacaaattccacagagaagttaatgttgcaagaattgtcaaaagtgacgatttggttttccatactccttctctcctgtatctgtatgaaatttttgggagggttcacgttcttttaaggacacaaaagggggtaataaaaggggcaactttcctgggggagaagcatgttcctatgaggaagaaggcttctgatgagctatttgattactttgaggttatcgtagaaggaggagataagaggttaaattattcatttgaagtattaacaatggaaggagcgaaatttgagtatggtcaatttaaggcgagacccttcagtatcgaatttccaacctgggttattgacagggtattctatcaaataatgccagacaaatttgctaggtctaggaaaattcaaggaattgcctatccaaaagataaatattggggaggagatctaatcggaattaaggaaaagatagaccaccttgtgaaccttggaataaatgcaatatatttaactccaatcttcagttccctcacatatcatggatatgacatagttgattatttccacgttgcaaggagacttggaggagacagggcctttgtggatttgttatctgagcttaaaaggtttgatataaaggttatccttgatggggtatttcaccatacgagctttttccacccatatttccaagatgttgtaaggaagggggaaaatagcagctttaaaaacttttacaggattattaaatttccagtagtctcaaaagaatttcttcaaatcctccattcaaaatcttcctgggaagaaaagtacaaaaagataaaatcccttggctggaattacgagagctttttctcagtttggataatgccgagattaaaccacgataatccaaaggttagagagtttatcaagaatgtgattcttttctggacaaataagggggtcgatggatttagaatggatgttgctcatggggttcctccagaagtgtggaaagaagttagagaagcattgccaaaagaaaagtacttaattggagaagttatggatgatgcaaggttatggctgtttgataaattccatggagtcatgaactatcggctctatgatgcaatcttaaggttttttggatatgaggagattacagccgaggaattcttaaatgaactagagctcttaagctcgtattatggcccagcagagtatctaatgtataattttttagacaatcatgatgttgagagatttttggatatagttggggataagaggaagtacgtgtgtgctttggtcttcttgatgacttacaaaggtattccatctctcttctacggagatgaaatagggttgagagggattaatctccaaggaatggaatcttccagagcaccaatgttgtggaatgaagaagagtgggatcaaaggattttggagataacaaagacactagtaaagattaggaaaaacaataaagccctcctttttggtaattttgtcccggtgaagtttaaaagaaaattcatggtatacaagagggaacacatgggagagagaactatcgttgccattaactactcaaattcacgcgttaaagaactaggaataacaattcctgaatattcgggcgtgataattaatgaagataaagtgaaattgataaagtactaa

SEQ ID NO: 13573 - protein, 645 aa, Pyrococcus furiosus DSM 3638
MYKLVSFRDSEIFGRVAEVEFSLIREGSYAYLLGDFNAFNEGSFRMEQEGKNWKIKIALPEGVWHYAFSIDGKFVLDPDNPERRVYTRKGYKFHREVNVARIVKSDDLVFHTPSLLYLYEIFGRVHVLLRTQKGVIKGATFLGEKHVPMRKKASDELFDYFEVIVEGGDKRLNYSFEVLTMEGAKFEYGQFKARPFSIEFPTWVIDRVFYQIMPDKFARSRKIQGIAYPKDKYWGGDLIGIKEKIDHLVNLGINAIYLTPIFSSLTYHGYDIVDYFHVARRLGGDRAFVDLLSELKRFDIKVILDGVFHHTSFFHPYFQDVVRKGENSSFKNFYRIIKFPVVSKEFLQILHSKSSWEEKYKKIKSLGWNYESFFSVWIMPRLNHDNPKVREFIKNVILFWTNKGVDGFRMDVAHGVPPEVWKEVREALPKEKYLIGEVMDDARLWLFDKFHGVMNYRLYDAILRFFGYEEITAEEFLNELELLSSYYGPAEYLMYNFLDNHDVERFLDIVGDKRKYVCALVFLMTYKGIPSLFYGDEIGLRGINLQGMESSRAPMLWNEEEWDQRILEITKTLVKIRKNNKALLFGNFVPVKFKRKFMVYKREHMGERTIVAINYSNSRVKELGITIPEYSGVIINEDKVKLIKY

SEQ ID NO: 13574 - DNA, 1614 bp, Streptococcus pyogenes MGAS8232
  CDS (1)..(1614): transl_table=11
atgaagaaacactggtggcataaagctacgatttatcagatttacccgagatcctttaaagacaccaatggcaatggtattggtgatttaaaaggcattaccagtcaactggactacttgcaaaaacttggcattacagccatttggttatctcctgtttaccaaagtccaatggatgacaatggttatgacatctctgactatgaagcgattgctgatgtttttggagacatggcagatatggatgagctcttggcagcagctaatgagcgaggcattaagattatcatggacttggtggtcaaccatacgtctgatgagcacgcttggtttgttgaagctagggaaaactctaatagtcctgagcgtgatttttatatttggcgagatgaacctaacgatttgacttctatttttagtggctcagcttgggaatatgataatgcatcagggcaatattatttgcacctttttagcaaacgtcagccagatctcaactgggagaatgaagctttgcgtcataaaatttacgatatgatgaatttctggattgccaaaggcataggtggttttcggatggacgtgattgacctgattgggaaggttcctgacttggaaatcacaggtaacgggccgcggttacacgattacctcaaagaaatgaatcaagcaacctttggcaatcatgacgtgatgactgtcggtgagacttggggagcaacgcctgaaattgctcgccagtattctcgccctgaaaataaagagttatccatggtcttccaatttgagcatgtgggtcttcaacataaacctgacgctcccaagtgggattatgcggaagaactggatgttcctgctctgaaagctatttttagcaagtggcagacagaattaaagttgggagaaggctggaattcacttttttggaataaccatgacttgccacgggtcttatccatttggggcaatgacagcacttaccgagaaaaatcagccaaggctttagctattttactgcatttgatgcgaggaaccccttacatttaccaaggagaagagattggcatgaccaattatccttttaaagacttaaccgaggttaatgatattgagtcccttaactatgctaaagaagctatgggaaatggagtgtcagctgcgcgtgtgatggatagcatccgtaaggtaggacgagacaatgctagaacgccgatgcagtggtctaaggatacacatgctggcttttctaaagcccaagagacttggttgccggtcaaccccaactaccaagacatcaatgtggccgatgcccttgctgatccagattctattttttacacttaccaaaaattgattgccttgcgtaaggagcaagactggctagttgaagcggattatcacctcttgccaacagctgataaagtgtttgcttatcagcgtcagcttggagaagagacatatgtgattgttgtcaatgtgtctgatcaagagcaagtctttgccaaagatttagcgggtgcagaagtggtcatcaccaatacagatgtggacaaagtgttagagaccaagcacttacaaccttgggatgccttttgtctcaaactgaaggcctag

SEQ ID NO: 13575 - protein, 537 aa, Streptococcus pyogenes MGAS8232
MKKHWWHKATIYQIYPRSFKDTNGNGIGDLKGITSQLDYLQKLGITAIWLSPVYQSPMDDNGYDISDYEAIADVFGDMADMDELLAAANERGIKIIMDLVVNHTSDEHAWFVEARENSNSPERDFYIWRDEPNDLTSIFSGSAWEYDNASGQYYLHLFSKRQPDLNWENEALRHKIYDMMNFWIAKGIGGFRMDVIDLIGKVPDLEITGNGPRLHDYLKEMNQATFGNHDVMTVGETWGATPEIARQYSRPENKELSMVFQFEHVGLQHKPDAPKWDYAEELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSKAQETWLPVNPNYQDINVADALADPDSIFYTYQKLIALRKEQDWLVEADYHLLPTADKVFAYQRQLGEETYVIVVNVSDQEQVFAKDLAGAEVVITNTDVDKVLETKHLQPWDAFCLKLKA

SEQ ID NO: 13576 - DNA, 1725 bp, Thermoanaerobacter tengcongensis MB4
  CDS (1)..(1725): transl_table=11
atgataaaagaggctatattccacaaaagcgatataccttatgcatatcctgtaaataaagaccaattaaaaatagtcttgagaacggcagttttcgatgtggatagggtatacattctttttaaagacaggtatgactggctgggcaaatttaaaataaagcctatgaccttagttcacactaacgagctttttgactattatgagactactcttgaattaaataagaggtttttgtactttttttatttagtttcagaaacgggagaaaaactttattacacagaagctggttttttcaaaaagaggccagaggatagcttctggggttttttccactatccctatataagggaaaaggatatattttctcctccggattgggcaaacgagtgcatagtgtatcagatatttccagacagattcaacaatggagacagaactaatgaccccgaaaacgtaaagccatggggggaaaagccgactgcagattctttttttggaggggatttacagggaataatcgacaaaatagattatttaaaagagttagggataaatgccatttatttaactccaatatttttgtctccttctactcacaaatacgacaccacggattattacacgatagaccctcattttggtgacacggaaaaagctaaagaattggtgaggaagtgtcatgacaatggcataaaagttatattcgatgcagtgttcaaccactgtggatacgacttttttgcatttcaggatgtggttaaaaatgggccgaagtcaaagtactgggattggttcaatgtgtacgaatggcccattaaaacgcatcccaaacctacttacgagacttttggcgagaatgtgtggagaatgcctaagcttatgactaaaaacccggaagtgcaaaagtacctactggaagtggctgaatactggattaaagaagtagacattgacggctggcgattggacgttgccaacgaaatagaccatcacttctggagaaagtttagagaggttgtaaaaaatgccaaaaaagatgccataatagtaggagaagtgtggcatgatgcttctccgtggttaagaggggaccagtttgactctgtcatgaattatccttttagaaatgcagttgtagacttttttgcgaagaggaaaataagtgctgtaaaattcaacacactgataactgagcagcttatgagacacatggatagcgttaatagagtcatgtttaacctcataggtagtcacgacactgaaaggtttttgactctcgcaaatggcatggtggcgcggatgaaattagctttggttttccagtttacatttgtgggagtgccgtacatctactatggagacgaagctggaatggtgggaggatttgaccctgactgcagaaggtgcatgatatgggaggaggaaaagcagaacaagggactttttgagttttacaaaaagctcatccgcataagaaaggagcatgaagaacttaagtatggcaatttcaccactttgtacgctgttggaagggtgtttgcttttagaagggaatataaaggaaattcaattgtggtgattataaacaacagcagcaaagaggaagtgatatttttagaagaggcgggaggaaaagaggatatattaaaaatgggagaattaaaaaggagtggcaatttgctgtatcttaagcctaacactgcctatattttgaagtag

SEQ ID NO: 13577 - protein, 574 aa, Thermoanaerobacter tengcongensis MB4
MIKEAIFHKSDIPYAYPVNKDQLKIVLRTAVFDVDRVYILFKDRYDWLGKFKIKPMTLVHTNELFDYYETTLELNKRFLYFFYLVSETGEKLYYTEAGFFKKRPEDSFWGFFHYPYIREKDIFSPPDWANECIVYQIFPDRFNNGDRTNDPENVKPWGEKPTADSFFGGDLQGIIDKIDYLKELGINAIYLTPIFLSPSTHKYDTTDYYTIDPHFGDTEKAKELVRKCHDNGIKVIFDAVFNHCGYDFFAFQDVVKNGPKSKYWDWFNVYEWPIKTHPKPTYETFGENVWRMPKLMTKNPEVQKYLLEVAEYWIKEVDIDGWRLDVANEIDHHFWRKFREVVKNAKKDAIIVGEVWHDASPWLRGDQFDSVMNYPFRNAVVDFFAKRKISAVKFNTLITEQLMRHMDSVNRVMFNLIGSHDTERFLTLANGMVARMKLALVFQFTFVGVPYIYYGDEAGMVGGFDPDCRRCMIWEEEKQNKGLFEFYKKLIRIRKEHEELKYGNFTTLYAVGRVFAFRREYKGNSIVVIINNSSKEEVIFLEEAGGKEDILKMGELKRSGNLLYLKPNTAYILK

SEQ ID NO: 13578 - DNA, 1575 bp, Thermoanaerobacter tengcongensis MB4
  CDS (1)..(1575): transl_table=11
atgagaaaaaatttaaaagcatttgtggcgctttttgcagcaattttgctgttctttagtgggtgcagtagcaagcaagaggcaaaagccccaaagtcagaagtcatatatcaggttatggtggataggttttacaacggagacccttcaaatgacgacccagaagtgagcaaaggaatgtttgaccccacccataccaactggaggatgtactggggaggggatttgaaaggactgacagaaaaaatcccttatataaaggggatgggggtcactgctatctggatttctccagtagtggataatataaataaaccagccgtatataatggcgagattaatgccccctatcacggatactgggcaagagatttcaaaagagtagaagaacactttggtacatgggaggactttgacaattttgtaaaggttgcgcatgagaatggaataaaagtgattttagattttgcgccaaatcacacgagccctgccgatgaagaaaatcctgattttgcagaaaatggcgcattatatgacgatgggaagctattaggtacttacagtaatgattcacttaagctttttcaccacaatggcagcataagcaactggaataatttaaaggaacttcaggataaaaatttgtttgatttggcagatttggaccagagcaaccctattgttgataaatacttaaaagactctattaagttatggtttaatcatgaaattgatggagtaaggctggatgctgcaaagcatatgcctatggagtgggtgaaaagctttgctaacactatttacagtattaaaaaggatgtgcttctttttggtgaatggatgttaagcggtcctactgacccgttgtatgggtataatatacagtttgctaatactaccggcttttctgtcctggattttatgttaaacggtgctataagagatgtatttggcaaggggtacggatttgagaggttaaatgacacgttagaggataccaataaagattacgaaaatccttataagctggttgcttttatagacaaccatgacatgcctagatttctgtccttgaacaatgacaaggataaattacacgaagctattgcttttgtaatgacgactcgagggatacctgtaatatactatggcactgagcagtaccttcataacgacacaaatggcggtaatgacccgtataatagaccaatgatggaaaagttcgatgagagcacaaaggcttatacattgataaaagagctgtcaaggttaaggcagctcactccagccctacagtatggaactactacggcaaggtatatttctgacgatgtgtatatttatgaaaggcagtatggaaaagatgtggtgctggttgcgataaataaaggagagaaaactactgttaaggcagtaaaaacatctttgaggaagggaatttataaagactaccttaaaggtctgttggagggtgttgagttaaaagtcacaaaaggcaatggagaaaacctagtgcaaggtttgactttacctggggacagcgtaagtgtgtggacaaatgtgaaagcgaagtaa

SEQ ID NO: 13579 - protein, 524 aa, Thermoanaerobacter tengcongensis MB4
MRKNLKAFVALFAAILLFFSGCSSKQEAKAPKSEVIYQVMVDRFYNGDPSNDDPEVSKGMFDPTHTNWRMYWGGDLKGLTEKIPYIKGMGVTAIWISPVVDNINKPAVYNGEINAPYHGYWARDFKRVEEHFGTWEDFDNFVKVAHENGIKVILDFAPNHTSPADEENPDFAENGALYDDGKLLGTYSNDSLKLFHHNGSISNWNNLKELQDKNLFDLADLDQSNPIVDKYLKDSIKLWFNHEIDGVRLDAAKHMPMEWVKSFANTIYSIKKDVLLFGEWMLSGPTDPLYGYNIQFANTTGFSVLDFMLNGAIRDVFGKGYGFERLNDTLEDTNKDYENPYKLVAFIDNHDMPRFLSLNNDKDKLHEAIAFVMTTRGIPVIYYGTEQYLHNDTNGGNDPYNRPMMEKFDESTKAYTLIKELSRLRQLTPALQYGTTTARYISDDVYIYERQYGKDVVLVAINKGEKTTVKAVKTSLRKGIYKDYLKGLLEGVELKVTKGNGENLVQGLTLPGDSVSVWTNVKAK

SEQ ID NO: 13580 - DNA, 1719 bp, Streptomyces coelicolor A3(2)
  CDS (1)..(1719)
atgaccgtcaacgagcccgtacctgacaccttcgaggacacccccgcgggggaccggcacccggactggttcaaacgagccgtcttctacgaggtcctcgtccgctccttccaggacagcaacggcgacggcatcggtgatctcaagggcctgaccgccaagctggactacctgcaatggctcggcgtggactgcctgtggctcccgcccttcttcaagtcaccgctgcgcgacggcggttacgacgtctccgactacaccgccgtgctgccggagttcggcgacctggccgacttcgtggagttcgtggacgcggcgcaccagcgcggcatgcgcgtgatcatcgacttcgtcatgaaccacaccagcgaccagcacccgtggttccaggagtcccgcaagaacccggacggcccctacggcgactactacgtctgggccgacgacgacacccggtacgccgacgcccgcatcatcttcgtcgacaccgaggcctccaactggacccacgacccggtccgcggccagtactactggcaccggttcttctcccaccagccggacctcaactacgagaacccggccgtgcaggaggagatgctcgccgccctgaagttctggctggacctgggcgtggacggctaccgtctcgacgccgtgccctacctgtacgccgaggagggcaccaactgcgagaacctgcccgcctcccacgcgttcctcaagcgggtgcgccgcgagatcgacgcgcagtacccggacaccgtactgctggccgaggccaaccagtggccggaggacgtggtcgactacttcggcgactactccacgggcggcgacgagtgccacatggccttccacttccccgtcatgccccgcatcttcatggccgtgcgccgcgagtcccgctacccggtctccgaaatcctcgccaagacccccgcgatcccgtccggctgccagtggggcatcttcctgcgcaaccacgacgagctgaccctggagatggtcaccgacgaggaacgcgactacatgtacgcggagtacgccaaggacccgcgcatgcgcgccaacatcggcatccgccggcggctggccaccctgctggacaacgaccgcgaccagatcgagctgttcaccgccctgctgctcgccctcccgggatccccgatcctctactacggcgacgagatcggcatgggcgacaacatctggctcggcgaccgcgacgccgtgcgcacccccatgcagtggacgcccgaccgcaacgccggcttctcgacctgtgacccgggccgcctctacctgcccgcgatcatggacccggtctacggctaccaggtgacgaatgtcgaggcgtccatggcctcgccctcctccctgctgcactggacccggcgcatgatcgagatccgcaagcagaaccccgccttcggcctcggcacctacaccgaactgccctcctccaacccggcggtgctcgccttcctgcgggagtacgaggacgacctggtgctgtgcgtgaacaacttcgcacggttcgcccagcccaccgagctggatctgcgcgagttcgccggacgccatccggtcgagctgttcggcggggtccgcttccccgccatcggcgaactgccgtacctgctgaccctcgggggccacggcttctactggttccggctcacccgagtcgcatcccgcatcggccgccgcgcttga

SEQ ID NO: 13581 - protein, 572 aa, Streptomyces coelicolor A3(2)
MTVNEPVPDTFEDTPAGDRHPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRKNPDGPYGDYYVWADDDTRYADARIIFVDTEASNWTHDPVRGQYYWHRFFSHQPDLNYENPAVQEEMLAALKFWLDLGVDGYRLDAVPYLYAEEGTNCENLPASHAFLKRVRREIDAQYPDTVLLAEANQWPEDVVDYFGDYSTGGDECHMAFHFPVMPRIFMAVRRESRYPVSEILAKTPAIPSGCQWGIFLRNHDELTLEMVTDEERDYMYAEYAKDPRMRANIGIRRRLATLLDNDRDQIELFTALLLALPGSPILYYGDEIGMGDNIWLGDRDAVRTPMQWTPDRNAGFSTCDPGRLYLPAIMDPVYGYQVTNVEASMASPSSLLHWTRRMIEIRKQNPAFGLGTYTELPSSNPAVLAFLREYEDDLVLCVNNFARFAQPTELDLREFAGRHPVELFGGVRFPAIGELPYLLTLGGHGFYWFRLTRVASRIGRRA

SEQ ID NO: 13582 - DNA, 3351 bp, Xanthomonas campestris pv. campestris str. ATCC 33913
  CDS (1)..(3351): transl_table=11
atgaatgcagttccagcccttcaggctgacgcagaacaatcggcagtggttgccgaccagctttggtacaaggacgcgatcatctaccaggtgcacgtcaagtcgttcttcgactccaatgacgatggcatcggcgatttccccggcctgatttccaagctcgactacatcgccgaactgggcgtggacacgatctggttgctgccgttctaccccagcccgcgccgcgacgacggctacgacatcgccgaatacatggcggtgcatccggactacggcaccatcgccgacttcgagcagctggtggcgcaggcgcatgcgcgcggcatccgcatcgtcaccgagttggtgatcaaccacacctccgatcagcatccgtggtttcagcgcgcccgcaacgcgccggctggttcgccggagcgcgacttctacgtctggtcggacaccgaccaggaatacgaaggcacgcgcatcattttctgcgataccgaaaagtccaactggacctgggacccggtggccggccagtacttctggcaccggttctattcgcaccagcccgatctcaacttcgacaacccggcggtgctggaatcggtgctggaagtgatgcgcttctggctggaccgcggcgtggacggcctgcgcctggatgcggtgccgtatttgatcgagcgctcgggcacctcgaatgaaaacctgccggaaacccacgccatcctgcgcaagatccgcgccacgctggatgccgaatacccggaccgcatgctgctggccgaggccaacatgtggccggaagacacccagcaatacttcggccaaaacgccgacgaatgccacatggcgttccacttcccgctgatgccgcgcatgtacatggcgatcgcgcgcgaagaccgcttccccatcaccgacatcatgcggcagacaccggagatcccggagacctgccagtgggcgatcttcctgcgcaaccatgacgagttgacgctggaaatggtcaccgattcggagcgcgattacctgtggcagacctatgcctcggaccgccgcgcgcgcatcaacttaggcatccgccgccgcctggcgccgctgctggagcgcgaccgccgccgcatcgaattgatgacctcgttgctgctgaccatgcccggcacgccggtgctgtattacggcgatgagatcggcatgggcgacaacatccatctgggcgaccgtgatggtgtgcgtaccccgatgcagtggtcgatcgaccgcaacggtggcttctcgcgtgccgacccggctgcactggtgctgccgccggtcatggacccgctgtacggcttccaggcggtgaacgtggaagcgcagatccgcgaccagcattcgctgctgacctggacccgccgcgtgctcagcgtgcgcaagcgctaccaggcgttcggccgcggcacgctgcgctttttgtacccgggcaaccgccgcatgctggcctacctgcgctgctatcaggacgaaaccgtgctgtgcgtggccaacctctcgcacaccttgcaggcggtggagttggacctgtccgagttcgaaggccgcgtgccggtggacatcatcggcggtggcagcttcccgccgattggccggctgacctatctgctgaccgtgccgccatttggtttctatgcgttccagctggtcagcgaaggcacgctgccggactggcatgtgcccagcccggtgccgttgccggattaccgcacgctggtgctgcgcagcgacaccgaagagagcgccgcactgctgccgcatctggccacgctggaaggcgagatcctgccggcgtggttatcggcacgccgctggttctcggccaaggaccaggcgctcaagagcgtgcgcatttctcggcgcacaccgttgccgggcgatgagccgatgagcctgctggagctggatgtggagctggaagacggccaccacgagtgctacatgctgccggtgggcatcgtctgggagcgcgagcacccgagcacgctggccgagcagctggcgctggcgcgcgtgcgccagggccgcgaggtggggtatctcaccgacgcgttcgcgctcaagccgatggtgcgcggcgtgatcgatgcactgcgccacgacgcggcgctggatttccacgacggcgacgatgcctcgcaacaaggccaggtgcgtttcgaatcgaccccggcgctggccgcgctggagattccggacgacccggagatccgctggttgtcggccgaacagagcaacagctcgctggtcgttgcggacaaggcggtgttcaagctgctgcgccacgtggccaccggtgccaatccggaaatcgagatcggccgccgcctcaccgagatgggctacgccaatgcggcgccgctgctgggcagcgtgagccgggtggacgcgcagggcaccatcaccaccatcgcactgttgcagggcttcatccgcaaccagggcgatgcctggcgttggacgctcgatcacctggcgcgcagtttcgacgaatacgccaccgcgcagaccgacgaagcccgcaacgaagcggtggccggctacgacgcgtttgccgcagtggtgggcaagcgcctggccgagttgcacgaggcactctcgcgcagcaccgacgatgccgacttcgcaccacagcgtatcgacctgcccacagccaacgatgtggtgggcggcgtggcacgccaggtggaggaaatgtgggaaacagtgcacgcccgcctgggcgccaccgacgatgcggccgaacgcgaggcgctggaatcggtgctggccgaacgcccgcagctggatgcgctgctggccaaggcgccaagcgtgctggccgaatcgctgttgacccgcgtgcatggcgacttccacctgggccagatcctggtggcgttcgacgacgtggtgctgatcgacttcgaaggcgagcccgccaagccgctggccgagcgccgcgccaaggccagcccgttgcgcgatgtggccggtttcctgcgctcgctcgattacgccagcgaagtgtctgcgcgtggcgaagagggcaccgccgcacgtgccggtgtgggggtggatgcgcacctggatgacttcctggtggaattccgccgccgctccacgcaatcgttcctggacgcttaccatgccgtgctcgacgccagcgcgcatccgtggatcgcgccggcggcgttcaatgcggccaccttgctgttcctggtggagaaggcctgctacgaggtgcgctacgaagcggcgaaccggccgggctggttgatggtgcccatccagggcttgcgacgcatcctgcaacgcgcgcgcgctggtgcgggagacacatga

SEQ ID NO: 13583 - protein, 1116 aa, Xanthomonas campestris pv. campestris str. ATCC 33913
MNAVPALQADAEQSAVVADQLWYKDAIIYQVHVKSFFDSNDDGIGDFPGLISKLDYIAELGVDTIWLLPFYPSPRRDDGYDIAEYMAVHPDYGTIADFEQLVAQAHARGIRIVTELVINHTSDQHPWFQRARNAPAGSPERDFYVWSDTDQEYEGTRIIFCDTEKSNWTWDPVAGQYFWHRFYSHQPDLNFDNPAVLESVLEVMRFWLDRGVDGLRLDAVPYLIERSGTSNENLPETHAILRKIRATLDAEYPDRMLLAEANMWPEDTQQYFGQNADECHMAFHFPLMPRMYMAIAREDRFPITDIMRQTPEIPETCQWAIFLRNHDELTLEMVTDSERDYLWQTYASDRRARINLGIRRRLAPLLERDRRRIELMTSLLLTMPGTPVLYYGDEIGMGDNIHLGDRDGVRTPMQWSIDRNGGFSRADPAALVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDTEESAALLPHLATLEGEILPAWLSARRWFSAKDQALKSVRISRRTPLPGDEPMSLLELDVELEDGHHECYMLPVGIVWEREHPSTLAEQLALARVRQGREVGYLTDAFALKPMVRGVIDALRHDAALDFHDGDDASQQGQVRFESTPALAALEIPDDPEIRWLSAEQSNSSLVVADKAVFKLLRHVATGANPEIEIGRRLTEMGYANAAPLLGSVSRVDAQGTITTIALLQGFIRNQGDAWRWTLDHLARSFDEYATAQTDEARNEAVAGYDAFAAVVGKRLAELHEALSRSTDDADFAPQRIDLPTANDVVGGVARQVEEMWETVHARLGATDDAAEREALESVLAERPQLDALLAKAPSVLAESLLTRVHGDFHLGQILVAFDDVVLIDFEGEPAKPLAERRAKASPLRDVAGFLRSLDYASEVSARGEEGTAARAGVGVDAHLDDFLVEFRRRSTQSFLDAYHAVLDASAHPWIAPAAFNAATLLFLVEKACYEVRYEAANRPGWLMVPIQGLRRILQRARAGAGDT

SEQ ID NO: 13584 - DNA, 1617 bp, Xanthomonas campestris pv. campestris str. ATCC 33913
  CDS (1)..(1617): transl_table=11
atgtcgcagacaccatggtggcgcggggccgtcatttatcagatttatccgcgtagttttctggattccaatggcgatggcgtaggcgatctgccgggcatcattgccaagctcgactacatcgccgggctgggagtagatgcgatctggatttcgccttttttcaagtcgccgatggccgatttcggctatgacatcgcagactatcgcgcggtggacccgttgttcgggtcgttggtcgatttcgatcgcttgctcgaaaaggcacatggccttgggttgaaagtgatgatcgatcaggtactgagccattcctcgatcgcgcatgtgtggtttcaggagagccgacaggaccggagcaacccgaaggctgattggtacgtgtgggccgatccgcgcgaggatggaacgccgccgaacaactggctgtcgttgtttggtggggtcgcatggcagtgggagccgcggcgtgagcagtactacctgcacaactttctggtggaccagcccgatctcaatttccacaacgccgaggtgcagcaggcaacgctcgataacgtgcggttctggctcgatcgcggtgtggatgggttccgtctggatgcgatcaacttctgctttcacgacgcgcaactgcgcgataacccggccaagccggcagacaagcgggtggggcgcggcttcagcgcggacaatccttacgcctaccagtatcattacttcaacaacacgcagccggaaaatctagcgttcctcgagcgcctgcgcgggctgctggatctttatccgaatgcagtgagccttggcgagatctcgtcggaagattcgctggccaccaccgccgaatacaccgcccagggccgcttgcatatgggctacagcttcgagctgctggtgcaggattacagcgctgcctacatccgcgacaccgtaagccggctcgaggccaccatgttggagggctggccatgctgggccatttccaatcacgacgtagtgcgcgcggtaacgcgctggggtggggcgcatgcgacgccggcgttcgcgcggatggtggtggcgctgctgtgttcgctgcgtggatcgatctgcctatatcagggcgaagagctcgggctcagtgaggcagaggtggcgttcgaggacctgcaggatccgtatggaataactttctggccgaccttcaagggccgggatggctgccgtacgccgatgccatggaccgacgcgccatctgccggattcaccagcggcaagccttggctgccgttagctgcgtcgcatcgtgccgctgctgtgagcgtgcaacaggatgatgcgcattccgtgttgagtgcagtacgggattttctagcttggcgcaaagagatgccggcgctgcgtgagggatccatcgctttctacgacacggccgaaccggtgctgatgttccgccgcgaacacgccggccaggttgtgctgttggcattcaatctgtccgccgatcctgccgacctggctttgcctgcaggcgagtgggagcaggtcgatgtacctggtgtcgagcttggggcgatggatggcggacacctaaggctggccgggcatgcggtcgttgctgctgtcggtcgtggctga

SEQ ID NO: 13585 - protein, 538 aa, Xanthomonas campestris pv. campestris str. ATCC 33913
MSQTPWWRGAVIYQIYPRSFLDSNGDGVGDLPGIIAKLDYIAGLGVDAIWISPFFKSPMADFGYDIADYRAVDPLFGSLVDFDRLLEKAHGLGLKVMIDQVLSHSSIAHVWFQESRQDRSNPKADWYVWADPREDGTPPNNWLSLFGGVAWQWEPRREQYYLHNFLVDQPDLNFHNAEVQQATLDNVRFWLDRGVDGFRLDAINFCFHDAQLRDNPAKPADKRVGRGFSADNPYAYQYHYFNNTQPENLAFLERLRGLLDLYPNAVSLGEISSEDSLATTAEYTAQGRLHMGYSFELLVQDYSAAYIRDTVSRLEATMLEGWPCWAISNHDVVRAVTRWGGAHATPAFARMVVALLCSLRGSICLYQGEELGLSEAEVAFEDLQDPYGITFWPTFKGRDGCRTPMPWTDAPSAGFTSGKPWLPLAASHRAAAVSVQQDDAHSVLSAVRDFLAWRKEMPALREGSIAFYDTAEPVLMFRREHAGQVVLLAFNLSADPADLALPAGEWEQVDVPGVELGAMDGGHLRLAGHAVVAAVGRG

SEQ ID NO: 13586 - DNA, 1617 bp, Xanthomonas axonopodis pv. citri str. 306
  CDS (1)..(1617): transl_table=11
atgttgcagacaccatggtggcgcggggccgtcatctatcagatctatccgcgtagctttccggattccaatggcgatggggtcggcgatctgccgggcatcatcgccaagctcgactacatcgctgggctgggcgtggatgccatctggatctcgccgtttttcaagtcgccgatggcagatttcggctatgacatcgcggactaccgtgcggtggatccgttgttcggaacgctggacgatttcgaccgtctgctcgacagggcgcatgcgcttggcctgaaggtgatgatcgatcaggtgttgagccacacctcgatcgaacatgcgtggttccaggaaagccggcaggaccggaccaatgcgaaggcggattggtatgtgtgggccgatccgcgcgaggacggaacgccgcccaacaactggttgtcgctgttcggtggtgtggcgtggcagtgggagccgcggcgcgagcagtactacctgcataacttcctggtcgatcagccggacctcaatttccataatgcggaggtgcagcaggcaaccctggacaatgtgcggttctggttggatcgtggagtagatggctttcgcctggacgcgatcaacttctgcttccatgacgcgcagctgcgcgataacccggccaagccggccgacaagcgggtggggcgtggctttagcgcggacaatccgtacgcctatcagtaccactacttcaacaacacgcagccggagaacctggcgttcctggagcgcctgcgtgcgctgctcgatcgctatccggatgcggtaagcctgggcgaaatctcttcggaagactcgctggcgaccacggccgaatacaccgccaagggccgcttgcacatgggctacagcttcgagctgttggtgcaggattacagcgcggcgtacatccgcggaacggtcagcaggctcgaggccaccatgttggaaggatggccgtgctgggccatttccaaccacgatgtggtgcgtgcggtgacgcgttggggcggtgaagatgcgtcgcctgcgttcgctcgcatggtagttgcgctgctatgttcgttgcgtggctcggtttgcctgtaccagggcgaggagcttgggctaggcgaggcggatgtggcgttcgaggatctgcgggatccgtacggcatcacgttctggccgaccttcaagggccgcgatggatgccgtacgccgatgccgtggaccgatgcgccgtcggcgggtttcaccagcggcaagccgtggttgccgttgtccgagccgcatcgtctggctgcagtgagtgtgcagcaggacgatgcccagtctgtgctgcgcgcagtgcgggcatttctgagttggcgcaggagcatgccggccctgctcgaaggggcgatcgcgttctacgacatcgcagagccggtgctgatgttccggcgtgagcatgcgggccaggtcatgctgttggcgttcaatttgtctgcagacatcaccgagctggcactgcctgcgggtgcatggcgccagatcgatgtgccgggggtggagcgtggcgtgatcgagcatggccgcgtgcgcttgccggggcatgctgtggtttgcgcaatgggcgggcagtga

SEQ ID NO: 13587 - protein, 538 aa, Xanthomonas axonopodis pv. citri str. 306
MLQTPWWRGAVIYQIYPRSFPDSNGDGVGDLPGIIAKLDYIAGLGVDAIWISPFFKSPMADFGYDIADYRAVDPLFGTLDDFDRLLDRAHALGLKVMIDQVLSHTSIEHAWFQESRQDRTNAKADWYVWADPREDGTPPNNWLSLFGGVAWQWEPRREQYYLHNFLVDQPDLNFHNAEVQQATLDNVRFWLDRGVDGFRLDAINFCFHDAQLRDNPAKPADKRVGRGFSADNPYAYQYHYFNNTQPENLAFLERLRALLDRYPDAVSLGEISSEDSLATTAEYTAKGRLHMGYSFELLVQDYSAAYIRGTVSRLEATMLEGWPCWAISNHDVVRAVTRWGGEDASPAFARMVVALLCSLRGSVCLYQGEELGLGEADVAFEDLRDPYGITFWPTFKGRDGCRTPMPWTDAPSAGFTSGKPWLPLSEPHRLAAVSVQQDDAQSVLRAVRAFLSWRRSMPALLEGAIAFYDIAEPVLMFRREHAGQVMLLAFNLSADITELALPAGAWRQIDVPGVERGVIEHGRVRLPGHAVVCAMGGQ

SEQ ID NO: 13588 - DNA, 3327 bp, Chlorobium tepidum TLS
  CDS (1)..(3327): transl_table=11
atgcctaaaaaacaagctgtaacaagctatcagccggagtcgctctggtacaaggatgccattatttatgaactacatgtcaaaaccttctgtgacagcgataacgatggcatcggtgattttcgcggcctgaagagccgcctcggctaccttgaaagcctcggagtgacggcgatctggattctgccgttctacccctcgccactgcgcgacgacggctacgacatcgccgattacaagtcggtcaatcccgactacggcacgatcgaggatttccgcgacttcctcgaagaggcgcatcggcgcggcatcaaggtgattaccgagctggtggtgaaccacacctccgaccagcacgagtggttcaaaaaagcccgcaaggctccgaaagggtcgccggagcgcgacttttacgtctggagcgacgacccgacgaagtatggcgaggcgcgcattattttccaggacttcgaggcttcgaactggacctgggatcccgtggctggccagtactactggcaccgctttttccatcaccagcccgacctgaacttcgagaatcccgccgtgcaccaggcgctgttcgacgtgctcgatttctggctcggcatgggagtggatggcctgcggcttgatgccgtaccctacctctacgaggctgaaggcaccaactgtgagaacctgccgcagaccttcgagttcctgcgcaagctgcgctcttatgtggacgagcattatcccaaccggatgcttcttgccgaggctaaccagtggccggaggactccgccgcctatcttggcaagggggacatgtgccacatgaacttccatttcccgctcatgccgcgcatgtatatggcgctggctaccgaggatcgttttccgatcatcgacattctcgcccagacgcccgaaattccggagagctgccagtgggcgtcgttcctgcgcaaccacgacgagctgacgcttgaaatggtgaccgacgaggagcgcgactacatgcgccgcgtttatgcccacgatgtcaaggcgcgcatcaacctcggcatccgccgccgcctcgcgccgctcatgtcgaacgaccgccgccgcatcgagctgatgaacatcatgctgctctccctgcccggtactccggtgctctattacggcgacgagatcggcatgggcgacaactactacctcggcgaccgtgacggcgtgcgcaccccgatgcagtggaacgccgaccgcaacgcgggcttttcgcgtgccaatccgcagcgcctgcttctgccggtgatcatcgaccccgagtaccactatgaagcggttaacgtcgaggtgcaggagtccaatcccaactcgctgctctggtggatgcgccacaccatcgccacggcccgccgcttccgagcgttcagccgcggcaccatcgagttcctcaacgccaacaaccccaaggtgctgatgtttatccgctcgtacgaagatgaaaccatcctcaccgtgatcaacctgtcccgcaacgcacaggtgatcaacgtcgatctttccgcttatgagggatgcgtgccggaggagattttcagcatgaaccgcttcccgagagtgcacaaaacaccatatatggtcgcgctcggaccatacggctatttctggcttcggctgatccgcgaggagtcgccggcggacaggtctgccctgcttgaaaaggttgcccttcgtgccggaagctggcaggagctgtttgttggccgcagtctcgaccagttcgaaaccgctattctgccaccctattacaagagcgtgcgctggttcgggggcaaagcccgcaatatcatcagaatcagggtgaccgataccgtgccggtcgccggaatggagaacactgcgtttgcgatgactgaagtgaactatccgagtggcgagaatgaacgctaccagcttccgctgaccttcgtgccagtggagcgaggtaaccttgcggatgagttgttctaccgtcatgccatagcaagggttgaacttgatggccttgaagggttcctcatcgacgcttcagccgacgagaccttccgttcaaggctgctcgatcttatcctgcacagagagacctggtccggcgcagctggcaagatcaccgcggatgccggcaagatgctcgaaaacagttgcctctcgaccgccggcgaagagccgcccgcctcgcatctgatgggcctggaacagagcaatacctcgattcgctacggtgagcagctctgcctgaagctctaccgcaagatcgacagcggcatggcacccgaaatcgaaatctcccgcgtgctgaccgatcagacagagtaccggaacattccggtctatctcggctcgtttgactacggcaaaagctaccgggagcgctgttcgctcggcattctccagaatttcgttccgaatgaatccgacggctggcagttgagtctcggccatgtccgccggtactatgaggatgtattgtcgcgctgttcgcagggcgtgcttccgccaacgctgccggaactttctggcaccacaagcaaactgccggagcttatccatgagctgatcggcgagttctatttccagatggtcggcaagcttgctgagcgcacggccggtatgcatcgtgcgctcggctctgtcgataccgatgctgctttctcgcccgagccgttcacgacgctctaccagcgctccatctatcaggcgatgactgaccaggtcaagcgcagcatgatcttcctgcgtgaatccatacacgccgttcccaaggaggcccgtccgcttgcccataagctgctcgatatgcagaaggagattctcgaacagttcgagccgatccgcaaggagaagatcgacacggtcaagatcaggattcacggtgactaccatctcggccaggtgctctacaccggtaatgacttcgtgattctcgatttcgagggcgagccggcccgctcactctcggagcgcaagatcaaacgctcggtctaccgcgacctcgcgggtatgctgcgttcgttcgactacgcggccttcaacgtgctgatgcagaaccaggctatccggcccgaagatcgcaaggcgctcgagccgtgggccgagctttggagctactatgttggtcagcattttatcgatgtctatacgcagcaaaccgaaggttcgggcctgattcccaaagagccgcgccagcgtgagctgctcctgcgcagctacctgatgaacaaggcgatctacgagctgaactacgagctgaacaaccgccccgagtggctgccgattccaatgaacggcatcctgcgcctcatccgtaactga

SEQ ID NO: 13589 - protein, 1108 aa, Chlorobium tepidum TLS
MPKKQAVTSYQPESLWYKDAIIYELHVKTFCDSDNDGIGDFRGLKSRLGYLESLGVTAIWILPFYPSPLRDDGYDIADYKSVNPDYGTIEDFRDFLEEAHRRGIKVITELVVNHTSDQHEWFKKARKAPKGSPERDFYVWSDDPTKYGEARIIFQDFEASNWTWDPVAGQYYWHRFFHHQPDLNFENPAVHQALFDVLDFWLGMGVDGLRLDAVPYLYEAEGTNCENLPQTFEFLRKLRSYVDEHYPNRMLLAEANQWPEDSAAYLGKGDMCHMNFHFPLMPRMYMALATEDRFPIIDILAQTPEIPESCQWASFLRNHDELTLEMVTDEERDYMRRVYAHDVKARINLGIRRRLAPLMSNDRRRIELMNIMLLSLPGTPVLYYGDEIGMGDNYYLGDRDGVRTPMQWNADRNAGFSRANPQRLLLPVIIDPEYHYEAVNVEVQESNPNSLLWWMRHTIATARRFRAFSRGTIEFLNANNPKVLMFIRSYEDETILTVINLSRNAQVINVDLSAYEGCVPEEIFSMNRFPRVHKTPYMVALGPYGYFWLRLIREESPADRSALLEKVALRAGSWQELFVGRSLDQFETAILPPYYKSVRWFGGKARNIIRIRVTDTVPVAGMENTAFAMTEVNYPSGENERYQLPLTFVPVERGNLADELFYRHAIARVELDGLEGFLIDASADETFRSRLLDLILHRETWSGAAGKITADAGKMLENSCLSTAGEEPPASHLMGLEQSNTSIRYGEQLCLKLYRKIDSGMAPEIEISRVLTDQTEYRNIPVYLGSFDYGKSYRERCSLGILQNFVPNESDGWQLSLGHVRRYYEDVLSRCSQGVLPPTLPELSGTTSKLPELIHELIGEFYFQMVGKLAERTAGMHRALGSVDTDAAFSPEPFTTLYQRSIYQAMTDQVKRSMIFLRESIHAVPKEARPLAHKLLDMQKEILEQFEPIRKEKIDTVKIRIHGDYHLGQVLYTGNDFVILDFEGEPARSLSERKIKRSVYRDLAGMLRSFDYAAFNVLMQNQAIRPEDRKALEPWAELWSYYVGQHFIDVYTQQTEGSGLIPKEPRQRELLLRSYLMNKAIYELNYELNNRPEWLPIPMNGILRLIRN

SEQ ID NO: 13590 - DNA, 1668 bp, Yersinia pestis KIM
  CDS (1)..(1668): transl_table=11
atgaataatccaatcccttggtggcaacatggtgtcatctatcagatttacccgaagagctttcaggacagtaccggtaatggctatggtgacctggcaggcgttgcgcagcggctggattatctgcaaaagctgggcgttgatgccatttggctgacaccggtgtatgtctcgccacaagtggataacggttatgacgtggcggattactgcgccattgaccccgcttatggcacattggatgactttaaacgtttggtcgcgggtgctcatcagcgaggcatacgcatcatcatggatatggtgttcaatcacacctccacagaacatgcctggtttaaagcttcgcaggatcgtaatagcccttatcggcaattttatatttggcgtgacggtgacggtggagacggcagtttaccgaataactggcgctcgaaattcggtggtcacgcatggcagtggcacgcggccagcggccagtattatctgcatttgtttgccccagagcaggctgatctgaattgggaacaccaaccggtacgcgatgagctcaaaaaggtgtgtgaattttgggccgatctgggggttgatggtctgcgtttggatgtcatcaatctggtgtccaaacagcaggatttccctaatgatctggacggcgatggccgccgtttttataccgatggcccacgcattcatgagtttttgcaggaactgagccgcgatgtgttccagccacgccgcctgatgacggtaggcgagatgtcatccacccgtctcgagcattgtcagcgatatgcggcattaggcggtgatgagttatccatgacctttaatttccatcacctgaaagtggattatcttaacggtgaaaagtggtcattgatgccgccgaatcgggtggagttgaaacacatttttaatcagtggcagcaagggatgcacaaccgagcatggaacgcactattttggtgtaatcacgatcaaccacgcattgtctcgcgttttggtcatgaaggcgcactacgtttgccagcggcaaagatgctggcgatggtactgcacggtatgcagggcacgccttatatttatcagggggaagaaattggcatgacgaaccccaatttcactgatatcactcaataccgtgatgttgaaagcctgaatatgtttgccgaactgagtgtggcaggccgcgaacccgatgagttattggcgattctggcagctaaatcccgtgataatagccgtacccccatgcaatgggatagcagcgataatgcgggtttcagccaaggcactccctggattgccccttgcagcaattatcatgagattaacgttaatgccgcattggccgacgctgactcggtgttttatgcctatcaatacctgatagccctgcgtaaacaatacgatattttcactttcggtgattatcaggatctttgcccacagcaccctgatttatggtgctatttgcgcagttggcaagggaagcaactgttggtagtcgctaacctgagtgaagagccccagcgatggcaacccgagggcctcacgctggacggtaattggcaattattgatgagcagctacgaccaaagcgccttccaaccgcaagatatgatattacgcggatatgaggggatttattgggtatgtgagtaa

SEQ ID NO: 13591 - protein, 555 aa, Yersinia pestis KIM
MNNPIPWWQHGVIYQIYPKSFQDSTGNGYGDLAGVAQRLDYLQKLGVDAIWLTPVYVSPQVDNGYDVADYCAIDPAYGTLDDFKRLVAGAHQRGIRIIMDMVFNHTSTEHAWFKASQDRNSPYRQFYIWRDGDGGDGSLPNNWRSKFGGHAWQWHAASGQYYLHLFAPEQADLNWEHQPVRDELKKVCEFWADLGVDGLRLDVINLVSKQQDFPNDLDGDGRRFYTDGPRIHEFLQELSRDVFQPRRLMTVGEMSSTRLEHCQRYAALGGDELSMTFNFHHLKVDYLNGEKWSLMPPNRVELKHIFNQWQQGMHNRAWNALFWCNHDQPRIVSRFGHEGALRLPAAKMLAMVLHGMQGTPYIYQGEEIGMTNPNFTDITQYRDVESLNMFAELSVAGREPDELLAILAAKSRDNSRTPMQWDSSDNAGFSQGTPWIAPCSNYHEINVNAALADADSVFYAYQYLIALRKQYDIFTFGDYQDLCPQHPDLWCYLRSWQGKQLLVVANLSEEPQRWQPEGLTLDGNWQLLMSSYDQSAFQPQDMILRGYEGIYWVCE

SEQ ID NO: 13592 - DNA, 1830 bp, Yersinia pestis KIM
  CDS (1)..(1830): transl_table=11
atgcttagtggttggcaccttccggtctcgccttttgttcgtttggcagacgacgcattacatatcacgctctggttgcaaggtgatagtttacctgcgcaagtctttctgcgttgtgagccagataatgaagagtggctgctcactatggaggggcatgagagccatgatcgttggcgctatagcgtttctttaccgttatatgaggggcagccaacccggcgctactgcttcaaactattatgggatgaccgccaacagtggtttggcccgttggggttctcggtgattcctccagcacagttggcacagtttgctgtagatgtacccgatagcgggcctgattgggtcgcggaccaagttttttatcagatcttccccgatcgctttgccagtagtcaggcagatcatggtgtgcaggaggggagttatattcatcatgcggccggttgcccggtatctcgccgcgagtggcagcagccattggatgatgtgcatgccgcatcgacattttatggtggcgatctggccggtattagtcagaaaatcccttactttcaacaactgggggttacggcactgtatttgaaccctatttttaccgctcccagtgtgcataaatatgatactgaagattattatcaggttgatccctacttggggggagagcgtgatttcttgcaattgcgagccgctacccgtgaagtaggaataaagttggtgctcgatggcgtgtttaaccacacgggtgattctcatcgctggtttgatcgctatcaacaaggggaaaacggcgcctgccatcacgaagattcgccttatcgtggttggtttacgttcctccctgatggacgagcattagattggaaaggtaatgccagtttgccaaaacttaattttgccaatgaagaggtcgctgaacgaatctatcgcagtgatgacagcgtcgtgcgttattggttacggccaccatacagtattgatggctggcgtctggatgtcgtacacatgctcggggaagatggcggcgctaaagggaatttgcaccatctgcacggtatctatcaggcagcaaaagaagaaaatccgcaggcttatattctgggcgaacattttggcgatgcacgtaattggttgcacgctggagtggaagacgcggcaatgaattatatgggttttgctttgccggtccgcagttttctcgccgagctagatgtggcttgccatcctataaaattggatgctgcggattgcgcctactggatggatgagtaccgcgcaggattgccccatagccagcaactccgtttatttaatcaattagatagccatgatactgcccgttttcttaccttattaaagggtgataaaacccgtatgcaaatggcgctaatatggttgtttagttggattggtgtgccttgcctattttatggtgatgagattgggctggatggagggaatgatccgttctgccgcaaaccgttcccgtgggatgaggctcagtgggatcatgacctattatcactgtgtcaacgtatggcggctttacgccacaaaagcatagcgttgcggcgcggggggtgtcaggtgatccatgccagtggtgattccctggtctttattcgtagctatcaaactgagcgtgtgatggtggcgatacaacgttccgatgatgcggatattttcctgcccgcctctcctttactcaatgtggctgagtggcagcgtctggaaggtggaggagacctggctgtcagtgagactggggtaaacatggggctggagggtaagagtgttaccttgtggtgtggtgttggtgagtgctaa

SEQ ID NO: 13593 - protein, 609 aa, Yersinia pestis KIM
MLSGWHLPVSPFVRLADDALHITLWLQGDSLPAQVFLRCEPDNEEWLLTMEGHESHDRWRYSVSLPLYEGQPTRRYCFKLLWDDRQQWFGPLGFSVIPPAQLAQFAVDVPDSGPDWVADQVFYQIFPDRFASSQADHGVQEGSYIHHAAGCPVSRREWQQPLDDVHAASTFYGGDLAGISQKIPYFQQLGVTALYLNPIFTAPSVHKYDTEDYYQVDPYLGGERDFLQLRAATREVGIKLVLDGVFNHTGDSHRWFDRYQQGENGACHHEDSPYRGWFTFLPDGRALDWKGNASLPKLNFANEEVAERIYRSDDSVVRYWLRPPYSIDGWRLDVVHMLGEDGGAKGNLHHLHGIYQAAKEENPQAYILGEHFGDARNWLHAGVEDAAMNYMGFALPVRSFLAELDVACHPIKLDAADCAYWMDEYRAGLPHSQQLRLFNQLDSHDTARFLTLLKGDKTRMQMALIWLFSWIGVPCLFYGDEIGLDGGNDPFCRKPFPWDEAQWDHDLLSLCQRMAALRHKSIALRRGGCQVIHASGDSLVFIRSYQTERVMVAIQRSDDADIFLPASPLLNVAEWQRLEGGGDLAVSETGVNMGLEGKSVTLWCGVGEC

SEQ ID NO: 13594 - DNA, 1608 bp, Streptococcus agalactiae 2603V/R
  CDS (1)..(1608): transl_table=11
atgaagaaacactggtggcataaagctacgatttatcaaatttacccacgttcatttatggattcagatggtgatggtgtgggggacattaaagggattactagcaaactagactaccttgaaaaattagggattactgctatctggttatcacctgtttatcaaagtccaatggatgacaatggttatgatatttcagattatcaagccattgcagatatttttggtgatatgaatgatatggaccaactgttacaagaggcaaatcaacgcgggattaaaatcatcatggatttggtagtgaatcatacctctgatgaacatgcttggttcgtagaagcgcgagaaaaccctaatagtcctgaacgtgatttttatatttggcgagatgaacctaacgatttgacttctatttttagtggctcagcttgggaatatgataaagtatcaggtcaatattatttgcacctttttagcaaacgtcagccagatctcaactgggagaatgaagctttacgtcataaaatttatgatatgatgaatttctggattgataagggtattggtggtttccgtatggatgtcattgatttaattgggaaaattccagataagggcattactggtaatggaccaaaacttcatgattatcttaaagaaatgaacagagctagttttggaaagcatgacttattgacggtgggtgaaacttggggagcaacgccagacattgcaaaacaatactcaaatcccgataatgaagaattatctatggtctttcaatttgaacatgtaggtcttcaacataaacctgacgctcctaagtgggattacagtgacggattagatgttccagcattgaaagatatttttacaaaatggcaaacacaattggagcttggccaaggttggaattctttattctggaataatcatgaccttcctcgagtgctctcgatctggggaaatgatagtgataacagaaaacaatctgccaaggctctagcaatcctactacatttgatgcgtggaacgccttatatctatcaaggtgaagaaattggtatgactaattatccatttgagtgtttagcagatgtagatgatattgaatcccttaactatgctaaagaagccatggataatggggtatctgaagcaacaattttagatagtattcgtaaagtcggtcgtgataatgctcgtactccaatgcagtggagtcaagaacatcaagctggttttactaaaggtaccccatggctagcagtcaatcccaattatcaggaaattaatgtggaggcagcgttaaatgatacggaaagtattttttatacttatcaaaaattagttgctttacgtaaagaacacgactggttagttgatgctgattttaaacttttggaaacagcagataaggtatttgcttatgttcgtcaaacagataaagaacgttatttaatagttgcgaacttatccgatcaaaaccaatcttttgaatttccagaagctgttaaagaaactattatttcaaatacagaggttcaagaagtactatcaagtaacactctcaagccgtgggatgccttctgcatagagctattctaa

SEQ ID NO: 13595 - protein, 535 aa, Streptococcus agalactiae 2603V/R
MKKHWWHKATIYQIYPRSFMDSDGDGVGDIKGITSKLDYLEKLGITAIWLSPVYQSPMDDNGYDISDYQAIADIFGDMNDMDQLLQEANQRGIKIIMDLVVNHTSDEHAWFVEARENPNSPERDFYIWRDEPNDLTSIFSGSAWEYDKVSGQYYLHLFSKRQPDLNWENEALRHKIYDMMNFWIDKGIGGFRMDVIDLIGKIPDKGITGNGPKLHDYLKEMNRASFGKHDLLTVGETWGATPDIAKQYSNPDNEELSMVFQFEHVGLQHKPDAPKWDYSDGLDVPALKDIFTKWQTQLELGQGWNSLFWNNHDLPRVLSIWGNDSDNRKQSAKALAILLHLMRGTPYIYQGEEIGMTNYPFECLADVDDIESLNYAKEAMDNGVSEATILDSIRKVGRDNARTPMQWSQEHQAGFTKGTPWLAVNPNYQEINVEAALNDTESIFYTYQKLVALRKEHDWLVDADFKLLETADKVFAYVRQTDKERYLIVANLSDQNQSFEFPEAVKETIISNTEVQEVLSSNTLKPWDAFCIELF

SEQ ID NO: 13596 - DNA, 1497 bp, Oceanobacillus iheyensis HTE831
  CDS (1)..(1497): transl_table=11
atgttaaatagaaataaattgcttctattgcttacagtgatttttgttttattgcctgtaactaatgtaaacgcagaagaaccaatcaatatacataatgaaattatttatgatattttagttgatcgttttaataatggagattctgaggaaacggaagaaattgctgtggatgacccgaatgcataccacggtggcgatattaaaggtataattgatcaactagatcgactaaaggaaatggggattactaccatttcattatcccctttaatgactaatcaacagaatggttatcacggatattgggtccttgattattttgaaatagacgagcaattaggaaccatggaagatcttaatcagttgattgaacaagcacatcaacgtgatatgaaagtagttatggatatggtaatcaattatgctgcagcatcacatgaagtaacagaagacgaaactaaagctgattggtggacggaaccttcttacacagctgcatcttggtctgctaatgcacttcaatggaatttgaatcaacctgaagttgcggagaatatgataaatgttgcagactactggatggaagagacggagatagatggttttacgttacatgctgttgatcaagcgccaattgactttcttcaagaatatacacaacatataaaagaaacagatgaagaattttatttaataggagatatattagatccagaatctgctaacattcaagaattagaagaaacacctctggatattgtagctaatcctatgctgcatgaacggttaaaacaagtattctctgatgtggataatccagtttctgaggtgtaccatcaatgggagaatttagagacagactctccgttaattacaattgataattttacagaagaacgttttaccaatgcatattcgaagaaccaacgaaattcactgacagcatggacactagcattgacatatatgtatactacaccaggaacacctctaattgttcaaggtacggagttgccaatgtatggtggagatgaagaggagtctcagcgacttgtaccatttaatagtggggacccagaattgaaagaatttcatactagaatagcgtctttacgaaatgaatttcctgcactacgacaaggtgacattgaactagtcgataccgttgattcgatgatagtctataaaagaagttatgaaggccaaacgatgtatgttgcgattaacaatggaagtgagtctgcttatgtagatgtaactgatgttgatgctaataaagagttacgcggccacttacaagataatttggttcgtgaaaaccaagaagggaatcatcgaattggaataccacgtgaatctgtagaagtgtatgaagtacaggatgatcatggtcttaactggtggtttattggatttattgttatggttattttggcctttattgctggagttatctatttgacaataaaacaacgcaagagagaaaagaaataa

SEQ ID NO: 13597 - protein, 498 aa, Oceanobacillus iheyensis HTE831
MLNRNKLLLLLTVIFVLLPVTNVNAEEPINIHNEIIYDILVDRFNNGDSEETEEIAVDDPNAYHGGDIKGIIDQLDRLKEMGITTISLSPLMTNQQNGYHGYWVLDYFEIDEQLGTMEDLNQLIEQAHQRDMKVVMDMVINYAAASHEVTEDETKADWWTEPSYTAASWSANALQWNLNQPEVAENMINVADYWMEETEIDGFTLHAVDQAPIDFLQEYTQHIKETDEEFYLIGDILDPESANIQELEETPLDIVANPMLHERLKQVFSDVDNPVSEVYHQWENLETDSPLITIDNFTEERFTNAYSKNQRNSLTAWTLALTYMYTTPGTPLIVQGTELPMYGGDEEESQRLVPFNSGDPELKEFHTRIASLRNEFPALRQGDIELVDTVDSMIVYKRSYEGQTMYVAINNGSESAYVDVTDVDANKELRGHLQDNLVRENQEGNHRIGIPRESVEVYEVQDDHGLNWWFIGFIVMVILAFIAGVIYLTIKQRKREKK

SEQ ID NO: 13598 - DNA, 1752 bp, Oceanobacillus iheyensis HTE831
  CDS (1)..(1752): transl_table=11
atgctaaaagaagcagtatttcatcgaccaaagaataattatgcttacctttacaaagagaatacgttacacattcgtttacaaacaaagaaagatgatgtagtaaaagccacacttatctatgcagatccttataattgggatgattcaggatggatttataacaaggcagacatgcgtctcatagcttccgatcagctattcgattattggcaaattgaaatttattgtaaaacacgtcgaataagatatggatttcaattatctgatactaaagaaactcttatttatacagagaaaggattttataaagaaattccaaatgatgacactgcttattacttctgcttcccttttttaaacccaatagatcaatttcaagcaccagaatgggtaaaggaaactgtatggtatcaaatttttcctgaacgatttgcgaacggaaatgaaacaattaatcctcctggaactttaccttggggaagcactacccctacacctacagatttttttggtggtgactttcaaggtataatcaatcacttggattatcttgtagatttaggtatttccggtatttattttacgcctatatttaaagcattttctaaccataaatacgatacgattgactatatggaaatcgatcctcaatttggggataaacagacatttcgaaagttagttaaagcttgtcatcaacgaggaattcgcattatgcttgatgctgtatttaatcatagtggctatttctttgaaccatttcaggatgtgttaaaaaaccaagagaagtctatttataaggaatggtttcatatcgagagttttcctttgagaacagacccagcaccaaactatgacacctttgcatatgtaggttcaatgccaaaactaaatacagagcacccggaagtgaaatcatatttacttaaagtagcatcatattggattgaagagtttgatatcgatgggtggcgattagacgtagctaatgaagtggatcaccaattttggagagatttccgtagacaagtgaaatccataaagccagatgtctatattctcggagaaatatggcatgattcgatgccctggttacaaggagatcaatttgacgcagtaatgaactatccacttaccagtgctgcacttgattttattgcaaaggaaaaaatagatgttaaagaatttgtccaacaaatttctaatgttctactttcttatccacagaacgtgaatgaagtagcatttaatctattaggcagtcatgatactcccagagttttaacacattgcaacaatcaagtcgaaaaagcaaaacttctatatatattattattaacgatgccaggttctccttgtatttattatggagatgaaattggaatgactggagaaggggatcctggttgcagagaatgtatggtttgggacgagaatgaacaaaatgtagaattaaaatctttccttaaaaaattaattcatgtgcggaaaacggaaaaggctgttgcaaatcaaggagaattttcatttgtaaaaactagtgataattatttcatttataaactttttcaacagcatatggaaatttatattattataaacccaagtaatcaggctctcgaagtatcacttccggtaaccaagtggaacagtgccttcgatttatgggaggaagatgatttcaatattaacactccaataaaatgtgaggaaaatagtttcaaaataatcaaagtaaattattcataa

SEQ ID NO: 13599 - protein, 583 aa, Oceanobacillus iheyensis HTE831
MLKEAVFHRPKNNYAYLYKENTLHIRLQTKKDDVVKATLIYADPYNWDDSGWIYNKADMRLIASDQLFDYWQIEIYCKTRRIRYGFQLSDTKETLIYTEKGFYKEIPNDDTAYYFCFPFLNPIDQFQAPEWVKETVWYQIFPERFANGNETINPPGTLPWGSTTPTPTDFFGGDFQGIINHLDYLVDLGISGIYFTPIFKAFSNHKYDTIDYMEIDPQFGDKQTFRKLVKACHQRGIRIMLDAVFNHSGYFFEPFQDVLKNQEKSIYKEWFHIESFPLRTDPAPNYDTFAYVGSMPKLNTEHPEVKSYLLKVASYWIEEFDIDGWRLDVANEVDHQFWRDFRRQVKSIKPDVYILGEIWHDSMPWLQGDQFDAVMNYPLTSAALDFIAKEKIDVKEFVQQISNVLLSYPQNVNEVAFNLLGSHDTPRVLTHCNNQVEKAKLLYILLLTMPGSPCIYYGDEIGMTGEGDPGCRECMVWDENEQNVELKSFLKKLIHVRKTEKAVANQGEFSFVKTSDNYFIYKLFQQHMEIYIIINPSNQALEVSLPVTKWNSAFDLWEEDDFNINTPIKCEENSFKIIKVNYS

SEQ ID NO: 13600 - DNA, 1398 bp, Bifidobacterium longum NCC2705
  CDS (1)..(1398): transl_table=11
gtgagcttggccacatgttcacggactgcgtttcatgccgattacccgggattcgcaccgcgatgtgcgaaaatggacacggtatcaatcaggaggtgcacagtggttgtaagcacggattcgagccgcacaatgcccgattgggtgaagtacggggtgttctggcacgtgtatccgctgggcttctgcggtgccgatatcaggcccgccggcccgcgccggttccatggccgcggccttgacgcgataattccctggctggagtacgtgcgcgatctaggcgcgtccggcctgctgctgggtccggtgttcgagtcggcgacgcatggatacgacacgctcgaccatatgcatatcgatgtgcgattgggcggggatgccgcgttcgatcagcttgtcgcggcctgccgggacatgggattgcaggtgatgctggatggcgtgttcaatcacgtgagccgcaatcatccggccgttcaggcggcgcttgacgagaccgccggacgcttgaatccggccgacaacccgtggcatggtctggtccgcgcgcatgtcggtgataatggcgaacccgctttggatgtgttcgaggggcacggggatctggtggcgctggaccattcggctgacgagaccgttgactatgtggtccatgtgatgagccattggctggatcgcggagccgccggctggcgcctcgacgccgcgtatgccgtgccgagcccgttctgggcgcgcgtgttgccgcaggtcaaagccgcacacccgtattcgtggattttcggcgaggtgatccatggcgattacccgcgcatcatcgaggaatccacgatggattcgatcacgcaatacgagctatggaagtcgatccagcatgcgctggagacggagaacttcttcgagctggattggaacttgaagcggcacaacgcgttcctggattccttcgtgccgcagacgttcatcggcaaccatgacgtgacgcgtatcgcatcgcagattggcccggccaaggcggcgttggcattggcggtgctcatgacggtcggcggcgtgccaagcatctattacggcgacgaacagggctatgtgggcgtcaagcaggagcgtttcggcggcgatgacgacgtacgtccgaagttccccggctcccctgccgaactgtccacgctgggagagccgacataccggctgcatcaggcgctgatcgcgctgcgccgtcgcaacccatggctgctggatgcgcgtaccgaggccgtgaagctggaaaacaagcacttcgtctatcgttcgacgagcgccgacgcccagcattccctgaccgtggacctcaacatcgagcaatcccccactttcaccatccgcaacgccgatggcagtacagcgtatcaatggtga

SEQ ID NO: 13601 - protein, 465 aa, Bifidobacterium longum NCC2705
MSLATCSRTAFHADYPGFAPRCAKMDTVSIRRCTVVVSTDSSRTMPDWVKYGVFWHVYPLGFCGADIRPAGPRRFHGRGLDAIIPWLEYVRDLGASGLLLGPVFESATHGYDTLDHMHIDVRLGGDAAFDQLVAACRDMGLQVMLDGVFNHVSRNHPAVQAALDETAGRLNPADNPWHGLVRAHVGDNGEPALDVFEGHGDLVALDHSADETVDYVVHVMSHWLDRGAAGWRLDAAYAVPSPFWARVLPQVKAAHPYSWIFGEVIHGDYPRIIEESTMDSITQYELWKSIQHALETENFFELDWNLKRHNAFLDSFVPQTFIGNHDVTRIASQIGPAKAALALAVLMTVGGVPSIYYGDEQGYVGVKQERFGGDDDVRPKFPGSPAELSTLGEPTYRLHQALIALRRRNPWLLDARTEAVKLENKHFVYRSTSADAQHSLTVDLNIEQSPTFTIRNADGSTAYQW

SEQ ID NO: 13602 - DNA, 1818 bp, Shigella flexneri 2a str. 301
  CDS (1)..(1818): transl_table=11
atgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccaatgcataagcagcgcagtcagccgcagccaggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtacctgatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcacaatcttggcacggggggagcttgtcacaactctgaatcgccctggcgcgactggtactcgtttagtgatgatggcacggcgctcgactggcttggctatgccagcttgacgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgcagggatcaccgaagcggcgaaagaaacccagccggaagcgtatattgtcggcgaacattttggcgatgcacggcaatggttacaggccgatgtggaagatgctgccatgaactatcgtggcttcacattcccgttgtggggatttcttgccaataccgacatctcttatgatccgcagcaaattgacgcccaaacctgtatggcctggatggataattaccgcgcagggctttctcatcaacaacaattacgtatgtttaatcagctcgatagccacgatactgcgcgatttaaaacgctgctcggtcgggatattgcgcgcctgccgctggcggtggtctggctgttcacctggcctggtgtaccgtgcatttattacggtgatgaagtgggactggatggtaaaaacgatccgttttgccgtaaaccgttcccctggcaggtggaaaagcaggatacggcgttattcgcgctgtaccggcgaatgattgtgctgcgtaagaaaagtcaggcgctgcgtcgtggcggctgtcaggtgctgtatgcggaagataacgtagtggtatttgtccgcgtgctgaatcagcaacgtgtactggtggcaatcaaccgtggcgaggccagtgaagtggtgctacccgcgtcaccgtttctcaatgccgtgcaatggcaatgcaaagaagggcatgggcaactgactgacgggattctggctttgcctgccatttcggctacggtatggatgaactaa

SEQ ID NO: 13603 - protein, 605 aa, Shigella flexneri 2a str. 301
MMLNAWHLPVPPFVKQSKDQLLITLWLTGEDPPQRIMLRTEHDNEEMSVPMHKQRSQPQPGVTAWRAAIDLSSGQPRRRYSFKLLWHDRQRWFTPQGFSRMPPARLEQFAVDVPDIGPQWAADQIFYQIFPDRFARSLPREAEQDHVYYHHAAGQEIILRDWDEPVTAQAGGSTFYGGDLDGISEKLPYLKKLGVTALYLNPVFKAPSVHKYDTEDYRHVDPQFGGDGALLRLRHNTQQLGMRLVLDGVFNHSGDSHAWFDRHNLGTGGACHNSESPWRDWYSFSDDGTALDWLGYASLTKLDYQSESLVNEIYRGEDSIVRHWLKAPWNMDGWRLDVVHMLGEAGGARNNMQHVAGITEAAKETQPEAYIVGEHFGDARQWLQADVEDAAMNYRGFTFPLWGFLANTDISYDPQQIDAQTCMAWMDNYRAGLSHQQQLRMFNQLDSHDTARFKTLLGRDIARLPLAVVWLFTWPGVPCIYYGDEVGLDGKNDPFCRKPFPWQVEKQDTALFALYRRMIVLRKKSQALRRGGCQVLYAEDNVVVFVRVLNQQRVLVAINRGEASEVVLPASPFLNAVQWQCKEGHGQLTDGILALPAISATVWMN

SEQ ID NO: 13604 - DNA, 1746 bp, Leptospira interrogans serovar Lai str. 56601
  CDS (1)..(1746): transl_table=11
ttgttggaatacagccttgacagtcttcattcttatatttttgattccattaaagctcgagtaaatatgacttctaaaaaatcaacttccaaaaaaaaatcacccaatcaattggataagtggtggcaaaaaacaacgatttaccagatttatccccgctcttttgcagatagtaatcgggatggtgttggagacattccagggatcatttctaaattggattatcttcaagatcttgggtttgaaacaatttggatatctcctttgtataaaagtccacaaatggatcacggttacgatgtaagtgattattactcgatcgctccagaatatggaactataaaagatgcagaaaagttaataaaggaagttcataagcgcgggatgaaaatcgtttttgatatggtgatgaatcatacttctattgaacacgattggtttatacaatcccgttctagtcgagataatcctaaaagagattggtatatttggaaagacggaagaggaaaaaataaacctcctaataattggagttcgtttgtgacacccaaggcctggcattatgattccaatacggatcaatggtatcttgcgagttttctagattttcaaccagacttaaattattacaatccagaagtcaaaaaggcaatgttcgacgttttgcgtttttggcttaagaagggagtagatggtttccgtttggatatttttcacgcgatttataaggataaatatttcagagacaatccgtttcgatttaaatatatcgtttcggaaaatgatcacgatggttattttcagagtagggttcatactgtaaaccatccaaataactttgcttttgcgaaagagctaagatccgttttagatgagtttgatggagatcgttttgcggtaggagaggtggccggagatgatcatatcatcaaacgctacttaggcgaaaaaaaagatggcctgaatctaatctttttattcgaaactttgttgttaaagttcaagactagtttttttaagggaatcgtaaaaaaaatggaacaagtatatccgtatccaaacgttcccacatacgtttttggaaaccatgaccaaagacgttacatgatgaaaatcaataataatctcgaaaaaggaaaattgattgctctgtttcagtttaccgcgaggggggttccagtcacttattacggagaagaaattggaatgaccaatgagacgatcaaattaactgaggcacaggatccgcttgcaagaatctatcgctggttaggtgattcgctttccgaattgttgggactcgcagacgttatcattcgggatcgagcaaggtcgccgatgcaatgggacgactcgccaaacgcaggttttacggttcaagaagcaaaaccatggattcgggttcacggaaattatagagaacgtaacgttttgatcgagtccgaagattcggattctcttttaaatacttataaaagtgttcttcgcattcgaaatggaagttttgctcttaaagagggttctttgagattaattgaagaaaacgttccaaaagatatgttagtttatttaagggaatttggtaaggaacgtaaactgatcgtttttaattttggtaaaaaaaccaaatttttttctaatcctaccgattgtagaaaatattttttctctacggtttctttcgatcataacgaatttgatcaatttaaaatacctccttgttctggagttatattaggtaattag

SEQ ID NO: 13605 - protein, 581 aa, Leptospira interrogans serovar Lai str. 56601
MLEYSLDSLHSYIFDSIKARVNMTSKKSTSKKKSPNQLDKWWQKTTIYQIYPRSFADSNRDGVGDIPGIISKLDYLQDLGFETIWISPLYKSPQMDHGYDVSDYYSIAPEYGTIKDAEKLIKEVHKRGMKIVFDMVMNHTSIEHDWFIQSRSSRDNPKRDWYIWKDGRGKNKPPNNWSSFVTPKAWHYDSNTDQWYLASFLDFQPDLNYYNPEVKKAMFDVLRFWLKKGVDGFRLDIFHAIYKDKYFRDNPFRFKYIVSENDHDGYFQSRVHTVNHPNNFAFAKELRSVLDEFDGDRFAVGEVAGDDHIIKRYLGEKKDGLNLIFLFETLLLKFKTSFFKGIVKKMEQVYPYPNVPTYVFGNHDQRRYMMKINNNLEKGKLIALFQFTARGVPVTYYGEEIGMTNETIKLTEAQDPLARIYRWLGDSLSELLGLADVIIRDRARSPMQWDDSPNAGFTVQEAKPWIRVHGNYRERNVLIESEDSDSLLNTYKSVLRIRNGSFALKEGSLRLIEENVPKDMLVYLREFGKERKLIVFNFGKKTKFFSNPTDCRKYFFSTVSFDHNEFDQFKIPPCSGVILGN

SEQ ID NO: 13606 - DNA, 1839 bp, Corynebacterium efficiens YS-314
  CDS (1)..(1839): transl_table=11
atgcagggtcgacgagacgtggaaaatgtctctacccttgtgggtatgactgacactaccccgttgagttcggacctgatcccagagagcaccgcccgcccggtagtcgatgccgagggcttcatcattgagcatgagtcggaggagtaccacactcccacccccgcccccggtgaacagccctgggagaaacatgaccgcgaatggtacaaggacgctgtgttctatgaggtgctggtgcgtgccttctacgacccggacaacaccggttcgggcaccctgaagggtctgacggagaagctggattacatccagtggctgggtgtggactgcatctgggtgccgcccttctacgactctcccctgcgtgatggtgggtatgacatccggaacttccgtgagatcctgccggagttcggcacggtggaggatttcgtggagctggttgaccaggcccaccgccgtggtctgcgtgtgatcaccgacctggtgatgaaccacacctccgatcagcatccgtggttccagcagtcccggacggatccggatggcccctatggtgacttctacgtctggggggatgatccggagatgtacaaggaagcccgcatcatcttcgtcgataccgaggaatccaactggacctacgacccggtgcgcaagcagtactactggcaccggttcttctcccaccagccggacctgaactatgacaacccggcggtgcaggaggcgatgctcgatgtgctgcggttctggctggatctgggtctggatgggttccgtctggatgccgtgccctacctgttcgagcgtgagggtaccaacggtgagaacctgccggagacccacgagtttctcaagcggtgccgtcgggtgatcgatgaggagtacccgggccgcatcgtcctggcggaggccaaccagtggccccatgatgtggtggagtacttcggtgagaaggagaagggcgatgagtgccacatggccttccacttcccgctcatgccccgcatcttcatgggtgtgcgccaggggtcccgcaccccggtcagtgagatcctcgagcacaccccggacatccccaagaccgcccagtggggtatcttcctgcgcaaccatgacgagctgaccctcgagatggtgtccgaagaggaacgcgcctacatgtaccagcagttcgcccccgagcctcggatgcgcgcgaacgtgggtatcaggcgtcgactagcaacgcttgtcgacggcgaccgcaaccagctcgaactcctgcacgggctgttgctgtccctcccgggttcccccgtgctgtactacggcgatgagatcggcatgggcgacaacatctggctgccggaccgtgatggcgtgcgcacccccatgcagtggtccaatgaccgcaacgggggtttctccaaggcagatcccgagcgtctttatctgccagcgatccagaatgaccgcttcggttatgcccaggtcaatgtggaaacccagctcaagcaggagaactccctgctgcagtggatccgcaaccagatcatgatccgcaagcagtacaaggccttcggcaagggcacctaccgggagatcgactccaccaacgaggcggtgctgaccttcctccgtgagtacaaaggccagaccattctgtgtgtcaacaacatgtcgaagctgccacaggcggtggccctggatctcagcgagttcgccggcatcaccccgcgtgaggtctccggcggccagtacttccccaccatcggtgagcgccagtgtgtgttcaccctggcaccgcatgggttcttctggctcgatctcaccggtgaggaggaggaatga

SEQ ID NO: 13607 - protein, 612 aa, Corynebacterium efficiens YS-314
MQGRRDVENVSTLVGMTDTTPLSSDLIPESTARPVVDAEGFIIEHESEEYHTPTPAPGEQPWEKHDREWYKDAVFYEVLVRAFYDPDNTGSGTLKGLTEKLDYIQWLGVDCIWVPPFYDSPLRDGGYDIRNFREILPEFGTVEDFVELVDQAHRRGLRVITDLVMNHTSDQHPWFQQSRTDPDGPYGDFYVWGDDPEMYKEARIIFVDTEESNWTYDPVRKQYYWHRFFSHQPDLNYDNPAVQEAMLDVLRFWLDLGLDGFRLDAVPYLFEREGTNGENLPETHEFLKRCRRVIDEEYPGRIVLAEANQWPHDVVEYFGEKEKGDECHMAFHFPLMPRIFMGVRQGSRTPVSEILEHTPDIPKTAQWGIFLRNHDELTLEMVSEEERAYMYQQFAPEPRMRANVGIRRRLATLVDGDRNQLELLHGLLLSLPGSPVLYYGDEIGMGDNIWLPDRDGVRTPMQWSNDRNGGFSKADPERLYLPAIQNDRFGYAQVNVETQLKQENSLLQWIRNQIMIRKQYKAFGKGTYREIDSTNEAVLTFLREYKGQTILCVNNMSKLPQAVALDLSEFAGITPREVSGGQYFPTIGERQCVFTLAPHGFFWLDLTGEEEE

SEQ ID NO: 13608 - DNA, 1839 bp, Vibrio vulnificus CMCP6
  CDS (1)..(1839): transl_table=11
atgaccctaccttttctttttcatgcgcaaacgccggattatttccgcgttgagaatcaaatcgctcacgttaccttaagaactcagcctgaaggaattcaagccgtctacctgcggcacgagcctgacaatgaagagtacttagtagaaatgcagcgagtctctaagttaggggaactcgatggctggcaagcgtcattccctttgaataaagaccgagagatcacccagtacgttttcaaagtgatcacagaaggtgccactgtctggttagacgctcgtggcgtacagaaacggatgccaggcagcgagtaccatttcaaatacaaccaatctcatcagccgccagagtgggtgagtgagcagattttctaccaaattttccctgatcgattctgtaatggtaacccagagatcagcgttaaaagtggcgaatactcggtaaaaaatggcacacgccctgtggtcgcaaaagagtggggagcggccgttgacaaacacaatggctatgggggttgtgagttttatggcggggacttggctggcattcgcagcaaattggattacctgcaaaccttgggcgtgacagcgctctatctcaatccgattttttcggcgccgagcaatcacaagtacgacaccactgattacttaaccattgatccgcatttgggaagcaatcaagagtttgcagagttgagcgaagcgcttcatcaacgcggtatgaaaattgtgcttgatgccgttttcaatcacacctcatgtgagcacccttggtttgacaaaaatggggtaggtgagataggggcctatcaccacatcgaatcgccttatcgccactattattttttcgaagacggtagccaaaattatattggctggaagggcgttgacagtttaccagtactgaattttgaaaatgcggaggtacgtaattacatttatgccagcgaacacgcggccattcgccactggttgaaagcaccctatcgaatcgatggttggcgttttgacgtgatccacatgcttggagaaggtgaaggggcgcgcaacaatgcctactatgttaagcagttccgcaatgcgactaaacaagaaaaccctcaagcttatgtattaggggagcatttcttcgaggcgagcaagtggctccaaggcgatcaagaagacggctcgatgaattactacggctttgcccatccagtgagagcattattggcccaaaaagacattgcctaccatcctattgagatcgactgcatcgattttgttgattggctaaatgaatcacgcgctaaagtaccttggcttaaccagctcagccagttcaatcaacttgacagccacgataccgcacgttttattaccttgttggaaaatgaccaagcgcgcatgaacattgctctcggcttgctgttcacttatgtcggaaccccttgtatctattatggtagtgaagttggactggaaggtgagaatgacccagataaccgccgctgtttcccgtgggagcgtgttggtcatgtggagacgttccaatatcaccaacgtctcattgaacttcgcaaaacgtctaaggcgctgcagcaagggtcgatccaatttttgcatgttgagccaacgtcgttcagttttgctcgtcagtatggtgaagacactctgcttgtgatggtcaacttagattcgaaggcatgctctatgacgctgccaatttggcaacttggaaagccgcaaggacgtctggtttccctattgggtaatgaaagtgctttgcaagtaaatagtaaagttgtggttaatatctcttctgaatccattcaaatttggaaacttgagtga

SEQ ID NO: 13609 - protein, 612 aa, Vibrio vulnificus CMCP6
MTLPFLFHAQTPDYFRVENQIAHVTLRTQPEGIQAVYLRHEPDNEEYLVEMQRVSKLGELDGWQASFPLNKDREITQYVFKVITEGATVWLDARGVQKRMPGSEYHFKYNQSHQPPEWVSEQIFYQIFPDRFCNGNPEISVKSGEYSVKNGTRPVVAKEWGAAVDKHNGYGGCEFYGGDLAGIRSKLDYLQTLGVTALYLNPIFSAPSNHKYDTTDYLTIDPHLGSNQEFAELSEALHQRGMKIVLDAVFNHTSCEHPWFDKNGVGEIGAYHHIESPYRHYYFFEDGSQNYIGWKGVDSLPVLNFENAEVRNYIYASEHAAIRHWLKAPYRIDGWRFDVIHMLGEGEGARNNAYYVKQFRNATKQENPQAYVLGEHFFEASKWLQGDQEDGSMNYYGFAHPVRALLAQKDIAYHPIEIDCIDFVDWLNESRAKVPWLNQLSQFNQLDSHDTARFITLLENDQARMNIALGLLFTYVGTPCIYYGSEVGLEGENDPDNRRCFPWERVGHVETFQYHQRLIELRKTSKALQQGSIQFLHVEPTSFSFARQYGEDTLLVMVNLDSKACSMTLPIWQLGKPQGRLVSLLGNESALQVNSKVVVNISSESIQIWKLE

SEQ ID NO: 13610 - DNA, 2064 bp, Vibrio vulnificus CMCP6
  CDS (1)..(2064): transl_table=11
atgaaactgaacgccataaccctaactctgcttctcagctcgacagcggcgattgccgagccgaatttaaccatttcaaccaccaccaacagccgagattttccgctcagtgccgagcagccattagtggtgccgctggtcaaagagagctatcaactgaaaatcactgggctggaaggtgattgccaagcgccagatgcgcaggtgattaagttcaatcaacccattgcgctgaattgtggcaaagtgaccgaacttccgcttaaaatccgctttacgggtgactacagctttgaactagacgcgaacgccaacacgctgacattcaaacgtgagccgaaaaaggtcgctaaaaccgaattcaaacgcccattgccgcaggtgacttgtgaagtttaccaaggcggtgaagtgacgattgaactgggcgacagtttcaaagacggcacctcactgcgtgacgcctacagcggccaagtggtgagcgtgaaaaaaggcaaagtgagcttaacgccatcagcgcaatctggcggtttggtgctgctggaaccggttaaacaaaacaaaaaagcgcgccctttcgattaccgcaacgccaatatttacttcgtgatggtggatcgctttaacaatggcgacaccagcaatgaccaaagttatggtcgtcagaaggatggtaaagaggaaatcggcaccttccacgggggcgatcttaaaggggtgattgaaaagctcgactacattcaacgtctcggcactgatgcgatttggttgtcgccgattgtggagcaagtgcacggttttgttggtggtggcgacagcggctctttcccattttatgcctatcacggctattggacgcgtgattttaccaagatcgatgagaactttggccgcgatgaagatttgaaaactctggtggaagaggcgcataaacgcggcatcaaagtcctgctcgatgcggtgatcaaccattccgggtattcaacactggcggatctgcaatttgatggcatgcaagtgacgacaaaagaagcgaacttgccagaaaaatgggccaactggcagccaacatcgggtgaaaactggcatagctaccactctgcgatcgactatcaaagccaaaactggtcacagtggtggggggcagattgggtgcgaactgggcttccgggttaccaacaaccgggcagcagcgacattactttgtctctcgctgggttgcctgattttcgcaccgagtcgacccaagcggtgacgccaccacagtggctgctagagaaccccggtacgcgcgtggtggcgcgtgacaactacaccgtcagcgactatttgattgagtggcaaaccgattgggtgaaacgctttggtattgacggctatcgggtagatacggtcaaacacgttgaaggcgaagtgtggaagcgcctgaaacaagaagcgacgaaaagcctcgatgcgtggcgcaaagccaatggccaatcgggtgcgccattttggatgatgggggaagtgtggggccactcagcctaccgcagcccttattttgacgacggttttgatgcgctgatcaacttcgatatgcagaagaaactcgataaaggcgcagcctgttttagccaaatggccgatacctatcgcgattacgccaacaccatcgcgcagcagagtgattttaatccagtgagctacatgtcctcgcacgatactgagctgttctttagccgatttaaagactatgccgtgcagcgcaacgccgcgaacgcattgctgctcagccctggtgcggtgcagatttactatggtgatgaagtagggcgcaatattggcccatacgcggatgatttccatcaaggcactcgctcggacatggtatggcaattgagcgcagagcaacaaacattgctcaatcattggcagaaactgggccagttccgccgggcgcatcccgcgattggcgctggtgtgcatcaggagattgaacaaactggcgcgtacgttttctcccgcaccttaggggatgacaaagtggttgtggcgtttgttggtcacgccgtgcaatag

SEQ ID NO: 13611 - protein, 687 aa, Vibrio vulnificus CMCP6
MKLNAITLTLLLSSTAAIAEPNLTISTTTNSRDFPLSAEQPLVVPLVKESYQLKITGLEGDCQAPDAQVIKFNQPIALNCGKVTELPLKIRFTGDYSFELDANANTLTFKREPKKVAKTEFKRPLPQVTCEVYQGGEVTIELGDSFKDGTSLRDAYSGQVVSVKKGKVSLTPSAQSGGLVLLEPVKQNKKARPFDYRNANIYFVMVDRFNNGDTSNDQSYGRQKDGKEEIGTFHGGDLKGVIEKLDYIQRLGTDAIWLSPIVEQVHGFVGGGDSGSFPFYAYHGYWTRDFTKIDENFGRDEDLKTLVEEAHKRGIKVLLDAVINHSGYSTLADLQFDGMQVTTKEANLPEKWANWQPTSGENWHSYHSAIDYQSQNWSQWWGADWVRTGLPGYQQPGSSDITLSLAGLPDFRTESTQAVTPPQWLLENPGTRVVARDNYTVSDYLIEWQTDWVKRFGIDGYRVDTVKHVEGEVWKRLKQEATKSLDAWRKANGQSGAPFWMMGEVWGHSAYRSPYFDDGFDALINFDMQKKLDKGAACFSQMADTYRDYANTIAQQSDFNPVSYMSSHDTELFFSRFKDYAVQRNAANALLLSPGAVQIYYGDEVGRNIGPYADDFHQGTRSDMVWQLSAEQQTLLNHWQKLGQFRRAHPAIGAGVHQEIEQTGAYVFSRTLGDDKVVVAFVGHAVQ

SEQ ID NO: 13612 - DNA, 1464 bp, Bradyrhizobium japonicum USDA 110
  CDS (1)..(1464)
atggcacagggcgaggtgaattggtggcgcgacggcatcttctaccaggtctatccgcgctcgtttcaggacagcgacggtgacggcgtcggcgatctcgccggcatcttgcggcggctgccttatgtgaagtcgctcggcgtcgacgcgatctggctgtcgccgatcttcccctcgccgatggccgatttcggctacgacatttccgaccataccggcatcgatccgctgttcggcacgatggcggatttcgacgcgctgctcacggccgcgcatgagcatggtctcaagctgatcctcgacctcgtgcccaaccacacctcggaccagcatccctggtttgtcgagagccggtcctcgcgcgacaatcccaagcgcgactggtacgtctggcgcgatccggcgcccgatggcggcgtgccgaacaactggctgtccgagttcggcggcagcgcgtggcagttcgacgagacgacgggtcaatattactatcacgccttcctcgcccagcagccggacctcaactggcgcaacccggacgtccgcgcggcgatctacgacgcgatgcggttctggctggacaagggcgtcgacggctttcgcgtcgacgtgatctggcacctgatcaaggacgccgaattccgcgacaatccgctcaatcctcactacgtcgagggccgtccgccgaacgagaagatcctgacgcaatattccaccgaccagccgccgttcaacttcgcgctgctctcgacgttctggagcgcgcgctcgatcgagacgatcatcgacgactacgagaaggcgctgccgaaaggcgcctggccgaactgggtgctcggcaatcacgaccgcccgcgggtcgccagccgtgtcgggcccgagcaggcccgcgtcgccgccatgctgctgctgacgctgcgcggcacgccgacgctctattacggcgacgagatcggcatgcatcagctcgcgatcgcgcccgaggacgtgcgcgatcccttcgagaagaacgtgcccggcatcggcgtcggccgcgacggttgccgcacgccgatgcagtgggattcctcgaacttcgccggcttctcgaacgtcaggccgtggctgccgctgcctgaggatcatatccacgagaatgtcgtcaatctcgaagccgacacgcgctcgatcctcagcctgtacaggcggctcatcgtgctgcgaaagagcagcccgcccctggtggccggcaactatcatccgatcgctgcgcagggcgatctcctgatctaccgccgcgaggccgagggcagggcggtgatcgtggccctcaatctcggccccgacccgatcgccgtcaccaccagcgcgatccgcttcggcagcgagatcctgctgtcgacgttcctggatcgtgagggtgagcggctggaaggggtgctggatctgcgcgggaatgaaggggtgatcgtgcagccgccctaa

SEQ ID NO: 13613 - protein, 487 aa, Bradyrhizobium japonicum USDA 110
MAQGEVNWWRDGIFYQVYPRSFQDSDGDGVGDLAGILRRLPYVKSLGVDAIWLSPIFPSPMADFGYDISDHTGIDPLFGTMADFDALLTAAHEHGLKLILDLVPNHTSDQHPWFVESRSSRDNPKRDWYVWRDPAPDGGVPNNWLSEFGGSAWQFDETTGQYYYHAFLAQQPDLNWRNPDVRAAIYDAMRFWLDKGVDGFRVDVIWHLIKDAEFRDNPLNPHYVEGRPPNEKILTQYSTDQPPFNFALLSTFWSARSIETIIDDYEKALPKGAWPNWVLGNHDRPRVASRVGPEQARVAAMLLLTLRGTPTLYYGDEIGMHQLAIAPEDVRDPFEKNVPGIGVGRDGCRTPMQWDSSNFAGFSNVRPWLPLPEDHIHENVVNLEADTRSILSLYRRLIVLRKSSPPLVAGNYHPIAAQGDLLIYRREAEGRAVIVALNLGPDPIAVTTSAIRFGSEILLSTFLDREGERLEGVLDLRGNEGVIVQPP

SEQ ID NO: 13614 - DNA, 1698 bp, Bradyrhizobium japonicum USDA 110
  CDS (1)..(1698)
atgatcgacgatctctggtacaagaacggcgtgatctactgcctgtccgtcggcacctatatggatgccgacggcgacggcgtcggcgacttcaagggcctgctgcggcggctcgactatctgcacggcctcggcatcaccacgatctggctgatgccattccagacctcgcccggccgcgacgacggctacgacatcgccgactattacagcgtcgattcccgctacggcacgctcggcgacttcgtcgaattcgcccatggctgcaagcagcgcggcatccgcatcatcatcgacctcgtcgtcaaccacacctcggaccagcatcgctggttcaaggacgcgcggcgcgacaagaactcgccctatcgcgactggtacgtctggtccgacacgaagcccgccaatgccaacaagggcatggtgtttcccggcgtgcagaaatcgacctggacgcgcgacaaggacgccggcgcctggtattttcatcgcttctacgattttcagcccgacctcaacacctcgaacccgcacgtgcaggccgagatcttgaagatcatgggcttctggatccagctcggcgtctccggattccgcatggacgccgtgcccttcgtgatcgcgaccaagggcgccaaggtgaagaagccggtcgagcaatacgacatgctgcgcgcgttccgcgaattcctgcaatggcgccagggtgacgccatcatcctcgccgaagccaatgtgctgccggaaaccgacatggaatatttcggccgcgatgccgaccgcatgcacatgatgttcaacttccacgtcaaccagcatctgttctatgcgctggcgtcggccgactcgcgaccgctggcaaaggcgctgaaggcgaccaagccgcggccgggctcggcgcaatggggcctgttcctgcgcaatcacgacgagctcgatctcgggcgcttgaccccggcgcagcgcgacaccgtgttcaagagcttcggccccgacaaggacatgcagctctacgaccgcggcattcgccgccgcctcgcgccgatgctcggcggcgaccgcaggcggctcgagcttgcctacagcctgatgtgcacgctgccgggaacgcccgtgatccgctatggcgacgagatcgggatgggcgacgatctctcattgccggagcgcaattgcgcgcgcacgccgatgcaatggtcgaccgagccgcatggcggcttcaccaagaacgacaagccggcctgtcccgtcatcgacaagggcccttatggctttccgcacgtcaacgtcgccaagcagcggcgcgatgccaattccatgctgaactggaccgaacgcatcgtccgcatgcgcaaggaggtgccggagatcggctggggcgatttcgcggtcattgcgacgcgtgatccggccgtcttcatcatgcgctatgactggcgcaacaattcggtgctgttcgtgcacaatctcgatgagaagccacgcgagatcgcgttctcgacggggctgcctgatgatgccggcgcgcacctgatcaatctgctcgcggaagaccacagccacgccgacaagcgcggccagcaccgcgtcgtgctggagccgtatggctatcgctggtatcgggtcggcgggttggattatctcttgaagcggagcgatatcgacggggatactgcgggtaacaagcatccggggtag

SEQ ID NO: 13615 - protein, 565 aa, Bradyrhizobium japonicum USDA 110
MIDDLWYKNGVIYCLSVGTYMDADGDGVGDFKGLLRRLDYLHGLGITTIWLMPFQTSPGRDDGYDIADYYSVDSRYGTLGDFVEFAHGCKQRGIRIIIDLVVNHTSDQHRWFKDARRDKNSPYRDWYVWSDTKPANANKGMVFPGVQKSTWTRDKDAGAWYFHRFYDFQPDLNTSNPHVQAEILKIMGFWIQLGVSGFRMDAVPFVIATKGAKVKKPVEQYDMLRAFREFLQWRQGDAIILAEANVLPETDMEYFGRDADRMHMMFNFHVNQHLFYALASADSRPLAKALKATKPRPGSAQWGLFLRNHDELDLGRLTPAQRDTVFKSFGPDKDMQLYDRGIRRRLAPMLGGDRRRLELAYSLMCTLPGTPVIRYGDEIGMGDDLSLPERNCARTPMQWSTEPHGGFTKNDKPACPVIDKGPYGFPHVNVAKQRRDANSMLNWTERIVRMRKEVPEIGWGDFAVIATRDPAVFIMRYDWRNNSVLFVHNLDEKPREIAFSTGLPDDAGAHLINLLAEDHSHADKRGQHRVVLEPYGYRWYRVGGLDYLLKRSDIDGDTAGNKHPG

SEQ ID NO: 13616 - DNA, 1626 bp, Lactobacillus plantarum WCFS1
  CDS (1)..(1626): transl_table=11
atgcaagcacattggtggcaacgcgcaacggtttatcagatttacccacgtagctttcaagatagtaacggggatggaattggtgacatccctgggattatcagtcggctcgattacttggcaacccttggtgtggatgcgctgtggttaagcccggtatacaaaagtccgaatactgataacggctatgacattgcggattatcaggcgattgacccagcatatggcacgatggccgatatggatcagttgatcgctcaagcggctcagcgtggcataaaaatcgtgatggatttggtcgtgaatcataccagtgatgagcatctgtggtttgtggatgcttgtcagaatccagatagtccgacgcgcgattattatgtatgggcggatgctgttgatgggcatgcgcctaatgatctgacatctggtttcagtggcggttcagcttgggagctagatgaactaacgggccaatactttttgcacttgttttcaaaaaagcagattgatttgaattggcagaatccagacttacgacgcgcaatttatcgtatgatgaatttctggatcgataagggaatcgaagggtttcggatggacgtcatagatatgattgccaaggagccacgtgcaaaaattttagtgaatgggccgcatctgcatgaatatttacatgaaatgaatcgtcagacttggcggaaccgtgattttttaacagtcggtgaagcctggagtgcaagtccagaagatgcgcgacagtacagtgatgagcagcgcgaagaattaagtatggtcttccaattcggccacttatgggctgatcgccaggttggcggcgaaaagtgggaacagcgaccacttgatgttgcacaactgaaacaagcgctctatgcttgccaaacgacgatggcgactcacgggtggaatagtttattctggagtaaccatgacctgccccgcgccgtttcacgctttggggctacgggtcagtaccgagagctgagtgcgaagatgttagccattgctttacacggactaaaaggcacaccttttgtctatcaaggggaagagattggtatgactgattgcccagttgcaactatcgatcaagttaacgatgttgaagcccggacaatttatcgacaattacgagcacagggtgatgatgctggtaccgccatgcagaaaatcaatatctttaatcgtgataatgcgcggacgcccatgcaatggacggctaagcaacacgcgggatttacaacgggcaaaccatggttggcaatcaatgccaattatccgaggatcaatgttgcggccgcccaagcggactaccaatcgatatggtggacgtatcagcggctaattagattacgcaaacagtcggcggtgttgcaacagggtgagtttaccgagttatcagcggtaccggcaccaatcgttgcctacactcggacttggcaacaaacccaatggctaatttgcgctaattttgctgatacacttattacggtagatctaccaaagcgagcatctgagttaatcatcagtaactatcaagattatcctgagcaactggggcgggtggtattacgaccgtatgaagcgtttatccttgcattaagctag

SEQ ID NO: 13617 - protein, 541 aa, Lactobacillus plantarum WCFS1
MQAHWWQRATVYQIYPRSFQDSNGDGIGDIPGIISRLDYLATLGVDALWLSPVYKSPNTDNGYDIADYQAIDPAYGTMADMDQLIAQAAQRGIKIVMDLVVNHTSDEHLWFVDACQNPDSPTRDYYVWADAVDGHAPNDLTSGFSGGSAWELDELTGQYFLHLFSKKQIDLNWQNPDLRRAIYRMMNFWIDKGIEGFRMDVIDMIAKEPRAKILVNGPHLHEYLHEMNRQTWRNRDFLTVGEAWSASPEDARQYSDEQREELSMVFQFGHLWADRQVGGEKWEQRPLDVAQLKQALYACQTTMATHGWNSLFWSNHDLPRAVSRFGATGQYRELSAKMLAIALHGLKGTPFVYQGEEIGMTDCPVATIDQVNDVEARTIYRQLRAQGDDAGTAMQKINIFNRDNARTPMQWTAKQHAGFTTGKPWLAINANYPRINVAAAQADYQSIWWTYQRLIRLRKQSAVLQQGEFTELSAVPAPIVAYTRTWQQTQWLICANFADTLITVDLPKRASELIISNYQDYPEQLGRVVLRPYEAFILALS

SEQ ID NO: 13618 - DNA, 1827 bp, Vibrio parahaemolyticus RIMD 2210633
  CDS (1)..(1827): transl_table=11
atgtctttgccatttctctttcatagccagacggttgatggtttagccttcgatggtaaacgcgtgaaggtctgtctaaaaacagaagcgttaacatttgatgctgtttatgtgcgtattgagccagacaacgaagaataccttgtcgccatggtgcaatgcggtagagctggagagttactgctgtgggaagtatcgttcgagccgaatagagatcgagacatcacccactatgtatttaaagtcgttagaaatggtcagcaatattggctagacgcacgtggagtgcaaaaacgtattccgcccaaagaatttcatttcaaattgaatgtaaaccatcaaccgccaaagtgggttcaagaacaagttttctatcagatttttcctgatcgttttgccgcgagtcaaagtgagtctgcgattcgtgaagcgtactacgagtacgatcctgatgctgagattaaaatgtggggagaaccagtagggaatcaccaaaactctggggcacgtgagttcttcggtggtgatctaaaaggcgttgagcaaaagcttggataccttgaacaattgggtgtgaccgcactgtacttcaatccgattttttcctcgccaagtaaccataagtacgacaccacggattatttcacgattgatcctatgctcggcaccaacgagcattttgcgtcattgtgcgaaaaaatccgcagcaaaaacatgaagatcgtattggatgcggtctttaaccatacttctgtgcatcacccttggtttgatattcagcagaaagggaaaggcgcgtacgggaatcctaaatccgattttcgcgactattacttctttgatggggagagtaatcactatattggctggaaaggtatcgacaatctgccggtattgaattttgagaatcacgaagtcagagaatatatctaccaaggtgaggcgtcggttatcaaacattggctgaagccaccatattccgtggatggctggcgttttgatgtcattcatatgctaggtgaaggggagggggcgaaaaataatgctcactacgtgaaagcatttcgccaagcgaccaaatccgttaatccgaatgcttatgtgttaggtgagcatttttttgaggcgactcaatggttgcaaggggagcaagaagatggcgcgatgaactactacggttttgcccatcctgttcgagcgtttattgcgcatcaagacatcacgtacgacccaattgatatagatggttttgagttcaaagcgtggttggatgaagccagagcaaaagttccttttgccaatcagctctcacaactcaatcaacttgatagccatgacacggcgcgttttctcaccttggtgaatggggatgagaaaaaaatgaaaatcgcgttggccttactcatgacttatgtcggtgcgccatgcatttattatggtagtgaagtcggtcttgagggaagctttgacccagataacagacgttgtttcccttggcatttagttcagggttcgccttggctccacctgtaccaacagtggattgaaattcgcaaacagttccaagctctacaatctggcagcatgcaatggctgtattgtgacgaaagggcatttgcttatgcaagacagcttggtgaagagacgatcattgttgcagtcaatattggtctacaagaaagcacgattgacctaccattgtggcagttaggcttgaatgcgaaacacttgcatcaattattagataagtgtgaaataattgattatgaaggtcatgtttctgtcaatatggcagcattaagtatcaatttgtggcaagtgaagtga

SEQ ID NO: 13619 - protein, 608 aa, Vibrio parahaemolyticus RIMD 2210633
MSLPFLFHSQTVDGLAFDGKRVKVCLKTEALTFDAVYVRIEPDNEEYLVAMVQCGRAGELLLWEVSFEPNRDRDITHYVFKVVRNGQQYWLDARGVQKRIPPKEFHFKLNVNHQPPKWVQEQVFYQIFPDRFAASQSESAIREAYYEYDPDAEIKMWGEPVGNHQNSGAREFFGGDLKGVEQKLGYLEQLGVTALYFNPIFSSPSNHKYDTTDYFTIDPMLGTNEHFASLCEKIRSKNMKIVLDAVFNHTSVHHPWFDIQQKGKGAYGNPKSDFRDYYFFDGESNHYIGWKGIDNLPVLNFENHEVREYIYQGEASVIKHWLKPPYSVDGWRFDVIHMLGEGEGAKNNAHYVKAFRQATKSVNPNAYVLGEHFFEATQWLQGEQEDGAMNYYGFAHPVRAFIAHQDITYDPIDIDGFEFKAWLDEARAKVPFANQLSQLNQLDSHDTARFLTLVNGDEKKMKIALALLMTYVGAPCIYYGSEVGLEGSFDPDNRRCFPWHLVQGSPWLHLYQQWIEIRKQFQALQSGSMQWLYCDERAFAYARQLGEETIIVAVNIGLQESTIDLPLWQLGLNAKHLHQLLDKCEIIDYEGHVSVNMAALSINLWQVK

SEQ ID NO: 13620 - DNA, 1818 bp, Salmonella enterica subsp. enterica serovar Typhi Ty2
  CDS (1)..(1818): transl_table=11
atgttgaatgcctggcacttaccggttgccccgtttgttaagcaacataacgataaattaaccattacgctgtggctgagcggagaaaatccgccgtctcgcgtgacgttgcgctcagaattcgataacgaagaaatctcactggcgatgcgcaaacagcgccgccagccgcagccgggcgtgacggcgtggcgagcgacgctcaatatcgcgttagggcagccccgtcgccgttacagctttaaattgctttggcatgaccgccagcgatggtttacgccgcagggatttagctgctttccacccgcgcgtctggaacaatttgcggttgatgtgccggatagcggcccgcagtgggtcgccgatcaaattttttatcagatcttcccggatcgttttgcccgcagcgcgacgcgtgaagccgatcaggaccgagtgtattaccatcatgccgcgggtcaggagattgtgctgcgcgactgggacgatcctttaaccccccaggcgggcggttccaccttttacggcggctgtctgaatggcatttgtgagaagctgccgtatctgaaaaaactgggcgtcacagcgctatatctgaatccggtatttaccgcgccgagcgtccataagtacgacacggaagattatcgccatgtcgatccgcaatttggcggcgatcgggcgctgctacgcctgcggcgtgaaacgcaagcacagggcatgaggctggtgctggatggcgtgtttaaccatagcggcgactcgcatgcgtggtttgacaggcataaccgcagcactggcggcgcgtgccatcacccggactcgccgtggcgcgactggtactccttttcaccacaaggcgtggcgctggactggctgggttatccgagcctgccgaaactcgattatcaatcagaaacgctggtggatgagatctatcgcggtgaggacagtatcgttcgtcactggctaaaggcaccgtggaatatggacggctggcggctggatgtcgtacatatgctgggcgaggcgggcggggcgcgccacaatttgcagcacgtcgccggcattacccgggcggcaaaagaggcgcagcctgaagcctatattgtgggggaacatttcagcgatgcgcggcagtggctacaggccgatgcggaagatgccgccatgaattatcgcggcttcaccttcccgctgtggggatttctcgccaatactgatatcgcttacgaaccacagcatattgatgcccggacctgtatcgcgtggatggataactaccgcgccggattatcgcaccagcagcaactgcgcatgtttaatcaactcgacagccatgatactgcgcgctttaaaaccctgctgggtaaagacgcggcgcgcctgccgctggcggtggtctggctgtttacctggcccggcgtgccatgtatttattacggcgatgaagtcggcgtggacggcgcaaatgaccccatgtgccgcaaaccgttcccatgggatgaacgcaagcaggacggcaacttgctggcgctgtaccagcgtatggcgaaactgcgccagagcagtctggcgctgcgtcgtggcggatgccaggcgctgtatgccgaaggtgacgtagtggtattcgtgcgagtttatcagcagcagcgggcgctggtggcgattaaccggggcgaggcctgtgaagtggcgctggaagcgttgccgttgctgaacgtggccggatggcaatgtaaaacgggaagcggtgacatccgcgagggaagacttagtttacccgcgatttccgcgacggtatggatgaatcgttga

SEQ ID NO: 13621 - protein, 605 aa, Salmonella enterica subsp. enterica serovar Typhi Ty2
MLNAWHLPVAPFVKQHNDKLTITLWLSGENPPSRVTLRSEFDNEEISLAMRKQRRQPQPGVTAWRATLNIALGQPRRRYSFKLLWHDRQRWFTPQGFSCFPPARLEQFAVDVPDSGPQWVADQIFYQIFPDRFARSATREADQDRVYYHHAAGQEIVLRDWDDPLTPQAGGSTFYGGCLNGICEKLPYLKKLGVTALYLNPVFTAPSVHKYDTEDYRHVDPQFGGDRALLRLRRETQAQGMRLVLDGVFNHSGDSHAWFDRHNRSTGGACHHPDSPWRDWYSFSPQGVALDWLGYPSLPKLDYQSETLVDEIYRGEDSIVRHWLKAPWNMDGWRLDVVHMLGEAGGARHNLQHVAGITRAAKEAQPEAYIVGEHFSDARQWLQADAEDAAMNYRGFTFPLWGFLANTDIAYEPQHIDARTCIAWMDNYRAGLSHQQQLRMFNQLDSHDTARFKTLLGKDAARLPLAVVWLFTWPGVPCIYYGDEVGVDGANDPMCRKPFPWDERKQDGNLLALYQRMAKLRQSSLALRRGGCQALYAEGDVVVFVRVYQQQRALVAINRGEACEVALEALPLLNVAGWQCKTGSGDIREGRLSLPAISATVWMNR

SEQ ID NO: 13622 - DNA, 2079 bp, Bacteroides thetaiotaomicron VPI-5482
  CDS (1)..(2079): transl_table=11
atgaataaacatctccactttttatctcttttgtggttgtcaatgctcatggcattcatgaccgcttgcagcgatgacaaaaatatcaccgaccctgctccggaacccgaaccgcccgtcgaagggcaatggaccgcacttaccgcctctcccgacacatgggacgagaccaaacgggcagacatctcctaccaattactgctctattccttcgccgacagcgacggagacggatatggagacctgaatggcgtcacccaaaagctggactatctcaaccaactaggcgtgaaagccctctggctctctcccatccacccctgtatgtcttatcacggatatgacgtcacagactacaccaaagtcaatccgcagctcggcacagaaagcgacttcgaccgtctggttacagaagcccacaaccgaggcatcaagatttatctggactacgtaatgaaccacaccggcactgcccacccgtggttcaccgaagctagttcatcatccgaaagcccgtatcgcaattattattctttctctgaagacccgaaaacagatatcgcagcaggcaaaatcgccatgatcacccaagaaggagcagccggatacaatgccgcagaatggtttcaggtttctgacgagaccgctgccgtgaaaggactgctgaaatttacactggactggagcaacgcaccttcccccatccttgtcgtttccacaggcaccaaagcagacgaggataatccagacacaggtaccgacaacgccaaatacttatactacggagaagacatctgtaaaaagttttatgacaaaggaaacaacatctatgaactcaccgtcgactttgagtccacttgggggcttctgatccgtactagcaatgcttctttctggccatccggaacaaaatacggcgcctcttcctcgtccgagaaactcgcgctgaacaaggatttcaaactgaccaacgccggcaaccctgccaacatcatgttcgacagccagcagatcacctatttccattctcatttctgcaccgactggtttgccgaccttaactacggccctgtagaccaggcaggcgaatcaccggcatatcaggcaatagcagacgccgccaaaggatggatcgcccgtggtgtggacggcctccgcctcgacgccgtgaagcacatctaccacagtgagaccagcgaagaaaatcctcgtttcctgaaaatgttctatgaagatatgaacgcctattacaaacaaaaaggacatacggacgacttctatatgataggcgaagtgttatcggaatacgataaagtagctccttattataaaggtctgcccgccctttttgaattttccttctggtatcgtctggaatggggaatcaataatagtaccggatgttattttgccaaagacatcctttcttaccaacagaaatacgccaactatcgaagcgattacatcgaagcaacgaaactgagtaaccatgacgaagaccgtacatcgtccaagttgggtaaatccgccgacaaatgcaaactggccgccgccgtcttactcacttccgccggacatccttacatctattacggtgaagaactgggactttacggaacaaaggataacggagacgaatatgtgcgcagcccgatgctatggggagatagctacactaccaactacacagacaagacggatgccaccgtttcgaaaaatgtgaaaacggtagcggaccaacaagccgatacccattcacttctgaacatatatttctccctcacccgattgcgcaacacctatccggcactggcagaaggaaatatgaccaaacattccgtctacaacgaatcacaggagaaagactataagccgattgccgcctggtatatgaccaaggacaacgagaaactgcttgtcatccataatttcggcggaacggccatgcaacttccgctgacagacaagattgagaaagtattgtttgtgaatggcgaaactcaacaaaatacagacagcgacagttacaccttgaaactgggaggatacgcctctgtagtattcaagttgggcaactaa

SEQ ID NO: 13623 - protein, 692 aa, Bacteroides thetaiotaomicron VPI-5482
MNKHLHFLSLLWLSMLMAFMTACSDDKNITDPAPEPEPPVEGQWTALTASPDTWDETKRADISYQLLLYSFADSDGDGYGDLNGVTQKLDYLNQLGVKALWLSPIHPCMSYHGYDVTDYTKVNPQLGTESDFDRLVTEAHNRGIKIYLDYVMNHTGTAHPWFTEASSSSESPYRNYYSFSEDPKTDIAAGKIAMITQEGAAGYNAAEWFQVSDETAAVKGLLKFTLDWSNAPSPILVVSTGTKADEDNPDTGTDNAKYLYYGEDICKKFYDKGNNIYELTVDFESTWGLLIRTSNASFWPSGTKYGASSSSEKLALNKDFKLTNAGNPANIMFDSQQITYFHSHFCTDWFADLNYGPVDQAGESPAYQAIADAAKGWIARGVDGLRLDAVKHIYHSETSEENPRFLKMFYEDMNAYYKQKGHTDDFYMIGEVLSEYDKVAPYYKGLPALFEFSFWYRLEWGINNSTGCYFAKDILSYQQKYANYRSDYIEATKLSNHDEDRTSSKLGKSADKCKLAAAVLLTSAGHPYIYYGEELGLYGTKDNGDEYVRSPMLWGDSYTTNYTDKTDATVSKNVKTVADQQADTHSLLNIYFSLTRLRNTYPALAEGNMTKHSVYNESQEKDYKPIAAWYMTKDNEKLLVIHNFGGTAMQLPLTDKIEKVLFVNGETQQNTDSDSYTLKLGGYASVVFKLGN

SEQ ID NO: 13624 - DNA, 1854 bp, Bacteroides thetaiotaomicron VPI-5482
  CDS (1)..(1854): transl_table=11
atgaaaaggaatttattattcattatcttactattattattacccggtcttcaccaggtattcgcaacaagcactataaagaaagtagccccgaccttttggtgggcaggaatgaagaatcccgaattgcagatactattatatggtgaccgcatatcatccgcagacgtcagtctttctgccgataatatcacgctgcaagaagtggtgaagcaggagaatcctaattatctggttctgtatttagacctttcgaaggctgctccacagaactttgacatcatcctgaaacaaggcaaaaagcagacaaaaatcccttacgagcttaaacagcgccggccgaatgcttcggcagtagaaggttttgattcgagcgacgtgctttatcttattatgccggaccgttttgccaatggcaacccctccaacgacatcattcccggaatgctggaaggaaatgtagaccgtaatgagcctttcgcacgtcatggcggtgatttgaaaggaatagagaatcatctggattacatagcagacctcggagtcaccagtatatggctcaacccgattcaggaaaatgacatgaaagaaggatcgtatcacggttatgccattaccgattattatcaggtagaccgccgcttcggcagtaacgaagagttccgcaaacttactcaggaagctaatgccaaagggctgaaagtcgtaatggacatgatcttcaaccattgcggttcggacaactatctgtttaaagatatgccctccaaagactggtttaactttgaaggcaactacgtgcagaccagcttcaagactgccactcaaatggacccgtatgcttccgattacgaaaagaaaatcgctatcgacggttggttcacactgaccatgccggacttcaaccaaagaaaccgtcatgtagctacttatctgatacagagcagtatctggtggattgaatacgccggtatcaacggcatccgtcaggatacacacccttatgccgacttcgatatgatggcacgctggtgcaaagcggtcaatgaagaatatcccaagttcaacattgtaggtgaaacatggctgggcaacaatgtactcatctcctactggcagaaagacagcagactcgcttatccgaagaacagcaatctcccgactgtcatggacttcccgctaatggaagagatgaacaaggctttcgacgaagagactaccgaatggaacggaggacttttcagactctacgaatatctatcacaggacatcgtctacagccatccaatgagcctgctgaccttcctcgacaatcacgatacttcccgcttctaccgttcggaagcagatacaaagaatctggaccgatacaagcaagccctgacgttcttactgacaacccgcggaataccgcagatatattatggaactgaaatcctgatggcagccgacaaggcgaatggagacggcctgctccgctgcgacttccccggaggctggccgaacgatacaaaaaactgctttgacgcagccaaccgcactccacagcaaaatgaagcattctcctttatgcaaaaactgctccaatggagaaaaggaaacgaagtcattgccaaaggtcagctcaaacatttcgcaccgaataaaggtgtctacgtttacgaacgcaaatacggtgataaatcagtcgttgttttcctgaatggaaacgaccgggaacagaccattgacctggttccttaccaagaaatacttcctgcctcatctgctttcgatttattgacagagaaaaaggttgaattaagaaatgaattaacacttccaagtcgtgaaatataccttttatccttttaa

SEQ ID NO: 13625 - protein, 617 aa, Bacteroides thetaiotaomicron VPI-5482
MKRNLLFIILLLLLPGLHQVFATSTIKKVAPTFWWAGMKNPELQILLYGDRISSADVSLSADNITLQEVVKQENPNYLVLYLDLSKAAPQNFDIILKQGKKQTKIPYELKQRRPNASAVEGFDSSDVLYLIMPDRFANGNPSNDIIPGMLEGNVDRNEPFARHGGDLKGIENHLDYIADLGVTSIWLNPIQENDMKEGSYHGYAITDYYQVDRRFGSNEEFRKLTQEANAKGLKVVMDMIFNHCGSDNYLFKDMPSKDWFNFEGNYVQTSFKTATQMDPYASDYEKKIAIDGWFTLTMPDFNQRNRHVATYLIQSSIWWIEYAGINGIRQDTHPYADFDMMARWCKAVNEEYPKFNIVGETWLGNNVLISYWQKDSRLAYPKNSNLPTVMDFPLMEEMNKAFDEETTEWNGGLFRLYEYLSQDIVYSHPMSLLTFLDNHDTSRFYRSEADTKNLDRYKQALTFLLTTRGIPQIYYGTEILMAADKANGDGLLRCDFPGGWPNDTKNCFDAANRTPQQNEAFSFMQKLLQWRKGNEVIAKGQLKHFAPNKGVYVYERKYGDKSVVVFLNGNDREQTIDLVPYQEILPASSAFDLLTEKKVELRNELTLPSREIYLLSF

SEQ ID NO: 13626 - DNA, 1767 bp, Enterococcus faecalis V583
  CDS (1)..(1767): transl_table=11
atgaacactgctgcaatctaccatcgtccagaaagtgaatttgcttatctttatacagaagaaaccatgcatattcgtttgcgtacggcaaaaggcgacattgcctctgtccaattagtgcaaggagatccttatcttttagggaaagaaaagtggtaccaacagtcgttaaccatggagaagttagtatctacggagttatatgattactggtttattgcattaagtgcaaaatttaaacgcctttcatatgcttttactttagtaggggcggatggtttgagggcgttttatggcgaacacggcatttatcctttagaagaaaagtatttagagatggcgaataattattttcggatgccgtattttcatgaaatcgatcgttttaaagcacctgaatgggtaaaagaaacggtttggtatcaaatatttccagagcgttttgcaaatggtgatctcgccaatgatcctgaagggacgttgccgtggggatctaaaagaccagatcgacaagatttttttggtggggatttgcaaggggtgctagatcatcttgattacattgaagatttaggtgttaacggcttatatttttgcccaatttttgaagcgttttctaatcacaaatatgatacgattgattatttaaaaattgacccagcttttggtgatggtgctacctttaagcgtttagtcgaagagtgtcatcgacggggcatcaagattatgttggacgccgtttttaaccatatgggggacacttcgcctcaatggcaagatgtgttaaaaaatggccaggactcaatttatgccgattggttccacgtaaatgagtttccagctagctatgaagaaagtgctgattttgaagaagcaagcaacattacctatgatacttttgcattcactccgcatatgcctaaattaaatacagcaaatccagaagtgcaagcctatcttttagaaattgctcgttattggattgaggaatatgatattgacgcctggcgtttagatgtggcaaacgaagtggatcatgcgttctggaaaaaattccggcaaacatgtgatgacgcaaaagaagatttttatattttaggagaaatttggcactcgtcgcaaagctggctccaaggagacgaatttcatgcagtgatgaattatgcatacacagatgcgattatgggctactttgtcaagcaagaactgtccttggaaaagatgctttctgaaatgaacaaccagttaatgctctatcgacaacaaacgaatcaaatgcagtttaatgttttagattcccacgatacaccacgcttattgcatgaaacgaaagaggataaagagctgatgcgccaagtattagcgtttacgtatattcaaccaggtgtcccttgtctttactatggtgatgaaattggtatgacaggtgatatggatcctgattgtcgtcgttgtatggtttgggaggaaaatcagcaagatttggatttgaaggaatttgtaaaatcattgattgcccttcgcaaaaagtatgcggctgttttttctggtggaacaatcgattggacaggaacttcttttgaaacggggttgattagactcgcttgtcgtttggaggaacagacgatttatgggatttttaatactggccaagagacacaatttgtcgatagaactgatcgagaagttttgctaagttcttctatcgaaattgcttcagaacagataatggttttaccaaaaggttttcttttatatcaagcataa

SEQ ID NO: 13627 - protein, 588 aa, Enterococcus faecalis V583
MNTAAIYHRPESEFAYLYTEETMHIRLRTAKGDIASVQLVQGDPYLLGKEKWYQQSLTMEKLVSTELYDYWFIALSAKFKRLSYAFTLVGADGLRAFYGEHGIYPLEEKYLEMANNYFRMPYFHEIDRFKAPEWVKETVWYQIFPERFANGDLANDPEGTLPWGSKRPDRQDFFGGDLQGVLDHLDYIEDLGVNGLYFCPIFEAFSNHKYDTIDYLKIDPAFGDGATFKRLVEECHRRGIKIMLDAVFNHMGDTSPQWQDVLKNGQDSIYADWFHVNEFPASYEESADFEEASNITYDTFAFTPHMPKLNTANPEVQAYLLEIARYWIEEYDIDAWRLDVANEVDHAFWKKFRQTCDDAKEDFYILGEIWHSSQSWLQGDEFHAVMNYAYTDAIMGYFVKQELSLEKMLSEMNNQLMLYRQQTNQMQFNVLDSHDTPRLLHETKEDKELMRQVLAFTYIQPGVPCLYYGDEIGMTGDMDPDCRRCMVWEENQQDLDLKEFVKSLIALRKKYAAVFSGGTIDWTGTSFETGLIRLACRLEEQTIYGIFNTGQETQFVDRTDREVLLSSSIEIASEQIMVLPKGFLLYQA

SEQ ID NO: 13628 - DNA, 1614 bp, Enterococcus faecalis V583
  CDS (1)..(1614): transl_table=11
atggaccaatggtggaaaaatgctgtcggttatcaaatttatcctcggagttttaaagatagcaacggggatggcattggtgatttgcagggaattattgagaaattaccgtatttaaaagaactaggggtcgattttttatggttaaatccgatttacacttcgccaaacgttgacaatggttatgatattgcggattatcaagggattcagccagagtttggtacgatggaagattttcaagaacttttggaccaagcgcatcaattaggtttgaagattattcttgatttagtggtcaatcataccagtgatcaacatccgtggtttgttgaagcgaaaaaaagtttagataatccgtatcgtgagtattatttatgggccgatgcgacaccagatcgtatgccgaatgaatggcaaagcttttttggtggctcgacttggacgtatgacgaaggtacaaagcaagcatattttcatgtgtttgcaaaagagcaacctgatttgaactggaaaaatcctaaagttcgtgaagagatttatgcgatgattcgctggtggttagatttgggaattgatggtttccgattggatgcgattagtcatatccaaaaagaaccttgggattttaaaattaccacgaatccgtgggctccatttatgaatgtaaaaggcattgaagactatatgctggatttgaaagttatttttgctgagtatgacatcatgacagtgggggaagctagtggcgtttcaagtaaaaaagcggtggaatggaccaatgatgcgggctatctgaatatgatttttgaattagagcacaatgttcgagaaggaaagccaggagaagaacggttaaatattttaggctataaaaaagtaatggctcgctggcaaaagcatttagggacagaaggctggaatgcattatatgtagaaaatcatgataatcccagaatcaattcaattttaggcaatgaaacctctcattctgctaaggcgattggaacaatcgccttgctcttgcgaggaacaccgtttatttatcaaggacaggaaatcggcatggttaattatccgtttcaacagattgacgagttagatgctaaagattctcataaccattatcgtttgcttatagaaagtggctacgatgcgaaacaagcattaaaagaagtggcgcattggacgcgggaccattcgcgtacgcctatgcagtggacgagtcaagaggcaagttcattcacctcggggcatccgtggttagcaattcatcccaatttcaaagaaataaatgtggctgaccaagaaacggatgcgcaatccgtattgaattattataaaaagttaattgcgttgcggaaagacaatccggtctttacagatggacagtttgaactattagcgcccaatcatccgtctgtttttgcttttttaagaaaaacaactgaggcaacagcgttagtgattgtcaatttaagtggagaaaagtgccaatttgacttgccgaataaattactaggcagaaagtggcaacaattattagggaatcaagattttacggtgaagaaacggatgcagttagcaccttatcaggcaggcgtcttccaataa

SEQ ID NO: 13629 - protein, 537 aa, Enterococcus faecalis V583
MDQWWKNAVGYQIYPRSFKDSNGDGIGDLQGIIEKLPYLKELGVDFLWLNPIYTSPNVDNGYDIADYQGIQPEFGTMEDFQELLDQAHQLGLKIILDLVVNHTSDQHPWFVEAKKSLDNPYREYYLWADATPDRMPNEWQSFFGGSTWTYDEGTKQAYFHVFAKEQPDLNWKNPKVREEIYAMIRWWLDLGIDGFRLDAISHIQKEPWDFKITTNPWAPFMNVKGIEDYMLDLKVIFAEYDIMTVGEASGVSSKKAVEWTNDAGYLNMIFELEHNVREGKPGEERLNILGYKKVMARWQKHLGTEGWNALYVENHDNPRINSILGNETSHSAKAIGTIALLLRGTPFIYQGQEIGMVNYPFQQIDELDAKDSHNHYRLLIESGYDAKQALKEVAHWTRDHSRTPMQWTSQEASSFTSGHPWLAIHPNFKEINVADQETDAQSVLNYYKKLIALRKDNPVFTDGQFELLAPNHPSVFAFLRKTTEATALVIVNLSGEKCQFDLPNKLLGRKWQQLLGNQDFTVKKRMQLAPYQAGVFQ

SEQ ID NO: 13630 - DNA, 1674 bp, Enterococcus faecalis V583
  CDS (1)..(1674): transl_table=11
atgaacagaaattggtggcaaaaagaagtggcctatcaaatttatccacgtagcttttcggatagtaataatgacggaattggtgatttacaaggcattattcaaaaactggattacttagaaaatttaggaattacgctgatttggctgagtccaatgtacccgtcgccaatggctgacaatggatatgatatttcagactattatggtatttctagcgattttggtacaatggcagacttcgatgaactcattgaagaagcaaaaaaacgaaacataaaagttattttagatttggtggtaaaccatacatctgatgaacatgcttggtttcaagatgttttaaaaaatcctcaaagtcgttttcgagacttttatattataaaagaaggacgagaagcacctacaaattggcggtctaacttcggtggtagtgtttgggaaaaattacctggggaagatgcctactactttcatgcctttcataaaaaacagccggatttaaattgggaaaatcctgaactacgcaaagaaatctatcaaatgattcgtttttggttaaacaaaggaattgctggttttcgtgtagatgcgattaattttattaagaaagatttgacttggacaaacttacctgctgatggggcagatcaattagccaaagtaacaaaagctagtagaaacatgccaggaatgagtgactttctgaacgaattaaaagaaaaagcttttgctggctttgatattgtcacagttgccgaagcggccggcgtcaattatctaaatttatcagaatttattggagaaacagggtatttcgacatgatttttgacttcaaatgggctgatttggatgtgaaatcaggaagcgaatggttttatagaatcgattggtcttggaatgatttacgcacattaattttcaaacagcaagaagccatgcaagaggctggttggagtgcaaattttattgaaaatcatgatcaacctcgagcgacaacgaaatatttaaaagaacaggctcaacagccaaatgcggttaaaacattcggcgccatgtatttctttttaaggggcacgccttttatttaccaaggacaagaattaggaatgaccaattttgaaaggggttcgattgatgaattcgatgatatttctagcattgatcaatactatcgagcaataaaagaaggatttacgcccaaagaagccttgtcacttgtcaatttgcgtagtcgagacaatgcccgcacgccttttccatggaatgattctatgtatggcggtttttcaagcgtcaagccttggttaggaatggtggataattataaagaaatcaatgccgaagcagaaataaaaaatagtcaaagtatttttcatttctataagcggatgattgcatttcgtcaaaagagtccctatacagacatcttactttatggaacatttgagggtctgtcaaatcttccagataatgttattgcttataaacgcaaattaaatgaaaaaacgatttacgccttttttaattttggtgaggcggttccaatccctcattatttagttaatggcacagttatttttgatacacagtctgaagaacgagagcaattagttcagcagggaacattattaaaaagctatcaaggactattgattactataaatgagtag

SEQ ID NO: 13631 - protein, 557 aa, Enterococcus faecalis V583
MNRNWWQKEVAYQIYPRSFSDSNNDGIGDLQGIIQKLDYLENLGITLIWLSPMYPSPMADNGYDISDYYGISSDFGTMADFDELIEEAKKRNIKVILDLVVNHTSDEHAWFQDVLKNPQSRFRDFYIIKEGREAPTNWRSNFGGSVWEKLPGEDAYYFHAFHKKQPDLNWENPELRKEIYQMIRFWLNKGIAGFRVDAINFIKKDLTWTNLPADGADQLAKVTKASRNMPGMSDFLNELKEKAFAGFDIVTVAEAAGVNYLNLSEFIGETGYFDMIFDFKWADLDVKSGSEWFYRIDWSWNDLRTLIFKQQEAMQEAGWSANFIENHDQPRATTKYLKEQAQQPNAVKTFGAMYFFLRGTPFIYQGQELGMTNFERGSIDEFDDISSIDQYYRAIKEGFTPKEALSLVNLRSRDNARTPFPWNDSMYGGFSSVKPWLGMVDNYKEINAEAEIKNSQSIFHFYKRMIAFRQKSPYTDILLYGTFEGLSNLPDNVIAYKRKLNEKTIYAFFNFGEAVPIPHYLVNGTVIFDTQSEEREQLVQQGTLLKSYQGLLITINE

SEQ ID NO: 13632 - DNA, 1719 bp, Streptomyces avermitilis MA-4680
  CDS (1)..(1719)
atgatcgtcaacgagcccgtcccggacaccttcgaggacacgcccgccaaggaccgcgatccggagtggttcaaacgcgccgtcttctacgaggtcctggtccgctccttccaggacagcaacggcgacggtgtcggcgacctgaagggcctgaccgccaagctggactatctgcagtggctgggcgtggactgcctgtggctgccgccgttcttcaagtcccccctgcgcgacggcggctacgacgtctccgactacaccgcggtgctgcccgagttcggtgacctggccgacttcgtcgagttcgtggacgcggcccaccagcgcggcatgcgcgtgatcatcgacttcgtgatgaaccacaccagcgacctgcacccgtggttccaggagtcccgcagcaaccccgacggcccctacggcgactactacgtgtgggccgacgacgacaagcagtaccaggacgcccggatcatcttcgtcgacaccgaggcctccaactggaccttcgacccggtccgcaagcagtactactggcaccgcttcttctcccaccagcccgacctcaactacgagaacccggcggtgcaggaggagatcgtctccgccctgcggttctggctcgacctcggcatcgacggcttccgcctcgacgcggtgccgtacctgtaccagcaggaaggcaccaactgcgagaacctgccggcgacgcacgagttcctgaagcgggtgcgcaaggagatcgacacgcactatccggacacggtgctgctcgcggaggcgaaccagtggccggaggacgtggtcgactacttcggcgacttcccctcgggcggcgacgagtgccacatggcgttccatttcccggtcatgccgcggatcttcatggcggtgcggcgtgagtcgcggtatccggtgtcggagatcctggcgaagacgccggcgatcccgtcgagctgccagtggggcatcttcctgcgcaaccacgacgagctgaccctggagatggtcaccgacgaggaacgcgactacatgtgggcggagtacgccaaggatccgcggatgcgggccaacatcggcatccgccggcgtctggcgccgctgctggacaacgaccgcaaccagatcgagctgttcaccgcgctgctgctgtcgctgcccggctcgccgatcctctactacggcgacgagatcggcatgggggacaacatctggctcggtgaccgggacgcggtgcgcactccgatgcagtggacgccggaccgcaacgcgggtttctcgtcctgcgacccggggcgtctgtatctgcccacgatcatggatccggtctacgggtaccaggtcacgaacgtggaggcgtcgatgtcgtcgccgtcctcgctgctgcactggacccggcggatgatcgagatccgtaagcagaacccggcgttcggcctcggctcgtacaccgaactccagtcctcgaacccggccgtcctcgcgttcctgcgggaggccccctcgaccggggggaacggggacgacctggtgctgtgcgtgcacaacttctcccggttcgcgcagcccacggagctggatctgcgggcgttcagcggccgtcatccggtcgagctgatcggcggtgtccgcttcccggccatcggggaactcccgtatctgctgaccctggcaggccacggcttctactggttccggctccgcaaggacgccgtctag

SEQ ID NO: 13633 - protein, 572 aa, Streptomyces avermitilis MA-4680
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTFDPVRKQYYWHRFFSHQPDLNYENPAVQEEIVSALRFWLDLGIDGFRLDAVPYLYQQEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDAV

SEQ ID NO: 13634 - DNA, 1752 bp, Streptomyces avermitilis MA-4680
  CDS (1)..(1752)
atgatcgtcaacgagcccgtcccggacaccttcgaggacacgcccgccaaggaccgcgatccggagtggttcaaacgcgccgtcttctacgaggtcctggtccgctccttccaggacagcaacggcgacggtgtcggcgacctgaagggcctgaccgccaagctggactatctgcagtggctgggcgtggactgcctgtggctgccgccgttcttcaagtcccccctgcgcgacggcggctacgacgtctccgactacaccgcggtgctgcccgagttcggtgacctggccgacttcgtcgagttcgtggacgcggcccaccagcgcggcatgcgcgtgatcatcgacttcgtgatgaaccacaccagtgacctgcatccgtggttccaggagtcccgcagcaaccccgacggcccctacggcgactactacgtgtgggccgacgacgacaagcagtaccaggacgcccggatcatcttcgtcgacaccgaggcctccaactggacgtacgacccggtccgcaagcagtactactggcaccgcttcttctcccaccagcccgacctcaactacgagagtgccgccgtccaggaggagatcctggcggcgctgcggttctggctcgatctgggcatcgacggcttcaggctggacgccgtcccctacctgtacaacgaagaggggacgaactgcgagaacctgccggcgacgcacgagttcctgaagcgggtgcgcaaggagatcgacacgcactatccggacacggtgctgctcgcggaggcgaaccagtggccggaggacgtggtcgactacttcggcgacttcccctcgggcggcgacgagtgccacatggcgttccatttcccggtcatgccgcggatcttcatggcggtgcggcgtgagtcgcggtatccggtgtcggagatcctggcgaagacgccggcgatcccgtcgagctgccagtggggcatcttcctgcgcaaccacgacgagctgaccctggagatggtcaccgacgaggaacgcgactacatgtgggcggagtacgccaaggatccgcggatgcgggccaacatcggcatccgccggcgtctggcgccgctgctggacaacgaccgcaaccagatcgagctgttcaccgcgctgctgctgtcgctgcccggctcgccgatcctctactacggcgacgagatcgggatgggggacaacatctggctcggtgaccgggacgcggtgcgcacgccgatgcagtggacgccggaccgcaacgcgggtttctcgtcctgcgacccggggcgtctgtatctgcccacgatcatggatccggtctacgggtaccaggtcacgaacgtggaggcgtcgatgtcgtcgccgtcctcgctgctgcactggacccggcggatgatcgagatccgtaagcagaacccggcgttcggcctcggctcgtacaccgaactccagtcctcgaacccggccgtcctcgcgttcctgcgggaggccccctcgaccggggggaacggggacgacctggtgctgtgcgtgcacaacttctcccggttcgcgcagcccacggagctggatctgcgggcgttcagcggccgtcatccggtcgagctgatcggcggtgtccgcttcccggccatcggggaactcccgtatctgctgaccctggcaggccacggcttctactggttccggctccgcaaggacgtcacccaggtcaccaaggtgagcttgttcgtgagctcttga

SEQ ID NO: 13635 - protein, 583 aa, Streptomyces avermitilis MA-4680
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTYDPVRKQYYWHRFFSHQPDLNYESAAVQEEILAALRFWLDLGIDGFRLDAVPYLYNEEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDVTQVTKVSLFVSS

SEQ ID NO: 13636 - DNA, 1665 bp, Bacillus anthracis str. Ames
  CDS (1)..(1665): transl_table=11
atgaataagacatggtggaaagaagcggttgcttatcaaatttatccacgtagctttatggattcaaatggtgatggtattggagatttacaaggtattattgcgaaactggattatttaaaagatttaggaatagatgtaatttggatttgtccaatgtataagtcacctaatgatgataatggttatgacattagtgattatcaagatattatggatgagtttgggacgatggaagactttgatgctttactagatgaagttcataaacgtgatatgaagcttattattgatttagttattaatcatacaagtgatgaacatccatggtttattgagtctcgttcatctaaagacaatccgaagcgtgattggtatatttggcatgatggtaaagatggtgcagaaccaaacaactgggaaagtatttttaatggttcggcatgggagtatgatgaagtaacaggacaatattatttacacttattctcgcgtaaacaaccagatttaaactgggagaataaagaagttcgagaagtgctatacgatacagttaattggtggcttgataaaggaattgatggtttccgagtagatgcaatcagccatattaaaaaagaagatggctttaaagatatgccaaatccaaaaggactaaagtatgttccatcttttgataaacatatgaatgtggatggtattcaacctttattagaagaattaaaagaaaatacgttttctaagtacgatattatgactgttggtgaagcgaatggcgttaagattgaagatgctgagctttgggttggagaagagcaaggtaagttcaatatggtattccaattcgaacatttaagtttatgggatgcagaaaagaagaaagatcttgatgttgtagggctgaaaaaggtattaacgaaatggcaaaaagggttagaaaataaaggatggaatgctttatatattgagaatcacgataagccgcgtatcgtttcaacttggggagatgataaacaatattggcgtgaaagtgcgacagctttaggagcaatgtatttctttatgcacggtacaccgtttatttatcaaggacaagaaattgggatgacaaatgttcaattcccaaacattgaagattacgatgatgtagcaattaaaaatttatatcgcgagaaaattgcagagggcgtatcccatcaagatatgatggaaattatatgggcttcttgccgcgataattcacgtacgcctatgcattgggacgatgagataaatgctggtttcacaacaggtacgccttggtttggtatgaatcaaaactacaaagaaatcaatgttgcaaagcaaaagaatgaagagaactctattttcaatttctataagaaaatgattgccctgaaaaaagagcatgatgtactgaattatggtacgtacgatttacttttagaagatgacccgcaaatttatgcatatactcgtacactaaacgatgaaaaaatagtcgtaattagtaatatctcaaaagaggaagctgtgtataatgaggatttatttgcactagaacgcaaacgtttgcttttaaataactatgaagttgcggaacatgaacaattaactacaatcacgttaaagccttatgaaacaagggtttatcgcatttcataa

SEQ ID NO: 13637 - protein, 554 aa, Bacillus anthracis str. Ames
MNKTWWKEAVAYQIYPRSFMDSNGDGIGDLQGIIAKLDYLKDLGIDVIWICPMYKSPNDDNGYDISDYQDIMDEFGTMEDFDALLDEVHKRDMKLIIDLVINHTSDEHPWFIESRSSKDNPKRDWYIWHDGKDGAEPNNWESIFNGSAWEYDEVTGQYYLHLFSRKQPDLNWENKEVREVLYDTVNWWLDKGIDGFRVDAISHIKKEDGFKDMPNPKGLKYVPSFDKHMNVDGIQPLLEELKENTFSKYDIMTVGEANGVKIEDAELWVGEEQGKFNMVFQFEHLSLWDAEKKKDLDVVGLKKVLTKWQKGLENKGWNALYIENHDKPRIVSTWGDDKQYWRESATALGAMYFFMHGTPFIYQGQEIGMTNVQFPNIEDYDDVAIKNLYREKIAEGVSHQDMMEIIWASCRDNSRTPMHWDDEINAGFTTGTPWFGMNQNYKEINVAKQKNEENSIFNFYKKMIALKKEHDVLNYGTYDLLLEDDPQIYAYTRTLNDEKIVVISNISKEEAVYNEDLFALERKRLLLNNYEVAEHEQLTTITLKPYETRVYRIS

SEQ ID NO: 13638 - DNA, 1761 bp, Bacillus anthracis str. Ames
  CDS (1)..(1761): transl_table=11
atgcttaaagaagccatttatcataggccaaaagataattacgcatacgcttacgatgaaaaaacgattcacatccgaatacgtacgaaaagagacgatgttcaaagcaccactcttatttatggtgatccttatgaatggaaagacgggaagtggatttcttcaagtacaccgatgaaaaaaactggttctactgcattgtttgattattggttcatttccatcgagccgaaatttaagcgcttacgttatggatttgaattaaaaaacgatacagacactcttatttatgcagagcgaggatttttttctaccactccaaatgatgacgttggtaactttttctgttttccatttattcatgcaaatgatgtattcaaagcaccttcttggattaaagatactgtttggtatcaaattttcccagaacggttcgctaatggagatcatacgctgaatccagaaaacacccttccttggggcagcgctgagccaactccaactaattttttcggtggagattttgctggtattattcaaaaccttgattaccttgttaagcttggaatttcaggaatatatttcacacctattttcaaagcacattcaaaccataaatatgacacaattgactacatggaaatcgatccacaatttggtacaaaagaaacattcaaagaactcgttcaggcatgtcatacacacggtataaaagtaatgctcgatgctgtattcaatcacagtggatactttttcgataaatttcaagacgtactacaaaatggtgagcagtcagcatataaagaatggttccatattcatgagttcccaattagaactgagccactcccgaattatgatactttcgcgtttacaccgtatatgccgaaattaaacacagcgcacccggatgtaaaagaatacttacttgaagtagggcgttattgggtgagagaattcaatatagacggttggcgccttgatgtagcaaatgaagtcgaccataacttttggagagaatttcgaagtgagataaaagcattaaattctgaagtatatattttaggagaaatttggcacgatgcacttccatggctacaaggagatcaattcgatgctgtcatgagctatcctgttacaaacgccctactgtcttactttgctaacgattccattaaggcaaatgaatttatgaaacaaattacagaatctctacattcctactctatgaatgtaaatgaagcagcatttcatttattagatagccatgatacaccaagaattttgacaacatgtaacggagataaaaataagttaaaattactttatgtattccatctttctttcatcggctctccttgtatttattatggagacgaaattggtatggacggcggtatggacccagattgtcgcaaatgtatggtttgggatacggaagaacaagatcatacattatttacacatgtacaaacattaatttcattacgaaagcaatataaagcatttggaggacatggtactttccaattcattgaagcaaatgatgaatataattatatttcttatacgaaaacatatgaagatgaaacgatctttttcgttttaaatccgactaatagtgatattacagcttcactccctctccatgttactggaaagaaaatcattaatatttatacaaacgaagaattttcagcggaagcaagtgtattacaagttacacttcctccatatggattctccatattaaaatggtaa

SEQ ID NO: 13639 - protein, 586 aa, Bacillus anthracis str. Ames
MLKEAIYHRPKDNYAYAYDEKTIHIRIRTKRDDVQSTTLIYGDPYEWKDGKWISSSTPMKKTGSTALFDYWFISIEPKFKRLRYGFELKNDTDTLIYAERGFFSTTPNDDVGNFFCFPFIHANDVFKAPSWIKDTVWYQIFPERFANGDHTLNPENTLPWGSAEPTPTNFFGGDFAGIIQNLDYLVKLGISGIYFTPIFKAHSNHKYDTIDYMEIDPQFGTKETFKELVQACHTHGIKVMLDAVFNHSGYFFDKFQDVLQNGEQSAYKEWFHIHEFPIRTEPLPNYDTFAFTPYMPKLNTAHPDVKEYLLEVGRYWVREFNIDGWRLDVANEVDHNFWREFRSEIKALNSEVYILGEIWHDALPWLQGDQFDAVMSYPVTNALLSYFANDSIKANEFMKQITESLHSYSMNVNEAAFHLLDSHDTPRILTTCNGDKNKLKLLYVFHLSFIGSPCIYYGDEIGMDGGMDPDCRKCMVWDTEEQDHTLFTHVQTLISLRKQYKAFGGHGTFQFIEANDEYNYISYTKTYEDETIFFVLNPTNSDITASLPLHVTGKKIINIYTNEEFSAEASVLQVTLPPYGFSILKW

SEQ ID NO: 13640 - DNA, 1641 bp, Mycobacterium bovis AF2122/97
  CDS (1)..(1641): transl_table=11
atggaccaacaccagcgaccggatccaatgggccccggctctcctcgcgccagcgctcgtcgaccggagccagatccgatgggcgagccgtggtggtcgcgagccgtgttctaccaggtctatccccgatcgttcgccgacagcaacggcgacggggtgggcgacctggacgggttggcgagccggcttgaccacctgcaacagctcggtgtcgacgcgatctggatcaacccggtcaccgtctcgccgatggcagaccacggatacgacgtcgccgatccccgcgacatcgacccactcttcggcgggatgccggcgttcgaacggttggtcgctgcggcacaccggcagggcatcaaagtcaccatggacgtggtgcccaaccacaccagttcggcgcacccatggtttcaggccgcgctggctgacctcccgggtagcccggcgcgggatcgctatttctttcgcgacgggcggggccccgacgggtcgctgccgccgaacaactgggagtcggtgttcggcgggccggcctggacccgagtgcgcgaaccggacggcaacccgggccagtggtacctgcaccttttcgacaccgaacagccggacctgaactcggacaacccggaaatccttgacgacttcgagaaaacactgcgcttctggctggaccgcggcgtggatggcttccgcatcgacgtggcgcacggcatggccaagcccccgggcctgccggactcaccggacctgggcatcgaggtgctgcaccaccgcgatgacgacccgcgcttcaaccacccgaatgtgcacgcgattcaccgcgacatccgcacggtgatcgacgagtaccccggagcggtaaccgtcggcgaggtgtgggtacacgacaacgcccgctgggcggagtatctgcggcccgacgaactgcatctcggcttcaatttccggctggcgcgaaccgagttcgacgccgccgagatccgcgacgcggtggcgaactccctggccgccgcggcgctgcagaacgcgaccccaacctggacgctggccaatcacgatgtgggacgggaggttagccgctacggcggcggcgagatcgggctgcgccgggccaaggcgatggcggtggtgatgctcgccctgccgggcgtggtcttcctctacaacggccaggaactgggtttgcccgacgtggacctgcccgacgaggtgctgcaggatccgacgtgggaacgctcgggacgcaccgaacgcggtcgcgatggctgccgggtgccgattccctggtcgggcaacattcccccgttcgggttctcgacgtgtccagacacctggttgccgatgccgccggaatgggcggcgctgaccgccgaaaaacaacgcgctgatgccggctcgaccttgtcgttttttcgacttgcactcagattacgtagggaacgaaatgaattcgacggcgacgtcgactggctggccgcgcccgacgatgcgctgatattccggcgtcacggcgggggtttggtgtgcgcgctcaacgccgctgagcgtccgctggcgctgccggcaggtgaacccatcctggccagcgcaccgttgaccgacgccacgttgccacccaatgccgcggcctggctggtgtag

SEQ ID NO: 13641 - protein, 546 aa, Mycobacterium bovis AF2122/97
MDQHQRPDPMGPGSPRASARRPEPDPMGEPWWSRAVFYQVYPRSFADSNGDGVGDLDGLASRLDHLQQLGVDAIWINPVTVSPMADHGYDVADPRDIDPLFGGMPAFERLVAAAHRQGIKVTMDVVPNHTSSAHPWFQAALADLPGSPARDRYFFRDGRGPDGSLPPNNWESVFGGPAWTRVREPDGNPGQWYLHLFDTEQPDLNSDNPEILDDFEKTLRFWLDRGVDGFRIDVAHGMAKPPGLPDSPDLGIEVLHHRDDDPRFNHPNVHAIHRDIRTVIDEYPGAVTVGEVWVHDNARWAEYLRPDELHLGFNFRLARTEFDAAEIRDAVANSLAAAALQNATPTWTLANHDVGREVSRYGGGEIGLRRAKAMAVVMLALPGVVFLYNGQELGLPDVDLPDEVLQDPTWERSGRTERGRDGCRVPIPWSGNIPPFGFSTCPDTWLPMPPEWAALTAEKQRADAGSTLSFFRLALRLRRERNEFDGDVDWLAAPDDALIFRRHGGGLVCALNAAERPLALPAGEPILASAPLTDATLPPNAAAWLV

SEQ ID NO: 13642 - DNA, 1761 bp, Rhodopirellula baltica SH 1
  CDS (1)..(1761): transl_table=11
ttgcatgggcggaacatggcgactgtcgagtacgaaatgcagcaacaggcaatcgccccgcgttttgccaattcgaattttacgcctcacaaccgaccaaggcatcccttcactatcaaaacgcattcacaaaaatctgctccgtcgaaaccagccgaacgtcgctggtgggaaaccggtgtgatctatcaaatctatccgcggtctttccaagacagcaatgccgacggtgtgggcgatctggcaggtatcaagcaacggctggactatctggttcgcctcggagttgacgcggtatggctttcaccgatttatccttcgccgatgttcgatttcggttacgacgtctcggactactgcggcattgatccgttgttcggtgatctgacagccttcgatcggttgctcaccgccatgcattcgcgtggtctcaagcttctgatggactttgttccgaaccactcatcagatcaacatccatggtttgtccagagccgttcatctcgcgacaatcccaagcgggattggtacatctggcgagatgcatcagctgacggcggtccacctaacaattggatcagcgatttcggtggctcgtcttggcaatgggacgcaacgacccggcaatactatttgcacgcctttcttccgcagcaacccgatctcaactggcgtcatcccgaactgcgtgaggcgatgatgaatgtcctgcggttctggttggatcgcggtgtcgatggatttcgcatggacgtgctttggcacatcgtcaaagacgccgctcttcgagacaatccgatcaatccggactggacgtctgaccgtacacagcgtgaccagctgattcagctgcactccaccgaccaaccagaagcccattcaatcgcggctgagtttcgcactttggcggacaactacggtgatcgcgttttgattggtgagatcagcctgcccaatgatcgactcgcgcgatggtttgggacggaagaacgaccggaggtacatctgccgaccaactttcatctcatcgaatgcgagtggaacgctccaaccctccgacgtgtgatcgctaactacgaagcgtcccttccaaactttggatggccgaactgggttttgggcagtcacgatgctcctcgcattgccgcccgacttggtgacgctcaatcccgagtcgccgccatgctgctgctaaccctgcgtggcacgcccacgctctatcaaggcgacgaaattgggattggtgaggtccccattcctcgcgatcaaattcgcgaccctcaggatttacggcaacctgaactgaatatcggacgagatcgatctcgcacgccgatgccttgggacgattccgccttcgccggtttcagcgtcaacgacacgtggctcccgctcaatcctgattggcgtcaaagaaacgttgcgacgcaggaggctgatccacagtcaattttgaatttgtacagaacactgctctcgcttcggcgaagccacgctgcgttatcgaacggcgacttcacacttctcgattccgacgatgatgtgctcgctttcgaaagaagacacggcgacgaacacctgttgatcgcgctgaacctcagtgagcaaacccgatcgttgccggtgccgtcgaaagctgccctcgtcacggtgctctgttccaccgtgtctcctcgagcaatcgatggaactctcgtaccaaacgaagggctgcttctgcaattggtagacaacgaagatcaatccgggcaagtttcatga

SEQ ID NO: 13643 - protein, 586 aa, Rhodopirellula baltica SH 1
MHGRNMATVEYEMQQQAIAPRFANSNFTPHNRPRHPFTIKTHSQKSAPSKPAERRWWETGVIYQIYPRSFQDSNADGVGDLAGIKQRLDYLVRLGVDAVWLSPIYPSPMFDFGYDVSDYCGIDPLFGDLTAFDRLLTAMHSRGLKLLMDFVPNHSSDQHPWFVQSRSSRDNPKRDWYIWRDASADGGPPNNWISDFGGSSWQWDATTRQYYLHAFLPQQPDLNWRHPELREAMMNVLRFWLDRGVDGFRMDVLWHIVKDAALRDNPINPDWTSDRTQRDQLIQLHSTDQPEAHSIAAEFRTLADNYGDRVLIGEISLPNDRLARWFGTEERPEVHLPTNFHLIECEWNAPTLRRVIANYEASLPNFGWPNWVLGSHDAPRIAARLGDAQSRVAAMLLLTLRGTPTLYQGDEIGIGEVPIPRDQIRDPQDLRQPELNIGRDRSRTPMPWDDSAFAGFSVNDTWLPLNPDWRQRNVATQEADPQSILNLYRTLLSLRRSHAALSNGDFTLLDSDDDVLAFERRHGDEHLLIALNLSEQTRSLPVPSKAALVTVLCSTVSPRAIDGTLVPNEGLLLQLVDNEDQSGQVS

SEQ ID NO: 13644 - DNA, 3342 bp, Bordetella pertussis Tohama I
  CDS (1)..(3342): transl_table=11
atgcctgccacccatcccgctcccgacccgctctggtacaaggacgccgtcatctaccagttgcacgtcaagtccttcttcgacgccaacgacgacggcgtgggcgacttcgccggcctgctggccaagctggactacatcgtcgagctgggcgtcaataccatctggctgctgccgttctatccgtcgccgcgccgcgacgacggctacgacatcgccgactatcgcggggtgcaccccgactatggctcgctggccgacgcccggctgctggtgcgggcggcccacgcgcgcggcctgcgcgtcatcaccgagctggtcatcaaccacacctccgaccagcacccttggttccagcgcgcccgcgccgcgcggccgggttcggcgcaccgcgcctattacgtctggtcggacgacgacaaggcctatgccggcacgcgcatcatcttctgcgacacggaaaagtccaactggacctgggacccggtggccggcgcctatttctggcaccgcttctattcgcaccagcccgacctgaactacgacaatccgcaggtgctgcgcgaagtgctgggcgcgatgcgctactggctggacatgggcgtggacggcctgcgcctggacgcggtgccctacctggtcgagcgggaaggcaccaacaacgagaacctgccggaaacccacgccatcctgcggcgcatccgccgcgtcatcgacagcgagtatcccggcaggatgctgctggccgaggccaaccagtggcccgaggacgcgcaagagtacttcggcgccggcgacgaatgccacatggcgttccactttcccctgatgccgcgcatgtacatggccatcgcgcaggaggaccgcctgcccgtcaccgacatcatccgccagacgccgtccatcgcgccgcaatgccaatgggccattttcctgcgcaaccacgacgagctgaccctggagatggtgaccagccgcgaacgcgactacctgtggaacgtctacgcggccgagccgcgcgcgcgcatcaacctgggcatccggcgccgcctggcgccgctgctcgagcgcgaccggcgccgcatcgaactgatgaacagcctgctgctgtccatgccgggcacgccggtgctgtactacggcgacgagctgggcatgggcgacaacatccacctgggcgaccgcgacggcgtgcgcacgcccatgcaatggtcgcccgaccgcaacggcggcttctcgcgcgccgaccccgagcgcctgccgctgccgctgctgatggggccgctgtacggctacgaggcggtcaacgtggaggcgcagcagcgcgacccgcattcgctgctgaactggacccgccgcatgctggccaagcgccgccagagccatgtgttcggccgtggcgaactgtcgttcctgtatccgggcaaccgcaagatcctggcctatctgcgcacctgggaagacacggtggtgctgtgcgtggccaacctttcgcaggcggcccagccggtcgaactgcacctgtccgagtacgccggccgcgtaccggtggaaatgctgggcggcaccgcctttccgcagatcggcgagctgccctatctgctgacgctgccgcctttcggcttctactggctggacctgagcgccggcgccgcgccgcccgcgtggcacagcgagctgccgccgcaaatgccggaatcgatcaccctggtgtcgcgcggcgcgggcgcggcgctgcgcctgaccgaggcatcgcgccgccagctggaagcggacgtgctgccggcctacctgcagcggcagcgctggtatgccgcgcgccgcaagcccggcgtcatgcggctggcctacagcgtgccgctgaacgacgacgtggaaagctattacgaagccgagatcgaagtcagcgacgacggaccgccgcgccgcttccatacgccggtggcgctggcctggcaggacgataccgccgcccagtatccgctggcgcgcgtgcggcgcggcgcgcagctgggcacgctcaccgacgcctcgctgcagcccggctatgcgcgcgtgctgctggcggccctgacggccggccgcgatatccaggccggcggcgagcccgccgtgcggctgcgcttcctgcccgagccgggcctggccgacctggcgctgcgcgatgacagcgaggtgcgcgcgctcagcgccgaccagtccaacagttcgctgctggtcggcgagcgcgtcgtgttcaagctgctgcgcgagctgcatgccggcccgcaccccgaagccgagatgacgcgctacctcacccaggccggctacgcgcatacgccggcgctgctaggcgaggtcgtgcgcgtgcagggcgaccaggcgccccatacgctggcgctggcccacgcctacgtcgtcaacgaaggcgatgcgtggaactggaccgtggcctacctgaaacgcacgctcgacgccgccatactgaccggcgccagcgccgacgactaccagcaggaactggccggctacgaagtgctggccggcaccatcgggcaacgcctggctcagatgcactcggtgctggcgcgcgccggcgaactgccgggcttcgcgccgcggccggccagcgagcgcgacgccgccctggcgggcgagcgcgcggtggcgcagctggaccgcgcgctgcaggccttgcgggcgtgcgagagcgggctcgcccctgcatcgcacgcctgcgcgcaatggctgttcgagcatcgcgaccggctggcggcccacatcatgacactggcgcaggccgaaaccggcgcgctgcgcatccgcgtgcacggcgacttccatctcggccagatcctggtcgcgcagaccgacgcctacctgatcgatttcgagggcgagccggcccggcccatggccgagcgccggcaactgagcagcccgttcaaggacgttgccggtattctgcgctcgttcgactatgcggtggccgaactcagccgcgacgatccgctgggcggcgcgccgcgcgacttcaacaccggcgtggccgagccggccgacccggccagcgcgccccgggaaacgcgcgaggcgctgctggcgcgcttccggcagcgcgccggcgcggccctgctggccagctatggcaatgccatcgaccccgtgctggccttgccgcccgagcgtgcccaggcgcttacctgcctgtacctgctggagaaggccgcctacgaaatctgctacgagtcggcctaccggcccgagcgcctgccggtgcccatccatggcctggccgaaaccgcccgcgccgcgctgctggcggccgccgtcgaccacgatgaaggaccggcgccatga

SEQ ID NO: 13645 - protein, 1113 aa, Bordetella pertussis Tohama I
MPATHPAPDPLWYKDAVIYQLHVKSFFDANDDGVGDFAGLLAKLDYIVELGVNTIWLLPFYPSPRRDDGYDIADYRGVHPDYGSLADARLLVRAAHARGLRVITELVINHTSDQHPWFQRARAARPGSAHRAYYVWSDDDKAYAGTRIIFCDTEKSNWTWDPVAGAYFWHRFYSHQPDLNYDNPQVLREVLGAMRYWLDMGVDGLRLDAVPYLVEREGTNNENLPETHAILRRIRRVIDSEYPGRMLLAEANQWPEDAQEYFGAGDECHMAFHFPLMPRMYMAIAQEDRLPVTDIIRQTPSIAPQCQWAIFLRNHDELTLEMVTSRERDYLWNVYAAEPRARINLGIRRRLAPLLERDRRRIELMNSLLLSMPGTPVLYYGDELGMGDNIHLGDRDGVRTPMQWSPDRNGGFSRADPERLPLPLLMGPLYGYEAVNVEAQQRDPHSLLNWTRRMLAKRRQSHVFGRGELSFLYPGNRKILAYLRTWEDTVVLCVANLSQAAQPVELHLSEYAGRVPVEMLGGTAFPQIGELPYLLTLPPFGFYWLDLSAGAAPPAWHSELPPQMPESITLVSRGAGAALRLTEASRRQLEADVLPAYLQRQRWYAARRKPGVMRLAYSVPLNDDVESYYEAEIEVSDDGPPRRFHTPVALAWQDDTAAQYPLARVRRGAQLGTLTDASLQPGYARVLLAALTAGRDIQAGGEPAVRLRFLPEPGLADLALRDDSEVRALSADQSNSSLLVGERVVFKLLRELHAGPHPEAEMTRYLTQAGYAHTPALLGEVVRVQGDQAPHTLALAHAYVVNEGDAWNWTVAYLKRTLDAAILTGASADDYQQELAGYEVLAGTIGQRLAQMHSVLARAGELPGFAPRPASERDAALAGERAVAQLDRALQALRACESGLAPASHACAQWLFEHRDRLAAHIMTLAQAETGALRIRVHGDFHLGQILVAQTDAYLIDFEGEPARPMAERRQLSSPFKDVAGILRSFDYAVAELSRDDPLGGAPRDFNTGVAEPADPASAPRETREALLARFRQRAGAALLASYGNAIDPVLALPPERAQALTCLYLLEKAAYEICYESAYRPERLPVPIHGLAETARAALLAAAVDHDEGPAP

SEQ ID NO: 13646 - DNA, 3342 bp, Bordetella bronchiseptica RB50
  CDS (1)..(3342)
atgcctgccacccatcccgctcccgacccgctctggtacaaggacgccgtcatctaccagttgcacgtcaagtccttcttcgacgccaacgacgacggcgtgggcgacttcgccggcctgctggccaagctggactacatcgtcgagctgggcgtcaataccatctggctgctgccgttctatccgtcgccgcgccgcgacgacggctacgacatcgccgactatcgcggggtgcaccccgactatggctcgctggccgacgcccggcggctggtgcgggcggcccacgcgcgcggcctgcgcgtcatcaccgagctggtcatcaaccacacctccgaccagcacccttggttccagcgcgcccgcgccgcgcggccgggttcggcgcaccgcgcctattacgtctggtcggacgacgacaaggcctatgccggcacgcgcatcatcttctgcgacacggaaaagtccaactggacctgggacccggtggccggcgcctatttctggcaccgcttctattcgcaccagcccgacctgaactacgacaatccgcaggtgctgcgcgaagtgctgggcgcgatgcgctactggctggacatgggcgtggacggcctgcgcctggacgcggtgccctacctggtcgagcgggaaggcaccaacaacgagaacctgccggaaacccacgccatcctgcggcgcatccgccgcgtcatcgacagcgagtatcccggcaggatgctgctggccgaggccaaccagtggcccgaggacgcgcaagagtacttcggcgccggcgacgaatgccacatggcgttccactttcccctgatgccgcgcatgtacatggccatcgcgcaggaggaccgcctgcccgtcaccgacatcatccgccagacgccgtccatcgcgccgcaatgccaatgggccattttcctgcgcaaccacgacgagctgaccctggagatggtgaccagccgcgaacgcgactacctgtggaacgtctacgcggccgagccgcgcgcgcgcatcaacctgggcatccggcgccgcctggcgccgctgctcgagcgcgaccggcgccgcatcgaactgatgaacagcctgctgctgtccatgccgggcacgccggtgctgtactacggcgacgagctgggcatgggcgacaacatccacctgggcgaccgcgacggcgtgcgcacgcccatgcaatggtcgcccgaccgcaacggcggcttctcgcgcgccgaccccgagcgcctgccgctgccgctgctgatggggccgctgtacggctacgaggcggtcaacgtggaggcgcagcagcgcgacccgcattcgctgctgaactggacccgccgcatgctggccaagcgccgccagagccatgtgttcggccgtggcgaactgtcgttcctgtatccgggcaaccgcaagatcctggcctatctgcgcacctgggaagacacggtggtgctgtgcgtggccaacctttcgcaggcggcccagccggtcgaactgcacctgtccgagtacgccggccgcgtaccggtggaaatgctgggcggcaccgcctttccgcagatcggcgagctgccctatctgctgacgctgccgcctttcggcttctactggctggacctgagcgccggcgccgcgccgcccgcgtggcacagcgagctgccgccgcaaatgccggaatcgatcaccctggtgtcgcgcggcgcgggcgcggcgctgcgcctgaccgaggcatcgcgccgccagctggaagcggacgtgctgccggcctacctgcagcggcagcgctggtatgccgcgcgccgcaagcccggagtcatgcggctggcctacagcgtgccgctgaacgacgacgtggaaagctattacgaagccgagatcgaagtcagcgacgacggaccgccgcgccgcttccatacgccggtggcgctggcctggcaggacgataccgccgcccagtatccgctggcgcgcgtgcggcgcggcgcgcagctgggcacgctcaccgacgcctcgctgcagcccggctatgcgcgcgtgctgctggcggccctgacggccggccgcgatatccaggccggcggcgagcccgccgtgcggctgcgcttcctgcccgagccgggcctggccgacctggcgctgcgcgatgacagcgaggtgcgcgcgctcagcgccgaccagtccaacagttcgctgctggtcggcgagcgcgtcgtgttcaagctgctgcgcgagctgcatgccggcccgcaccccgaagccgagatgacgcgctacctcacccaggccggctacgcgcatacgccggcgctgctgggcgaggtcgtgcgcgtgcagggcgaccaggcgccccatacgctggcgctggcccacgcctacgtcgtcaacgaaggcgatgcgtggaactggaccgtggcctacctgaagcgcacggtcgacgccgccatgctgaccggcgccagcgccgacgactaccagcaggaactggccggctacgaagtgctggccggcaccatcgggcaacgcctggctcagatgcactcggtgctggcgcgtgccggcgaactgccgggcttcgcgccgcggccggccagcgagcgcgacgccgccctggcgggcgagcacgcggtggcgcagctggaccgcgcgctgcaggccttgcgggcgtgcgagagcgggctcgcccctgcatcgcacgcctgcgcgcaatggctgttcgagcatcgcgaccggctggcggcccacatcatgacactggcgcaggccgaaaccggcgcgctgcgcatccgcgtgcacggcgacttccatctcggccagatcctggtcgcgcagaccgacgcctacctgatcgatttcgagggcgagccggcccggcccatggccgagcgccggcaactgagcagcccgttcaaggacgttgccggcatcctgcgctcgttcgactatgcggtggccgaactcagccgcgacgatccgctgggcggcgcgccgcgcgacttcaacaccggcgtggccgagccggccgacccggccagcgcgccccgggaaacgcgcgaggcgctgctggcgcgcttccggcagcgcgccggcgcggccctgctggccagctatggcaatgccatcgaccccgtgctggccttgccgcccgagcgtgcccaggcgcttacctgcctgtacctgctggagaaggccgcctacgaaatctgctacgagtcggcctaccggcccgagcgcctgccggtgcccatccatggcctggccgaaaccgcccgcgccgcgctgctggcggccgccgtcgaccacgatgaaggaccggcgccatga

SEQ ID NO: 13647 - protein, 1113 aa, Bordetella bronchiseptica RB50
MPATHPAPDPLWYKDAVIYQLHVKSFFDANDDGVGDFAGLLAKLDYIVELGVNTIWLLPFYPSPRRDDGYDIADYRGVHPDYGSLADARRLVRAAHARGLRVITELVINHTSDQHPWFQRARAARPGSAHRAYYVWSDDDKAYAGTRIIFCDTEKSNWTWDPVAGAYFWHRFYSHQPDLNYDNPQVLREVLGAMRYWLDMGVDGLRLDAVPYLVEREGTNNENLPETHAILRRIRRVIDSEYPGRMLLAEANQWPEDAQEYFGAGDECHMAFHFPLMPRMYMAIAQEDRLPVTDIIRQTPSIAPQCQWAIFLRNHDELTLEMVTSRERDYLWNVYAAEPRARINLGIRRRLAPLLERDRRRIELMNSLLLSMPGTPVLYYGDELGMGDNIHLGDRDGVRTPMQWSPDRNGGFSRADPERLPLPLLMGPLYGYEAVNVEAQQRDPHSLLNWTRRMLAKRRQSHVFGRGELSFLYPGNRKILAYLRTWEDTVVLCVANLSQAAQPVELHLSEYAGRVPVEMLGGTAFPQIGELPYLLTLPPFGFYWLDLSAGAAPPAWHSELPPQMPESITLVSRGAGAALRLTEASRRQLEADVLPAYLQRQRWYAARRKPGVMRLAYSVPLNDDVESYYEAEIEVSDDGPPRRFHTPVALAWQDDTAAQYPLARVRRGAQLGTLTDASLQPGYARVLLAALTAGRDIQAGGEPAVRLRFLPEPGLADLALRDDSEVRALSADQSNSSLLVGERVVFKLLRELHAGPHPEAEMTRYLTQAGYAHTPALLGEVVRVQGDQAPHTLALAHAYVVNEGDAWNWTVAYLKRTVDAAMLTGASADDYQQELAGYEVLAGTIGQRLAQMHSVLARAGELPGFAPRPASERDAALAGEHAVAQLDRALQALRACESGLAPASHACAQWLFEHRDRLAAHIMTLAQAETGALRIRVHGDFHLGQILVAQTDAYLIDFEGEPARPMAERRQLSSPFKDVAGILRSFDYAVAELSRDDPLGGAPRDFNTGVAEPADPASAPRETREALLARFRQRAGAALLASYGNAIDPVLALPPERAQALTCLYLLEKAAYEICYESAYRPERLPVPIHGLAETARAALLAAAVDHDEGPAP

SEQ ID NO: 13648 - DNA, 1452 bp, Prochlorococcus marinus str. MIT 9313
  CDS (1)..(1452): transl_table=11
atgcaatggggcatgcagcagatcgatgggctgaccaacactccccgctgggttgcccaggcggtggtgtatcagatcttccctgatcgttttcgttgtagtggccgtgtcttagctcatcagcatttggctttgcgctgctggggcagtgacccttctgagcagggttttcaggggggagatctctacggggtgatcgaggcccttgatcatctccaggcgcttggtatcagctgcctttacttgacacccgtctttagttctgccgctaatcatcgctatcacgcttatgactacttgcaggtggatccgcttctcggtggcaatgcagcgctagaggctttgattgaggcggtgcatcgccgcgggatgcgcatcattttggatggcgtgtttaatcactgtggtcgcgggttctgggcttttcatcatcttttggaaaatggtgaggcttcgccctatcgcgattggtttgaggtgcggcaatggccgcttcatccctatccacggcgtgggcaggattgtggttacagctgctggtggaacgatccagccttgccaaagttcaatcatgcccatgcccctgtgcgtgagtatttgattgccgtagcccgctattggctcgagcagggaatcgatggttggcgacttgacgttgctgatgaggtgcctgctgagttttggctggagtttcggcacatggttaaggcagtgaatccagacgcttggatcttggctgagatctggggtgatgcgagaccgtggctacaggggcagcactttgatggggtgatgaattatcggatgggttggagcagcctttgctgggttgctggtaagcgattacgccgtcggtatcgcaatcctgcctatccccttgaccctctgagtggggaggcttttgttgagctattggcaacaacgctgggttggtatcgacctgaggtgaaccgcagccagttgaacttgcttgatagccacgatgtgccgagagctttgcacacacttcagggggatcttgcggcgttgaagttggccttgctgttgttgtttttgcaaccaggggcgccttgcatctactacggcacagaggcgggtttgcagggtggccctgaaccaggttgccgagaagggttcccttggcatacgccttggcctgcagacctgcgcgatttcattcagtcgttgagtgatctgcgccaacgttgcccagcgttgagtgatggcggtttgcaatggcaaccgattggagctgatgcacttcatgcttggctgatgcagcccgagccaggcacaacacaaaaggagacgccgattcaggtgtgggtcaatcgcagtcgcaggtcatggttgcggatgaaaggctcatcgacagaccctctttggctggaaggagcattggaatgcaatggccggggattaggccctcaatcagcagtgttgtttcactga

SEQ ID NO: 13649 - protein, 483 aa, Prochlorococcus marinus str. MIT 9313
MQWGMQQIDGLTNTPRWVAQAVVYQIFPDRFRCSGRVLAHQHLALRCWGSDPSEQGFQGGDLYGVIEALDHLQALGISCLYLTPVFSSAANHRYHAYDYLQVDPLLGGNAALEALIEAVHRRGMRIILDGVFNHCGRGFWAFHHLLENGEASPYRDWFEVRQWPLHPYPRRGQDCGYSCWWNDPALPKFNHAHAPVREYLIAVARYWLEQGIDGWRLDVADEVPAEFWLEFRHMVKAVNPDAWILAEIWGDARPWLQGQHFDGVMNYRMGWSSLCWVAGKRLRRRYRNPAYPLDPLSGEAFVELLATTLGWYRPEVNRSQLNLLDSHDVPRALHTLQGDLAALKLALLLLFLQPGAPCIYYGTEAGLQGGPEPGCREGFPWHTPWPADLRDFIQSLSDLRQRCPALSDGGLQWQPIGADALHAWLMQPEPGTTQKETPIQVWVNRSRRSWLRMKGSSTDPLWLEGALECNGRGLGPQSAVLFH

SEQ ID NO: 13650 - DNA, 1407 bp, Synechococcus sp. WH 8102
  CDS (1)..(1407): transl_table=11
atggcgtcctccacgcccttccacgacccaccggcctgggtggcggatgccgtggtgtatcagatctttccggatcgattccgccgcagtggtcaggtgaaggctcagcaacatcttgagctgaagccctggggcagtgatccccgtgagcagggctttcaagggggggatctctacggggtgatcgaggcgttggatcagctgcaggccatgggcatcagctgcctgtacctcacgccgatcttcagctccgccgccaatcaccgctatcacgcctacgactatttcgaggtggatcccctgctgggggggaatgacgctctggatacgttgatcgcagccttacaccagcggggcatgcggctggtgctcgatggtgtgttcaaccactgcggccgtggcttctgggcctttcatcacctggtggaaaacggccaggactccccctaccgggattggttcaatgtgcaccgctggcctgtaaagccgtatccggccgagggcgaggactgcggctacgattgctggtgggctgtgcctgatctgcccaagttcaaccatgccaatcccgcagtgcgggaccatctgttggaggtgggtcgtttctggctggaacggggcatcgatggttggcgtctggatgtgcccgcggaagtgccagccgagttctgggtggatttccgtcgcgtggtgcgggaggtcaaccctgacgcctggatcgtgggtgagatctggggtgatgcccgggagtggctgcggggcgagcactttgatggggtgatgaattaccgcctcggctggagcagcctcggctgggtggcaggagatcggttgaggcagggataccgcaatccggagtacccactgaatcccctcagtagcgaggatttgatcgaaatctggagcaccacgtccggttggtaccgcccagccgtgaatcgagctcagatgaacctgctcgatagccacgatgttcctcgggcactccacagcctcgatggagatgtgaaggctctgaagctcgccctgctgctgatctttctgcagcaaggggccccatgcgtgtactacggcaccgaatctggattgtgcggtggcccggaacccgcctgtcgtgaagcctttccctggggtgaaccctggcctgcggatctgagctcaaccattgcggccttggctgatctccggcgaaatcaacccaatctcattcgcggcgatctgaagtgggagccgatcggacgcgacggactgctgggaagcacccctggcggtttaagcgtctgggttaaccgcagcaccacgacctcgctgcagattgatcctgggatttccagaatctggagttgtggcgcctgcgatggacaagctctagagccgcaatctgcagtggtgcatctgcagggataa

SEQ ID NO: 13651 - protein, 468 aa, Synechococcus sp. WH 8102
MASSTPFHDPPAWVADAVVYQIFPDRFRRSGQVKAQQHLELKPWGSDPREQGFQGGDLYGVIEALDQLQAMGISCLYLTPIFSSAANHRYHAYDYFEVDPLLGGNDALDTLIAALHQRGMRLVLDGVFNHCGRGFWAFHHLVENGQDSPYRDWFNVHRWPVKPYPAEGEDCGYDCWWAVPDLPKFNHANPAVRDHLLEVGRFWLERGIDGWRLDVPAEVPAEFWVDFRRVVREVNPDAWIVGEIWGDAREWLRGEHFDGVMNYRLGWSSLGWVAGDRLRQGYRNPEYPLNPLSSEDLIEIWSTTSGWYRPAVNRAQMNLLDSHDVPRALHSLDGDVKALKLALLLIFLQQGAPCVYYGTESGLCGGPEPACREAFPWGEPWPADLSSTIAALADLRRNQPNLIRGDLKWEPIGRDGLLGSTPGGLSVWVNRSTTTSLQIDPGISRIWSCGACDGQALEPQSAVVHLQG

SEQ ID NO: 13652 - DNA, 1662 bp, Synechococcus sp. WH 8102
  CDS (1)..(1662): transl_table=11
atgagccaaaccatgccgtggtggaccggcacggtcatctatcaactgatcgtgcgcagcttcgccgatggcaacggtgatggcatcggcgatttcaagggtctggcttcgcgcttgccctatctgcgctggctcggggtgaagacgctctggctgacacccacgtacccatctcccttacgggatggtggctacgacatcaccgacttcaaggacattcaccctgatctgggcgatctggcgtcgttccatcggtttctgacggcagcccacagccagggcatgcgcgtgattctcgatctggtgctgaaccacaccagcgaccttcacccctggttccagcgagcccgctgggcccccaagggcagcactgaacgggatgtgtacgtctggagcgacgacccatcccgctacagcgacgccccggtgctgttccggcactttgaagcgtccaactgggagtgggacccagtggcggagcagtactacctgcaccgtttcctgagccatcagcccgacctcaactacgccaacccgtgggtgcaggaggccatgctcgaggtggttgacttctggctggagcgtggggtcgacggctttcgccttgatgcggtgccgtttctgtttgaggaggagggcacccggtgtgaagggttgccggagacccatgccttcctgcggcgtctgcgggcccgtgtggatgccatgggacgagaggtgctgttgctgggggaagcgatccaacccgtgcaggaggcagccccctatctggcgaaggacgaactgcacggagccttcaacttcgtgctcacagcccatctgttcgctgctgtggcctccggcagcactcgccagctcggggactgtctcaacgaggcggaacacgcggttgatggcccgcgctgggccctgccgctccgcaaccacgacgagctctggctgggggatgggcacctgatccccgacgaggtgatccagtcgatccgggtgggcttgccccaggggcaggggcattggctcaactggggcatcaaccgtcgattggcaccgctgctcaatggcgacccccgctccaaccgactgcttcacggactgatttacagccttccaggcatgccctgcctgtattacggcgacgagctggggatgggggattggccggggttacgggatcgggatccgaaccgcacacccatggcctggacacctgcccgcaacggtggcttctcctcggctcccgaccctttgctggtgcttccgccgatcacagctcctgggtacgactaccgagtcgtgaacgttgaggtacagaaacagctgccgggttccttgctgaactggcaccgccgcatgctcacttgccggcgtttgctgccggccctcgcccatggatcattgcagctgttgccgtgcagccatcccggtgccttggtttacgtccgcgcgactgaggccatgacggtgttggtggcgggcaatgtcacggccgccggagcctccttcagcctggatctcacggcctgggagggcttgcggactcgcgaggtgatgtggggctgtgaattcccgctggccagccgcgaatggtttgtgaatctgtctccttacggcatcaactggtggttgatcggcgaggtggataccgctgtgcccgtgagctga

SEQ ID NO: 13653 - protein, 553 aa, Synechococcus sp. WH 8102
MSQTMPWWTGTVIYQLIVRSFADGNGDGIGDFKGLASRLPYLRWLGVKTLWLTPTYPSPLRDGGYDITDFKDIHPDLGDLASFHRFLTAAHSQGMRVILDLVLNHTSDLHPWFQRARWAPKGSTERDVYVWSDDPSRYSDAPVLFRHFEASNWEWDPVAEQYYLHRFLSHQPDLNYANPWVQEAMLEVVDFWLERGVDGFRLDAVPFLFEEEGTRCEGLPETHAFLRRLRARVDAMGREVLLLGEAIQPVQEAAPYLAKDELHGAFNFVLTAHLFAAVASGSTRQLGDCLNEAEHAVDGPRWALPLRNHDELWLGDGHLIPDEVIQSIRVGLPQGQGHWLNWGINRRLAPLLNGDPRSNRLLHGLIYSLPGMPCLYYGDELGMGDWPGLRDRDPNRTPMAWTPARNGGFSSAPDPLLVLPPITAPGYDYRVVNVEVQKQLPGSLLNWHRRMLTCRRLLPALAHGSLQLLPCSHPGALVYVRATEAMTVLVAGNVTAAGASFSLDLTAWEGLRTREVMWGCEFPLASREWFVNLSPYGINWWLIGEVDTAVPVS

SEQ ID NO: 13654 - DNA, 1863 bp, Gloeobacter violaceus PCC 7421
  CDS (1)..(1863): transl_table=11
atggcaatcaccatcgaagagaaagctccccgcaagctcagcgaagcggatctgcggccgcgcggccaagtgcatccgagcccggcaagctggcgcgatcagtttctctaccagctgttgccggaccgcttcagcgacggccgcgaggcggatcggccgctttttgacccggccgatccggcccgattccaggtcaaagacagaggagcctggatggcggcggggaagcgattcgtaggtggaaccctcaaaggcgtcatcagcaagctcgactatctgcaggggctcggggtgacgacgctgtggctcaacccaccctggaagcagcgagcggatctggagacttatcacggctacggtattcagaactttttcgacatcgatccgcgcttcgggacccgccaggatctgcgcgacttggtcgatgccgcccacgcacggggcctgtacgtcatcctcgatgtgatctataaccacagcggcaacaactggttctaccgagacgaatgggacggcagcccgcaatcgatgcgcccctaccgctatgcgcccggctatccggtgcacggttggcgctccggcgacgggcgcagcgtgggtgagattgtttctctcgacgacggcgtctggcccgaggagtttcaaaactttgactggtacacccgcgccgggcggatcatcaactggagcgaagcggcctgggaggattatctgagcccccaggtcgaatttcgccggggcgatttttttgatctcaaagacttcaacctggccaatcccgccaccatcgccggtttggcccgcgtctaccagtactggattgccctcagtgactgcgacggatttcgtgtcgatgcggtcaagcacgtctcccctgtcgaatcgcgcaagttctgcgcggccatcaacgagtatgcccagtcgatcggcaaggacaattttttgctcaccggtgaactcaccgacgaccgcatgctgcttgcctacctcgacatcgtcgggcgcaacctggatgcggccctcgacatcgtcagcgcgccgattcagctgaccgccgcagccaagggccttgctcacccgggcgccttcttcggtctttacgacgagaacaccctggcgggcgcctaccgccagagcgggctttatcatgtctcggtcctcgacgatcacgacatgtcctcgcgcagctacaaatcgcgctttgccgcccacggcgaaggggtgcccaacctttaccggcaggtggcccacgcggtcggcgtgcaactgacgatgcccggtattccttcgatttactacggcaccgaacaggccctggacggctccgagagcaaccacgactacggcatcgatgggtcgcacgaatatgtcgatcgctacgtgcgcgaagcgatgttcgggggtgcctttggtgcctttcgcaccgagggttgccactttttcaacccggatcaccctacctatctgcgcatcgccgccatcgcccgcctgcgcaaccgtctggacgccgtcggcaaaaccctgcgccgggggcatcactacctgcgggagacctcgtttgtccaccgaccctttgtcctcccgggggccggcgagctggtggcctggtcgcaaattctgttcgagacggaggcgctgatggtcctcaacacccacggcctggagaatcgaggtgccgaggtgaccgtcgagacctcgctgcacccggaaggttcgtcgatggccgtcctgtaccacagcgaatggagcgacgaccagctgcgtcagccgccgtcggctcagaccgtgcctgtcgagtatggccacggtcgcgccacggtgcgcatcgacctgcccccctgcggcatggtgattctgagctga

SEQ ID NO: 13655 - protein, 620 aa, Gloeobacter violaceus PCC 7421
MAITIEEKAPRKLSEADLRPRGQVHPSPASWRDQFLYQLLPDRFSDGREADRPLFDPADPARFQVKDRGAWMAAGKRFVGGTLKGVISKLDYLQGLGVTTLWLNPPWKQRADLETYHGYGIQNFFDIDPRFGTRQDLRDLVDAAHARGLYVILDVIYNHSGNNWFYRDEWDGSPQSMRPYRYAPGYPVHGWRSGDGRSVGEIVSLDDGVWPEEFQNFDWYTRAGRIINWSEAAWEDYLSPQVEFRRGDFFDLKDFNLANPATIAGLARVYQYWIALSDCDGFRVDAVKHVSPVESRKFCAAINEYAQSIGKDNFLLTGELTDDRMLLAYLDIVGRNLDAALDIVSAPIQLTAAAKGLAHPGAFFGLYDENTLAGAYRQSGLYHVSVLDDHDMSSRSYKSRFAAHGEGVPNLYRQVAHAVGVQLTMPGIPSIYYGTEQALDGSESNHDYGIDGSHEYVDRYVREAMFGGAFGAFRTEGCHFFNPDHPTYLRIAAIARLRNRLDAVGKTLRRGHHYLRETSFVHRPFVLPGAGELVAWSQILFETEALMVLNTHGLENRGAEVTVETSLHPEGSSMAVLYHSEWSDDQLRQPPSAQTVPVEYGHGRATVRIDLPPCGMVILS

SEQ ID NO: 13656 - DNA, 1443 bp, Gloeobacter violaceus PCC 7421
  CDS (1)..(1443): transl_table=11
atgcagattcacacaccgaactgggtaaagcacgctatcttctatcagatctttccggaccgcttctcccgcacccagcagttaaaacaaaagctgttgcaggcggtctccttcgaggattgggcagccgccccgaccctctacggctataaaggcggcgatctgtggggggtaatcgaaagactcgattacctgtcggatttgggcatcaacgccatctatttcactccgatatttcaatcggcgagtaaccaccgctaccatacccacgattactatagagtcgatccgctgctgggaggaaacgaggcgttcaaggcattgctcgatgccgcccacgcccgcgacatcaaagtggtgctcgacggtgtatttaaccacgcgagccgcggttttttcttcttccacgacatccttgaaaatggtcaactctccccgtggctcgactggttcaagatcgaaggctggcccctctcgccctacaatgtcgagcagcccgccaactatgcctgctgggacaacaaccgtgccctgccccagttcaaccatgccaatccgatggtgcgcgagtacattatggagattgccgaatactggatcaaagcgggtatcgacggctggcgcctcgatgtgcccgcctgtgtagaggcggaaggtttctggcaggaatttcgcgagcgcgtcaaggcaatcaatcctgaagcctacatcgtcggcgaaatctgggaggatgcccgccagtggctcgacggcacccagttcgacggggtgatgaattatctgtttgccgccccgaccatcgcctttacggccggggatcgcgtccaggtgcagtacgtgcaggaccgttcctacaggccctacccggcgctgttcgccgttgagtacaaagaggcaatcgacaaattgttggggctgtacgactgggagatccagctggcgcaactcaacttgctcgatagccacgacacggccagggtactgaccatcgccgggggcgaccgcgcgagtgtagaactggcgacactgctgttgctcacctttcccggggcgcccagcatctactacggcgacgaggtgggcctgcccggcggcatcgaccctgattcgcgccagggttttcctcccgaatcgcagtggaacggcgaactgctcgcgctgcaccgcgacttgatcgccctgcgccaccgccacgaagcgctgcgcatcggcaaatacaaaagcgtctatgcctccggccagtgctatgtcttcgagcgccgcctggaggcggaagtgctgttggtggccgtcaacgccgggaccgaaccggcgcgcgtcaccctcgaagcgcctggggaaacctacccgcgcaaagtgctcttcggtcccggccaggtggaagccgccgaagggcatctggaattgagcctgccggcccgcagcggtctggtgctggggtag

SEQ ID NO: 13657 - protein, 480 aa, Gloeobacter violaceus PCC 7421
MQIHTPNWVKHAIFYQIFPDRFSRTQQLKQKLLQAVSFEDWAAAPTLYGYKGGDLWGVIERLDYLSDLGINAIYFTPIFQSASNHRYHTHDYYRVDPLLGGNEAFKALLDAAHARDIKVVLDGVFNHASRGFFFFHDILENGQLSPWLDWFKIEGWPLSPYNVEQPANYACWDNNRALPQFNHANPMVREYIMEIAEYWIKAGIDGWRLDVPACVEAEGFWQEFRERVKAINPEAYIVGEIWEDARQWLDGTQFDGVMNYLFAAPTIAFTAGDRVQVQYVQDRSYRPYPALFAVEYKEAIDKLLGLYDWEIQLAQLNLLDSHDTARVLTIAGGDRASVELATLLLLTFPGAPSIYYGDEVGLPGGIDPDSRQGFPPESQWNGELLALHRDLIALRHRHEALRIGKYKSVYASGQCYVFERRLEAEVLLVAVNAGTEPARVTLEAPGETYPRKVLFGPGQVEAAEGHLELSLPARSGLVLG

SEQ ID NO: 13658 - DNA, 1635 bp, Vibrio vulnificus YJ016
  CDS (1)..(1635): transl_table=11
atggaaaacaaatggtggcacgatgcggtggtctatcaaatctacccgcgtagtttttgcgattcaaacaacgacggcatcggcgatttaaatggcatcatcagcaaactcgattacctgaaaacacttggcgtaaacgtgctttggctctcgcccgtatataagtcgcctatggatgacaacggttacgacatttctgattatcaagatatcgctgcggaatttggcaccatggctgatatgcaaaacttacttgatcaagcaaaagcgcgtgatatccgcatcgtaatggatcttgtcgtcaaccatacctcagatgaacacccttggtttgtagaagctcgtaaatcaaaagacaacccttatcgtgactactatatttggcgtgatgcaaaaccagatggcagtgtgcccgatgaccaaggttcgatttttggaggcagtgcttggcaatgggatgaagcaacacaacagtattacttccatctattttctaagcgacagccggatctcaattgggagaatcctaaagtccagcaggaagtacacaagatgatgaactggtggattgaccaaggcatcggtggatttaggctcgacgttatcgacttgattggcaaagagatcgacaaaggcattactggtaatggcccaaggctgcatccactattgcaggaaatgaacagagcgacgtttggcgacaaagatctgctgaccgttggtgaaacatggggagcaaccccagaaattgcaaaattgtatagcgatcctgagcgtcatgaactctccatggtgttccaatttgagcacatcacgctcacttggcaacacggtgacaaatggaaccctattcctcttgatctcaaacaattcaaacacgtactgaccaagtggcaaactgaattatcgaaccaaggttggaactcgttgttttggaacaaccacgatttaccacgcgtagtctcgaaatacggtgatgaccaacgctatcgtgttgagtcagcgaaaatgctggcaacggcgttgcatttcctcaaaggcacgccttacgtctaccaaggtgaagagatcggtatgaccaatgtcgcgtttgagtcgttagagcaatacaaagacattgaaacgctgaacttctacaaagtgaaaacagaatcaggggtgtcacatcaacatatgatggacgcgatacatgagaacagccgtgacaatgctcgcaccccaatgcagtggtccgcatctcagaatggtggctttagtcaggcgaaaccttggattgaagtgaatccgaactatccagagatcaacgtggaacaagcattggcagattcagattccattttctatcactaccaaaagctgattgaactgcgcaaacagcacccagcgatcgtctatggcgatttcaccccactgtttgcagagcacgatagtgtgtttgcttatgtccgctcacatcaagatgagcaactgctggtcatcaacaactttagcgatcaagatgtttcattagcgttgccggataacttgcaaaacaaagaagttaactgtctgatttataactacgattcgttggatatgctcggagtgacattgtcactaaaaccgtatcagtgctacgcatttaaacttagataa

SEQ ID NO: 13659 - protein, 544 aa, Vibrio vulnificus YJ016
MENKWWHDAVVYQIYPRSFCDSNNDGIGDLNGIISKLDYLKTLGVNVLWLSPVYKSPMDDNGYDISDYQDIAAEFGTMADMQNLLDQAKARDIRIVMDLVVNHTSDEHPWFVEARKSKDNPYRDYYIWRDAKPDGSVPDDQGSIFGGSAWQWDEATQQYYFHLFSKRQPDLNWENPKVQQEVHKMMNWWIDQGIGGFRLDVIDLIGKEIDKGITGNGPRLHPLLQEMNRATFGDKDLLTVGETWGATPEIAKLYSDPERHELSMVFQFEHITLTWQHGDKWNPIPLDLKQFKHVLTKWQTELSNQGWNSLFWNNHDLPRVVSKYGDDQRYRVESAKMLATALHFLKGTPYVYQGEEIGMTNVAFESLEQYKDIETLNFYKVKTESGVSHQHMMDAIHENSRDNARTPMQWSASQNGGFSQAKPWIEVNPNYPEINVEQALADSDSIFYHYQKLIELRKQHPAIVYGDFTPLFAEHDSVFAYVRSHQDEQLLVINNFSDQDVSLALPDNLQNKEVNCLIYNYDSLDMLGVTLSLKPYQCYAFKLR

SEQ ID NO: 13660 - DNA, 3303 bp, Rhodopseudomonas palustris CGA009
  CDS (1)..(3303): transl_table=11
atgaataaaatgacatcgatcgccccgagcgacagaccggacgcggaaacttccgacgaactctggtacaaagacgccatcatctaccagttgcacgtcaaggcgttcgccgacagcaacaatgacggcatcggcgacttcgcgggtctcaccgagaagctggattatctgcaggagctcggcgtcaacacgctgtggctgctgccgttctatccgtcgccgcagcgcgacgacggatacgacatcgccgactacggatcgatcaatcccgacttcggcacgatgaaggacttccgccgcttcatcgtcgaggccaagaagcgcaatctccgggtcatcaccgagctggttatcaaccacacctcggatcagcacgcctggttcaagcgggcgcggcgcagcccgaaagactccagcgcgcgcgactggtacgtctggagcgacaccgaccagaaatatctcggcacccggatcattttcaccgacaccgagaaatcgaactggacctgggatcccgaggccggccagtattactggcaccggttcttctcgcaccagcccgatctcaacttcgacaatccgcgcgtcgtcagcgccgtggtcaaggtgatgaaacgctggctcgacaccggcgtcgacggcttccggctcgacgcgatcccgtatctgtgcgagcgcgacggcaccaacaacgagaaccttcccgagacccacgccgtcatcaagcggctgcgcgccgagctcgacgcctacgccaagggcaagctgctgctcgccgaggccaaccaatggccggaggacgtgcagcagtatttcggcgatggcgacgagtgccacatggcctaccacttcccgctgatgccgcggatctatatggcgatcgcgcaggaagaccgcttcccgatcaccgacatcatgcggcagacgccggagattcccgcgaactgtcagtgggcgatgttcctgcgcaaccacgacgagctgacgctcgaaatggtcaccgacgtcgagcgcgactatctgtggaagacctacgcggccgatccgcgagcgcggatcaacgtcggcatccgtcgccgcctcgcgccgctgatggacaatgatcgccgcaagatcgaactgatgaactcgctgctgatgtcgttccctggcacgccgatcatctactatggcgacgaaatcggcatgggcgacaacatctatctcggcgaccgcaacggcgtgcggacgccgatgcagtggtcgcccgaccgcaacggtgggttttcgcgggccgacccggcacggctgtacgcaccgccgatcatggaccccgtgtacggctacgcctcggtcaacgtcgaagcccagcagcgcagcctttcgtcattgctgagcgcgatgaagcgcttgatcgcggtgcgcaaatcgacgccggcgttcggccgcggcagcatcaccttcatccgtccgagcaaccgcgcggtgatcgcctacgttcgccaatacaaggacgaggtcattctgtgcgtcgccaatctgtcgcgtgccgcgcaggcgaccgaactcgacctgtcgccgtggaaggaccgcgtgccgcaggagatgctcggccgcaccaaattcccgccgatcggcgatccggcctacatgatcacgctggcgcccttcggcttctactggttcaagctgcaggagcccggcacggctgcgcatgtcgcgccggtctccaccgtgcctgaattcgtcacgctggtggtgccgctcggttcgacctggatgacgctcggccgcacccgctcgatgttcgagcacgaggtgctgccgaccttcctgtcccgcacccgctggtttccggagcgcaatccgcgggcgatccatccgcggctcacctcggcgattccgttcgccaatgacggcgacaaccgtccgtggctggcgttcttcgaggccacgcagcgggggacgacggcgcgctatctgctgccgatgcagatcgactgggtgcggttcgaccgcgaacgctacaatccgcgggcctatgcggcggtgcgccagggcgcccgcgaaggtaccctgctcgatgtcgccgccgatccctcgttcatcgacctgctgctggagaacgtccgcgacgccgtcaccgtgaccggcgataacggcgaccgactggaattccgccctgggtccaagctcgcggaacggcccgccgggccattccagaacattcgcgcggtcgaaaccgagcagtcgaattcgaccgcactggtcgacggcgactacgtcgtcaaactgtatcggcggctgcagatcggcatcaatcccgagctggagatgggacgcttcctcaccgaggtcgccggctatgccaacaccccggccctgctcggcagcgtcgagctgatcgaaggcgacaagaccagcgcggtcgcggtggtgcacgaatttgcccgcaatcagggcgacggctggaccgtcacctccggctatctcgatcgctacatcgacgaacaacgcgtgctgagccgcgccgaggaaaagaccgagagcgatcagctcgcgccctatctgcatttcatgcagcagaccggcaagcgggtcgcggagatgcacatcgcgctcgccagccatcccgaggtgccggacttcgccccggagccgatcaccctcgacgcctcgcgcgactgggccgaaaccgttgcggcatccgccgaccggatgctcgacgaactgcggcgccggcgcgacacgctgaaggaaggcgaccggacgctggtcgacgaactgctggcggcccgcgacgtgctgatgtcccgcatccacggcctgctcggcgacgacggcggcctgaacatccgccatcacggcgacttccatctcggacagatgttgatcgtcaaggacgacatctacatcatcgacttcgaaggtgagccgcgccgcaccttggacgaacgccgcgccaaagcaccggcggctcgcgacgtggctgggctgatccggtcgatcgactattcgacgaccgccgcactcgagcgagcgctgaaagcagcctccgacgagccaggccgactgaccgaggcgctcgacctgtggcggatccgcgccacaggcgcgttcctggacgcctatcgccaaaccatgggcgacagcccggtgtggccggcggatatcgcggccgccgaccgggtgctcgacttcttcctgattgaaaaggcgctgtacgagatcgactacgagatcgcgcatcgtcccgactgggtgcatgtgccgctggtcggcattctccgtatcctgtcgccgcctcccgaggagcttccatga

SEQ ID NO: 13661 - protein, 1100 aa, Rhodopseudomonas palustris CGA009
MNKMTSIAPSDRPDAETSDELWYKDAIIYQLHVKAFADSNNDGIGDFAGLTEKLDYLQELGVNTLWLLPFYPSPQRDDGYDIADYGSINPDFGTMKDFRRFIVEAKKRNLRVITELVINHTSDQHAWFKRARRSPKDSSARDWYVWSDTDQKYLGTRIIFTDTEKSNWTWDPEAGQYYWHRFFSHQPDLNFDNPRVVSAVVKVMKRWLDTGVDGFRLDAIPYLCERDGTNNENLPETHAVIKRLRAELDAYAKGKLLLAEANQWPEDVQQYFGDGDECHMAYHFPLMPRIYMAIAQEDRFPITDIMRQTPEIPANCQWAMFLRNHDELTLEMVTDVERDYLWKTYAADPRARINVGIRRRLAPLMDNDRRKIELMNSLLMSFPGTPIIYYGDEIGMGDNIYLGDRNGVRTPMQWSPDRNGGFSRADPARLYAPPIMDPVYGYASVNVEAQQRSLSSLLSAMKRLIAVRKSTPAFGRGSITFIRPSNRAVIAYVRQYKDEVILCVANLSRAAQATELDLSPWKDRVPQEMLGRTKFPPIGDPAYMITLAPFGFYWFKLQEPGTAAHVAPVSTVPEFVTLVVPLGSTWMTLGRTRSMFEHEVLPTFLSRTRWFPERNPRAIHPRLTSAIPFANDGDNRPWLAFFEATQRGTTARYLLPMQIDWVRFDRERYNPRAYAAVRQGAREGTLLDVAADPSFIDLLLENVRDAVTVTGDNGDRLEFRPGSKLAERPAGPFQNIRAVETEQSNSTALVDGDYVVKLYRRLQIGINPELEMGRFLTEVAGYANTPALLGSVELIEGDKTSAVAVVHEFARNQGDGWTVTSGYLDRYIDEQRVLSRAEEKTESDQLAPYLHFMQQTGKRVAEMHIALASHPEVPDFAPEPITLDASRDWAETVAASADRMLDELRRRRDTLKEGDRTLVDELLAARDVLMSRIHGLLGDDGGLNIRHHGDFHLGQMLIVKDDIYIIDFEGEPRRTLDERRAKAPAARDVAGLIRSIDYSTTAALERALKAASDEPGRLTEALDLWRIRATGAFLDAYRQTMGDSPVWPADIAAADRVLDFFLIEKALYEIDYEIAHRPDWVHVPLVGILRILSPPPEELP

SEQ ID NO: 13662 - DNA, 1617 bp, Rhodopseudomonas palustris CGA009
  CDS (1)..(1617): transl_table=11
atggaaagcgtgacgagcgtgtcgtggtgggcggcgggtgtgctgtaccagatctatccgcgctcgtttcaggacagcaacagcgacggcatcggtgatctgcgcgggatcatcgatcggctcggctatctgtccgatctcggcgtcgacgcgatctggctgtctccgatctttccgtcaccgatggcggactttggctacgatgtcgccgactatgtcggcatcgatccaatcttcggcacgatggacgatttcgacgcgctggtgctcacggcccatgcccgcgggctcaaggtcattctcgatctggtgccgaaccattcatccgaacagcatccctggttcatcgagagccggtcgtcgcggcacaaccccaagcgcgattggtacatctggcgcgaccccgcaccgggcggcggaccgccgaccaattggctgtcggaattcggcggcagcggctgggagtacgacgacgcgaccgggcagtattactatcacgcctttctgaagcagcagccggacctcaactggcgcaatccggaggtgcgggccgcgatctatgacgcgatgcggttctggctgcggaagggcgtcgatggcttccgggtcgacgtgatctggcacctgatcaaggacgaccaatttcgcgacaacccgcccaatccggattttcgccccggcatgccgccgcacgccgcgctgatcccgatttactccgcggatcggccagagacgttggaggtggttgccgagctgcgccgtgtcgtcgacgaattcgatcatcggctgctgattggcgagatctatctgccggtggagcggctggtcgcgtattacggagcggagctgaagggtgcgcagctgcctttcaacttcgcgctgctgtcgacgccgtggcgcgcccgggagattgcgacgctgatcgaacgctacgagcaggcgttgccggccggcgcgtggccgaattgggtgctgggcaatcacgaccggccgcgggtggcgagccgggtcgggccggcacaggcccgcgtcgccgcgatgctgctgctgacgctgcgcggcactccgacgatgtattacggcgacgagctcggcatggagcaggtcgagatcgcgcccgaggacgtgcaggatccgttcgagaagaacgtacccggcatcggtgtcggccgcgatggctgccgcacgccgatgcagtgggacgcgtcggaccaggccggattctcggatgtccggccgtggctgccgctggccccgaacgccacccaggataacgtcgctaatctgcgcgccgacgcgcagtcgatcctaaacctctatcgcgctctgctgcggctgcggcgcgcgctgccccagctggcgctcggcgcttaccagccgctcgcggcggagggcgagctgttgctgtatcgccggcatcatcaggggcagtcgatcttggtggcgctcaatcttggcccggatccgatctcggcggcgtccgacgcgatcgggctcgacggcgaggtgctgctgtcgaccatgctcgatcgcgccggcgaacgcatcggtgccacgctcgacctgcgcggcaacgaaggcatcatcgtcggccgggcgccggaggacgtggtttag

SEQ ID NO: 13663 - protein, 538 aa, Rhodopseudomonas palustris CGA009
MESVTSVSWWAAGVLYQIYPRSFQDSNSDGIGDLRGIIDRLGYLSDLGVDAIWLSPIFPSPMADFGYDVADYVGIDPIFGTMDDFDALVLTAHARGLKVILDLVPNHSSEQHPWFIESRSSRHNPKRDWYIWRDPAPGGGPPTNWLSEFGGSGWEYDDATGQYYYHAFLKQQPDLNWRNPEVRAAIYDAMRFWLRKGVDGFRVDVIWHLIKDDQFRDNPPNPDFRPGMPPHAALIPIYSADRPETLEVVAELRRVVDEFDHRLLIGEIYLPVERLVAYYGAELKGAQLPFNFALLSTPWRAREIATLIERYEQALPAGAWPNWVLGNHDRPRVASRVGPAQARVAAMLLLTLRGTPTMYYGDELGMEQVEIAPEDVQDPFEKNVPGIGVGRDGCRTPMQWDASDQAGFSDVRPWLPLAPNATQDNVANLRADAQSILNLYRALLRLRRALPQLALGAYQPLAAEGELLLYRRHHQGQSILVALNLGPDPISAASDAIGLDGEVLLSTMLDRAGERIGATLDLRGNEGIIVGRAPEDVV

SEQ ID NO: 13664 - DNA, 3336 bp, Geobacter sulfurreducens PCA
  CDS (1)..(3336): transl_table=11
atggctcgcaggacaccgctgtcggacgacacccccctctggtaccgggacgccgtcatctaccaactccacgtgaaggccttcgccgattccgacggcgacggcgtgggggacttccggggcctcatggggaagctcgattatctccagtccctggggatcaccgccatctggatacttcccttctacccgtcccccttgcgcgacgacggctacgacattgccgactactacaacgtcaaccccagctacaacaccctgcgcgaattccgggaattcctcagggaggcccatgcccgccgcatccgggtcatcaccgagctggtcctcaaccacacctcggaccagcacccctggttccagcgtgcccgccgggcaaaaccgggctcggtccaccgggactactacgtctggagcgatacccccgaccggtaccgggaaacccggatcatcttccaggacttcgagacgtccaactggagttgggacccggtggccaaggcctactactggcaccggttctattcccaccagcccgacctcaatttcgacaacccccgggtccagtcggaagtgctccggatcatcgactactggctggggatgggtgtggacggcgtccggctggatgccgtcccctacctcttcgagcgggaaggaaccaactgcgaaaacctgcccgaaacccatgacttcctgaaaaggctccggggacacatggacgcctcgttccccaaccggatgctgctgggcgaggccaatcaatggcccgaggacgcggtggcctatttcggcgagggggacgagtgcaacatgctcttccacttcccgctgatgccccgcatgtacatggccatcgagatggaggaccgcttcccggtggtcgacatcctcgaccagacccccgcgatccccgagggatgccagtgggccatctttctccgcaaccacgacgagctgaccctggagatggtgaccgacgaggagcgggactacatgtaccggatctacgcctcggaccccaaggccaggatcaacctgggaatccggcggcggctggcgcccctcctcggcaaggaccggcggcggatcgaactcatgaacgccctgctcttctccctgcccggcacccccgtcatctactacggcgatgagatcggcatgggggacaactactacctgggggaccgcaacggcgtccgtacccccatgcagtggagccccgaccgcaatgccggtttttccggcgccaacccccagcgcctcttcctgccggtcatcatcgatcccgaataccactacgaagcggtaaacgtggacatccaggagcgcaaccccacctcgctgctctggtggatgcggcgcatcatcgccgtgcgccgccgctaccgggccttcagccgcggcgccatggagatgctctatccggccaaccacaaggtcctggcctttctccgccgccacgaggatgaagtgatcctcgtggtggtcaacctctcccgcttcgcccaggccatcaacctggaccttcaggaattcgccggcatatcccccgaagacctcttcagccggaatcgcttcccggtcatccgcgaagccacctatcccctcaccctgggcccccacgaccacttctggttcctgctgcggcgcagggaagcgccgcttcaggccgaggaagaactgccgcggatcaggcttcggggagaactcccctggtgggagactctccgccagaccaggggcgacgctcacctggaacgggtgaccaccgattacctcaagcgaagcggttggttccggggaaaagcgagggcaatcatcggctacgtgctgcgcgacaccgtgctcctgcggcagggggaacgggtgttccccatcttcttccttgaggtacgctaccaggacggcccgccggaaacctacctgattcccgtggcgttcctcaccggtgccggagcgaaacgggtaagcgccgaatccccccgggcggccatagccgctctttccgtgggggacgaagagggcattctctgcgatgcggtccatgaccgggaattcagggacgcgctccttgccctggcactcggccgtcgccggctccatggcgaggaaaacagtctcatcgtgccggttcacgccggagcaggacgcatcggctccagggaagagatgcgtcatctcgcctccgaactccccaaggcggaacagaccaacagcatcatcacctacggcgatcgccacgtgctcaagctctaccgcaaggtggagccgggcatcaattccgaggtggagatggcgcggttcctcaccgcaaaatcgagctaccccaacgttgcccccttccaggggagcctggaattgcggcatcccggcgtcgagccgggcgctatcggcctgctccagggatacgtacagaaccagggcgacggctggcgactctccctccacctcctgggccagtacttcgagcggattctctcgtgccggggcgagctgccaccgccgccgtcgcgtttttcgagcctcatggacggcagcgcctgcaccgtgccggaaccggcggcggagctcatcggcggcttttatttggagatggctggacttctcggccgccggaccgccgagctccacttggccctcgccgccgggggaaacgacccggcttggcggcccgaggagtattccaccctctaccagcgctccgtgtaccagtccatgcgcaaccaggcccgacgcagcctccagctcctggcccagcaccacaaggacctgcccgcagaggcgttggcatcggccgacaggattctgagcgcggaaaaggaacttctcgcctgtctgcgtcccatcgtcggccggcggattcaggccatgaagagccgcatccacggcaacttcaggttggaaaaggttctcttcaccggcaaggacttcatgataatcgacctggagggcgagccggaccggcccctcggcgagcgccgcatcaaacgctcccccctgcgggatgtggcgggaatgatccgctccttccacaacgccaccctgacggcccttgcccgccacggcgctggccatcccggcgacatcccgctcctggagccctgggcggaggcctgctggtatcacgtgagctgccgctatctggccggctacctggagcagatgggcacaagccccctcgtcccgacggagcggagcgacctcgagaccctcctccgctcgttcctgctggacaatgccctccacgaactcggctatgccctcgccaaccgccccgaacgggtttcctcttacctgcgcggggtcgagacggtgctgcgggagttccggtaa

SEQ ID NO: 13665 - protein, 1111 aa, Geobacter sulfurreducens PCA
MARRTPLSDDTPLWYRDAVIYQLHVKAFADSDGDGVGDFRGLMGKLDYLQSLGITAIWILPFYPSPLRDDGYDIADYYNVNPSYNTLREFREFLREAHARRIRVITELVLNHTSDQHPWFQRARRAKPGSVHRDYYVWSDTPDRYRETRIIFQDFETSNWSWDPVAKAYYWHRFYSHQPDLNFDNPRVQSEVLRIIDYWLGMGVDGVRLDAVPYLFEREGTNCENLPETHDFLKRLRGHMDASFPNRMLLGEANQWPEDAVAYFGEGDECNMLFHFPLMPRMYMAIEMEDRFPVVDILDQTPAIPEGCQWAIFLRNHDELTLEMVTDEERDYMYRIYASDPKARINLGIRRRLAPLLGKDRRRIELMNALLFSLPGTPVIYYGDEIGMGDNYYLGDRNGVRTPMQWSPDRNAGFSGANPQRLFLPVIIDPEYHYEAVNVDIQERNPTSLLWWMRRIIAVRRRYRAFSRGAMEMLYPANHKVLAFLRRHEDEVILVVVNLSRFAQAINLDLQEFAGISPEDLFSRNRFPVIREATYPLTLGPHDHFWFLLRRREAPLQAEEELPRIRLRGELPWWETLRQTRGDAHLERVTTDYLKRSGWFRGKARAIIGYVLRDTVLLRQGERVFPIFFLEVRYQDGPPETYLIPVAFLTGAGAKRVSAESPRAAIAALSVGDEEGILCDAVHDREFRDALLALALGRRRLHGEENSLIVPVHAGAGRIGSREEMRHLASELPKAEQTNSIITYGDRHVLKLYRKVEPGINSEVEMARFLTAKSSYPNVAPFQGSLELRHPGVEPGAIGLLQGYVQNQGDGWRLSLHLLGQYFERILSCRGELPPPPSRFSSLMDGSACTVPEPAAELIGGFYLEMAGLLGRRTAELHLALAAGGNDPAWRPEEYSTLYQRSVYQSMRNQARRSLQLLAQHHKDLPAEALASADRILSAEKELLACLRPIVGRRIQAMKSRIHGNFRLEKVLFTGKDFMIIDLEGEPDRPLGERRIKRSPLRDVAGMIRSFHNATLTALARHGAGHPGDIPLLEPWAEACWYHVSCRYLAGYLEQMGTSPLVPTERSDLETLLRSFLLDNALHELGYALANRPERVSSYLRGVETVLREFR

SEQ ID NO: 13666 - DNA, 1335 bp, Mycobacterium avium subsp. paratuberculosis str. k10
  CDS (1)..(1335): transl_table=11
gtggccagtgtcgtgaccggacccgactgggtccagcacgtcatctggtggcaggtctacccgctggggttcgtcggcgcgtacccgctaccgcagtccagcgagccgccgcaaccggaacaacaccggttgcggcggctcgtcgactggttcgaccacgcgatcgaactcggcgcctccggcatcgccctgggcccgatcttcgcctcccggacccatggctacgacaccaccgaccactaccgcatcgatccccggctcggcgacgacaccgacttcgaccacctcatcgcgcaagcgcaccggcgcggcctgcgggtgctgctcgacggcgtgttcaaccacgtcggtgtggacttcccgcggtatcgcgccgccatcgactctgacgatcacgccgccgcccgctggtttcgcggtagtcgcgggcgttttcacaccttcgagggccacgacggcctgatcaccctcaaccacgacaatcccgaggtcgtcgactacaccgtcgacgtcatggcgcactggctgggacgcggcgccgacggctggcgtctggacgcggcttacgctgtgccggaaacgttttgggcggccaccctgccccgggtgcgcgaccgctacccgcaggcctggttcgtcggcgaattgatccacggcgactacgccgcggtggtgcgggccgccggcttcgactctgccacccagtacgagctgtggaaggcgatctggagcagcctcaacgacggcaacttctatgaactggactgggcgctgcagcggcacaacgcatttctgggccggttctcgccgctgaccttcatcggcaaccacgacgtcacccggatcgccagccagctgaacaaccccgcgcacctggcgcacgccctggtgctgctgctgacggtcggcggggtgcccagcgtgtacgccggcgacgagctcggctttcgcggggtcaaggaggaacggttcggcggcgacgacgcggtacggcccgagttcggctctcccccaataccattggatgacttcggcacagaggtgtggaggctgcaccaatacctgatcgggctgcgccgccgccatccctggctgcacggggccaccaccaccgcgctgctgctgcaaaaccggcactacgtgtacgagacccgcagcggcgatgaggccctgctgatcgtgctcaacatcggcgatgagccgctgcgggtttcgctccgcgagctgggcggccggcgcgggcgggtgatcggcggctcggcggccccaccgccggaggtgctcgacacggtggtcgtcgagccgcagggctggcggatcctgagcccgatttag

SEQ ID NO: 13667 - protein, 444 aa, Mycobacterium avium subsp. paratuberculosis str. k10
MASVVTGPDWVQHVIWWQVYPLGFVGAYPLPQSSEPPQPEQHRLRRLVDWFDHAIELGASGIALGPIFASRTHGYDTTDHYRIDPRLGDDTDFDHLIAQAHRRGLRVLLDGVFNHVGVDFPRYRAAIDSDDHAAARWFRGSRGRFHTFEGHDGLITLNHDNPEVVDYTVDVMAHWLGRGADGWRLDAAYAVPETFWAATLPRVRDRYPQAWFVGELIHGDYAAVVRAAGFDSATQYELWKAIWSSLNDGNFYELDWALQRHNAFLGRFSPLTFIGNHDVTRIASQLNNPAHLAHALVLLLTVGGVPSVYAGDELGFRGVKEERFGGDDAVRPEFGSPPIPLDDFGTEVWRLHQYLIGLRRRHPWLHGATTTALLLQNRHYVYETRSGDEALLIVLNIGDEPLRVSLRELGGRRGRVIGGSAAPPPEVLDTVVVEPQGWRILSPI

SEQ ID NO: 13668 - DNA, 1773 bp, Mycobacterium avium subsp. paratuberculosis str. k10
  CDS (1)..(1773): transl_table=11
atgaacgacgcaagagaagctgtcgaacaccatcccgaggaaggcagtcacgtccaggacggtgtcgtcgagcaccccgaggccgaggacttcgacaacgccgccgcgctgcccaccgacccgacgtggttcaagcacgccgtgttctacgaggtgctggtccgcgcgttcttcgacgccaacgccgacggcgccggcgacctgcgcggtctgctggcgcagctggactacctgcagtggctgggcatcgactgcatctggctgcccccgttctacgactcgccgctgcgcgacggcggttacgacatccgggatttctacaaggtgctgccggagttcggcacggtcgaggatttcgtggcgctgctcaacgccgcgcacgagcggggcatccgggtgatcaccgacctggtgatgaatcacacgtcggagtcgcacccctggttccaggagtcccggcacgaccccgacggaccgtacggcgacttctacgtgtggagcgacaccagcgaccgctacgccgatgcccgcatcatcttcgtcgacaccgaggagtccaactggacgttcgacccggtgcgccgccagttttactggcaccggttcttctcccaccagcccgacctgaactacgacaacccggccgtgcaggaagccatgatcgacgtgatccggttctggctcgggctgggaatcgacgggttccggctggacgcggtgccctacctgttcgagcgggagggcaccaactgcgagaacctgccggagacgcacgccttcctcaagcgggtccgcaaggtcgtcgacgacgagttcccgggccgggtgttgctggccgaggccaaccagtggccggccgacgtggtcgagtatttcggcgaccccagcaccggcggcgacgaatgccacatggcgttccacttcccgctgatgccgcgcatcttcatggccgtgcgccgcgagtcgcgattcccgatctcggagatcctggcccagacgccgcagatccccgagatggcgcagtgggggatcttcctgcgcaaccacgacgagttgacgctggagatggtcaccgacgaagagcgcgactacatgtacgccgagtacgccaaggatccgcggatgaaggccaacgtcggcatccgccgccggctggcgccgctgctggacaacgaccgcaaccagatcgagctgttcaccgccctgctgctgtccctgcccggctcgccggtgctctactacggcgacgagatcggcatgggcgacgtgatctggctgggggatcgcgacggggtgcgcacgccgatgcagtggacgccggaccgcaacgccggcttctccaaggccaaccccggccggctgtatctgccacccagccaggacccggtgtacggctaccaggcggtcaacgtggaggcgcaacgcgacacctcgacgtcgctgctcaacttcacccgcaccatgctcgccgtgcggcgccggcacgaggccttcgcgatcggcacgttcgaggagctcggcggatccaacccgtcggtgctggcgttcgtgcggcaggtgtccaacgacggggacaccgtgctgtgcgtcaacaacctgtcgcggttcccgcagccgatcgagctgaatctgcagcactggagcgggtgcatcccggtcgagctgaccgggcacgtggaattcccccgcatcgggcacctgccctacctgctgacgctgccggggcacggtttctattggttccagctgaccgcatgcgaggaggacacatga

SEQ ID NO: 13669 - protein, 590 aa, Mycobacterium avium subsp. paratuberculosis str. k10
MNDAREAVEHHPEEGSHVQDGVVEHPEAEDFDNAAALPTDPTWFKHAVFYEVLVRAFFDANADGAGDLRGLLAQLDYLQWLGIDCIWLPPFYDSPLRDGGYDIRDFYKVLPEFGTVEDFVALLNAAHERGIRVITDLVMNHTSESHPWFQESRHDPDGPYGDFYVWSDTSDRYADARIIFVDTEESNWTFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPADVVEYFGDPSTGGDECHMAFHFPLMPRIFMAVRRESRFPISEILAQTPQIPEMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRTPMQWTPDRNAGFSKANPGRLYLPPSQDPVYGYQAVNVEAQRDTSTSLLNFTRTMLAVRRRHEAFAIGTFEELGGSNPSVLAFVRQVSNDGDTVLCVNNLSRFPQPIELNLQHWSGCIPVELTGHVEFPRIGHLPYLLTLPGHGFYWFQLTACEEDT

SEQ ID NO: 13670 - DNA, 1725 bp, Lactobacillus johnsonii NCC 533
  CDS (1)..(1725): transl_table=11
atgcaacttgcagctttaaaacacagaactgaaagtgaaaattgttttgttattgatcattcacacgttaaaattagacttcatacggcaaaagatgatgtggaaaaagtaattgttcattacacggataactatctcccaccaaaacaagctaaagaacttgaaatggagaaaataggtagtggtcaagttaatgattactggggagcaaccttaactgctccatatcaccgaattaaatatacttttgaagtgataggcaaagacggaagtcatgtgatcttcggtgatcgtagtattgaaaaatttagcgataaaaagttaagagaagatggaatgtattttaaagttccgtacttccatgatattgatcgcatcaagactccaaaatggcttaaagatattgtttggtatcaaatttttccagagcgttttgctaatggcgataaaagtaatgacccagcaaatgttaaagaatggaatccagaagatcatccaggcagagaagatttttatggtggagacttacagggagttttagatcatctagatgatctacagaaattaggagttacgggattatatttctgcccaatttttaaggcaagttctaatcataaatatgacacaattgattatttacaagtagatccagcttttggagacaaggatttgtttgcaaaagtagttaatgaagcacataagcgtgggatgaaagtgatgcttgatgctgtatttaatcacttaggtgatcaatcaatgcagtggcaagatgtcgttaaaaatggcgaaaaatcacgttttaaagattggttccacattaattcatatcctgttgaaccatatcgggacccaagtaaaggtgaaaataatccaccatatgaaacttttgccttcgaaaaacatatgcctaagttaaatacggctaacccagaagtacaggactttttattagaaattgcgacctactgggtaaaatattttgatattgatgcttggcggctagatgttgcaaatgaagttgaccaccatttctggaagagattccatgatgaattagttaaaataaagcctgatttttatattgctggggaaatatggcattcagctcgtccatggcttcagggggatcaatttacaggtgtaatgaattatccatatactttacaaattgaagaccacttctttaaacataaaatggatgctaaagaccttagtgaacacctaactgatcagttaatgatgtatccagatatggttgaccaggctatgatgaatatgcttgattcccacgatacggctagaattttaactttagcaaaagacaatcaagatttagctttgcaagcagttgcgtatgaatttgttcaacctggagtgccatgtatttactatggaacagagatggggatgagcggtgataatgatccggattgtcgtaaaccaatggattggagtaagataaatggtccggtatggcaaagagttcatgaattagtgaaattcagactagatcatagtgataccttaaataaaggtactgttaagttaacggtaacagaaaaaggacttctaaaagttgaacgaacaggcaaagaaacaataaaggcctactataataccggtaaacataatgtaaaaattgataaaacagcagctcttagtcagaattataaagcgggagtgttagcgccaaatggctttttgattgaggttaaagcttaa

SEQ ID NO: 13671 - protein, 574 aa, Lactobacillus johnsonii NCC 533
MQLAALKHRTESENCFVIDHSHVKIRLHTAKDDVEKVIVHYTDNYLPPKQAKELEMEKIGSGQVNDYWGATLTAPYHRIKYTFEVIGKDGSHVIFGDRSIEKFSDKKLREDGMYFKVPYFHDIDRIKTPKWLKDIVWYQIFPERFANGDKSNDPANVKEWNPEDHPGREDFYGGDLQGVLDHLDDLQKLGVTGLYFCPIFKASSNHKYDTIDYLQVDPAFGDKDLFAKVVNEAHKRGMKVMLDAVFNHLGDQSMQWQDVVKNGEKSRFKDWFHINSYPVEPYRDPSKGENNPPYETFAFEKHMPKLNTANPEVQDFLLEIATYWVKYFDIDAWRLDVANEVDHHFWKRFHDELVKIKPDFYIAGEIWHSARPWLQGDQFTGVMNYPYTLQIEDHFFKHKMDAKDLSEHLTDQLMMYPDMVDQAMMNMLDSHDTARILTLAKDNQDLALQAVAYEFVQPGVPCIYYGTEMGMSGDNDPDCRKPMDWSKINGPVWQRVHELVKFRLDHSDTLNKGTVKLTVTEKGLLKVERTGKETIKAYYNTGKHNVKIDKTAALSQNYKAGVLAPNGFLIEVKA

SEQ ID NO: 13672 - DNA, 1668 bp, Lactobacillus johnsonii NCC 533
  CDS (1)..(1668): transl_table=11
atgaatgattggaaaaagaaagctgtagtgtatgaggcatatgtacaaagttttaaagattcaaatggagatggaattggagatattcagggactaatagaaaagctagactatataaaaaatttaggtgccaatgttatctggttaactccaatttttaaatctcctttagtagacaatggttatgatattgcagattatcaggccattaatccaatttatgggacaatggatgattttaagaaattattgagtaaggctcatgaaaaagggttgagaattgtcctggatttggttgttaatcatacttctgaccaacataaatggtttaaagaatcccaaaaaaacaaagaaaataagtattctgattattatatttggcgtgatccaaaagaagatggaagtgcacctactaatttaggctcagcttttggtggttcagcttggacctatgttccagaaagaaatcaatattatttacacctttttgcaaaacaacagccagatttgaactgggataatccagaagtaagaaatgatatttataaaataatgatgttttggttagacatgggagttgatggctttagaatggattccattagctttatatccaaaccaagtaaatttgaagatgcgcctttagaagataataaagagtatggcgcttattactatggatcagctaacggtccacatattcatcaatatttacaagagatgaacagagaagtactaagtaaatatgatgtaattgctattggagaaacgccacatacaagtgctaaagaagcaagattatttgttgaacctgaacgacatgaattagatatggtatttcaatttgaacatatgcatgttgattatggaaaatatggaagatactctgatgtaacttttaagatgagtgatctgcgcaattctatgtcgagttggcaaaatagtctttcttggaattcaaattatcttggaaatcatgatcaacccagaattgtctctagatttggaaatgataataagtatcgaaaagaatcagcaaaaatgttggctatagtatctttattacaaaagggtactccatttatttttcaaggtgaagaaattggaatgaccaatttacatattaagaaaatagatgagttaaaggaccttgaagcacataatatatataattttttaagatcaaaaggtattagtgaagatgacgcattgaatatggtcaacaggaaaactagagataatgcccgtacaccaatgcaatgggatgaatcggaacaaggtggtttttcaagtgaaacgccatggatggaagttaatccaaattataaagaaattaatgtgaagaaagatttgaaagatccagactcgatatatcatttttatcaaaagattttgaaattaagaaataataatcaagtattgttagatggaaagtatgagctagtttcttctgatgattctgcagtttttgcctatactcgaagtacggggaaagaaaaattggcagttatttgttcttttgtcccatataaggttaaatataatttgcctactgattttgtaaatagaaatgaattgcttttatctagctatggtgacaataaagcaaaagcctcaaatgttatgtatttaaggccttatgaaggagttgtgattagacgtgagtag

SEQ ID NO: 13673 - protein, 555 aa, Lactobacillus johnsonii NCC 533
MNDWKKKAVVYEAYVQSFKDSNGDGIGDIQGLIEKLDYIKNLGANVIWLTPIFKSPLVDNGYDIADYQAINPIYGTMDDFKKLLSKAHEKGLRIVLDLVVNHTSDQHKWFKESQKNKENKYSDYYIWRDPKEDGSAPTNLGSAFGGSAWTYVPERNQYYLHLFAKQQPDLNWDNPEVRNDIYKIMMFWLDMGVDGFRMDSISFISKPSKFEDAPLEDNKEYGAYYYGSANGPHIHQYLQEMNREVLSKYDVIAIGETPHTSAKEARLFVEPERHELDMVFQFEHMHVDYGKYGRYSDVTFKMSDLRNSMSSWQNSLSWNSNYLGNHDQPRIVSRFGNDNKYRKESAKMLAIVSLLQKGTPFIFQGEEIGMTNLHIKKIDELKDLEAHNIYNFLRSKGISEDDALNMVNRKTRDNARTPMQWDESEQGGFSSETPWMEVNPNYKEINVKKDLKDPDSIYHFYQKILKLRNNNQVLLDGKYELVSSDDSAVFAYTRSTGKEKLAVICSFVPYKVKYNLPTDFVNRNELLLSSYGDNKAKASNVMYLRPYEGVVIRRE

SEQ ID NO: 13674 - DNA, 1665 bp, Bacillus cereus ATCC 10987
  CDS (1)..(1665): transl_table=11
atgaataaaacatggtggaaagaagcggttgcttatcaaatttacccacgtagctttatggattcaaatggtgatggtattggggatttacaaggtattattgcaaaactggattatttaaaagatttaggtatagatgtaatttggatttgtccaatgtataagtcacctaatgatgataatggttatgacattagtgattatcaagatattatggatgagtttggtacgatggaggacttcgatgctttactagatgaagttcataagcgtgatatgaagcttattattgatttagttattaatcatacaagtgatgaacatccatggtttattgagtctcgttcatctaaagacaatccgaagcgtgattggtatatttggcatgatggtaaagatggtgcggaaccaaacaactgggaaagtatttttaatggttcggcatgggaatacgatgaagtaacaggacaatattatttacacttattctcacgtaaacaaccagatttaaactgggagaataaagaagttcgcgaagtgttatacgatacagttaattggtggcttgataaaggaattgatggtttccgtgtggatgcgatcagccatattaaaaaagaggatggctttaaagatatgccaaatccaaaagaactaaagtatgtaccatcttttgataaacatatgaatgtggatggtattcaacctttattagaagagttaaaagaaaatacattttctaagtacgatattatgactgtcggtgaagcgaatggtgttaagattgaagatgctgagctttgggttggagaagaacaaggtaagttcaatatggtattccaattcgaacatttaagcttatgggatgcagaaaagaagaaagatcttgatgttgtagggttgaaaaaagtattaacgaaatggcaaaaaggtctagaaaataaagggtggaatgctttatatattgagaatcacgataagccacgtatcgtttcaacttggggagatgataaacaatattggcgtgaaagtgcgacagctcttggagcgatgtatttctttatgcatggtacaccgtttatttatcaaggacaagaaattgggatgacaaatgttcaattcccaaatattgaagattacgatgatgtagcaattaaaaatttatatcgtgagaaaattgcagagggtgtatctcatcaagatatgatggagattatatgggcttcttgccgcgataattcacgtacacctatgcagtggaacgatgagatgaatgctggcttcacaacaggtgccccttggtttgggatgaatccaaactataaagaaattaatgttgaaaagcaaaagagtgaagagaactctattttcaatttctataagaaaatgattgctttgaaaaaagagcacgatgtactgaattatggtacgtacgatttacttttagaagatgatccgcaaatttatgcatatactcgtacattaagcgatgaaaaaatcgttgtaattagtaatatctcaaaagaggaagctgtatataatgagggttcattcgcgatagaacgcaaacgtttgcttttaaataactacgaagttgcggaacatgaacaagtaactacaatcacgttaaagccttatgaaacaagggtttatcgtatttcataa

SEQ ID NO: 13675 - protein, 554 aa, Bacillus cereus ATCC 10987
MNKTWWKEAVAYQIYPRSFMDSNGDGIGDLQGIIAKLDYLKDLGIDVIWICPMYKSPNDDNGYDISDYQDIMDEFGTMEDFDALLDEVHKRDMKLIIDLVINHTSDEHPWFIESRSSKDNPKRDWYIWHDGKDGAEPNNWESIFNGSAWEYDEVTGQYYLHLFSRKQPDLNWENKEVREVLYDTVNWWLDKGIDGFRVDAISHIKKEDGFKDMPNPKELKYVPSFDKHMNVDGIQPLLEELKENTFSKYDIMTVGEANGVKIEDAELWVGEEQGKFNMVFQFEHLSLWDAEKKKDLDVVGLKKVLTKWQKGLENKGWNALYIENHDKPRIVSTWGDDKQYWRESATALGAMYFFMHGTPFIYQGQEIGMTNVQFPNIEDYDDVAIKNLYREKIAEGVSHQDMMEIIWASCRDNSRTPMQWNDEMNAGFTTGAPWFGMNPNYKEINVEKQKSEENSIFNFYKKMIALKKEHDVLNYGTYDLLLEDDPQIYAYTRTLSDEKIVVISNISKEEAVYNEGSFAIERKRLLLNNYEVAEHEQVTTITLKPYETRVYRIS

SEQ ID NO: 13676 - DNA, 1710 bp, Anopheles gambiae str. PEST
  CDS (1)..(1710)
atggactggtggcaaaggacggtgttctatcagatctacccgcgctcgttcatggactcgaacggggacggggtgggcgatctgcgcggcataacgagccggttggagcatctgaaggatgccggcattggtgcgacctggctatcgcccatcttccgatcgccgatggttgacttcgggtacgacattgcggactataccgccatccagccggagtacgggacgatggaggactttgaggcgctgctggcggaagcgaagcggctcggcatcaagatcatcctggactttgtgcccaatcacacgagcgaccagtgcgaatggttccggcggtcggtggcgcgcgaacacccgtacaccgattactacgtgtggcaggatgggcgcgtcgacccaaacggtaatgggacggcccgtttgccaccgaacaattggcaatcggtattctacggttccgcctggacgctgcatccggaccgcggtcagtactatttgcatcagtttaccgcccagcagccggatctgaactttcgcaacccggccgtggtggacgagatgcgcgaggtgctgcggttctggctgcgcaagggtgtggccggctttcgcatcgacgccgttaatcatctgttcgaggcggacggctttccggacgagccggaaacgggcacggaccgggatccactgtcctacggctttacgcaccacatctacacgaaggatttgctcgaagactacgacatggtgtaccagtggcgagcgctgctggacgactggagccgcgagcatggaggcgacgctcgcatcataatgaccgaagcgtacgccaacattaccttcaccatgaagtactaccacgcggaggaggacgacggcgaccagccggacggtcaaccgcgagccgctgcgggttcacacatgcccttcaactttctgctcatcaccgacctgaaccgtgactcgagtgcgcaggactttgtgtacacgatacagaagtggctcacgtacatgccgcgggtgggggccaccgccaactgggtgctgggcaatcacgatcagccgcgctggctgaacgcgatgccggccggcgcccgggcgaactgggtgctgggcaatcacgatcgtccgcgcattgcctcgcggtacgggcgcgatcttgcctcgagcctggccgtgctggagatgacactgcccggcattgcggtcgtgtactatggtgaggagatcggtatggaggacaaccgggacattacgttcgaggagacgcaggacccgcaggccgccaacacgaacccggacgtgtatcagcagtttacgcgcgatcccgtccgcacaccgttccagtgggatgcgacggcgtacgctgggtttaccgtagctagcgcccagaagacgtggctgccggtacatccgaactatcgggaggtgaatctggccgcccagaaggcggcgagcaacagtatgttcaagctgtaccagcggctgatcaagctgcgcaaggagcacacgttcatgcacggtgatttcgagtcgaaggtgctgctgaacaatgtgtttggctatacgcgcacgctcgagggcgagcagtcgtacgcggtcgtggtcaatctgaacgataacgatgtgaatgtgaacctgcaggagctgcacgaggacattgacacggcccgggtggcgcttacgtcgctcgacgctcgcatgaaggagggctag

SEQ ID NO: 13677 - protein, 569 aa, Anopheles gambiae str. PEST
MDWWQRTVFYQIYPRSFMDSNGDGVGDLRGITSRLEHLKDAGIGATWLSPIFRSPMVDFGYDIADYTAIQPEYGTMEDFEALLAEAKRLGIKIILDFVPNHTSDQCEWFRRSVAREHPYTDYYVWQDGRVDPNGNGTARLPPNNWQSVFYGSAWTLHPDRGQYYLHQFTAQQPDLNFRNPAVVDEMREVLRFWLRKGVAGFRIDAVNHLFEADGFPDEPETGTDRDPLSYGFTHHIYTKDLLEDYDMVYQWRALLDDWSREHGGDARIIMTEAYANITFTMKYYHAEEDDGDQPDGQPRAAAGSHMPFNFLLITDLNRDSSAQDFVYTIQKWLTYMPRVGATANWVLGNHDQPRWLNAMPAGARANWVLGNHDRPRIASRYGRDLASSLAVLEMTLPGIAVVYYGEEIGMEDNRDITFEETQDPQAANTNPDVYQQFTRDPVRTPFQWDATAYAGFTVASAQKTWLPVHPNYREVNLAAQKAASNSMFKLYQRLIKLRKEHTFMHGDFESKVLLNNVFGYTRTLEGEQSYAVVVNLNDNDVNVNLQELHEDIDTARVALTSLDARMKEG

SEQ ID NO: 13678 - DNA, 1800 bp, Anopheles gambiae str. PEST
  CDS (1)..(1800)
atggccctctactactggctagctttactactgttgggctggtctactgtgaccgcccagaaggattggtgggaaagtgcgagcttctatcaaatctatccgcgatcgtttcaagatagtaacggcgatggaataggcgatcttaatggcatcaaaagtcggttgccgtatctgaagtcactcggtatgactgcattttggctttccccgatctacccttcgccgatggccgactttgggtatgatatctccaactttatggacattcatccgagctttggaacgttggctgactttaagcagctggtggaagaagcgaaaaaactgcaattacgcatcatcctcgacttcgtgcctaaccattcgagcgacgagcatgagtggttcaagaaaagcgttcagcgagtaagtgggtacgaagactattacgtgtggcaggatcccaaaccgggcacggaacgcgaccctccaaacaactgggttgcagcatggtacggttcggcgtgggaatggaatgacgaaagaaagcaattttatttgcaccagtttcacaagaagcagcccgatctgaactaccgcaacccggccgtggtgcaggctatgaaggatgtgttgcgcttctggttggaccagggcgtcgacggcttccgtattgatgcggtcccgtggctgttcgagacggtgggtttcccggacgaacctgttagcggtcattccaccgatccgttaagtcagaactaccttacccacatttatacgctcgatcaaccggaaaccgttgacatggtgtatcaatggcgggaattgatggatcagtacaaacaagagcacaataccaccaccaaagtgctcatgaccgaggcatggtcctcgttggatgttgtaaaaacgtacttcaacgacagtaacaaccggcaaggatcgcaaatgccgttcaacttccagttaatcatgcggctggatcaaaattctaaagcatccgattttcagacggttattaactcgtggctggatatcattcctcctggccacacgcccaactgggtgcttggtaatcacgacaaacgtcgtgtttcgtcacgaatgggtggagaccatatggtagacataatggctatgatcgagctcaccttacccggcataacggtcacttaccagggagaagaaattggaatgcatgacgttgatatctcgtgggcggacactcaagatcctgctgcatgccagctgaccgaagagacgtatcaggaaggtacacgcgacccagccagaacaccgttccagtgggattctactgcaaacgcaggttttacgaacgcttctgtaaaaccgtggcttccgctagctaccgattatccgctggtgaacgtaaaaacacaacaagaatcagcccaaaacagtcatataaaggtgttcaaggagctgatgaacttacgcggcacgaacacgcttatctggggctcgtttaagtcactggtacttggcgaaaatgtgtacgctatactgcgttctttccccaacgacaaacgaacatatgtcgtgctggcaaacattggctccaagagcgaaataattgacgctacaaaactggacaacagtttaccgaacgagcttgtgtttcgcgtggtaagcgtatcgtcaaatcatatcaccggagaatcggtcgcaacaaacaacattcttttacagccttacgaagccgtagttttggctaaccatgcaattcgactggcgcagcagctttatgtattgatcggtgcttttggtatgttggtgggtgtgcaattgtttaaggcgtaa

SEQ ID NO: 13679 - protein, 599 aa, Anopheles gambiae str. PEST
MALYYWLALLLLGWSTVTAQKDWWESASFYQIYPRSFQDSNGDGIGDLNGIKSRLPYLKSLGMTAFWLSPIYPSPMADFGYDISNFMDIHPSFGTLADFKQLVEEAKKLQLRIILDFVPNHSSDEHEWFKKSVQRVSGYEDYYVWQDPKPGTERDPPNNWVAAWYGSAWEWNDERKQFYLHQFHKKQPDLNYRNPAVVQAMKDVLRFWLDQGVDGFRIDAVPWLFETVGFPDEPVSGHSTDPLSQNYLTHIYTLDQPETVDMVYQWRELMDQYKQEHNTTTKVLMTEAWSSLDVVKTYFNDSNNRQGSQMPFNFQLIMRLDQNSKASDFQTVINSWLDIIPPGHTPNWVLGNHDKRRVSSRMGGDHMVDIMAMIELTLPGITVTYQGEEIGMHDVDISWADTQDPAACQLTEETYQEGTRDPARTPFQWDSTANAGFTNASVKPWLPLATDYPLVNVKTQQESAQNSHIKVFKELMNLRGTNTLIWGSFKSLVLGENVYAILRSFPNDKRTYVVLANIGSKSEIIDATKLDNSLPNELVFRVVSVSSNHITGESVATNNILLQPYEAVVLANHAIRLAQQLYVLIGAFGMLVGVQLFKA

SEQ ID NO: 13680 - DNA, 1509 bp, Anopheles gambiae str. PEST
  CDS (1)..(1509)
atgcttgctggggcactctctttagtggcatgtttagatcttaccgtaccaacgtcccgcgattggtgggaaaaggctgccttctatcaaatctatccccgatcgttcatggacagtgatggggatggtgtgggcgatcttaacggaattgcttcgaagctgccgtacctgaagtcgatcggagtgaaggcgttctggatgtcaccgatctacaaatcaccgatggtcgattttggctatgatatttctgactttcgggacattcacgaggagtttggaacgatggctgactttgagcggttggtggagcaggcgcacgggctcggcctgaaggtgatcatggactttgtgccgaaccattcgagcaatctgcacgagtggttcgtaaagtcggaacagcgagagccgggctatgaggactattacgtgtggcatgatgggaaggttaatccggcgggcggtaggaacttaccaccaaacaattggattcaagccttccgtggcagtgcatggcagtggagtgatcagcggcaacagtactacctacaccagttcaccgtcgagcaaccggacttaaactaccgaaatccgacggtcgttcaggagatgaaagatgtgctgctgttctggctgggcaagggcgtggacgggttcaggatcgatgccgtgccgacgctgtacgaagatacgcagctgcgcgacgagccagtgagcgggctgacggatgatcccgaagataccaactacctgcgacacatctacacgcaggatctgccagaaacggtcgagatggtgtacgaatggcgggaactgatcgatgcattccaggcagagcatggcggcgagacgcgcgtcatcatgacggaggcctactcaacgctagatgtgatcaagacgtattacgcgagcagtacaggacggttgggatcccatatgccgttcaactttcgactcattaccgaagtggacaagcaatcgacggctgcggactacgtgaaggtggtcaaggattggatgagcatactgcctgccggacaggtgccaaactgggtgatgggcaatcatgatcgtccacgcgttgccacgcgtctcggggaggaacgaattgacgcactgaacatggtgctgctgtccctctccggcgcaagtgtcacataccaaggggaagagattggcatgaccgatgtgtacatctcctgggaggacaccgtcgatccggcggcctgcaatgcaggcaaagacctatacgcggaaaagtcacgcgatccgtgccgcacaccgttccagtgggatgatacggcaatggctgggtttactaccggctccaaaacctggctacccgtcggcgaccggtacagggaagtgaacgtgcaggcgcaacttgcggccgaaaaaagtcacctcaaagtgtaccaatcgatgatggaattgcgcaagacgaaaacttaccagctcggtacggtgaaagcagttgcgctcggcgattccgtgctggcggttgtgcgatag

SEQ ID NO: 13681 - protein, 502 aa, Anopheles gambiae str. PEST
MLAGALSLVACLDLTVPTSRDWWEKAAFYQIYPRSFMDSDGDGVGDLNGIASKLPYLKSIGVKAFWMSPIYKSPMVDFGYDISDFRDIHEEFGTMADFERLVEQAHGLGLKVIMDFVPNHSSNLHEWFVKSEQREPGYEDYYVWHDGKVNPAGGRNLPPNNWIQAFRGSAWQWSDQRQQYYLHQFTVEQPDLNYRNPTVVQEMKDVLLFWLGKGVDGFRIDAVPTLYEDTQLRDEPVSGLTDDPEDTNYLRHIYTQDLPETVEMVYEWRELIDAFQAEHGGETRVIMTEAYSTLDVIKTYYASSTGRLGSHMPFNFRLITEVDKQSTAADYVKVVKDWMSILPAGQVPNWVMGNHDRPRVATRLGEERIDALNMVLLSLSGASVTYQGEEIGMTDVYISWEDTVDPAACNAGKDLYAEKSRDPCRTPFQWDDTAMAGFTTGSKTWLPVGDRYREVNVQAQLAAEKSHLKVYQSMMELRKTKTYQLGTVKAVALGDSVLAVVR

SEQ ID NO: 13682 - DNA, 1716 bp, Gibberella zeae PH-1
  CDS (1)..(1716)
atgggtagtacaggtcaaactctacgagcttggtggaaagagagctcggtatatcaaatataccctgcgtcttaccaagactccacaggctctggtgttggtgacctcaaaggtatcatctctcgagttgactacctcaaagacttgggcgttgatatcatatggctttctcccatcttcaagagtccccaggttgatatggggtacgatatcagcgactactacaccgttgatcctccgtatggcaacgtctctgatgttgatgttctcaaagacaaactacatgagcgaggaatgaaacttgttctcgatttggtgatgaaccacaccagcgaccaacacgagtggttcaaggagtctcgcaagtccaaggacaacccctaccgagactggtatatctggaagcctgcaaagtacgatgcagacggaaacagacacccccccaacaactgggatgctcacttccagggaagtgcctgggagtacgacgagatcacagatgagtactacctctgcctcttctgcaagcagcagccagatctcaactgggagaacccagcggtcagaaaacaggtccaccaggtaatgcgcttctggcttgaccgaggcgtcgatggtttccgcatggacgtcatcaactttgtcagcaaggaccaagcattccccgactcagacaagactgtcctccgtgggacagagtactatgcatgtggtcctaggtgtcatgagttcctcaaggaaatcggtagcattctccaggagtacgatgcctttagtgttggtgaaatgccttgtgttcatgatgagagggagttgatcaaggctgtgcacggtgaccgaggagagctgagcatgatcttccattttgagctgatggatcttgatcacggcgtcgaaggcaagttcacgcccagatcctggaaactatcagagctgaaggctacaaccctcaagtggcagaggttcatgtacgacaacgaaggctggaacgcgctgtacctggagaaccacgatcagccacgagctgtcagccgcttcgtccacgatgatcctgagcatcgcgttgccagcgcgaaactgatcgcactcttcctcggcttccagtcaggcacacccttcatctaccaaggccaggagattggtatgaccaatgttccgaaggactgggacttggaagagtacaaggaccttgactgtcttaaacattgggatcttcacaagaatgatgatgttgcagcccagaattcctacaaggtcgagtatcaaaggaagtctcgtgacaacgctcgtacccctatgcaatgggatgcaagcccaaacgcaggcttcaccactgctgatgccaacccgtggatgcgcgtcaacgacaactataccgacatcaacgctgcttcacagacatcagattccaactctgtgtacagctgttatcgtcaagtacttgggaagcgcaaggagtacaaggatatctttgtctatggtaacttccaactcgtggacgagtccaacgacaagatctttgcgtactcacgacgggctgatagcggggagacggctctcgtcgtgtgcaacttctcagtggattccgttgcatggaagttacctggcgaggctcgagaggtgctgactagtccagcgggaaggacactcaatgacttgaacagtggtgagatcaagctagcaccctgtgaggctttcgctgtcctcctgaaatga

SEQ ID NO: 13683 - protein, 571 aa, Gibberella zeae PH-1
MGSTGQTLRAWWKESSVYQIYPASYQDSTGSGVGDLKGIISRVDYLKDLGVDIIWLSPIFKSPQVDMGYDISDYYTVDPPYGNVSDVDVLKDKLHERGMKLVLDLVMNHTSDQHEWFKESRKSKDNPYRDWYIWKPAKYDADGNRHPPNNWDAHFQGSAWEYDEITDEYYLCLFCKQQPDLNWENPAVRKQVHQVMRFWLDRGVDGFRMDVINFVSKDQAFPDSDKTVLRGTEYYACGPRCHEFLKEIGSILQEYDAFSVGEMPCVHDERELIKAVHGDRGELSMIFHFELMDLDHGVEGKFTPRSWKLSELKATTLKWQRFMYDNEGWNALYLENHDQPRAVSRFVHDDPEHRVASAKLIALFLGFQSGTPFIYQGQEIGMTNVPKDWDLEEYKDLDCLKHWDLHKNDDVAAQNSYKVEYQRKSRDNARTPMQWDASPNAGFTTADANPWMRVNDNYTDINAASQTSDSNSVYSCYRQVLGKRKEYKDIFVYGNFQLVDESNDKIFAYSRRADSGETALVVCNFSVDSVAWKLPGEAREVLTSPAGRTLNDLNSGEIKLAPCEAFAVLLK

SEQ ID NO: 13684 - DNA, 1635 bp, Leptospira interrogans serovar Copenhageni str. Fiocruz L1-130
  CDS (1)..(1635): transl_table=11
ttggataagtggtggcaaaaaacaacgatttaccagatttatccccgctcttttgcagatagtaatcgggatggtgttggagacattccagggatcatttctaaattggattatcttcaagatcttgggtttgaaacaatttggatatctcctttgtataaaagtccacaaatggatcacggttacgatgtaagtgattattactcgatcgctccagaatatggaactataaaagatgcagaaaagttaataaaggaagttcataagcgcgggatgaaaatcgtttttgatatggtgatgaatcatacttctattgaacacgattggtttatacaatcccgttctagtcgagataatcctaaaagagattggtatatttggaaagacggaagaggaaaaaataaacctcctaataattggagttcgtttgtgacacccaaggcctggcattatgattccaatacggatcaatggtatcttgcgagttttctagattttcaaccagacttaaattattacaatccagaagtcaaaaaggcaatgttcgacgttttgcgtttttggcttaagaagggagtagatggtttccgtttggatatttttcacgcgatttataaggataaatatttcagagacaatccgtttcgatttaaatatatcgtttcggaaaatgatcacgatggttattttcagagtagggttcatactgtaaaccatccaaataactttgcttttgcgaaagagctaagatccgttttagatgagtttgatggagatcgttttgcggtaggagaggtggccggagatgatcatatcatcaaacgctacttaggcgaaaaaaaagatggcctgaatctaatctttttattcgaaactttgttgttaaagttcaagactagtttttttaagggaatcgtaaaaaaaatggaacaagtatatccgtatccaaacgttcccacatacgtttttggaaaccatgaccaaagacgttacatgatgaaaatcaataataatctcgaaaaaggaaaattgattgctctgtttcagtttaccgcgaggggggttccagtcacttattacggagaagaaattggaatgaccaatgagacgatcaaattaactgaggcacaggatccgcttgcaagaatctatcgctggttaggtgattcgctttccgaattgttgggactcgcagacgttatcattcgggatcgagcaaggtcgccgatgcaatgggacgactcgccaaacgcaggttttacggttcaagaagcaaaaccatggattcgggttcacggaaattatagagaacgtaacgttttgatcgagtccgaagattcggattctcttttaaatacttataaaagtgttcttcgcattcgaaatggaagttttgctcttaaagagggttctttgagattaattgaagaaaacgttccaaaagatatgttagtttatttaagggaatttggtaaggaacgtaaactgatcgtttttaattttggtaaaaaaaccaaatttttttctaatcctaccgattgtagaaaatattttttctctacggtttctttcgatcataacgaatttgatcaatttaaaatacctccttgttctggagttatattaggtaattag

SEQ ID NO: 13685 - protein, 544 aa, Leptospira interrogans serovar Copenhageni str. Fiocruz L1-130
MDKWWQKTTIYQIYPRSFADSNRDGVGDIPGIISKLDYLQDLGFETIWISPLYKSPQMDHGYDVSDYYSIAPEYGTIKDAEKLIKEVHKRGMKIVFDMVMNHTSIEHDWFIQSRSSRDNPKRDWYIWKDGRGKNKPPNNWSSFVTPKAWHYDSNTDQWYLASFLDFQPDLNYYNPEVKKAMFDVLRFWLKKGVDGFRLDIFHAIYKDKYFRDNPFRFKYIVSENDHDGYFQSRVHTVNHPNNFAFAKELRSVLDEFDGDRFAVGEVAGDDHIIKRYLGEKKDGLNLIFLFETLLLKFKTSFFKGIVKKMEQVYPYPNVPTYVFGNHDQRRYMMKINNNLEKGKLIALFQFTARGVPVTYYGEEIGMTNETIKLTEAQDPLARIYRWLGDSLSELLGLADVIIRDRARSPMQWDDSPNAGFTVQEAKPWIRVHGNYRERNVLIESEDSDSLLNTYKSVLRIRNGSFALKEGSLRLIEENVPKDMLVYLREFGKERKLIVFNFGKKTKFFSNPTDCRKYFFSTVSFDHNEFDQFKIPPCSGVILGN

SEQ ID NO: 13686 - DNA, 1251 bp, Thermus thermophilus HB27
  CDS (1)..(1251): transl_table=11
ctggacctgggggtggaggccatctacctcaaccccgtcttcgcctccaccgccaaccaccgctaccacaccgtggactacttccaggtagaccccatcctggggggaaacgaggccttaaggtacctcctggaggtggcccacgcccacggggtgagggtcatcctggacggggtcttcaaccacacgggccggggcttcttcgccttccagcacctcatggaaaacggcgagcaaagcccctaccgggactggtaccacgtcaagggcttccccctaaaggcctacaccgcccaccccaactacgaggcctggtggggcaaccccgagctccccaagctcaaggtggagaccccggcggtgcgggaatacctcctcgccgtggccgagcactggatccgcttcggcgtagacggctggcgtctggacgtgcccaacgaaatccccgaccccaccttctggcgggagttccgccaaagggtcaagggggcaaaccccgaggcctacatcgtgggggagatctgggaggaggcggacccttggctccagggggacatgtttgacgcggtgatgaactaccccctcgcccgggccgtcctgggcttcgtgggcggggaggccctggaccgggacctcgcggcgcagacgggcctaggccgcatagaacccctccaggctctggccttcagccatcggctggaggacctcttcggccgctaccgccccgaggtggtccgggcccagatgaacctcctcacctcccacgacacccccaggctcctcagcctgatgcgggggagcgtggagcgggcccggctggccctggccctcctcttcctcctcccggggaaccccaccgtctactacggggaggaagtggggatggcggggggcaaggacccggaaaaccggggcgggatggtctgggaggaggcccgctggcagaaggacctcctggagacggtcaagcgcctggcccggctcaggaaggaacaccccgcgctccgcaccgccccctacctgcggatctacgcccaggacggccacctggccttcgcccgggggccccacctggcggtggtgaacgcctctccccaccccttccgccaggacttccccctgcacggggtcttcccccgggggggaagggcggtggacctcctctccggggaggtctgcacgccccagggggggaggctctgcggccccgtgctcccgcccttctccctggccctgtggcgggaggcctaa

SEQ ID NO: 13687 - protein, 416 aa, Thermus thermophilus HB27 [sequence omitted]

SEQ ID NO: 13688 - DNA, 1662 bp, Listeria monocytogenes str. 4b F2365
  CDS (1)..(1662): transl_table=11
atgaaagaaaaagattggtggaaaaaaagcgtagtgtaccaaatctatccaaagagttttaatgattcaaatggtgatggagttggtgatattcaaggaattatcgagaaattagattatttaaaagagctaggtgtggacgttatctggttgtccccagtatacgattcgcctcaagatgacaatggttacgatattcgcgattatcaaaaaatttacgaagagtatggagatatggcgacttttgatcaattacttcaaggtttacacgaccgcgaaatgaaacttgtaatggatcttgttgttaaccatacttctgatgaacacaagtggtttgaggaatccagaaaatccaaagacaacccgtacagagattactatttctggcgcgaggaaaacgaaatcaataactggggctcgattttcagcggtccagcatgggaattggacgaaaaaacaggtgagtactatttacacctattctccaaaaaacaacctgatttaaactgggaaaaccctaaattacgccaagatgtatataatatgatgaaattctggctagataaaggcattgatggcttccgcatggatgtaattaattttatttccaaaaatactgatttcccagatggtccagtaccagatggtcaaatttatggcgatgctggcaatgatttttgtaatggaccgcggattcatgagttcttgcaagaaatgaaccaagaagttacttctaaatacgatgtgatgactgttggcgaaatgcctggtgctagtacaaccgacgcgcaaatttacacgaatccagcaaataatgaagtcgatatgatttttacatttgaacatatgaacttagattccgatggcgacaataaatgggatctaaaaccaatctacttaccagatttaaaagaaaatatgtctgaatggcaagtggcgcttcaagaaaacggttggaatagcttatattggaataatcatgaccaaccgcgtatcgtttctcgttttgggaatgacaatcgtttccgtgttcgttcagcgaaaatgcttgcaacttgtttgcatatgatgaaaggaacgccatatatttatcaaggtgaagaaattgggatgacgaatgttcattttgaaacgctagatgattaccgtgatatcgaaacgctaaacatgtacaaagaacgcaaagagcaagggcacagccacgaaagcatcatgcagtcgatttacacaaaaggccgtgacaatgcgagaacgccgtaccagtgggataatagcgagaatgctggcttcacaaccggaacgccttggcttaaagtcaacccgcgctatacagaaatcaacaacgaagaagcgctgaaaaacccagattccattttctactactaccaaaatcttattaagttacgaaaaacgactgaaatcatcacaactggtaattatcgtttgttattacctaaagatgaagcgattttcgcatatgaacgctacacagaaaatgaaaaattagtggttttatgtaatttcacagaagaagaacaagttatttctgatgaaaacattttgaacgaaatccaaaaaggttccgtgcttgtaaacaatgttcctaatattatagaaggaactttacgaccttacgaagcaatcgtttatcaaatcaagtaa

SEQ ID NO: 13689 - protein, 553 aa, Listeria monocytogenes str. 4b F2365
MKEKDWWKKSVVYQIYPKSFNDSNGDGVGDIQGIIEKLDYLKELGVDVIWLSPVYDSPQDDNGYDIRDYQKIYEEYGDMATFDQLLQGLHDREMKLVMDLVVNHTSDEHKWFEESRKSKDNPYRDYYFWREENEINNWGSIFSGPAWELDEKTGEYYLHLFSKKQPDLNWENPKLRQDVYNMMKFWLDKGIDGFRMDVINFISKNTDFPDGPVPDGQIYGDAGNDFCNGPRIHEFLQEMNQEVTSKYDVMTVGEMPGASTTDAQIYTNPANNEVDMIFTFEHMNLDSDGDNKWDLKPIYLPDLKENMSEWQVALQENGWNSLYWNNHDQPRIVSRFGNDNRFRVRSAKMLATCLHMMKGTPYIYQGEEIGMTNVHFETLDDYRDIETLNMYKERKEQGHSHESIMQSIYTKGRDNARTPYQWDNSENAGFTTGTPWLKVNPRYTEINNEEALKNPDSIFYYYQNLIKLRKTTEIITTGNYRLLLPKDEAIFAYERYTENEKLVVLCNFTEEEQVISDENILNEIQKGSVLVNNVPNIIEGTLRPYEAIVYQIK

SEQ ID NO: 13690 - DNA, 1533 bp, Listeria monocytogenes str. 4b F2365
  CDS (1)..(1533): transl_table=11
ttggaattttggcgtcgtagtgtgttttatgaaatttatatgaaatcatttcaagacagtaatggcgatggtttaggtgattttaaaggtttaacgagcagattagattatctagtggatttgggaattgatggtatttggttgactccattttatccttcaccgcaagtggataatggttatgatgtgtctgattactgcgatattaacccggattacggcgatatgactgattttcgagtgtttatgaaagcggcagatgctcgaggaataaaagttattatcgacttagtattaaatcattcgtcaacagagcatgcttggtttaaggagtcgcgtagtagtaagacgaatcctaaacgagattattatatttggcgagaaaaaccaaataattgggaatcgttttttggtggttctgcttgggaaatggatgaacttactggcgagtattactatcatagttttgcaaaagaacaggctgacttaaactgggcgaatgaagctgttcgcgcagaaatggagcaagttttagcgttttggttgaatgagggagtggcgggattcaggttagatgttatcaataatttaacgctcgtacttgaatttacggataatccagtcacatctggtgaaatggagcatgtgtatgaccgtaatcagagtggcttagaacaagcgttagaggatatcgcttccttttgtcgaaaagagcgcgacgtgtttctagtaggcgaaattagctcggaccaattagctgaaattgctagatatagctcgaaaaaaatgctagatgtcacatttaattttaattttggcagtgttgatcagctagatgcaaaatctgtatttacgacattgaatgagatggaaacggcattaaatgaagggcagtggccgacgcttttctttggaagtcatgatatgagcaggttcagaagtcgcctcgcatctggaggcttagtaaagacccagttgctcgcatttttaatgttaactgcgaaaggcgtgccgtttatatactacggagaagaggtgggtatgcctgatttaacgttttcttccgtaaaagagatgcgcgatattcaagggacagccgcgtactatcaagctttacaaactgggacagatgaaaaacaagcactcgaaattgctattgaaaaaacgcgtgacaaagcacgtgggccgatgattttcccagatggaaagccatttactctaggtgaaccatggattaaaatggcgactttgccggaaaaagaagcacgaacgatgtggcgattttatcaaggattactcgcatttcgtaaagaaaatgattttaaagagatggaatatacttttttgaagttggatggagaagtactcagttatcagcgaggtgaatttatctttttacttcattttggtgaggaagaggtaacttatccgcttcaggggaactatcagcttgtttttggagaagcagtgatggtaggaaatggcattagaatgggcgcgcatactggaattgcgcttagagtggaggaatag

SEQ ID NO: 13691 - protein, 510 aa, Listeria monocytogenes str. 4b F2365
MEFWRRSVFYEIYMKSFQDSNGDGLGDFKGLTSRLDYLVDLGIDGIWLTPFYPSPQVDNGYDVSDYCDINPDYGDMTDFRVFMKAADARGIKVIIDLVLNHSSTEHAWFKESRSSKTNPKRDYYIWREKPNNWESFFGGSAWEMDELTGEYYYHSFAKEQADLNWANEAVRAEMEQVLAFWLNEGVAGFRLDVINNLTLVLEFTDNPVTSGEMEHVYDRNQSGLEQALEDIASFCRKERDVFLVGEISSDQLAEIARYSSKKMLDVTFNFNFGSVDQLDAKSVFTTLNEMETALNEGQWPTLFFGSHDMSRFRSRLASGGLVKTQLLAFLMLTAKGVPFIYYGEEVGMPDLTFSSVKEMRDIQGTAAYYQALQTGTDEKQALEIAIEKTRDKARGPMIFPDGKPFTLGEPWIKMATLPEKEARTMWRFYQGLLAFRKENDFKEMEYTFLKLDGEVLSYQRGEFIFLLHFGEEEVTYPLQGNYQLVFGEAVMVGNGIRMGAHTGIALRVEE

SEQ ID NO: 13692 - DNA, 1761 bp, Bacillus thuringiensis serovar konkukian str. 97-27
  CDS (1)..(1761): transl_table=11
atgcttaaagaagccatttatcataggccaaaagataattacgcatacgcttatgatgaaaaaacgattcacatccgaatacgtacgaaaagagacgatgttcaaagcaccactcttatttatggtgatccttatgaatggaaagacgggaagtggatttcttcaagtacaccgatgaaaaaaactggttctactgcattgtttgattattggttcatttccatcgagccgaaatttaagcgcttacgttatggatttgaattaaaaaacgatacagacactcttatttatgcagagcgaggatttttttctaccactccaaatgatgacgttggtaactttttctgttttccatttattcatgcaaatgatgtattcaaagcaccttcttggattaaagatactgtttggtatcaaattttcccagaacggttcgctaatggagatcatacgctgaatccagaaaacacccttccttggggcagcgctgagccaactccaactaattttttcggtggagattttgctggtattattcaaaaccttgattaccttgttaagctcggaatttctggaatatatttcacacctattttcaaagcacattcaaaccataaatatgacacaattaactacatggaaatcgatccgcaatttggcacaaaagaaacattcaaagaactcgttcaggcatgtcatacacatggtataaaggtaatgctcgatgccgtattcaatcacagtggatactttttcgataaatttcaagacgtactacaaaatggtgagcagtcagcatataaagaatggttccatattcatgagttcccaattagaactgagccactcccgaattatgatactttcgcgtttacaccatatatgccaaagttaaacacagcgcacccggatgtaaaagaatacttacttgaagtagggcgttattgggtgagagaattcaatatagacggttggcgccttgatgtagcaaatgaagtcgaccataacttttggagagaatttcgaagtgagataaaagcattaaattctgaagtatatattttaggagaaatttggcacgatgcacttccatggctacaaggagatcaattcgatgctgtcatgagctatcctgttacaaacgccctactgtcttactttgctaacgattccattaaggcaaatgaatttatgaaacaaattacagaatctctacattcctactctatgaatgtaaatgaagcagcatttcatttattagatagccatgatacaccaagaattttgacaacatgtaacggagataaaaataagttaaaattactttatgtattccatctttctttcatcggctctccttgtatttattatggagacgaaattggtatggacggcggtatggatccagattgtcgcaaatgtatggtttgggatacggaagaacaagatcatacattatttacacatgtacaaacattaatttcattacgaaagcaatataaagcatttggaggacatggtactttccaattcattgaagcaaatgatgaatataattatatttcttatacgaaaacatatgaagatgaaacgatctttttcgttttaaatccgactaatagtgatattacagcttcactccctctccatgttactggaaagaaaatcattaatatttatacaaacgaagaattttcagcggaagcaagtgtattacaagttacacttcctccatatggattctccatattaaaatggtaa

SEQ ID NO: 13693 - protein, 586 aa, Bacillus thuringiensis serovar konkukian str. 97-27
MLKEAIYHRPKDNYAYAYDEKTIHIRIRTKRDDVQSTTLIYGDPYEWKDGKWISSSTPMKKTGSTALFDYWFISIEPKFKRLRYGFELKNDTDTLIYAERGFFSTTPNDDVGNFFCFPFIHANDVFKAPSWIKDTVWYQIFPERFANGDHTLNPENTLPWGSAEPTPTNFFGGDFAGIIQNLDYLVKLGISGIYFTPIFKAHSNHKYDTINYMEIDPQFGTKETFKELVQACHTHGIKVMLDAVFNHSGYFFDKFQDVLQNGEQSAYKEWFHIHEFPIRTEPLPNYDTFAFTPYMPKLNTAHPDVKEYLLEVGRYWVREFNIDGWRLDVANEVDHNFWREFRSEIKALNSEVYILGEIWHDALPWLQGDQFDAVMSYPVTNALLSYFANDSIKANEFMKQITESLHSYSMNVNEAAFHLLDSHDTPRILTTCNGDKNKLKLLYVFHLSFIGSPCIYYGDEIGMDGGMDPDCRKCMVWDTEEQDHTLFTHVQTLISLRKQYKAFGGHGTFQFIEANDEYNYISYTKTYEDETIFFVLNPTNSDITASLPLHVTGKKIINIYTNEEFSAEASVLQVTLPPYGFSILKW

SEQ ID NO: 13694 - DNA, 1710 bp, Leifsonia xyli subsp. xyli str. CTCB07
  CDS (1)..(1710): transl_table=11
gtgagtttcaccgcaccgatcacgcttcccgggctcaccctcgacccgcagtggtatcgccgatccgtcttctacgaggtgatggtccgctccttcgtcgacagcaacggcgacggctccggcgatctcgcgggtctgacctccaaactcgactacctgcagtggctcggcatcgacgcgctctggctcccgccgttcttccagtcccccctgcgcgacggcggctacgacgtgagcgacttccgcgcgatcctgcccgagttcggaaccatcgacgagttccgcgacctggtcaccaaggcgcacgagcgcaacatgcggatcatcatcgacctgccgatgaaccacacctccgaccagcacgagtggttccagcaatcgcggtccaacccggaagggcccttcggcgatttctatgtctggaacgagaccgacgacaagtacccggacatccgcatcatcttcgtggacaccgaggactccaactgggccttcgacgaggcgcgtcgccagtactactttcaccggttcttctcgcaccagccggacctcaacttcgagaaccccgccgtacacgacgcaatgttcgacatcgtccggttctggctcgacctcggcgtcgacggcttccggctcgacgctatcccctacctctacgagtcggacgagggcaacggcgagggcgagccgcccacgcacgagttcatcaagaggctccgcgaggtggtcgatcgggagtacccgggccggatgatggtcgccgaggccaaccagtggccgcgcgaagtcgctgccttcttcggcagcgaggaggagccggagtgtcacatggccttcgacttcccggtgatgccgcgtatcttctacgcgctccgctcgcaacaggcctccgagctcatccacgtgctctccgagaccacggacgtgcccgatgggtacgcctggggcgtgttcctgcgcaaccacgacgagctgacgctggaaatggtaagcgaggagtaccgccaggccatgtacggctggtatgcctacgacccgcgcatgcgcgccaacatcggcatccgccggcggctcgcgccgctcctggacaactcgcgcgccgaactcgaactcgcccacgccctcctcttctccctcgccggcagcccgtttctctactacggcgacgagatcgggatgggcgacaacatctggctgcccgatcgcgacagctcgcgcacgccgatgcagtggacccccgaccgcaacgccggtttctccagcgccgacccgggcaaactcttcctcccggtcgtccagtcgctcgtctatcactacaaccaggtgaatgtggaggcgcagctcgcgcagtcgcgctcgctgctgcactgggtgcgcaacgtcatccatgtgcggaaagcgcatcccgtgttcggtctgggcgacatgcgtgtgctgccgaccaaccacgagtcggtgctggccttcgtgcggacgtacgagggcagcggcagccacttcggcgaccagccggaggatgtgctgtgcgtgttctcgttcgcgcacaatccggtctccgtcaccctcgaagcgccggagttcgccggtcggacactgtacgatctgttcggcggcgcagagttcccgaccgtcgccgaggacggccgcttcaccctgaccctcggcacccagagcttctactggctgcacatcgaaccgcgccgcgattaa

SEQ ID NO: 13695 - protein, 569 aa, Leifsonia xyli subsp. xyli str. CTCB07
MSFTAPITLPGLTLDPQWYRRSVFYEVMVRSFVDSNGDGSGDLAGLTSKLDYLQWLGIDALWLPPFFQSPLRDGGYDVSDFRAILPEFGTIDEFRDLVTKAHERNMRIIIDLPMNHTSDQHEWFQQSRSNPEGPFGDFYVWNETDDKYPDIRIIFVDTEDSNWAFDEARRQYYFHRFFSHQPDLNFENPAVHDAMFDIVRFWLDLGVDGFRLDAIPYLYESDEGNGEGEPPTHEFIKRLREVVDREYPGRMMVAEANQWPREVAAFFGSEEEPECHMAFDFPVMPRIFYALRSQQASELIHVLSETTDVPDGYAWGVFLRNHDELTLEMVSEEYRQAMYGWYAYDPRMRANIGIRRRLAPLLDNSRAELELAHALLFSLAGSPFLYYGDEIGMGDNIWLPDRDSSRTPMQWTPDRNAGFSSADPGKLFLPVVQSLVYHYNQVNVEAQLAQSRSLLHWVRNVIHVRKAHPVFGLGDMRVLPTNHESVLAFVRTYEGSGSHFGDQPEDVLCVFSFAHNPVSVTLEAPEFAGRTLYDLFGGAEFPTVAEDGRFTLTLGTQSFYWLHIEPRRD

SEQ ID NO: 13696 - DNA, 1683 bp, Bacillus licheniformis ATCC 14580
  CDS (1)..(1683): transl_table=11
atggcaagggcatggtggaaagaggcagtcgtttatcaagtgtatccgcgcagttttatggattcgaacggggatggcgtcggagatatcaacgggatcagagagaagcttccgtatatcagggagctcggggcagatgccatttggatttgtccggtctttgattctcccaatgcagataacggctacgacatcagggattatcaaagcatcatgccggaatttggcacgatggacgactttgacgaactattaactgaagcgcatcagctcggaatgaaactgatcatcgatcttgtcatcaatcatacgagcgatgaacatccttggtttatcgaatcaagagcagagcggaattccgggaaacgggactggtatatttggcatgacggaaaggacggaagcgaaccgaacaactgggaaagcatattcggcggctcagcctggacttatgacgaaaaaacagagcaatattatctgcacctttttcacgaaaagcagcctgatctgaattgggaaaacagtgatatgcgaagcgctctttatgacatgatcaactggtggcttcaaaaaggaatcgacggattcagggttgacgcgatttcgcacattaagaaaaaagaagggctgccggatctgccgaatccggaagggcgccctttcgtgccttcatttgcttatcatatgaatgtcgaagggattatggcgttattgcaggatgtaaaagagaatacgttcgccgggtatccacatatcatgacagtcggcgaagcaaacggtgtcagcgctgaagaagcggaggactgggttggagaaccaaacggtatattcagcatgatttttcaatttgaacacctcgggctttgggatattgaaggcggagaacccgatatccccgaactcaagcggattttgtcaaactggcaatctgctcttgaaggaaaaggctggaacgcgctttttatcgaaaatcatgatcagccccgggccgtttcagtttggggagatgacgggaaatacagaacagtcagcgcgaaggccttagctgcaatgtattttttgatgaaaggcaccccgtttatttatcaagggcaggaaatcggaatgacaaacgcgattttcttagatatagacgattatgatgacgtctcgattaaaaattattaccggattcaaaaagaaaagggccgctcacacgaagacatcatgaaggcggtatggaaaaagagcagggatcacgcgcgcacgcctatgcaatggactgatcggccaaatgccggctttaccaaaggggaaccgtggctgcgcatgaacgaaaattacaagctgatcaatgtcgttcatcagcagcatgacccccggtcggtctatcatttttataaacggttaatcgcaatcagaaaacggtatgacgtcttcatcgacggatcatataaactgcttctggctgaggatcggcagatttttgcatacttgcgaaagcttgaagaagaaaccgccatcgtgatcgtgaacctcagcgcacgccaggcgttttaccatcatcccgcatatccgttatgttcgaacggactgctgctgtcaaacttggatatcaacgcgcacaagcacctcacatctttcatgatgagaccctatgaggcgcgcgtttatttgatcagacaggaaatcggcgatttgtaa

SEQ ID NO: 13697 - protein, 560 aa, Bacillus licheniformis ATCC 14580
MARAWWKEAVVYQVYPRSFMDSNGDGVGDINGIREKLPYIRELGADAIWICPVFDSPNADNGYDIRDYQSIMPEFGTMDDFDELLTEAHQLGMKLIIDLVINHTSDEHPWFIESRAERNSGKRDWYIWHDGKDGSEPNNWESIFGGSAWTYDEKTEQYYLHLFHEKQPDLNWENSDMRSALYDMINWWLQKGIDGFRVDAISHIKKKEGLPDLPNPEGRPFVPSFAYHMNVEGIMALLQDVKENTFAGYPHIMTVGEANGVSAEEAEDWVGEPNGIFSMIFQFEHLGLWDIEGGEPDIPELKRILSNWQSALEGKGWNALFIENHDQPRAVSVWGDDGKYRTVSAKALAAMYFLMKGTPFIYQGQEIGMTNAIFLDIDDYDDVSIKNYYRIQKEKGRSHEDIMKAVWKKSRDHARTPMQWTDRPNAGFTKGEPWLRMNENYKLINVVHQQHDPRSVYHFYKRLIAIRKRYDVFIDGSYKLLLAEDRQIFAYLRKLEEETAIVIVNLSARQAFYHHPAYPLCSNGLLLSNLDINAHKHLTSFMMRPYEARVYLIRQEIGDL

SEQ ID NO: 13698 - DNA, 1764 bp, Bacillus licheniformis ATCC 14580
  CDS (1)..(1764): transl_table=11
atgatggaatatgcagcgatacatcatcagcctttcagctctgatgcctattcttacaatggacggacattgcacatcaagatccgtacaaaaaaggatgatgccgaacacgtccgcttggtttggggcgatccttacgaatacaccggcggcacatggaaagcgaacgagcttgcgatggcgaaaattgccgcaacaagcacccatgattactggtttgccgaagtggcgcctccattcaggcgtctgcaatacggatttatcctgacaggcgctgatgatcgagacactttttacggaagcaatggtgcatgtccgtttgccgggaaagcggcggatataggcaaacactgttttaaatttccgtttgttcatgaggcagacacgtttgatgcacctgactgggtcaaatcaaccgtctggtatcaaatttttccggagcgctttgccagcgggcgggaagatttgtctccggaaaacgctttgccatggggaagcaaagatcctgaggcgcacgattttttcggaggggatttgcaggggatcatggacaagctggactatttggaagacttgggggtaggcggaatctatttgacgccgatctttgccgcgccttccaaccataaatacgacacattggactattgctccatcgatccgcattttggcgatgaggagctctttcgcacgctggtcagccggattcacgagcggggaatgaaaatcatgcttgatgctgtttttaaccacattggcagcgcttcgcaagagtggcaggatgttgtcaaaaacggtgaaacgtcccgctataaagactggttccatattcattctttccctgttaaagaaggcagctatgatacatttgcgtttactcccgagatgccgaagctcaatacggccaacccggaagttcaggcttatttgcttgatattgcgctgtactggatccgcgaatttgatatcgacggctggcgtttggatgtggcaaatgaagttgatcatgcgttttggaagaaattccggcaagccgtcacggcagaaaagcccgacatttttatattgggcgaaatctggcatcaggctgatccgtggcttagaggagacgaatttcattcggtcatgaactacccgttcacagaaccgatgattgactattttgcagacggatcgatttcagcttcgcaaatggccagccgcatcaattcgcatttaatgagcgggatgaagcaggtcaatgaggtgatgtttaatttgctggacagtcatgacacgaagcggattttgacaagatgcggaggagatgacaaaaaggtgcgctctcttttggcattcatgtttgctcagacaggctcgccgtgcatttattacggaacggaagtcgggcttgacggcggcgatgatccattgtgccggaagtgcatggtttgggaagaggaaaaacagaatcaagagatgctcgcatttatgaaacggctgatcgctttgcgaaaacaagagaatgatgtattgacttatggcgcgcttgagtggaagctggttgatgaccaaaacgattttgtcagtttttctcgaacgcatgaaggaaaagagctgatctacttcttccaccagggcagcgaggtgcgccgtgtcagattgcgggatttgaagattgcaagcgataaaagaatatacgatgcgtggacggaagaagcgcttcagcatgatgatgtggtcgacattcagccaggcggatttttcattttgggggcggtctaa

SEQ ID NO: 13699 - protein, 587 aa, Bacillus licheniformis ATCC 14580
MMEYAAIHHQPFSSDAYSYNGRTLHIKIRTKKDDAEHVRLVWGDPYEYTGGTWKANELAMAKIAATSTHDYWFAEVAPPFRRLQYGFILTGADDRDTFYGSNGACPFAGKAADIGKHCFKFPFVHEADTFDAPDWVKSTVWYQIFPERFASGREDLSPENALPWGSKDPEAHDFFGGDLQGIMDKLDYLEDLGVGGIYLTPIFAAPSNHKYDTLDYCSIDPHFGDEELFRTLVSRIHERGMKIMLDAVFNHIGSASQEWQDVVKNGETSRYKDWFHIHSFPVKEGSYDTFAFTPEMPKLNTANPEVQAYLLDIALYWIREFDIDGWRLDVANEVDHAFWKKFRQAVTAEKPDIFILGEIWHQADPWLRGDEFHSVMNYPFTEPMIDYFADGSISASQMASRINSHLMSGMKQVNEVMFNLLDSHDTKRILTRCGGDDKKVRSLLAFMFAQTGSPCIYYGTEVGLDGGDDPLCRKCMVWEEEKQNQEMLAFMKRLIALRKQENDVLTYGALEWKLVDDQNDFVSFSRTHEGKELIYFFHQGSEVRRVRLRDLKIASDKRIYDAWTEEALQHDDVVDIQPGGFFILGAV

SEQ ID NO: 13700 - DNA, 1620 bp, Methylococcus capsulatus str. Bath
  CDS (1)..(1620): transl_table=11
atgacggacgggaacggcacgctggcctggtggcagaccggcatcatctaccagatctatcccctttccttccaggacagcgacggcgacggcaggggtgatcttcccggcatcctccaccggctcgactacctggccgacctgaacatcgccgccgtctggctgtcgcccgtcttcgcctcgccgatgcgggacttcggctatgacgtggctgactacacgtccatccatccctggttcggaaccctgagcgatttcgaccggctgctggccggcttgcacggccgtggcatcaagctgatcctggacctggtgccgaaccacacctccgaccggcacccctggttcctggaaagccgaagttcgcgcgacaaccctagacgcgactggtacctctggcgcgatccggcaccgggcggcgggccacccaacaactggctgagctttttcggtggcccggcctggacctacgacgagaccaccggacaatactatctgcaccagttcacgccggagcagccggagctgaacctgcgccacccggccgtgctggaggcgatgctggaggtgatgcggttctggctggatcgaggcgtggacggcttccgggtcgacgtgccctggctgctgatcaaagacgccgggttccgagacgaaccggaaaatccggcctgggacggcatcgatccgcacggccggctgctccacatccatacggcgcatcagcccgaactgcaccgcatcatccgggccatgcgcgcggtcgtcgacggctatcccggcgagcgggtcttgatcggggagacaaacgtgccggaggaagaactcgtcaagtactatggcgcggcacgggacgaattccacctacccttcaacttccggctgatccatgccccctgggacgcgcggaaaatccggcagatggtcgaaacttacgaagcgatcctcccccaaagggcctcgcccgcctgggtgctcggcaaccatgaccagccccgcatcgccagccgcttcggtcccgacgcggcccgtgtcgccaccatgctgctgctgaccctgcgtggcacaccgacctgctattacggcgacgagttggggatggagaacggggtgatcccaagggaccgcatccgtgatccgcaggcattgaatcagcccgggatttcgggcgtgttcaatcgcgatgaggcacggaccccgctgccttgggacacctcgcccaatgccggcttcgcgcccgaaggcgtcgacccctggctgccgttgggggaggactggcccatgagaaacgttgcccggcaggcggcggacccccgctccatgctggcgctcttcagggctctgaccagactgcgccaatgccacccggccttgagccatggcagttacgaaagcgtggacacgaaggccgacggcgtcttcgcctacaagcggacggccggcgccgaacgcctcctcatcgtgctcgatttcgccggcagtgaacatctcctggactcgggcgaactcgccgatggcgcggagattctgctgagcaccggcatgcggcgcaccggccgggtcgatctgcggcggctccgtttgctctccaatgaaggtctcatactgaaaatatcttga

SEQ ID NO: 13701 - protein, 539 aa, Methylococcus capsulatus str. Bath
MTDGNGTLAWWQTGIIYQIYPLSFQDSDGDGRGDLPGILHRLDYLADLNIAAVWLSPVFASPMRDFGYDVADYTSIHPWFGTLSDFDRLLAGLHGRGIKLILDLVPNHTSDRHPWFLESRSSRDNPRRDWYLWRDPAPGGGPPNNWLSFFGGPAWTYDETTGQYYLHQFTPEQPELNLRHPAVLEAMLEVMRFWLDRGVDGFRVDVPWLLIKDAGFRDEPENPAWDGIDPHGRLLHIHTAHQPELHRIIRAMRAVVDGYPGERVLIGETNVPEEELVKYYGAARDEFHLPFNFRLIHAPWDARKIRQMVETYEAILPQRASPAWVLGNHDQPRIASRFGPDAARVATMLLLTLRGTPTCYYGDELGMENGVIPRDRIRDPQALNQPGISGVFNRDEARTPLPWDTSPNAGFAPEGVDPWLPLGEDWPMRNVARQAADPRSMLALFRALTRLRQCHPALSHGSYESVDTKADGVFAYKRTAGAERLLIVLDFAGSEHLLDSGELADGAEILLSTGMRRTGRVDLRRLRLLSNEGLILKIS

SEQ ID NO: 13702 - DNA, 1866 bp, Photobacterium profundum SS9
  CDS (1)..(1866): transl_table=11
atgaaaacgccatttctttaccatggacaggatagcgcctggcttactcctacagacaacacgcttaacgtaacaatggtcagtgatgttgatacactgatatcagctatctttattcgatgtgaacccgataatgaagaactattaattgatatggaacgcggtagaacccaaggtcgcctgcaatactggcacgggaaattaccgttcaattcagataaagacaccactttttatacctttaaagtgatgcaaaacagtcgtcaatggtggctacacggttgtggcgtgtcaccgcgagtaccgggtaaagaaaagcacttcaaattcaataaccagcatcaaccgccagcttgggttaaagaacagattttctatcaagttttcccagaccgtttttcaaatgcaaacccatcaatcagtgttcaatctaatgaatactgtttacgtggcacagaaaaaccgacaatagcaaaagcatggggtgaatcagcatcaaaccatgattcgagtggaccaagcgaattcttcggaggcgacttacaaggtattcacaataagattgattacttacaagaattaggtgtaaccgcactctatttgaatccgatatttaccgcgcccagtaatcataaatacgatacaacggattacctcaatatcgatcctcatttaggcacgaatgagcaatttgccaacatggtggcagatctgcatcaacgtaatatgaagattatgctagatgccgtgtataaccatacctcagtcgaccacccttggttcgatatgtatcaacgtaataccgcagaccaagctgtgggcgcatacgatcatcctaactctacttaccgtcagtattatcaatttaccgataacagtaacgaatacgttggctggaatggtatatcaacgctacctaaactgaatttttctaatcctgaagtacaggattatatctatgcgggtgacgacgcggtaatcaaacactggctaaaaccaccctataatatagatgcatggcgtttcgatgttatccatatgctaggtgaaggcaaaggcgcacgtaataatgctcattttgttaaatccttccgcaatgcagccaagtcggtcaatcctgagtgctatgtgttaggcgaacatttctttgaagcgtctaactggcttcaaggtgatcaagaagacggtgctatgaactattacggttttgctcaccctcttcgtgcttttttttctcaaaaagacattgcctatcacgcatgccaaatcaatgctgtagaattagtagaatggctaaacgaagcgcgtacaaaattaccgtggttgaatcagctctctcagcttaaccagctagatagccacgatacaatgcgttttttaaccatggtggataacaacacagaaacgatgcacctagcattaatgatgctttttgcttatgtaggcacaccgtgtgtttactacggtacagaagttgaattacaaggcggtcaagatccagataaccgtcgttgtttcccgtgggaaagaacagagcaagaacaaaaaccacaaacattcagttatttgcagcaactcattgctgtcagaaaatcatcaaccgcccttcaatccggcagtgttcagtggttattggctgagaaccaatattttgcttttgctagaacgacagaaacagagcatgttatttgccttattaataacagtgaatcagctaaaacacttcatttaccggtttggcaattaggcattgagtcgggttctttacgcgacctgttaactgatgatgaatggcatattagcgaaggaagtgtatctgtcacattggcaggcaaagaaggaatattactgactgtcagcgaataa

SEQ ID NO: 13703 - protein, 621 aa, Photobacterium profundum SS9
MKTPFLYHGQDSAWLTPTDNTLNVTMVSDVDTLISAIFIRCEPDNEELLIDMERGRTQGRLQYWHGKLPFNSDKDTTFYTFKVMQNSRQWWLHGCGVSPRVPGKEKHFKFNNQHQPPAWVKEQIFYQVFPDRFSNANPSISVQSNEYCLRGTEKPTIAKAWGESASNHDSSGPSEFFGGDLQGIHNKIDYLQELGVTALYLNPIFTAPSNHKYDTTDYLNIDPHLGTNEQFANMVADLHQRNMKIMLDAVYNHTSVDHPWFDMYQRNTADQAVGAYDHPNSTYRQYYQFTDNSNEYVGWNGISTLPKLNFSNPEVQDYIYAGDDAVIKHWLKPPYNIDAWRFDVIHMLGEGKGARNNAHFVKSFRNAAKSVNPECYVLGEHFFEASNWLQGDQEDGAMNYYGFAHPLRAFFSQKDIAYHACQINAVELVEWLNEARTKLPWLNQLSQLNQLDSHDTMRFLTMVDNNTETMHLALMMLFAYVGTPCVYYGTEVELQGGQDPDNRRCFPWERTEQEQKPQTFSYLQQLIAVRKSSTALQSGSVQWLLAENQYFAFARTTETEHVICLINNSESAKTLHLPVWQLGIESGSLRDLLTDDEWHISEGSVSVTLAGKEGILLTVSE

SEQ ID NO: 13704 - DNA, 1656 bp, Thermus thermophilus HB8
  CDS (1)..(1656): transl_table=11
gtggagcttttcctggaaaccgaggcgcgggaaggggttctcctttacgagcgggacggggagttgcagaaaaagcccatggcgccttgggagcggggcctaaaggcgcgggtgcccgtccacgcgagccccttccgctactgcttccgcctcccccaaggctacctgggcagccacggcctggagaggaccctgccccgctacgaccgcttcttccacctcctcgccaagccccttcccccggagtgggccctgggggcggtcttctaccagatctttcccgaccgcttccgccaagggcgcccggagcttgcccccaaggagggggcctggctttacggggggaggcccatccgcaagaaggcctggcacgagccccccggggaggacggggcccgggagttctacgggggggacctctttggggtcctcgaggccctcccctacctggaggccctgggggtggaggccctctacctcacccccatcttccaaagcccctccagccaccgctacgacaccgaggactaccaccgggtggaccctcatctaggcggggaggaggcgcttagggcgctttacgaggccctcgaggcccgggggatgaagctcatcctggacggggtcttcaaccacgtgggggcgacccacccctggttccagaaggcccttgaggacccctcctcccccgagcgggggatgttcaccttttatccggacgggagctacgccagcttctggggcgtgaagcacatgcccaagctggactacgcttccgccctcacccaggagcgcttcgtcttcggaaaggaggcccccgtccgctactggatgcgcctcgcccatggctggcggctggacgtggcccactccatcggggaaggggggacgaaccggaagaacgcccgctggctcagggccctggcccgggccgccaaggaggagcgggaggacgccctcgtcttcggggagctctcctacgacaccgtccccacgctgagggcccacaccctggacggggccatgcactacgccggcttcgcccacccggtgatggagtggctctcggggcgggacctccacggaaaccccgtggagctggaggccgaggacctttggcgggccctctttgaccactacgccgcccttcccctccagctccgccacgcgatgtacaccctcctctcctcccacgacatcccccgggccctctggcgcctcaggggggacaaggagcgcttcaagaccgcctacgccctcctctttgccttccccggaagccccgccgtctactacggggacgaggtgggcctctcccagcccaacccctacgaggtctggcggggagacccctactgccgcgcccccttcccctgggacgaggccctttgggacaaggacctcctcgccttcctccggcgcctcatcctcctcaagaagacccaccccgccttgaggctcggggggctcctccccctcaaggcccctccgggggtcctggccttcaggcggcgccaccgggggagggaggtctgggcctttttcgccaaggaagaggtgcgcctttcccttccccggggggtggacctcctttcgggaagggaggtggcgggggaggtggaggcgcggtacctcctcctggagcctttagaatga

SEQ ID NO: 13705 - protein, 551 aa, Thermus thermophilus HB8
MELFLETEAREGVLLYERDGELQKKPMAPWERGLKARVPVHASPFRYCFRLPQGYLGSHGLERTLPRYDRFFHLLAKPLPPEWALGAVFYQIFPDRFRQGRPELAPKEGAWLYGGRPIRKKAWHEPPGEDGAREFYGGDLFGVLEALPYLEALGVEALYLTPIFQSPSSHRYDTEDYHRVDPHLGGEEALRALYEALEARGMKLILDGVFNHVGATHPWFQKALEDPSSPERGMFTFYPDGSYASFWGVKHMPKLDYASALTQERFVFGKEAPVRYWMRLAHGWRLDVAHSIGEGGTNRKNARWLRALARAAKEEREDALVFGELSYDTVPTLRAHTLDGAMHYAGFAHPVMEWLSGRDLHGNPVELEAEDLWRALFDHYAALPLQLRHAMYTLLSSHDIPRALWRLRGDKERFKTAYALLFAFPGSPAVYYGDEVGLSQPNPYEVWRGDPYCRAPFPWDEALWDKDLLAFLRRLILLKKTHPALRLGGLLPLKAPPGVLAFRRRHRGREVWAFFAKEEVRLSLPRGVDLLSGREVAGEVEARYLLLEPLE

SEQ ID NO: 13706 - DNA, 1767 bp, Geobacillus kaustophilus HTA426
  CDS (1)..(1767): transl_table=11
atgaggaaagaagccatccaccaccgctcaaccgaccatttcgcttatgcttatgacagcgagacgctccatctccggcttcaaacaaagaaacatgatgtcgaccacgtcgagctgctttttggcgacccgtacgaatggcacgatggcgcctggcagtttcaaacgatgccgatgcggaaaacgggaagcgacgggttgtttgactattggctcgccgaagtcaaaccgccatatcgacggctgcgctatgggtttgtgcttcgagctgggggcgagaaactggtctatacggaaaaaggattttaccatgaagctccgagcgacgacaccgcttactacttttgcttcccctttcttcatcgggtcgacctattccaagcgccgggctgggtaaaagacacagtatggtatcaaattttccccgagcggttcgccaacggcaacccggccatcagtccgaaaggggcgcggccgtggggaagcgaggacccgacgccgacgagctttttcggcggcgacttgcaaggaatcatcgatcaccttgactatttggctgatctcggtattaccggcatttacttgacgccgattttccgcgcaccgtccaatcataaatacgacaccgctgattattttgaaatcgacccgcactttggggacaaagagacattgaaaacacttgtcaaacgctgccatgaaaaaggaatccgcgtcatgctcgatgcggtcttcaatcattgcggctatgagtttggcccgtttcaagatgtgttaaaaaacggcgcagcgtctaggtataaagattggttccatattcgcgagtttccgctccaaacggagccgcgcccgaattacgacacgtttgcgttcgtgccgcaaatgcccaagctcaacaccgcccatccggaagtgaagcgctacttgcttgatgtcgcgacgtactggattcgcgagtttgatattgacggctggcggctcgatgtggcaaacgaaatcgatcaccaattttggcgcgaattccgtcaggcggtgaaggcgctaaagcccgatgtgtacattctcggcgagatttggcatgatgccatgccttggctgcgcggcgaccagtttgacgccgtcatgaactacccgttggcggacgcggcgctccgctttttcgcgaaagaggaaatcagcgcccgccagtttgccgatatcatgatccgacttcttcattcgtatccgaaacaggtgaacgaagcggcattcaacttgcttggcagccatgatacaccaaggctgctcactgtttgcggcggcgacgtccgcaaagtgaagttgttgtttttgttccagctcacgttcactggttcgccgtgtatttactatggcgatgagatcggcatgacgggtggaaacgatccggaatgccggaaatgtatggtgtgggatccggagcaccaaaaccgcgaactgttggcgcatgtcaagcggctgattgcgctaaggaagcagcaccgggcgctccggcgcggagatgtctcctttctttccgccgacgacaaccctaaccatctcgtgtatgaaaaaattgacggcgctgaaaccgtgctcgtcatcatcaaccgaagcaatgatgccgccgacattccgctcccgctcgaccttcgcggaaaatggcttgttgacctcttgaccggagagcggtttgcggccgaggcggaaacgctttgcgcctctttgcctccgtatgggtttgtgctctataaagttgaaagctggtaa

SEQ ID NO: 13707 - protein, 588 aa, Geobacillus kaustophilus HTA426
MRKEAIHHRSTDHFAYAYDSETLHLRLQTKKHDVDHVELLFGDPYEWHDGAWQFQTMPMRKTGSDGLFDYWLAEVKPPYRRLRYGFVLRAGGEKLVYTEKGFYHEAPSDDTAYYFCFPFLHRVDLFQAPGWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFGPFQDVLKNGAASRYKDWFHIREFPLQTEPRPNYDTFAFVPQMPKLNTAHPEVKRYLLDVATYWIREFDIDGWRLDVANEIDHQFWREFRQAVKALKPDVYILGEIWHDAMPWLRGDQFDAVMNYPLADAALRFFAKEEISARQFADIMIRLLHSYPKQVNEAAFNLLGSHDTPRLLTVCGGDVRKVKLLFLFQLTFTGSPCIYYGDEIGMTGGNDPECRKCMVWDPEHQNRELLAHVKRLIALRKQHRALRRGDVSFLSADDNPNHLVYEKIDGAETVLVIINRSNDAADIPLPLDLRGKWLVDLLTGERFAAEAETLCASLPPYGFVLYKVESW

SEQ ID NO: 13708 - DNA, 1542 bp, Geobacillus kaustophilus HTA426
  CDS (1)..(1542): transl_table=11
atggaaatggggaaccggctctttatgctgctcgtccttccgttccttcttttttatgcctggccggtgcaggcggcggaaaaagaagaacggacgtggcaagatgaagccatttatttcattatggtcgaccggtttaacaatatggatccgacaaacgaccagaacgtgaatgtgaacgatccgaaagggtatttcggcggcgacttgaaaggggtgacggcgaaactcgattacatcaaggagatgggatttaccgccatttggctgacgccgatttttaaaaacatgccgggcggttatcatggctattggattgaagatttttatcaagtcgatccgcactttggcacgctgggcgatttgaaaacactcgtcaaagaagcgcataagcgcgacatgaaagtcattttggattttgtcgccaaccatgtcggttacaatcacccatggttacatgacccaacgaaaaaagattggtttcacccgaaaaaagagattttcgactggaacgaccaaacacagcttgaaaacggctgggtgtatgggttgcctgatttggcgcaggaaaatccagaggtcaaaacgtatttaattgacgctgccaaatggtggatcaaagaaacggacattgacggctatcgcctcgatacggtgcgccatgtgccaaaatcattttggcaggagttcgccaaagaagtgaaatcggtgaaacaagactttttccttcttggcgaagtgtggagcgacgatccgcgctatattgccgagtacggccaatacggcatcgacggttttgtcgattatccgctgtatggcgcggtgaagcagtcgcttgctaggcgcgatgcgtcactgcgcccgctgtatgacgtctgggaatacaacaaaacgttttacgaccgcccgtacttgctcgggacgtttttggacaatcacgataccgtgcggtttacgaaactttcgattgacaaccgcaacaatccgatttcacgcatcaagctggcgatgacgtatttgttcaccgcccccggcatcccgatcatgtattacggaacggaaatcgccatgaacggcggcgaagacccggacaaccgccgcttgatggatttccgcgccgatccggagatcatcgattacttgaaaaaaatcggcccgctccgccaacagctgccgtctttgcggcgcggcgattttacgctcctgtatgaaaaagacggcatggcggtgtggaaacggcaatatgaagatgaaacaacggttatcgccatcaacaacacgggcgaaacgcagcacgttcacctaacgaacgaccagctgccaaaaaacaaggaactgcgcggctttttattggacgatctcgtccgcggcgatggcgacggatacgatcttgtgctcgaccgcgaaacggcggaagtgtacaaactgcgggaaaaaacagggatcaacgttccgtttatcgccgccatcgtatcggtttacgtgttgtttcttttgtttttgtatttggtgaaaaaacgggcgaagcggatgccggaatag

SEQ ID NO: 13709 - protein, 513 aa, Geobacillus kaustophilus HTA426
MEMGNRLFMLLVLPFLLFYAWPVQAAEKEERTWQDEAIYFIMVDRFNNMDPTNDQNVNVNDPKGYFGGDLKGVTAKLDYIKEMGFTAIWLTPIFKNMPGGYHGYWIEDFYQVDPHFGTLGDLKTLVKEAHKRDMKVILDFVANHVGYNHPWLHDPTKKDWFHPKKEIFDWNDQTQLENGWVYGLPDLAQENPEVKTYLIDAAKWWIKETDIDGYRLDTVRHVPKSFWQEFAKEVKSVKQDFFLLGEVWSDDPRYIAEYGQYGIDGFVDYPLYGAVKQSLARRDASLRPLYDVWEYNKTFYDRPYLLGTFLDNHDTVRFTKLSIDNRNNPISRIKLAMTYLFTAPGIPIMYYGTEIAMNGGEDPDNRRLMDFRADPEIIDYLKKIGPLRQQLPSLRRGDFTLLYEKDGMAVWKRQYEDETTVIAINNTGETQHVHLTNDQLPKNKELRGFLLDDLVRGDGDGYDLVLDRETAEVYKLREKTGINVPFIAAIVSVYVLFLLFLYLVKKRAKRMPE

SEQ ID NO: 13710 - DNA, 4983 bp, Geobacillus kaustophilus HTA426
  CDS (1)..(4983): transl_table=11
ttggccaaacaaaggagaagggagcgggggatgatcaagagggcaaggagaatgctatcattggttttggcatcggtgttgttgctggcattgactcctttccaggcggttgccgctgcgaacgaggcaggaagttctagcgctctagggaatggagcgcatcggtggacggccgaatccacggcctcgcaaccacggacgatcacgctcgtcggcacgctacaagatgaattgggccatacggcggaatgggatccgggggcattggcgacgaggatgcatgatgaagggaatgggctttatacattcaccgggacgctgccggctgggacgtatgagtacaaaattgcggtcaatggcagctgggatgaaaactacggagccggcggccgcaatggcgacaatctggtgttgaagctggatcggcaaaccgaggtgacgttttattaccatgaccggacgcatgcgatcgcggattcgacatggtatacggcgattgcgaaggagaaacagccgcgcctcgtcgggacggtgctgccggccatcggctatgagggggagaacgatggatggaccccggggacatcgacggcgctgttgaccgatgacgatttcgactcggtgtacacgtttacggcgcaggtgccgaaagggtcgtatgaatataaaatcgtcctcggaaacaattggaacgagagctacccacaagagaatgcacgcttaaccgttttggaaacgacgaccattacattcttcttcaatgcgaaaacaaaagaggtgtacaccgactacaaccccaatggctctgacggtgttgttcagaaagaccgattaaaacacaatacatgggatacgctgtaccgccagccgtttggtgcggtgaaagcgggaacgaaggtgacgcttcgtctggcggcgaaaaaaggcgatttgacgaaggcggatgtgtatgtgaaaaatgcgacgaccggaaccgccaaagtctacacgatggaaaaagtcagcgtgctcggggatgatgaatattgggaggtggcgttcaccccttcgacgcccggggtgtacgggtataaatttatagcgcaagatgccggaacgaaagtggaatacggcgaagatacgcaagaagggcaatgggggaaagcggtggacagccgcgcggagctgtttcaactgacggtgtatgatccggattacaggacgcccgactggatgaaagaagcggttgtgtatcaaattttcccggatcggttctttaatggcaacccttcaaatgataacagcaagcagcaggcacgcggggcgcagccgattgagcatcgcgattggtcggatttgcccgataatccgcgcctgaaagggacgagcggctacgatggcgacggcgaatggtcgaatgactttttcggcggagatgtggccgggattgaacagaagttggattacttgcagtcgcttggggtgaacacgatttacttaaacccgatcgccaatgcaccgtcaaaccataaatacgatgcaagcaattacaaagaattggatccgatgtttgggtctccggaagagtttcaatcatttgttcaggaactggcgaaacgggggatgcatctcatcttagacggcgtgttcaaccacgtatccgatgattcgatttactttgaccgctatcaccgttatccgacggtcggcgcctatgaatattgggaagcggtttacgatttgatgaacgaaaaaggattgagcgaggaggaagcgcggaaacaggcggaagagaagttcaaacaacaagagcaaacgttcagcccgtatgggtttcatctttggttcaatattgaaaacgaaaaagtcgatggtcgttataagtatcagtcatggtggggctatgacagtctgccggagtttaagtcggtgacgggggaaaaagtgccgaatccgagtgaattgaacaacgatgcgctcgcaaattacattttccgtgaatcggattcggtggcgaaaagctggattgcccgcggcgcctctgggtggcggttggatgtagcgaatgaggtggatccggcgttttggcgcgagtttcgccaagagttgcttcaaggatcgtacgaccgcggcccgacgttaaaagaaggggagcagccgctcattttaggggaaatttgggatgacgcatcgaaatattttctaggcgaccagtacgattccgtgatgaactaccggttccgcggggcggtgcttgactttttgcgaaatgggaatgcagaagaggccgatcagcgactgacggccataagggaagactacccgagcgaagcgttttatgcgctgatgaatttgatcggttcgcatgacacggcgcgggcggtctttctgcttgggaacggaacggattcattcgagcgggcggagtttgatccgaattataatgaagaacttggaaaaaagcggctcaagctagcggcgattttgcagatgggatatccgggggcgccgacgatttattacggtgatgaagcaggggtaagcggctccaaagatccggacaaccgtcgtacgtatccgtggggtaaagaagatcaaaatctgttggcgcactatcggaaagtcggtcaaattcgccagcaccatcaaacgctgttggcccatggcgacatcaagacgttgtatgcgcaaggggatgtatacgtctttgcccgccaatacggtcgtgacgtggcgatcattgccgtcaaccgtggcaatgaggacagaacggtggcgcttgacgtcgcttcgtggctgcccaacggcaccgtgctgacggatgagttgcatgatggcgggaaagctacggtcgctgacggaacgttgacggtcacgattccggccttggacggacggatgatgtttgggacggtgacggcagaaatgcctgccgcggtcagaaatttgcaggcaagcgccgtggttggtggcgtgacgcttacttgggaagggcaagcgtcgaagtatcgggtgtaccaatcaaccattcaaggggctggttatacgttagcggcggaaacgaacgggacttccgtgacgatcgattcgttggcgaacgggaccgcgtattactttgccgttaccgccgtcgatgagaacgggaatgagtcgccaaaggtggaaacgaatcgcgtcgttcctcattatccgctgacgagcgacaatgtccagttcgtgaccacgttaagcgatgccacactcgacttgtcccagccgcaaccaatcgatgtcaaagtgaacatcgacggtgtgacaagcaaaggagcagccgatggattgcaagcggtgttgcaagtgaaagggccgcatgacgaagcatggaaagaatatagagcggtttaccaagggcaagatggcgacgctaatgtgttccgtgccgccttcaccccgcttgtggcagggacgtatacgtatcgctatgcgctgacgaccaaccttggcgaggattgggtgtatacggaagccaaacaagtgacgtttgcggccgactccagcgaccaaaaagcgccggccgaggcgattgcgctgacgccgccgcctgttgagtcagggcaagttcatttgtcatggcagtttgtaggaaaaaatgatgcggatgcatacttgctagtcatcgaacgcaatggaacagtcattcatatgacgacatccatcagcacatcgttcgttgattacggggtcgaaaacggcaccgagtatgcgtacgttgtcaagctgtatgaccgcgctggaaatgtcaccgcgtccaacacggtcaaagtgaagccggacattgtgatggtgaaagtcatttttaaagtcaaagccccagactatacgccgttagatgcccgaattacgattccgaacagtttgaacggctggaacacaggggcatgggaaatgtcgcgcaatggagcggtgacgcctgattggcaatttacaactgaagtgcaagaaggggaaacgatcacgtataagtatgtgaaaggcgggtcgtgggatcaggaagggctggctgatcatacgcctgcagacgttggggatgatgatgtcagttattatggatacggctcgatcggcacggatttgaaagtgaccgttcacaatgaaggaaacaatacgatggttgtggaagaccgcattttgcgctggattgatatgccggtggtcatcgaagaggtgaaaaaacaagggagtcaagtgacgatcaagggcaatgccattaaaaatggcgttttgacgatcaacggtgagcgggtgccgattgatgaccggatgtcattctcgtacacgtttgcgccggccagccatcaaaaagaagtgtcgattcatattgaaccatcggctgaaagcaaaacagccattttcaacaacgacggcggagcgattgcgaaaaacacgaaagattatgtgttgaatttagaaacgaagcaattgcgcgaagggaagttgacaacgccgccaagcaacggcgattctccgggaagcgaaacgccgtcccatgacggaggggcaacaccaggcaacggcacctctccgggcagcggtggtccatcggatggcgcatcccctggggggagcgttccgccgggcggcacagctccaccgggaaacgaagcgcctccatccagaccgccgcaaaaaccgtctccatcgaaaccaaaagagaaaccgagaaagccaaccactcctccaggccaagtgaaaaaagtgtactgggatggcgtggagttgaaaaaagggcaaatcggccgcttgacggtgcaaaagccgatcaatctatggaaacggacgaaggatgggcgccttgtgttcgtccgcatcttacagcctggggaagtataccgcgtctacgggtatgatgcgcgcttcggcgggcagtacgcagtcggcggcgggtattacgtgaccgacatcgacacgcacatccgctatgaaacgccgtcaaaggagaagttgaagttggtgaatggggagtaa

SEQ ID NO: 13711 - protein, 1660 aa, Geobacillus kaustophilus HTA426
MAKQRRRERGMIKRARRMLSLVLASVLLLALTPFQAVAAANEAGSSSALGNGAHRWTAESTASQPRTITLVGTLQDELGHTAEWDPGALATRMHDEGNGLYTFTGTLPAGTYEYKIAVNGSWDENYGAGGRNGDNLVLKLDRQTEVTFYYHDRTHAIADSTWYTAIAKEKQPRLVGTVLPAIGYEGENDGWTPGTSTALLTDDDFDSVYTFTAQVPKGSYEYKIVLGNNWNESYPQENARLTVLETTTITFFFNAKTKEVYTDYNPNGSDGVVQKDRLKHNTWDTLYRQPFGAVKAGTKVTLRLAAKKGDLTKADVYVKNATTGTAKVYTMEKVSVLGDDEYWEVAFTPSTPGVYGYKFIAQDAGTKVEYGEDTQEGQWGKAVDSRAELFQLTVYDPDYRTPDWMKEAVVYQIFPDRFFNGNPSNDNSKQQARGAQPIEHRDWSDLPDNPRLKGTSGYDGDGEWSNDFFGGDVAGIEQKLDYLQSLGVNTIYLNPIANAPSNHKYDASNYKELDPMFGSPEEFQSFVQELAKRGMHLILDGVFNHVSDDSIYFDRYHRYPTVGAYEYWEAVYDLMNEKGLSEEEARKQAEEKFKQQEQTFSPYGFHLWFNIENEKVDGRYKYQSWWGYDSLPEFKSVTGEKVPNPSELNNDALANYIFRESDSVAKSWIARGASGWRLDVANEVDPAFWREFRQELLQGSYDRGPTLKEGEQPLILGEIWDDASKYFLGDQYDSVMNYRFRGAVLDFLRNGNAEEADQRLTAIREDYPSEAFYALMNLIGSHDTARAVFLLGNGTDSFERAEFDPNYNEELGKKRLKLAAILQMGYPGAPTIYYGDEAGVSGSKDPDNRRTYPWGKEDQNLLAHYRKVGQIRQHHQTLLAHGDIKTLYAQGDVYVFARQYGRDVAIIAVNRGNEDRTVALDVASWLPNGTVLTDELHDGGKATVADGTLTVTIPALDGRMMFGTVTAEMPAAVRNLQASAVVGGVTLTWEGQASKYRVYQSTIQGAGYTLAAETNGTSVTIDSLANGTAYYFAVTAVDENGNESPKVETNRVVPHYPLTSDNVQFVTTLSDATLDLSQPQPIDVKVNIDGVTSKGAADGLQAVLQVKGPHDEAWKEYRAVYQGQDGDANVFRAAFTPLVAGTYTYRYALTTNLGEDWVYTEAKQVTFAADSSDQKAPAEAIALTPPPVESGQVHLSWQFVGKNDADAYLLVIERNGTVIHMTTSISTSFVDYGVENGTEYAYVVKLYDRAGNVTASNTVKVKPDIVMVKVIFKVKAPDYTPLDARITIPNSLNGWNTGAWEMSRNGAVTPDWQFTTEVQEGETITYKYVKGGSWDQEGLADHTPADVGDDDVSYYGYGSIGTDLKVTVHNEGNNTMVVEDRILRWIDMPVVIEEVKKQGSQVTIKGNAIKNGVLTINGERVPIDDRMSFSYTFAPASHQKEVSIHIEPSAESKTAIFNNDGGAIAKNTKDYVLNLETKQLREGKLTTPPSNGDSPGSETPSHDGGATPGNGTSPGSGGPSDGASPGGSVPPGGTAPPGNEAPPSRPPQKPSPSKPKEKPRKPTTPPGQVKKVYWDGVELKKGQIGRLTVQKPINLWKRTKDGRLVFVRILQPGEVYRVYGYDARFGGQYAVGGGYYVTDIDTHIRYETPSKEKLKLVNGE

SEQ ID NO: 13712 - DNA, 1689 bp, Azoarcus sp. EbN1
  CDS (1)..(1689): transl_table=11
atgaggacggcaggcgacaacgcgggtggcagggcatggtggaaggaggccgtcgtgtatcagatctatccgcgcagcttcatggattcgaacggcgacgggatcggcgatctgaacggcatcaccgtgcggctcgactacttgaagtcgctcggcgtcgacgtgatctggatctgcccggtgttcagctcgccgaacgatgacaacgggtacgacatcagcgactaccgggcgatcatggacgacttcggcacgatggcggatttcgactgcctgctcgccgaagtccaccgccgcggcatgcggctgatcctcgatctcgtcgcgaaccacaccagcgacctgcacccgtggtttctcgaatcgcgcgcgtcgctgaacaacccgaagcgcgactggtacttgtggcgcgacggcaaggacgggcgcgagccgaacaactgggagagcattttcaagggctcggtgtggaaatacgacgacaagaccggccagtatttcctgcacctgttctcggagcggcagccggacctgaactgggacaacccggaagtgcggaccgcgatctacgaaatggtgcgctggtggctcgacaagggcgtcgacggcttcaggctcgacgccgtcagccacaagaagaaggagccggggctgcccgacatgccgaatccgcacggcctcgattacgtgccgtcgttcgagaagcacatgaacgtcgatggcgtgctcgactacctggacgagttgtgccgccacacgttcgaccactacgacgtgatgaccgtcggcgaagccaacggcgtgtcgccggagcaggccagagcctgggtgggcgaggagcaccggcggctcaacatgatcttccagttcgagcattccgcgctgtggaagaaggcgccgcgcaacgggctcgaccttccggcgctcagggccgtgctgacgaaatggcagaagagtctcgacggcaccggctggaatgcgctgttcctcgaaaaccacgatctgccccgggtcgtttcgcgctggggcgacaccggccgctactggcgtgagagcgcgactgcgctggcaacgatgtatttcctgatgcagggcacgccgttcatctaccaggggcaggaactcggcatgacgaacagccgctttgcggcgctcgatgatttcaacgacgtcctgacgaaaaatcgcttcgcgtcgatgaagcgtgaagggctcgccgagggcgacatcatcgacctgttgtcgatcgtctcgcgcgacaacgcacgcacgccgatgcagtgggacgggtcggcgaacggcgggttcagctccggcacgccgtggctgcgcgttaatccgaacttcaacgagatcaacgccgagctgcaggagcgcaactccgcgtcggtgctgaaccattaccgccgcctcatcgcgctgcgcaaacgcgagcccgggctcgtccatggccactgcgagctgctgatggaggacgacgcgcagatctatgcctacagccgaacgcatggttcgcagcgctacgtgatcatcacgaacatgacgcgcgacgaagcccgataccaccagccggacctgctgctggacggcggcggattgctgctcgcgaaccagccggtcgagccgcacaccccgaccgacagtctgctgctcgagccgtacgaggcgcgcgtgtaccgttttcgctga

SEQ ID NO: 13713 - protein, 562 aa, Azoarcus sp. EbN1
MRTAGDNAGGRAWWKEAVVYQIYPRSFMDSNGDGIGDLNGITVRLDYLKSLGVDVIWICPVFSSPNDDNGYDISDYRAIMDDFGTMADFDCLLAEVHRRGMRLILDLVANHTSDLHPWFLESRASLNNPKRDWYLWRDGKDGREPNNWESIFKGSVWKYDDKTGQYFLHLFSERQPDLNWDNPEVRTAIYEMVRWWLDKGVDGFRLDAVSHKKKEPGLPDMPNPHGLDYVPSFEKHMNVDGVLDYLDELCRHTFDHYDVMTVGEANGVSPEQARAWVGEEHRRLNMIFQFEHSALWKKAPRNGLDLPALRAVLTKWQKSLDGTGWNALFLENHDLPRVVSRWGDTGRYWRESATALATMYFLMQGTPFIYQGQELGMTNSRFAALDDFNDVLTKNRFASMKREGLAEGDIIDLLSIVSRDNARTPMQWDGSANGGFSSGTPWLRVNPNFNEINAELQERNSASVLNHYRRLIALRKREPGLVHGHCELLMEDDAQIYAYSRTHGSQRYVIITNMTRDEARYHQPDLLLDGGGLLLANQPVEPHTPTDSLLLEPYEARVYRFR

SEQ ID NO: 13714 - DNA, 1770 bp, Bacillus clausii KSM-K16
  CDS (1)..(1770): transl_table=11
atgaaagtagcgatctaccatcgcccgaaaagtgaagatgcctacgcgtatgacaaagatacgatccacattcgtctgcgcacgcgcaaagacgatgctcacgaggtcatgcttatttatggagatccttacgattgggcgggaaacgaatgggtgactgccaaaaaaacaatgacacaagcaggggccgatggagaatatgattattggtttgtggaagtgaagccgccctaccatcgccttcgttacgggttcgaaattaaggcaaaagatgagacgatttactatggagaaagtgggttttgcgatacgcctgcaaaagacattagcgattatttctgttttccgtttatgaatcaagccgatttgtttacaccgcctgaatgggttaaagaaacgatctggtatcaaatctttcctgaacgttttgccaatggcgatcattcccgtgaccctgaaaatacattggcttggggaagtgcaccaccgactgcaaccaattatttcggcggtgaccttcaagggattgtcgatcatcttgattatttgcagaagctaggaattaacggcatttatttaacaccaatctttaaagcgttttccaaccataaatacgatacgattgattatttaaaagtagatccccaatttggagatgaaacgacacttaaactgcttgtcgatgaatgccataagcgcggcattcgtgtcatgcttgatgccgtcttcaaccatgcaggcctgtattttccaccttttcaagatgtactaaaacaccagcaggaatcagaatatagggattggtttcatatccgccaatttcctgttcgagcagaggaaccacctaattacgatacgttcgccttcacgcctttaatgccgaaactaaatacagcaaatgaagcagtaaaggactatttattgaacgtagctacgtattggattaaggagtttgacattgacggttggcgtttagatgtcgccaatgaagtcgaccatgccttctggcgtgagtttcgcaacagagtcaaagcattaaaaccagatttgtatattctcggtgaaatatggcataacgcttacccttggctgcaaggcgaccaattcgatggggtcatgaactacccgctcactgacgcgatttttgactttgtccaacacggcaaaagcgcaaccacttttcaatacgcggtcacaaaacatttgtacagttacccaaaattggtgaacgaagtccagttcaatttgctcggcagccatgacacaccaagaattttaactgtaagtgggggcaacaaaaaattagtcaaactttcctacttattgctgttttcctttcctggctcaccttgtatttattacggggatgaaatcggcatggccggagaaaatgaccctggttgccgcgcgtgcatggtgtgggaggaagaccaacaagatcaggagctattccaatttctgcaaaaactaattaagatccgcaaaactcaccaagcaatgggcacctataacaccttaaaattttatgactctggcactgaggatgtgctgttgtattccacatccgctggcggagagcttcttttatttgcggttaaccgcagtaaacaagaagcaacggtcaaactccctgattcactaaagagccttgcatttgtcgatgtcatttgcgaaagcccattgcaaagcgaagagctccacgttgaaggcgagtgctttttgttccttcattctgtcgacgccaacaaatgcggccaagtagacaagtaa

SEQ ID NO: 13715 - protein, 589 aa, Bacillus clausii KSM-K16
MKVAIYHRPKSEDAYAYDKDTIHIRLRTRKDDAHEVMLIYGDPYDWAGNEWVTAKKTMTQAGADGEYDYWFVEVKPPYHRLRYGFEIKAKDETIYYGESGFCDTPAKDISDYFCFPFMNQADLFTPPEWVKETIWYQIFPERFANGDHSRDPENTLAWGSAPPTATNYFGGDLQGIVDHLDYLQKLGINGIYLTPIFKAFSNHKYDTIDYLKVDPQFGDETTLKLLVDECHKRGIRVMLDAVFNHAGLYFPPFQDVLKHQQESEYRDWFHIRQFPVRAEEPPNYDTFAFTPLMPKLNTANEAVKDYLLNVATYWIKEFDIDGWRLDVANEVDHAFWREFRNRVKALKPDLYILGEIWHNAYPWLQGDQFDGVMNYPLTDAIFDFVQHGKSATTFQYAVTKHLYSYPKLVNEVQFNLLGSHDTPRILTVSGGNKKLVKLSYLLLFSFPGSPCIYYGDEIGMAGENDPGCRACMVWEEDQQDQELFQFLQKLIKIRKTHQAMGTYNTLKFYDSGTEDVLLYSTSAGGELLLFAVNRSKQEATVKLPDSLKSLAFVDVICESPLQSEELHVEGECFLFLHSVDANKCGQVDK

SEQ ID NO: 13716 - DNA, 2298 bp, Thermococcus kodakarensis KOD1
  CDS (1)..(2298): transl_table=11
atgaaaaaaggtggtctgctgctcattctcctgattctggtctcaatcgccagcggatgtatctcggagagcaacgaaaatcaaactgcaacggcttcgaccgttccaccgacttcagtgacaccctcacagtcttccactcccacaacctcgacctcgacgtacggcccttccgaaagaacggagcttaaacttccttcggttaactacactcccatctacgtcggcatagagaaaggctgtccctccggaagagtcccggtgaagttcacgtacaaccccggaaacaagaccgtaaagtctgtcagcctccgcgggagcttcaacaactggggagagtggccgatggagctgaagaacggcacgtgggagacgaccgtctgtctccgccctggaaggtatgagtataagtacttcatcaacggccagtgggtcaaggacatgtccgacgacgggacgggaaggccctacgaccccgatgcagacgcctatgcccccgatggctacgggggaaagaacgccgtgagggtagttgagggccgcgaagcgttctacgtggagttcgatccaagagacccagcctacctcagcatcgcggacaaaagaaccgtggtcaggttcgaggctaagagagacaccgtcgagtctgcggttctcgttacggatcacgggaactacacgatgaagcttcaggtctggtgggacttcggcgaaacctggcgcgccgagatgccagttgaacccgctgattattacattctcgtaacctcctccgacggcgggaagtttgccgtcctaaacacaagcgaaagcccgttcttccactttgatggcgttgaggggttcccccagctggagtgggtgagcaacgggataacctaccagatattccccgacaggttcaacaacggcaataaaagcaacgatgccctagctttggatcacgacgagctaattttgaaccaggttaatccagggcagccaatcctctccaactggagcgacccgataacgcccctccactgctgccaccagtacttcggcggcgacataaagggaataacggagaagctcgactaccttcagagcctaggtgttactataatctacatcaacccgattttcctctcgggaagcgcccacggctacgacacctacgactactaccggctcgaccccaagttcgggaccgaggatgagctgagagagttcctcgatgaggcccacaggaggggaatgagggtaatcttcgatttcgtgcccaaccactgcggcatagggaatccagccttcctcgacgtctgggagaagggcaacgaaagcccatactgggactggttcttcgtcaagaagtggcccttcaagctcggcgatgggagcgcctacgtcggctggtggggctttgggagccttccgaagctcaacactgccaaccaggaggtcagggagtacctgataggagcggccctccactggatagagttcggctttgacggcattagggtggatgtgccgaacgaagtcctcgacccggggacgttcttcccggagctgagaaaggcagttaaggagaaaaagcccgacgcgtacctcgtcggcgagatatggacgctctccccggagtgggtgaagggagaccgcttcgactccctcatgaactacgccctcgggagggacatcctcctgaactacgctaagggcctgctcagcggagaaagtgcaatgaaaatgatgggacgttactacgcttcctacggcgagaacgtagttgcgatgggcttcaacctcgttgattcgcacgacacttcgagggttctcactgacctcggtggtggcaaactgggagacacaccgtcaaacgagtcaattcagaggctcaagctcctctcaacgctcctctatgccctgcccggaactcccgtcaccttccagggggacgagaggggactgctcggagacaagggacactacgatgagcaacgctatccgatacagtgggatactgtgaacgaggacgtcctgaaccactacagggcactggcggagctcagaaaaagagttcccgcattgaggagcagcgcaatgaggttctacactgccaaaggcggcgttatggccttcttcaggggacatcatgacgaggttctcgtcgttgccaacagctggaagaagccagccctactggagcttcccgagggagagtggaaagtaatctggcctgaggatttcagcccggaactgcttcgcggcacagttgaagtgccagccatagggataatcatccttgagcggggttga

SEQ ID NO: 13717 - protein, 765 aa, Thermococcus kodakarensis KOD1
MKKGGLLLILLILVSIASGCISESNENQTATASTVPPTSVTPSQSSTPTTSTSTYGPSERTELKLPSVNYTPIYVGIEKGCPSGRVPVKFTYNPGNKTVKSVSLRGSFNNWGEWPMELKNGTWETTVCLRPGRYEYKYFINGQWVKDMSDDGTGRPYDPDADAYAPDGYGGKNAVRVVEGREAFYVEFDPRDPAYLSIADKRTVVRFEAKRDTVESAVLVTDHGNYTMKLQVWWDFGETWRAEMPVEPADYYILVTSSDGGKFAVLNTSESPFFHFDGVEGFPQLEWVSNGITYQIFPDRFNNGNKSNDALALDHDELILNQVNPGQPILSNWSDPITPLHCCHQYFGGDIKGITEKLDYLQSLGVTIIYINPIFLSGSAHGYDTYDYYRLDPKFGTEDELREFLDEAHRRGMRVIFDFVPNHCGIGNPAFLDVWEKGNESPYWDWFFVKKWPFKLGDGSAYVGWWGFGSLPKLNTANQEVREYLIGAALHWIEFGFDGIRVDVPNEVLDPGTFFPELRKAVKEKKPDAYLVGEIWTLSPEWVKGDRFDSLMNYALGRDILLNYAKGLLSGESAMKMMGRYYASYGENVVAMGFNLVDSHDTSRVLTDLGGGKLGDTPSNESIQRLKLLSTLLYALPGTPVTFQGDERGLLGDKGHYDEQRYPIQWDTVNEDVLNHYRALAELRKRVPALRSSAMRFYTAKGGVMAFFRGHHDEVLVVANSWKKPALLELPEGEWKVIWPEDFSPELLRGTVEVPAIGIIILERG

SEQ ID NO: 13718 - DNA, 2724 bp, Xanthomonas oryzae pv. oryzae KACC10331
  CDS (1)..(2724): transl_table=11
gtgggagctgggcctgcccgatcacgccaccgttgccgtggacgatctgtgggacgggcatcgcttcgcgtggcacggcaaataccaacacatccgtctagaggcgaggcggccgttcgcgttatggcgcatccgcgcaggagaggtcgcatgaatgcagtggcatcgttacaagccgacgcggagccatccgccgtggtcgccgaccagcgttggtacaaggacgcgatcatctaccaagtgcacgtcaagtcgttcttcgactccaacgacgatggcatcggcgattttcccggactgatttccaagctggattacatcgccgaactcggcgtggacaccatctggttgttaccgttctaccccagcccgcgccgtgacgatggctacgacattgccgaatacatggcggtgcatccggattacggcagcatcgaagattttgaacagttggtcgcgcaggcgcacgcgcgcggtatccgcatcgtcacagagctggtgatcaaccacacctcggatcagcatccctggtttcagcgcgcacgcactgcgccagccggctcgcccgggcgcgacttctacgtgtggtcggataccgatcaggagtacgaaggcacgcggatcatcttctgcgataccgaaaaatccaactggacctgggatccggtggccgggcagtacttttggcaccgcttctattcgcatcagccggatctgaacttcgataacccggccgtgctggaagctgtgctggaagtgatgcgcttctggctggatcgcggcgtggatggcctgcgtctggatgcagtgccgtatctgatcgaacgcgccggcacctccaacgaaaatctgccggaaacccatgccattttgcgcaagatccgcgccaccctggatgccgaatacccggaccgcatgctgctggccgaagccaacatgtggccggaagacacccagcaatacttcggccagaacgccgacgaatgccacatggcattccacttcccgctgatgccgcgcatgtacatggcaatcgcgcgcgaagaccgcttccccatcacggacatcatgcgccagaccccggagattcccgagagctgccagtgggcgatattcctgcgcaaccacgatgagttgaccctggaaatggtcaccgattcggaacgcgattatctgtggcagacctatgccgccgatcgccgcgcgcgtatcaatctgggtatccgccgccgcctggcgccgttgctggagcgcgaccgccgccgtatcgagttgatgacctcgttgttgctgaccatgcctggcacgccggtgctgtattacggcgacgaaatcgggatgggcgacaacatccatctgggcgaccgcgatggcgtgcgtacgccgatgcagtggtcgatcgaccgcaacggcggcttttcccgtgccgacccagcgcagctggtgctgccaccggtgatggacccgctgtacggcttccaggcggtgaatgtggaagcgcagatccgcgaccagcattcactgctgacctggacgcgccgcgtgctcagcgtgcgcaagcgctaccaggccttcggccgcgggacgctgcggttcctgtatccgggcaaccgccgcatgcttgcgtacctgcgctgttatcaggacgaaaccgtgctgtgtgtggccaatctctcgcacacgctacaagcggtagaactggatctgtccgagttcgaagggcgcgtgccggtggacatcatcggcggcggcagcttcccgccgatcgggcggctgacctacctgctcacggtgccgccgttcggcttttatgcgttcgagctggtgagcgaaggcaccttgccggattggcatgtgcccagcccggtgccgttgccggactaccgcacgctggtgctgcgcagcgatgccgacggaagtgcggcgctgctgccgcatttgcctacgttggaaggcgaaatcctgccggcatggctgtcggcacggcgctggttttcagccaaggatcaggcgctgcgcagtgtgcgcatcgcgcgtcgcacaccgctgccgggcgaccaaccgatgacgctgctggagctggaggtggagctggaggacggccgccgcgagcgctacatgttgccggtgggcatcgtgtgggagcgcgagcaacccagcacgctggctgagcagctggcgctggcgcgcgtgcgtcaaggacgcgaggtgggctacctgaccgacgcgtttgcgctcaagccgatggtacgcggcgtgatcgatgcgctgtgcagcaacgcagcgctaaagttctgcgatggcgaggaggcatcgcaacaaggccaggtacgtttcgaagccaccccggcgctggcgatgctggatatcccgcacgacccggagatccgctggttgtcggccgaacagagcaacagctcgctggtgatcgccgacaaggccgtgttcaagctgctacggcacgttgcggtgggcgcgaacccggagatcgaaatcggccgccggttgaccgagatgggctacgccaacgccgcgccgctgctgggcagcatcagccgcgtcgacgggcagggcacggtcaccaccatcgcgttgttgcagggcttcatccgcaatcaaggcgatgcgtggcgctggacgctcgaccatctggcacgtagcttcgacgaatacgtcgaccgcgcagacagacgaagcgcgcgccgaagccgtcgctggctatga

SEQ ID NO: 13719 - protein, 907 aa, Xanthomonas oryzae pv. oryzae KACC10331
MGAGPARSRHRCRGRSVGRASLRVARQIPTHPSRGEAAVRVMAHPRRRGRMNAVASLQADAEPSAVVADQRWYKDAIIYQVHVKSFFDSNDDGIGDFPGLISKLDYIAELGVDTIWLLPFYPSPRRDDGYDIAEYMAVHPDYGSIEDFEQLVAQAHARGIRIVTELVINHTSDQHPWFQRARTAPAGSPGRDFYVWSDTDQEYEGTRIIFCDTEKSNWTWDPVAGQYFWHRFYSHQPDLNFDNPAVLEAVLEVMRFWLDRGVDGLRLDAVPYLIERAGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFELVSEGTLPDWHVPSPVPLPDYRTLVLRSDADGSAALLPHLPTLEGEILPAWLSARRWFSAKDQALRSVRIARRTPLPGDQPMTLLELEVELEDGRRERYMLPVGIVWEREQPSTLAEQLALARVRQGREVGYLTDAFALKPMVRGVIDALCSNAALKFCDGEEASQQGQVRFEATPALAMLDIPHDPEIRWLSAEQSNSSLVIADKAVFKLLRHVAVGANPEIEIGRRLTEMGYANAAPLLGSISRVDGQGTVTTIALLQGFIRNQGDAWRWTLDHLARSFDEYVDRADRRSARRSRRWL

SEQ ID NO: 13720 - DNA, 1260 bp, Vibrio fischeri ES114
  CDS (1)..(1260): transl_table=11
atgattacaaaagcagcgatttatcatcgatctcactctagttattcttatgcatatgataaggatacgcttcatttgcgaattcgtaccgcaaaaggagaagtagacaatgcgacgctaagaattggcgacccatacgattggacttttggtggcggtggcggcaatttaaatgctgaagacgcaagcggctggacaggtggaaccaacttacccatgataaaagagtgtgaaacagaactgtttgactactggttttgtgaagcacaacctcgcttttatcgtgcacgttacgctttccttcttgaaggcaaagacagtgaaaaattactggtaagcgaaaaactcatcacccaaataaccgatgacgccgatccaatactcagtcaattactgaatttttattgcttcccatacatgaacccaactgatgtgtttaacgcaccagaatgggttaaagaaaccatttggtatcaaattttcccagagcgttttgctaatggtgacccatctatctcaccaaaaaatgtactgccttggggatctgaagatccaaaaaccaacagtttctttggtggcgatttacaaggggttattgatcatcttgattacctgcaagatctcggtattactggtatttatttcacacctatcactcaaggtgaaacgaaccataaatacgacaccaccgattatttaaaagtagaccccgcttttggtagtgatgaaacggttcatactttaatagatgaagcacataaacgtggcatgaaagtcatgctagatgcggtatttaatcatatcggtgctaattcaattcagtggcaagatgtcattaaacatggaaaagactctcaatacatcgattggttttatgtcgagcaatttccactgattgatgagtcaaaaaaagcgtaccacagtaaagagcaattaaattatcgtgcctttgcttttgcgcaaaacatgccaaaactcaatacagaaaatccagaagtgattgaatacctaattgaagttggccgctactgggtgaaaaactttgacattgatgcatggcgtttagatgtagcaaacgaagttgatcaacgtttttggcgacgcttccgtgatgaactaaaagccatcaaacctgagttatatattttaggtgaagtgtggcacgactcaatgaactggctaggtggtgatcagtttgatggcgtaatgaattacccattagcggatgccatgttaggcttttttgcccatgacacctaa

SEQ ID NO: 13721 - protein, 419 aa, Vibrio fischeri ES114
MITKAAIYHRSHSSYSYAYDKDTLHLRIRTAKGEVDNATLRIGDPYDWTFGGGGGNLNAEDASGWTGGTNLPMIKECETELFDYWFCEAQPRFYRARYAFLLEGKDSEKLLVSEKLITQITDDADPILSQLLNFYCFPYMNPTDVFNAPEWVKETIWYQIFPERFANGDPSISPKNVLPWGSEDPKTNSFFGGDLQGVIDHLDYLQDLGITGIYFTPITQGETNHKYDTTDYLKVDPAFGSDETVHTLIDEAHKRGMKVMLDAVFNHIGANSIQWQDVIKHGKDSQYIDWFYVEQFPLIDESKKAYHSKEQLNYRAFAFAQNMPKLNTENPEVIEYLIEVGRYWVKNFDIDAWRLDVANEVDQRFWRRFRDELKAIKPELYILGEVWHDSMNWLGGDQFDGVMNYPLADAMLGFFAHDT

SEQ ID NO: 13722 - DNA, 1815 bp, Corynebacterium glutamicum ATCC 13032
  CDS (1)..(1815): transl_table=11
atgactgatacctctccgttgaattctcagccgagtgcagatcaccaccctgatcacgcggctcgcccagttcttgatgcccacggcttgatcgttgagcacgaatcggaagagtttccagtccccgcacccgctcccggtgaacagccctgggagaagaaaaaccgcgagtggtacaaagacgccgttttctacgaagtgctggttcgtgccttctacgatccagaaggcaacggagtcggatcgttgaaaggcctgaccgaaaaactggattacatccagtggctcggcgtggattgcatttggatcccaccgttttatgattccccactgcgcgacggcggttacgatatccgcaacttccgtgaaatcctgcccgaattcggcaccgtcgatgacttcgtggaactcgttgaccacgcccaccgccgtggcctgcgtgttatcaccgacttggtcatgaatcacacctccgaccagcacgcatggttccaagaatcccggcgcgacccaaccggcccctacggagatttctatgtgtggagcgatgatcccaccctgtacaacgaagcccgcatcatctttgtagatacagaagaatccaactggacctatgatccggtgcgtggccagtacttctggcaccgcttcttctcccaccaaccagacctcaactacgacaaccccgcagtccaagaggccatgctagatgtcttgcgtttctggctggacctgggacttgatggtttccgactagatgccgttccttatctttttgaacgcgaaggcaccaacggcgaaaacctcaaagaaacccacgatttcctcaaactgtgtcgctctgtcattgagaaggaataccccggccgaatcctgctcgcagaagccaaccaatggccccaagatgtggtcgaatacttcggtgaaaaagacaaaggcgatgaatgccacatggccttccacttccctttgatgccgcgcatcttcatgggagttcgccaaggttcacgcaccccgatcagtgagatcctggccaacaccccggagattcccaagactgcccaatggggtattttcctgcgtaatcatgatgagctcacccttgaaatggtctccgatgaggaacgcagctacatgtactcccaattcgcctccgaacctcgcatgcgcgccaacgtaggaatccgcaggcgcctttccccactgcttgaaggcgaccgcaaccagctggaactccttcacggtttgttgctgtctctacctggctcacccgtgttgtattacggtgatgaaattggcatgggcgacaatatctggctccacgaccgcgacggagtgcgcacccccatgcagtggtccaacgaccgcaacggtggtttctccaaagctgatcctgaacgcctgtaccttccagcgatccaaaatgatcaatacggctacgcccaagtaaacgtggaaagccaactcaaccgcgaaaactccctgctgcgctggctccgaaaccaaatccttatccgcaagcagtaccgcgcatttggtgccggaacctaccgtgaagtgtcctccaccaatgagtcagtgttgacatttttacgagaacacaagggccaaaccattttgtgtgtcaacaacatgagcaaatatcctcaggcagtctcgcttgatttgcgtgaatttgcaggacacacccctcgagagatgtcgggcgggcagctgttccctaccattgctgaacgggagtggattgtcactttagcccctcacggattcttctggtttgatctcaccgccgatgaaaaggacgatatggaatga

SEQ ID NO: 13723 - protein, 604 aa, Corynebacterium glutamicum ATCC 13032
MTDTSPLNSQPSADHHPDHAARPVLDAHGLIVEHESEEFPVPAPAPGEQPWEKKNREWYKDAVFYEVLVRAFYDPEGNGVGSLKGLTEKLDYIQWLGVDCIWIPPFYDSPLRDGGYDIRNFREILPEFGTVDDFVELVDHAHRRGLRVITDLVMNHTSDQHAWFQESRRDPTGPYGDFYVWSDDPTLYNEARIIFVDTEESNWTYDPVRGQYFWHRFFSHQPDLNYDNPAVQEAMLDVLRFWLDLGLDGFRLDAVPYLFEREGTNGENLKETHDFLKLCRSVIEKEYPGRILLAEANQWPQDVVEYFGEKDKGDECHMAFHFPLMPRIFMGVRQGSRTPISEILANTPEIPKTAQWGIFLRNHDELTLEMVSDEERSYMYSQFASEPRMRANVGIRRRLSPLLEGDRNQLELLHGLLLSLPGSPVLYYGDEIGMGDNIWLHDRDGVRTPMQWSNDRNGGFSKADPERLYLPAIQNDQYGYAQVNVESQLNRENSLLRWLRNQILIRKQYRAFGAGTYREVSSTNESVLTFLREHKGQTILCVNNMSKYPQAVSLDLREFAGHTPREMSGGQLFPTIAEREWIVTLAPHGFFWFDLTADEKDDME

SEQ ID NO: 13724 - DNA, 3327 bp, Pseudomonas syringae pv. syringae B728a
  CDS (1)..(3327)
atggccaaaaagcccggtgacgcgacatttatcaaagacccgctctggtacaaggatgcggtgatttatcaggttcacgtgaaatcgttctttgattccaataacgacggaatcggcgatttcgcgggcttgatcgaaaagctcgactacattgccgcgctgggcgtcaacaccatctggttgttgccgttttatccgtcgccacgccgggacgatggctacgacatttccgaataccgggatgtgcacagcgactacggcaccatggccgatgccaagcgtttcatcgcccaggcacacaagcgcggcctgcgagtgatcagcgagctggtcatcaatcatacttccgaccagcatccctggttccagaaagcccgcaatgccaagcccggttccaaggcgcgggacttctatgtgtggtcggacaccgatcagaagtacgacggtacgcggatcatctttctcgataccgagacgtccaactggacctgggacccggttgccggccagtacttctggcaccgtttctactcgcaccagccggatctgaatttcgacaacccgcacgtgctggatgcggttctggaagtcatgcgcttctggctggatctgggcatcgacggtttgcgtctggatgccattccgtatctcatcgagcgggacggcaccaacaacgagaacctgccggaaactcatcaggtgctcaagcgcatccgtgccgagatcgacgcgaactatccggaccgcatgctgctggccgaggccaaccaatggccggaagatacccagctgtattttggtgacagcaaaggcccggacggcgatgaatgccacatggcctttcactttccgttgatgccacgcatgtacatggcgctggcccaggaagatcgttttccgatcaccgatattttgcggcagacgccggagatcccggaaaattgccaatgggcgattttcctgcgcaaccacgatgaactgaccctggaaatggtcaccgatcgtgagcgtgattacctgtggaattactacgcggccgaccgccgtgcacggatcaacctgggcatccgtcggcgcctggcacccttggtggatcgcgatcgtcgccgggtcgagttgctgaacagcatgctgttgtcgatgcccggcacaccgacgctgtattacggcgacgagatcggcatgggcgataacatctacctgggcgaccgggacggtgtgcgcacaccgatgcaatggtccatcgaccgcaacggcggtttttcgcgcgccgacccggccagcctggtgttgccaccgatcatggacccgatgtacggcttccagtcggtcaacgtcgaaatccaggagcgtgacccgcattcgctgctgaactggaaccggcgcatgctcgccgtgcgcaaacagcagaaggcattcggacgtggcacgctgaaaatgctctcgccgtcgaaccgccgcattctggcgtatacccgcgaatacacagcacctgacggacacagtgaagtggtgctgtgtgtcgccaacgtttccagcgccgctcaggctgcagagcttgagttgtctgcctacgcaggcacggtaccggtggaaatgctcggcggcagcgcattcccgcccatcggccagttgagctacctgctgacgctgccgccgtacggcttttactggtttttactggcttcggagaatcaaatgcccagttggcacgttgaacccgcgcagagcatgccggacttcccgactctggtgctcaagaagcgtctggaagagttgctcgaagagccactgcgcagcaccatggaaaacacctcgctggcggtttacctgcccaaacggcgctggttcgcgggcaaggacaaggcgatcgagaaggtcagcattgcctacgccgtgcgcttcggcgaagaagcgaatccggtgctgctcagcgaaatagaagtcaccgcaggcgggcagaccgatcgctatcaattgccgttcggcttgctggccgaagacgacatcagcagtgcactgccgcagcaactggcgctcgcccgagtgcgtcgcaatcgcgatgtcgggctgatcacggatgcatttaccctggaaactttcatccgcgcagtgattcagggcatgcagtcggatacggtcataccctgtgccgacggcgagttgcgtttcgagcaaagttcgcagctggcacccctcggcctgaacgccgagtcggaagtgcgctacctgtctgccgagcaatcgaacagttcggtggtggtcggcagcagcctggtgctcaagctgattcgcaaagtcagcgccgggacgcaccccgagctggaaatgggcgcgttcctgacccgtgccggcttcaagaacatttcgccgctgctgggctctctggtacgcgtcggcaaggacggtcagcccaacctgctgatgatcgctcagggctatctgagcaaccagggcgatgcgtgggagtggacccagaacaatctcgagcgtgcggtacgtgacgagctggcacatggtgtttccggtcaggaacagcattacaacgcgctgctcgagctcgcggacttctcgcgcagtcttggccagcgtctgggtgagatgcaccagattctcgcgtcgcccaccgacaatgcggattttgccgtcgaagtcaccagcagccaggacagcaaggcctccggggtcagcgtcaacgctcagctcgagcgcgccttgcagctgctggaacagcgcatcggcgagctggacaaggacgatcagcaactggtcaacgatctgctcgcgcagcgcaagcagatccgccagcgcgtcgaaggcctggccaagcgctccgccggtggcctgcgcattcgtgtgcatggcgatctgcatctggggcaagtactggtggtcaagggtgatgcctacctgatcgatttcgagggtgaaccggcccgcgcacttgaagagcgccgtgccaagcacagcccgttcaaggatgtcagcggtgtcctgcggtcctttgactacgctgcggccatggctgtacgcagtgcgcagagcgtcgacacgtctcccgaggcagccggcgcgcgcaaacgtgttgccgatacctacctggcgcaggcgcgagaaacctttatcgagggttatcgctcggcgaccaccggcattgcccatgcctggaaagatgcaaaaggggaggacgctgcactcgagctgttcacccttgaaaaagctgcttatgaagtgatctacgaagccgagaaccgtccagcctggctggccgttcccttgcaaggcttgcgtgggttgctgcaaccgtctgatggagagtcaatatga

SEQ ID NO: 13725 - protein, 1108 aa, Pseudomonas syringae pv. syringae B728a
MAKKPGDATFIKDPLWYKDAVIYQVHVKSFFDSNNDGIGDFAGLIEKLDYIAALGVNTIWLLPFYPSPRRDDGYDISEYRDVHSDYGTMADAKRFIAQAHKRGLRVISELVINHTSDQHPWFQKARNAKPGSKARDFYVWSDTDQKYDGTRIIFLDTETSNWTWDPVAGQYFWHRFYSHQPDLNFDNPHVLDAVLEVMRFWLDLGIDGLRLDAIPYLIERDGTNNENLPETHQVLKRIRAEIDANYPDRMLLAEANQWPEDTQLYFGDSKGPDGDECHMAFHFPLMPRMYMALAQEDRFPITDILRQTPEIPENCQWAIFLRNHDELTLEMVTDRERDYLWNYYAADRRARINLGIRRRLAPLVDRDRRRVELLNSMLLSMPGTPTLYYGDEIGMGDNIYLGDRDGVRTPMQWSIDRNGGFSRADPASLVLPPIMDPMYGFQSVNVEIQERDPHSLLNWNRRMLAVRKQQKAFGRGTLKMLSPSNRRILAYTREYTAPDGHSEVVLCVANVSSAAQAAELELSAYAGTVPVEMLGGSAFPPIGQLSYLLTLPPYGFYWFLLASENQMPSWHVEPAQSMPDFPTLVLKKRLEELLEEPLRSTMENTSLAVYLPKRRWFAGKDKAIEKVSIAYAVRFGEEANPVLLSEIEVTAGGQTDRYQLPFGLLAEDDISSALPQQLALARVRRNRDVGLITDAFTLETFIRAVIQGMQSDTVIPCADGELRFEQSSQLAPLGLNAESEVRYLSAEQSNSSVVVGSSLVLKLIRKVSAGTHPELEMGAFLTRAGFKNISPLLGSLVRVGKDGQPNLLMIAQGYLSNQGDAWEWTQNNLERAVRDELAHGVSGQEQHYNALLELADFSRSLGQRLGEMHQILASPTDNADFAVEVTSSQDSKASGVSVNAQLERALQLLEQRIGELDKDDQQLVNDLLAQRKQIRQRVEGLAKRSAGGLRIRVHGDLHLGQVLVVKGDAYLIDFEGEPARALEERRAKHSPFKDVSGVLRSFDYAAAMAVRSAQSVDTSPEAAGARKRVADTYLAQARETFIEGYRSATTGIAHAWKDAKGEDAALELFTLEKAAYEVIYEAENRPAWLAVPLQGLRGLLQPSDGESI

SEQ ID NO: 13726 - DNA, 1659 bp, Lactobacillus gasseri
  CDS (1)..(1659)
atgagacattggtatgaccgagcaattatttatcaaatttatcctaagtccttccaggattctaacggtgatggtattggcgacttaaatggtattagaaaaagaataccgtatttgaaggaactaggagttaatgctgtctggctgaatccagtctttgtttcaccacaagttgataatggctatgatgtatcaaactattttgccattgaccccaaaatgggaaccatggaagatatggatgacttaatcaaagaaatgcatgaagctggaattcatgtaattatggattttgttttaaaccatacttctgatcaacatccgtggtttcaagatgcaattaaaaaccctgatagtatttatcgagactactatatttttgctggtaaaaataatcagagaccaaataattggggaagtttttttggaggtagtgtttgggagaaagatcctgctggaacagggcaattttattttcatctttttgataaaagaatgcccgatttgaactggaaaaatcctgaagtcagacatgcaatgagtgaaattgcaaaatattggctagaaaagggaattgacggcttgagattagatgcctttatccatattgctaaagcagatttaaggcaaaatttcccagttaatagtgaaaatgaagaacccgtgatagctgagccattttttgcaaacttaccacaagtacaaaaatggatgcgacctttctgtgaggaaataaagcaagattatcctgatgcactattgttaggagaagcagcaagcgcgaatgttaatttagcagttgattatacaaataaagataatcacttgatggatagtgtaattacatttagatactttacagaggatcaaagtcagattgatcctagtttttcagctcaataccagccgaaatcattagatttagtaaaatttaagcaaaatcaggctgtttggcaacaaactttaagtggtgtttctaagccaaccttgtactggaataatcatgatatggctagaatagcgactagaattgctaaaaatgatattcaagctcggagcttagccatgctcatgtatttacaaaatgggttgccgattatttattatggcgaagaactcggaatgaaaaatttggagtttgaagacgcaacacaatttgaagatgagacagttaaagaatttattgaaagcgccaaaaaagctggaaaaactagtcaagaagcattactaatggcaagtaaaacccataaattgccagctagagggccaatgccatggaataatgaaaaaaataatggctttagtgatggaaatccttggcttaaaggaaagaaagttgattatgctaatgcggctgatgaaatagcagataaccatagcatgtttaatttctacaaaaaattgatcgccctaaagaaagaagcattgtttgaagatggtggctactatttattaccaacgtcaaatgacagctatgtttatgagcgtaatttagaagatcaaaaagcattagtcgctgtttctttaagtaaagatcctattgagcttgacgtagatcctgaatttaagcaggaaaaattagtagcaggcaactatcaattgaaagatggaaaattaaaattagctccgtatgcgggagtagtattagaaaaagactaa

SEQ ID NO: 13727 - protein, 552 aa, Lactobacillus gasseri
MRHWYDRAIIYQIYPKSFQDSNGDGIGDLNGIRKRIPYLKELGVNAVWLNPVFVSPQVDNGYDVSNYFAIDPKMGTMEDMDDLIKEMHEAGIHVIMDFVLNHTSDQHPWFQDAIKNPDSIYRDYYIFAGKNNQRPNNWGSFFGGSVWEKDPAGTGQFYFHLFDKRMPDLNWKNPEVRHAMSEIAKYWLEKGIDGLRLDAFIHIAKADLRQNFPVNSENEEPVIAEPFFANLPQVQKWMRPFCEEIKQDYPDALLLGEAASANVNLAVDYTNKDNHLMDSVITFRYFTEDQSQIDPSFSAQYQPKSLDLVKFKQNQAVWQQTLSGVSKPTLYWNNHDMARIATRIAKNDIQARSLAMLMYLQNGLPIIYYGEELGMKNLEFEDATQFEDETVKEFIESAKKAGKTSQEALLMASKTHKLPARGPMPWNNEKNNGFSDGNPWLKGKKVDYANAADEIADNHSMFNFYKKLIALKKEALFEDGGYYLLPTSNDSYVYERNLEDQKALVAVSLSKDPIELDVDPEFKQEKLVAGNYQLKDGKLKLAPYAGVVLEKD

SEQ ID NO: 13728 - DNA, 1467 bp, Nostoc punctiforme PCC 73102
  CDS (1)..(1467)
atgcaaattcaaacaccagattgggtaaagcacgctgttttctaccaaattttcccagatcgctttgccagaagcaaacagccgcgcaaacggttattgcaagaagcccgttgggaagattgggactctatgccaaccctccagggttataaaggtggggatttatggggcatcatggaggatttagactacatccagaatttggggattaacgcgatttatttcacacccatctttcaatccgccagtaatcaccgctatcatacccacgattattatcaagttgacccgatgttagggggcaacgaggcttttaaagaattgcttgatgcagcccatcaacggaatatcaaagtcgttctggatggggtgtttaaccattccagccgtggctttttctttttccacgacgttttagaaaatggcccccattcaccttgggtaaattggttcaaaatagaaggctggcccctttcaccttataacggtgaattccctgcaaactacgtgggttgggcgggaaatcgcgccttgccagaatttaaccacgataatccagaagtacgagaatatattatggaaattgccgaatattggcttaaattcggcatcgacggttggcgattagatgtcccatttgaaataaaaactccgggtttttggcaggaattccgcgatcgcactaaagccatcaatcccgaagcatatattgtgggcgaagtgtggggagattcccgccagtggttggatggaacgcaatttgacggcgtaatgaattatttatttgctgggccgacaattgcttttgcagctggcgatcgcgtagtcttagaacaagtccaaagccgcgactatcaaccctacccacccttatttgctgccgagtacgccaccaaaatccaagaagtactgcaactttacccttgggaaattcagctaactcaactcaatttgttagcaagtcacgatacagcccgattgatgaccattgcaggcggtgatatagcgagtgtagaattatcgactttactgttactcacctttcccggtgcccccagcatttactatggtgatgaagtcggtttacctggtggcatagatcccgactcaaggcgtggctttcctttagaggctaactggaatcaagaaattttcaatactcatcgtcaattaattaccatccgccaaacatacccagccttgcgtacaggtgattaccaagtcctctatgctcaagggcaactttatctctttgcacgaactttaggcacagaagaattgataattgctataaacgctggcacaagttcggcaaccgcaaatgtagatgtggctagtttgcatactcaacccaacaagctgttatatggtactgctgaagctgagtggaatggtgaagaaggaactcagcaattgtcattaactcttcccgcacgcagtggctgcatcctggggactggggactag

SEQ ID NO: 13729 - protein, 488 aa, Nostoc punctiforme PCC 73102
MQIQTPDWVKHAVFYQIFPDRFARSKQPRKRLLQEARWEDWDSMPTLQGYKGGDLWGIMEDLDYIQNLGINAIYFTPIFQSASNHRYHTHDYYQVDPMLGGNEAFKELLDAAHQRNIKVVLDGVFNHSSRGFFFFHDVLENGPHSPWVNWFKIEGWPLSPYNGEFPANYVGWAGNRALPEFNHDNPEVREYIMEIAEYWLKFGIDGWRLDVPFEIKTPGFWQEFRDRTKAINPEAYIVGEVWGDSRQWLDGTQFDGVMNYLFAGPTIAFAAGDRVVLEQVQSRDYQPYPPLFAAEYATKIQEVLQLYPWEIQLTQLNLLASHDTARLMTIAGGDIASVELSTLLLLTFPGAPSIYYGDEVGLPGGIDPDSRRGFPLEANWNQEIFNTHRQLITIRQTYPALRTGDYQVLYAQGQLYLFARTLGTEELIIAINAGTSSATANVDVASLHTQPNKLLYGTAEAEWNGEEGTQQLSLTLPARSGCILGTGD

SEQ ID NO: 13730 - DNA, 1674 bp, Nostoc punctiforme PCC 73102
  CDS (1)..(1674)
atggcaaatttaactgactttaaattgtttgctcctcgcaacaaaggagcagctttaattgggtctttttcggattggaaagaaattccaatgtctaaaagtgaagatggttattttcgcactaaaatcaaactggaagacggcgtttatcaatataaatttcgcattcaaactaaaagtccaaattttgcacctgatgaatggatcgatgtcattgatcctaaagcaacagaagttaatgaaacagaaaaatatggcatagttcgtattcaagatgggcaacgcattgttgatagttacttttggcaacacgatgaaatgccgttgcctgataaccgggaattagtcatatatgaaatgcacgttgctgattttactggtgatgaagttgattctaacgagcgaggcaaatatctagggataattgctaagttagattatctttgcgaactgggaattaatgcaattgaattaatgccagttaatgagtaccctggtgattatagctggggctataaagttcgccacttctttgctacagaatctagttacggttcaacagaagatttaaagcgattgattgacgagtgtcatggtagaggtattcgcgtctttatggatggaatttataaccacacagatgaagaatgcccattaatactaattgaccgcaattactggtactacgaacataaacattatcctgaagacccagctaattactgggggccagagtttaactatgatttttacgacaaaaacttaaatattcaacctgcatgggaatacatcggcgatgtggtaaggttttggattcaggaatatcacattgatggaattcgctttgatgcagtacggcaattggctaactttgaatttctcaactggctgactaagcaagcgaaaaaccatgctgcacccaagcagttttacaacattgctgaacacattcccgatacaaacactgtagtcaagccagatgggccattagatgcttgttggcatgagagctttcgctactttttagttccatatatttgtggaaaatcatttgaattagaacaactcaagcaaattttagaccccaaacagcagggttatgcgatcgctaccaatgtgataaattatttggcaacccacgatcgcgaacgtctattacgagaattaggcaattgcggcatctttgacgcagccgcatttgaacgagccaagttagcagctgttttgttaatgacagcgatgggtataccgatgctgtggatggcagaagagtttggcgaataccagcaaaaaagtgaagatgtgactaagccgcagaaaattacttggtctttgttgttagacgaccaaaattatgatttatttgagtattatcaaaagctgattactctacgccagcaaactccagctttgcaaagtgacaatattaagtttttctacgaaaatgcagatgataaagtgttggcttacagccgttgggatgagcaaaattctcatgtcgtcgttgtggtaaatttttccgatcggagtctaaatcaatataaaatttccgacttcccaactactgaagattggcgagattgggttggtaatcgggaagtgaaatctggagaagatggtttagtcactgacttgccaagctatacagctaaaatatttgttttgcaaacatga

SEQ ID NO: 13731 - protein, 557 aa, Nostoc punctiforme PCC 73102
MANLTDFKLFAPRNKGAALIGSFSDWKEIPMSKSEDGYFRTKIKLEDGVYQYKFRIQTKSPNFAPDEWIDVIDPKATEVNETEKYGIVRIQDGQRIVDSYFWQHDEMPLPDNRELVIYEMHVADFTGDEVDSNERGKYLGIIAKLDYLCELGINAIELMPVNEYPGDYSWGYKVRHFFATESSYGSTEDLKRLIDECHGRGIRVFMDGIYNHTDEECPLILIDRNYWYYEHKHYPEDPANYWGPEFNYDFYDKNLNIQPAWEYIGDVVRFWIQEYHIDGIRFDAVRQLANFEFLNWLTKQAKNHAAPKQFYNIAEHIPDTNTVVKPDGPLDACWHESFRYFLVPYICGKSFELEQLKQILDPKQQGYAIATNVINYLATHDRERLLRELGNCGIFDAAAFERAKLAAVLLMTAMGIPMLWMAEEFGEYQQKSEDVTKPQKITWSLLLDDQNYDLFEYYQKLITLRQQTPALQSDNIKFFYENADDKVLAYSRWDEQNSHVVVVVNFSDRSLNQYKISDFPTTEDWRDWVGNREVKSGEDGLVTDLPSYTAKIFVLQT

SEQ ID NO: 13732 - DNA, 1266 bp, Bifidobacterium longum DJO10A
  CDS (1)..(1266)
atgcccgattgggtgaagtacggggtgttctggcacgtgtatccgctgggcttctgcggtgccgatatcaggcccgccggcccgcgccagttccatggccgcggccttgacgcgataattccctggctggagtacgtgcgcgatctaggcgcgtccggcctgctgctgggtccggtgttcgagtcggcgacgcatggatacgacacgctcgaccatatgcatatcgatgtgcgattgggcggggatgccgcgttcgatcagcttgtcgcggcctgccgggacatgggattgcaggtgatgctggatggcgtgttcaatcatgtgagccgcaatcatccggccgttcaggcggcgcttgacgagaccgccggacgcttgaatccggccgacaacccgtggcatggtctggtccgcgcgcatgtcggtgataatggcgaacccgctttggatgtgttcgaggggcacggggatctggtggcgctggaccattcggctgacgagaccgttgactatgtggtccatgtgatgagccattggctggatcgcggagtcgccggctggcgcctcgacgccgcgtatgccgtgccgagcccgttctgggcgcgcgtgttgccgcaggtcaaagccgcacacccgtattcgtggattttcggcgaggtgatccatggcgattacccgcgcatcatcgaggaatccacgatggattcgatcacgcaatacgagctatggaagtcgatccagcatgcgctggagacggagaacttcttcgagctggattggaacttgaagcggcacaacgcgttcctggattccttcgtgccgcagacgttcatcggcaaccatgacgtgacgcgtatcgcatcgcagattggcccggccaaggcggcgttggcattggcggtgctcatgacggtcggcggcgtgccaagcatctattacggcgacgaacagggctatgtgggcgtcaagcaggagcgtttcggcggcgatgacgacgtacgtccgaagttccccggctcccctgccgaactgtccacgctgggagagccgacataccggctgcatcaggcgctgatcgcgctgcgccgtcgcaacccatggctgctggatgcgcgtaccgaggccgtgaagctggaaaacaagcacttcgtctatcgttcgacgagcgccgacgcccagcattccctgaccgtggacctcaacatcgagcaatcccccactttcaccatccgcaacgccgatggcagtacagcgtatcaatggtga

SEQ ID NO: 13733 - protein, 421 aa, Bifidobacterium longum DJO10A
MPDWVKYGVFWHVYPLGFCGADIRPAGPRQFHGRGLDAIIPWLEYVRDLGASGLLLGPVFESATHGYDTLDHMHIDVRLGGDAAFDQLVAACRDMGLQVMLDGVFNHVSRNHPAVQAALDETAGRLNPADNPWHGLVRAHVGDNGEPALDVFEGHGDLVALDHSADETVDYVVHVMSHWLDRGVAGWRLDAAYAVPSPFWARVLPQVKAAHPYSWIFGEVIHGDYPRIIEESTMDSITQYELWKSIQHALETENFFELDWNLKRHNAFLDSFVPQTFIGNHDVTRIASQIGPAKAALALAVLMTVGGVPSIYYGDEQGYVGVKQERFGGDDDVRPKFPGSPAELSTLGEPTYRLHQALIALRRRNPWLLDARTEAVKLENKHFVYRSTSADAQHSLTVDLNIEQSPTFTIRNADGSTAYQW

SEQ ID NO: 13734 - DNA, 3333 bp, Desulfovibrio desulfuricans G20
  CDS (1)..(3333)
atgagcattatgattgagccggcgggccttgatccgcagtggtacagggatgccatcatatacgaattgcacatcaaatcgtttcatgattccgacggcgacggcatgggcgatatggcggggctgattgaaaaactggactatctgcaggatctcggggtcacggcgctgtggctgctgcccttttacccctctccgctgcgtgatgacggctacgatattgccgactacatgagcatcaaccccgactacggcagcatggctgacttccgcaagctgctgcgcgaggctcattcccgcgggttgcgcgtcattacagaactggtgctcaaccacacctcagaccagcatgcctggttccggcgggcgcggcgggcccctgccggttcggaagagcgcgatttttacgtgtggagcgatacctcggacaggtacaaggacgcccgcatcattttcaaagacttcgagccttcaaactggtcatgggaccctgtggcacgggcatattactggcatcgtttctatcatcaccagcctgatctcaattatgaaaatccggccgtgcacaaggccatgttccgggtcatcgacttctggctggacatgggggtggacggagtgcggctggatgctgtgccctatctgtacgaagaagaaggcacaaactgcgaaaatctgccgcggacccatgattttcttaaagcgttgcgcagccacatagacagcagatttcagggccgcatgctgctggccgaggcgaaccagtggccggaagacgcggcccgttatttcggcgacggtgattcgtgtcatatggcatttcattttccgcttatgccgcgcatgtttatggccattgaaatggaagaccgtcatccggtcattgatataatggagcagactccggaactgccggacggttgccagtgggctatttttctgcgtaaccatgacgaactgacgctggagatggtgacggacgaagagcgcgactacatgtaccgcatgtatgcccgtgatccgcgtgcgcggataaatctcggcatccgccgccgccttgccccgctgctgggcaacgaccgccgcagagtggagctgcttaacgtgctgcttttcaccatgccggggacaccggtgctttattatggtgacgagataggcatgggggacaactactatctgggcgaccgcgacggtgtgcgtacccccatgcaatggagtgcggacagaaacgccggtttttcacgctccaatccgcagcgtctttttctgccggtggtcatcgatccggaataccactacgaggctgtgaatgtggaaacgcagcagtccaacaaaagttcgctgctgtggtggatgaagcgcatcatcgccatgcgcagaagatatacggctttcagccggggcggcatttcgtttctccggccggaaaactcccgtgtgcttgcctacatgcgcagctctggtgaagaacatgtgctggtggtgactaacctgtcgcggcacgcacaggcagcttcgctggatttaagcggctgggaaggctaccggccggtggaagtcttcagcaacacgcgctttcccgctgtcaggcaaccggcgtatacaattacgctcaatccttacggctactatattttccacatgcgcagagaggaggcggcggaagcgcttaccggattattttcgccgcctatgctcatgccggtgtccggagcgcgttttcttgatgtggaagtacgcgaggcgctgcagcgcagagttctgcccggctatctgacacgtcgcggattgctgggaacaagcgccgtgcagctgcgcgaggctgtcattctggaagcggtgcccgtgggcggcaagggtgcccccagctggttgctgattgtggaagcacggtatcaggagcgccagccggaatggttcggcatgcttgtatcgttgctggctggtgaacctgcccggcagacggtgcgtgaagcgcctgtgcatctcatgtgcacttttggtgaagacgcgccggaagccgtacttgtggaatcctttgatgccagctgccgttgcggcgcgttgctgcagcttgtctcgcgcacgcagacagtgaagggcaggcacggcgagctggcagtggcccccgccggcggtacccgcggcagagtgcgggcggcctgcgccgaagatgctcctgccctgtggaagccccatatccacgccaccagcgttgtctgcggtgaaagtgtgcttttcaaggtgtaccgccgcatggacgaaggtgtgaatccggatgtggaactgctgcgctttctgaccgaagaggcggggtatcctcatgtgcccgcgtatatgggcgttgtggagtacagacggtcgcgcacatcgtccatggctgtggccatgctgcatgaatatgtgcaggcgcagggcgacgcacaggaaatgtgccgcgatatggtacgcaggttctttgacagggtgctggccgcacggggcgagatggatatccgtccccggctgtatgcccgttctcccgtggaagccgcaggaagacctttgccgcaggaataccgtgaacttatgggcgatatggattttgccggcatgcagctgctgggcaggcgtgtgggcgaactgcaccgcgcgctggcgttcagctctgaagactctgcttttgctccggagccgttttccaccctgtatcaacggtctgtgtatcagggtatgcaaagccgggtaaagcaggtcctgacccgtctggaacgttcgcttgctttgctgccggaatcggccagagacgatgctgcgcgggtgctggaactgcgcgaagaagctttgcggcgcatgcgcggttttcttacgcgcaaacttgattgtctgaaaatcagggtgcatggcaacctgcatctgggcaatgtgctgcgcagcggcagagagtatgtgatcgtgaactttgagggcaggccggacaagtctctttccgaacggaggctgaagcgttcacccctgcgcgatgtggcagatctggtacggtcggtgcattacaccgtgctcacggtgctgatgcatgaatcggttctccggcctgaagaccgcgcgtttcttgaaccctgggccgatttgtggcgcatagaagcctcaggagctttcatgaccacatatcttgaagccgtgggcggcagcaggctggtgcccgaaaatgaacaaggcgttcaggtgctgctggaagcgtttttgctggaaaaagcgtttatggagcttgatgcagaactgaaagcgccttccggcatggtgggactgccgctggctgccattatcaccctgctgggagcagagggctga

SEQ ID NO: 13735 - protein, 1110 aa, Desulfovibrio desulfuricans G20
MSIMIEPAGLDPQWYRDAIIYELHIKSFHDSDGDGMGDMAGLIEKLDYLQDLGVTALWLLPFYPSPLRDDGYDIADYMSINPDYGSMADFRKLLREAHSRGLRVITELVLNHTSDQHAWFRRARRAPAGSEERDFYVWSDTSDRYKDARIIFKDFEPSNWSWDPVARAYYWHRFYHHQPDLNYENPAVHKAMFRVIDFWLDMGVDGVRLDAVPYLYEEEGTNCENLPRTHDFLKALRSHIDSRFQGRMLLAEANQWPEDAARYFGDGDSCHMAFHFPLMPRMFMAIEMEDRHPVIDIMEQTPELPDGCQWAIFLRNHDELTLEMVTDEERDYMYRMYARDPRARINLGIRRRLAPLLGNDRRRVELLNVLLFTMPGTPVLYYGDEIGMGDNYYLGDRDGVRTPMQWSADRNAGFSRSNPQRLFLPVVIDPEYHYEAVNVETQQSNKSSLLWWMKRIIAMRRRYTAFSRGGISFLRPENSRVLAYMRSSGEEHVLVVTNLSRHAQAASLDLSGWEGYRPVEVFSNTRFPAVRQPAYTITLNPYGYYIFHMRREEAAEALTGLFSPPMLMPVSGARFLDVEVREALQRRVLPGYLTRRGLLGTSAVQLREAVILEAVPVGGKGAPSWLLIVEARYQERQPEWFGMLVSLLAGEPARQTVREAPVHLMCTFGEDAPEAVLVESFDASCRCGALLQLVSRTQTVKGRHGELAVAPAGGTRGRVRAACAEDAPALWKPHIHATSVVCGESVLFKVYRRMDEGVNPDVELLRFLTEEAGYPHVPAYMGVVEYRRSRTSSMAVAMLHEYVQAQGDAQEMCRDMVRRFFDRVLAARGEMDIRPRLYARSPVEAAGRPLPQEYRELMGDMDFAGMQLLGRRVGELHRALAFSSEDSAFAPEPFSTLYQRSVYQGMQSRVKQVLTRLERSLALLPESARDDAARVLELREEALRRMRGFLTRKLDCLKIRVHGNLHLGNVLRSGREYVIVNFEGRPDKSLSERRLKRSPLRDVADLVRSVHYTVLTVLMHESVLRPEDRAFLEPWADLWRIEASGAFMTTYLEAVGGSRLVPENEQGVQVLLEAFLLEKAFMELDAELKAPSGMVGLPLAAIITLLGAEG

SEQ ID NO: 13736 - DNA, 1467 bp, Anabaena variabilis ATCC 29413
  CDS (1)..(1467)
atgcaaattcaaacaccagactgggtgaaaaacgctgtattctaccaaatctttccagaccgttttgctataagtaaacagtcccggaagcggctgttgcgtgatgtgcgttgggaagactgggacgcaatgccaacactgcaaggatacaaaggcggtgatttatggggcattatggagcagttggactatattcaagatttgggcatcgatgccatctactttacgcccatctttcagtctgccagcaatcaccgctatcatacccacgactattatcaagtagacccgatgttgggtgggaatgccgcttttaaggagttactagacgcggcccacgaacgcaatattaaagttgtcctcgatggcgtatttaatcattccagtcgaggatttttctttttccatgacgttttggaaaatggcccccattctccttgggtaaattggttcaaaatagaaggctggcctcttgcaccatatacaggtgagttaccggcaaattacgtaggttgggctgataatcgtgccttgcccgtatttaatcacgataacccagacgtacgggaatatattatggaaattgccgaatattggcttaaattcggcatcgacggctggcgattggatgtaccatttgaaattaaaactcctggcttttggcaagaattccgcgatcgcgttaaagccattaaccccgaagcttatattgtgggggaagtgtggggagattcccgtgagtggctagatgggacgcaattcgacggcgtgatgaattacttatttgccgggccgaccattgcttttaccgcaggcgatcgcgtagtcttagaacaagtccaaagccgcgactatcaaccgtatccgcccctattcgccgccgaatacgccaccaaaattcaggaagtactgcaactttatccttgggaaattcaacttacccaactcaacttattagccagtcacgatacagccagactaatgaccattgctggcggtgatcaagccagtatagaattagctaccctattactacttacctttcctggtgcgccgagtatctactacggtgatgaagtgggtttaccgggaggtatagaccccgattctcgccggggttttcccttagaagccaactgggatagagaaatttaccagactcaccgtcaattaatagccttacgccacgcttacccagccttacgcacaggtgagtatcaagttatttgggcgcaaggtgcattgtatgtatttgcccgtactttaggtaaggaagaactgattattgctgtaaatgtaggtacagcaccagcccaggctaatgtagatgttgctagtttgcagactcagccagataaaatcctgtatggcgaagcagaatttagctggcacaatacagaagaaacaaaacaactttccttaaatctccccccacgtagtggctgcattttgggtttaggggattag

SEQ ID NO: 13737 - protein, 488 aa, Anabaena variabilis ATCC 29413
MQIQTPDWVKNAVFYQIFPDRFAISKQSRKRLLRDVRWEDWDAMPTLQGYKGGDLWGIMEQLDYIQDLGIDAIYFTPIFQSASNHRYHTHDYYQVDPMLGGNAAFKELLDAAHERNIKVVLDGVFNHSSRGFFFFHDVLENGPHSPWVNWFKIEGWPLAPYTGELPANYVGWADNRALPVFNHDNPDVREYIMEIAEYWLKFGIDGWRLDVPFEIKTPGFWQEFRDRVKAINPEAYIVGEVWGDSREWLDGTQFDGVMNYLFAGPTIAFTAGDRVVLEQVQSRDYQPYPPLFAAEYATKIQEVLQLYPWEIQLTQLNLLASHDTARLMTIAGGDQASIELATLLLLTFPGAPSIYYGDEVGLPGGIDPDSRRGFPLEANWDREIYQTHRQLIALRHAYPALRTGEYQVIWAQGALYVFARTLGKEELIIAVNVGTAPAQANVDVASLQTQPDKILYGEAEFSWHNTEETKQLSLNLPPRSGCILGLGD

SEQ ID NO: 13738 - DNA, 3366 bp, Ralstonia eutropha JMP134
  CDS (1)..(3366)
atgaaacgcctgaccgaacccgccaacgccctgctgctcaacgcggatccgctctggtacaaggacgcggtggtctaccagcttcatatcaagtccttctacgacgcgaacggcgacggcgtgggggacttcgcgggcctgctggccaagctggactacctggtcgacctcggcattgacacgatctggctgctgccgttctacccgtctccgcggcgcgatgacggctacgacattgcggattaccgcaacgtgcatcccgactacggcacgctcgccgaagcccgccgcttcgtcggggctgcgcatgcgcgcggcatccgcgtcatcacggaactggtcatcaaccacacctcggaccagcatccgtggttccagcgagcgcgcaaggccaagccgggctccgccgcgcgccgctactacgtgtgggccgacaatgaccaggcctatgccggcacccgcatcatcttctgcgacaccgagaaatcgaactggagctgggaccctgtcgccggcgcgtacttctggcaccgcttctattcgcaccagcccgacctgaacttcgacaacccgcaggtcatgaacgaggtgctgtcggtcatgcggttctggctggacatcggcgtggacgggctgcggctggacgctgtgccttacctcgtcgaacgcgaaggcaccacgaacgagaacctgcccgagactcataccgcgatccggcatatccgctcgcatctcgattcccactaccagggacgcgtgctgctcgccgaggccaacatgtggccagaagatgcgcagcagtacttcgggcgcagcagcaccggcgacaagggcgacgaatgccatatggccttccacttcccgctcatgccgcgcatgtacatggccatcgcacgcgaagaccgcttcccgatcaccgacatcatgcgccagacgccggagctgccgaccgactgccagtgggcgatcttcctgcgcaaccatgacgaactgacgctcgagatggtcaccagcagtgagcgcgactacctgtgggaagtctatgcgtcggaccggcgcgcacgcatcaaccttggcatccggcgcaggctggcgccgctgatggaacgcgaccggcgtcgcatcgaactgatgaacagcctgctgttttccatgccgggcacgccagtgatctactacggcgacgagatcggcatgggcgacaacatccaccttggcgaccgggacggcgtgcgcacgccgatgcagtggtcgcccgaccgcaatggcggcttctcgcacgcggaccccgagcgcctggtgctgccgccgctgcagggccccctgtacggctacgaggccgtcaacgtcgaagcgcaggcgcgcgatccgcattcgctgctcaactggatgcgccgcatgctggcgctgcggcgcaagcaccgcgcgttcgggcggggcacgctgcgcttcctgtttccgggaaaccgcaagatcctggcctatctgcgcgagtacgaaggcgagcacatcctgtgcgtcgcgaacctgtcgcgggcgccgcaggccgtggaactcgatctttcggccttcaacgggcgcgtgccggtggagatgatgggcgccacgccgttccccgcgatcggcacgctgacctacctgctgacgctgcccccctatggcttctactggttcgtgctcagcgaggatgcccatccgcctgcctggcacgtctcggccccggaacagatgcccgaccagatcacgctcgtgctgcagaacaaggggcggcccgaactgacggaggccgcgcgccgcatgctcaacgatgaagtgctgccgccctatatccgccgccggcgctggttcggcgcgaaggacgacagcatccagcgcgccacactcgcctacatggccccgttcaccaaaggcaccacaggcgaggaaatctatctcggcgaagtggaagtcaggctttccggcggccgtaccgagcgctaccagcttccgcttggggtgctgtgggaccgcgagagtgccgatagcgtgtcccagctggcgcacgggctgtcgatggcgcgcgtacgccagggcagccgggtaggactggccacggatggcttcgtgctggaaccgttcgcgcgcgaggtcatccgcgcgctgcgtgcagacgccgaactgcaggggccacaggagaccatccgcttccgctccgagcccgggctgtccgcggtacagcccgagcaggaggaaatccagtggatgtcagcggagcagtccaacagctcgctggcgtacaacaacacggccgtgctcaagctggtgcggcgcctctccggcggcacacatccggaagtggagatgacgcgctacctgacggcgcagggttatccgcattcccctcccctgctgggcgaggtggtccggaccggcgcggacggcgtgccccatacgctgatgatggtgcagggctacatcctgaaccagggcaacggctgggactggacgctcgactacctcagtcgcgtgatcgatgacgcgctgcccgcgcaggaaagcgcggacgagttcgccgaagcgatgaacggctacgccaccatggccggcacgctcggccgacggctggccgagttgcatgcagtgctcgcgcgtcccaccgacgatcccgcctttgccccgcggccggctaccgatgctgaaacgcggcagtgggccgagcaggccatggcggctatcacgcatgcactggcattgctggaaaagcgcgcgcagaacgacccgaaatccgcaagcaagcgcttcatggccgacgtcgatacgctgctgaaggcgcgcgacgccctgcccgcactggtcaaccggcttgccgcagccgcgcccggcagcctgcagacacgattccacggcgacttccacctgggccaggtgctgattgcgcagaacgacacctacctggtggatttcgaaggcgagccgggtcagccactcgactggcgccggcgcaaaacctcgccactgcgcgatgttgcggggctgctgcgttcgatcgactacgccgctgcgaccgttggcacggaccggcaggaacgcacccacgcggagttgccgcccgcgctggcggagcgccgcggcggcttgctcgaacgcttccgcgaaaccgccagcgacgccttcctgggctgctaccggcgtcatatggaggcctccggcacgccgtgggccgacaacgcgcagtttcagccgctactcgatctgttcctgctggaacgcgctgcgtacgaagtcgaatatgaagcggccaatcgcgtcgcctggatcgaccttccggccagcgggctcgcgcgcatggtgcgcaagctcatggccggaaacctggaggcgcaatga

SEQ ID NO: 13739 - protein, 1121 aa, Ralstonia eutropha JMP134
MKRLTEPANALLLNADPLWYKDAVVYQLHIKSFYDANGDGVGDFAGLLAKLDYLVDLGIDTIWLLPFYPSPRRDDGYDIADYRNVHPDYGTLAEARRFVGAAHARGIRVITELVINHTSDQHPWFQRARKAKPGSAARRYYVWADNDQAYAGTRIIFCDTEKSNWSWDPVAGAYFWHRFYSHQPDLNFDNPQVMNEVLSVMRFWLDIGVDGLRLDAVPYLVEREGTTNENLPETHTAIRHIRSHLDSHYQGRVLLAEANMWPEDAQQYFGRSSTGDKGDECHMAFHFPLMPRMYMAIAREDRFPITDIMRQTPELPTDCQWAIFLRNHDELTLEMVTSSERDYLWEVYASDRRARINLGIRRRLAPLMERDRRRIELMNSLLFSMPGTPVIYYGDEIGMGDNIHLGDRDGVRTPMQWSPDRNGGFSHADPERLVLPPLQGPLYGYEAVNVEAQARDPHSLLNWMRRMLALRRKHRAFGRGTLRFLFPGNRKILAYLREYEGEHILCVANLSRAPQAVELDLSAFNGRVPVEMMGATPFPAIGTLTYLLTLPPYGFYWFVLSEDAHPPAWHVSAPEQMPDQITLVLQNKGRPELTEAARRMLNDEVLPPYIRRRRWFGAKDDSIQRATLAYMAPFTKGTTGEEIYLGEVEVRLSGGRTERYQLPLGVLWDRESADSVSQLAHGLSMARVRQGSRVGLATDGFVLEPFAREVIRALRADAELQGPQETIRFRSEPGLSAVQPEQEEIQWMSAEQSNSSLAYNNTAVLKLVRRLSGGTHPEVEMTRYLTAQGYPHSPPLLGEVVRTGADGVPHTLMMVQGYILNQGNGWDWTLDYLSRVIDDALPAQESADEFAEAMNGYATMAGTLGRRLAELHAVLARPTDDPAFAPRPATDAETRQWAEQAMAAITHALALLEKRAQNDPKSASKRFMADVDTLLKARDALPALVNRLAAAAPGSLQTRFHGDFHLGQVLIAQNDTYLVDFEGEPGQPLDWRRRKTSPLRDVAGLLRSIDYAAATVGTDRQERTHAELPPALAERRGGLLERFRETASDAFLGCYRRHMEASGTPWADNAQFQPLLDLFLLERAAYEVEYEAANRVAWIDLPASGLARMVRKLMAGNLEAQ

SEQ ID NO: 13740 - DNA, 2586 bp, Rhodobacter sphaeroides 2.4.1
  CDS (1)..(2586)
atgaatcagaatgtctctccctccaccgttgccgtccgccgcacggacggcatcgatcgcagccaaaccgactggtacaaggacgcgatcatctatcagctgcacatcaaggcgtttcaggacgccaatggcgacgggatcggtgacttcgcgggcctgatgcagcggctggattatgtgcaggcgctgggcgtgaccgcgatctggctgctgcctttctatccctcgccgctccgcgacgacggctacgacatctcggactatcgctcgatcaacccgtcctacggcgcgatgcgcgacttcaagctgttcgtgcaggaagcgcacaagcgcgggctgcgcgtcatcaccgagctggtcatcaaccacacctccgaccagcatccctggttccagcgggcccggcgggcgaagaagggatcggccgcgcgcgactggtacgtctggagcgataccgaccagaaattccccgaaacgcggatcatcttcctcgatacggaaaagtcgaactggacctgggatccggtggcaggcgcctattactggcaccgcttctattcgcaccagcccgacctgaacttcgacaatccccgtgtgctcgaggaagtgctcaagatcatgcgcatgtggctcgagatgggcgtcgacgggctccggctcgacgcgatcccctatctggtcgagcgcgagggcaccaacaacgagaacctccccgagacgcacgatgttctcaagaagatccgggccaacctcgaccagcatttccccgacaggatgctgctcgccgaggcgaaccagtggccggaggacacgcgcccctatttcggcgagggcgacgaatgccacatgggcttccatttcccgctgatgccgcggatgtacatggcgctggcgcaggccgaccggcatccgatcaccgacatcatccgccagacgcccgagatcccggaaggctgccaatggggcatcttcctccggaaccacgacgagctgacgctcgagatggtgacggccgaagagcgcgactacatgtggcgcttctacgccgaagattcgcgggcgcggatcaatctcggcatccggcgcaggctggcgccgctgatgaagaacgaccggcgcaagatcgagcttctgaaccagatgctgatgtcgatgcccggcacgcccatcgtttattacggcgacgagatcggcatgggcgacaactactatctcggcgaccgggatggcgtgcggacgcccatgcaatggtcggccgaccgcaacggcggcttctcgcgctgcaatccgcagcagctctacctgccgacgatcctcgatccggtctacggccatcaggcgatcaacgtcgaggcgcaggcggcggacccgtcgtcgctcctgaactggacgcgccgcctgatcgcggtgcgcaagcagcatccggccttcgggcgcggctcgatgagcctgctctatccgcgcaaccgcaaggtgctggcctatgtccgcagccacgagggcacggacatcctctgcgtggcgaacctctcggacacggcgcaggcggtcgagctggatctcgggcggttccgcggcgcggtgccggtcgagctcacgggccggtcggagtttccgccggtgggcgatctgccctacatgctgacgctgccgccctacggcttctactggttcatcctctccgaccagcaggcgctgccgagctggcaccagccgatgcccgagacgctgccggatttcatcacgctcacgacgcgcgacgggcgggccgagacggcgctcaccgggcgcgagacgcgccagctcgaggccgacgtgctgccgaactggctgccgctgcaacgctggttcggggccaaggaggagaagatcagcgcggtgaaactggccgttctgggctcgctgtcggccgatcatgccctcgtccggctcgaggccgatgtgggcggcgaggtgcagcagtatttcctgcccgcctccgcactctggggcgaggagcagctccgggccggggcgcccaagctgagcttcaccctggccaaggtccggcgcgggccgcaggtgggcgcgctcatcgacggggcctatgacgagcagatggcgcaggcgatgctcgaggcgctgcgcgacggtcgcagactgtctggtgccgggggcgaggtggtgttcgagccgggctcgggactggccgagatcgccgacccgggcgagccgcgctatctcggggccgagcagtcgaacatttccatcgccttcggcgaccgcctgatcctgaagctctaccgacgcctgcgggccggcgagcagccggacgtcgaggtggcgcgcttcctgacggaagtggcgggctacacccatacgccccgctatctcggcgtcgtgagcctgcgcccggcggagggcgaggcgaccgtcctcgccgcgggcttcgccttcgtggccaaatggggcaacgctggcgcggctcttcgacgcgctagtcggaactggcgaatccgggatgagacggccagcgccgaatggaaaggaggtaacatccggaacaaacgggcacttatgaagagaggaagtatagtgcacccatag

SEQ ID NO: 13741 - protein, 861 aa, Rhodobacter sphaeroides 2.4.1
MNQNVSPSTVAVRRTDGIDRSQTDWYKDAIIYQLHIKAFQDANGDGIGDFAGLMQRLDYVQALGVTAIWLLPFYPSPLRDDGYDISDYRSINPSYGAMRDFKLFVQEAHKRGLRVITELVINHTSDQHPWFQRARRAKKGSAARDWYVWSDTDQKFPETRIIFLDTEKSNWTWDPVAGAYYWHRFYSHQPDLNFDNPRVLEEVLKIMRMWLEMGVDGLRLDAIPYLVEREGTNNENLPETHDVLKKIRANLDQHFPDRMLLAEANQWPEDTRPYFGEGDECHMGFHFPLMPRMYMALAQADRHPITDIIRQTPEIPEGCQWGIFLRNHDELTLEMVTAEERDYMWRFYAEDSRARINLGIRRRLAPLMKNDRRKIELLNQMLMSMPGTPIVYYGDEIGMGDNYYLGDRDGVRTPMQWSADRNGGFSRCNPQQLYLPTILDPVYGHQAINVEAQAADPSSLLNWTRRLIAVRKQHPAFGRGSMSLLYPRNRKVLAYVRSHEGTDILCVANLSDTAQAVELDLGRFRGAVPVELTGRSEFPPVGDLPYMLTLPPYGFYWFILSDQQALPSWHQPMPETLPDFITLTTRDGRAETALTGRETRQLEADVLPNWLPLQRWFGAKEEKISAVKLAVLGSLSADHALVRLEADVGGEVQQYFLPASALWGEEQLRAGAPKLSFTLAKVRRGPQVGALIDGAYDEQMAQAMLEALRDGRRLSGAGGEVVFEPGSGLAEIADPGEPRYLGAEQSNISIAFGDRLILKLYRRLRAGEQPDVEVARFLTEVAGYTHTPRYLGVVSLRPAEGEATVLAAGFAFVAKWGNAGAALRRASRNWRIRDETASAEWKGGNIRNKRALMKRGSIVHP

SEQ ID NO: 13742 - DNA, 3417 bp, Burkholderia cepacia R18194
  CDS (1)..(3417)
atgatgaaacgcgaagattccctcgacgacgtacgccgcgcgcaattcccgtcgctcgcgccgggcggcacaccacgccggcgccgtgcacgccgccgcgcgccggcgctctgcgcggacgatccgctgtggtacaaggacgcgatcatctaccaggtgcacgtgaagtcgttctacgactcgaacaacgacggcatcggcgatttccccggcctgatcgcgaaactcgactacatcgccgaactcggcgtcgacacgatctggctgctgccgttctacccgtcaccgcgccgcgacgacggctacgacatcgccgattaccgcgacgtgcatcccgactacggcacgctggccgacgtgcggcgcttcatccgcgaagcgcatgcgcgcggcatccgcgtgatcaccgagctggtgatcaaccacacgtcggaccagcatccgtggttccagcgcgcgcgccgcgcgaaaccgggttcgacgcaccgcgactattacgtgtggtccgacaccgacacgaaatacgcgggcacgcggatcatcttcctcgatacggaaacgtcgaactgggcgcacgacccggtcgccggccagtactactggcaccgcttctattcgcaccagccggacctgaacttcgacaacccggccgtcgtgcgcgaggtgatgcaggtgatgcgcttctggctcgatctcggcatcgacgggctgcggctcgacgcggtgccgtatctcgtcgcgcgcgagggcaccaacaacgagaacctgcccgagacgcacgcgatcctgaagcggatccgcgcgacgatcgacgccgagtacccgaaccggatgctgctcgcggaggcgaaccagtggccggaagacgtgcaggaatatttcggcgacgaggacgaatgccacatggcgttccacttcccgctgatgccgcgcatctacatgtcgatcgcgagcgaggatcgcttcccgatcgtcgacatcatgcggcagacaccggaactcgcaccgagcaaccagtgggccgtgttcctgcgcaaccacgacgagctgacgctcgagatggtcaccgactccgagcgcgatctgttgtggcagacctatgcgagcgaccggcgcgcgcggctgaacctcggcatccggcgccggctcgcgccgctgatggaacgcgaccggcgccgcatcgagctgatcaactcgctgctgctgtcgatgccgggcacgccggtgatctactacggcgacgaactcgggatgggcgacaacatccacctcggcgaccgcgacggcgtgcgcacgccgatgcagtggtcgtcggatcgcaacggcggcttctcgcgcgccgacccggaactgctcgtgctgccgccggtgatgggttcgctgtacggctatgacgcggtcaacgtcgaggcgcagacacgcgacccgcattcgctgctgaactggacgcgccgcatcctgtcgacgcgccgcgcgtcgcaggcgttcggacgcggcacgatccgcttcctgcgcccggagaaccgcaaggtgctcgcgtacctgcgcgagctggacggcgacgatccggtgctgtgcgtcgcgaacctgtcgcgcgcgtcgcaggccgtcgagctcgacctgtccgaattcgcgggccgcgtgccgatcgagatgacgtcggattcgccgtttccgccgatcggccagctcccgtatctcctcaccttcccgccgtacggattcctgtggttcgtgctcgccgagcatggccgcgagccgtcgtggcggcagccccatgcggagccgctgcccgaatacgtgacgctcgtgatgcggcgcggcgatgcgcggccggacatcgaacagctgcacgtgctcgcgcacgatgcgttgccgtcgtggctcgcgcggcggcgctggttcgcgtcgaaggaccgtgcgatcggcgcggcccggctgaacgtcgtcacgccggtgccgggcgaaccgttccagtatgcggaggcgtgggtcgaatccgatgagccaggcgacgtcgaacgctacgtcgtgccgctcgcggccgcgtggggcggtgaaacctcgcagccgctgttcgcgcagctcgcgctggcgcgtgtgcggcgcggccattcggtcggctacctgaccgacgcgttcgcgctgccggcgttcgcacacgggatgctgcgcaagctgcgcgacggcgcgacggtgccgacctccgatgacggccggctcgcgttcctgccggaagacgcgctcgccgcgctcgatcccggcgacaacgccgacgtgcgctggctcgcggccgagcagagcaacagctcgctcgtgatcggcgacgcgatcgtgctgaaactggtgcgcaaggtcgcgcacggcgtgcatccggaagcggaaatgagccgctacctgacgcggatcggctacccgaacaccgcgacgctcgccggtgaagtcgtgcacgtcgatccggacggcacgccgcatacggtcgcgatcctgcagcgctacgccgacaaccagggcgatgcgtggacgcgctcgttcgatttcctgcgccgcgcagtggacgagctcgcgctgccggccgcggacgaagaagagcccgacgatacggacgaggaacccgacgcgctgctcggctatgcggcgttcgcggggatcatcggcacgcggctcggccagttgcacgtcgcgctcgcgcagccgtccgacgatccggcgttcgcgccggagcacgcgacgcccgaacacgtcgacggctggtgcgcggacgcgatcgcatcgttcgaacacgcgctcgacgtgctgcacacgcggctcgatgcgctcgatcccgcgacgcgcgcggcggccgacacgctgctcgcgtcgcgcgatgcggccgtgcgcgcgctcggcgagctcgtgccgcgcacgctcgatgcgcaatgcatccggatccacggcgatttccatctgggccaggtgctcgacgtgcagggcgacgcgctactgatcgacttcgaaggcgagccggcacgcccgctcgagcggcgccgcgcgaaatcgcatccgctgcgcgacgtggccggcctgctgcggtcactgtcgtatgtgagcgcaatcgcgcaattcgcgatcgagaaggcgccaccgcaggcggccggccgcaagcgcgcgctgttcgaccgcttcgggcaggccgccgccgaccgcttcgtcgactgctatcgcgcggccgccgaactcgcccccgcgcgtttcgtcgacccgcgctacgcctatcgcctgctcgcgctgttcctgatcgacaaggcgtcgtacgagctgtgctacgaagccgcgaaccggcccgactggctaagcgtgccggtcggcgggctcgcggcgctggtcgaacggctgctcgatggcggcgccgcctccgacgacggagacacgccatga

SEQ ID NO: 13743 - protein, 1138 aa, Burkholderia cepacia R18194
MMKREDSLDDVRRAQFPSLAPGGTPRRRRARRRAPALCADDPLWYKDAIIYQVHVKSFYDSNNDGIGDFPGLIAKLDYIAELGVDTIWLLPFYPSPRRDDGYDIADYRDVHPDYGTLADVRRFIREAHARGIRVITELVINHTSDQHPWFQRARRAKPGSTHRDYYVWSDTDTKYAGTRIIFLDTETSNWAHDPVAGQYYWHRFYSHQPDLNFDNPAVVREVMQVMRFWLDLGIDGLRLDAVPYLVAREGTNNENLPETHAILKRIRATIDAEYPNRMLLAEANQWPEDVQEYFGDEDECHMAFHFPLMPRIYMSIASEDRFPIVDIMRQTPELAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAVNVEAQTRDPHSLLNWTRRILSTRRASQAFGRGTIRFLRPENRKVLAYLRELDGDDPVLCVANLSRASQAVELDLSEFAGRVPIEMTSDSPFPPIGQLPYLLTFPPYGFLWFVLAEHGREPSWRQPHAEPLPEYVTLVMRRGDARPDIEQLHVLAHDALPSWLARRRWFASKDRAIGAARLNVVTPVPGEPFQYAEAWVESDEPGDVERYVVPLAAAWGGETSQPLFAQLALARVRRGHSVGYLTDAFALPAFAHGMLRKLRDGATVPTSDDGRLAFLPEDALAALDPGDNADVRWLAAEQSNSSLVIGDAIVLKLVRKVAHGVHPEAEMSRYLTRIGYPNTATLAGEVVHVDPDGTPHTVAILQRYADNQGDAWTRSFDFLRRAVDELALPAADEEEPDDTDEEPDALLGYAAFAGIIGTRLGQLHVALAQPSDDPAFAPEHATPEHVDGWCADAIASFEHALDVLHTRLDALDPATRAAADTLLASRDAAVRALGELVPRTLDAQCIRIHGDFHLGQVLDVQGDALLIDFEGEPARPLERRRAKSHPLRDVAGLLRSLSYVSAIAQFAIEKAPPQAAGRKRALFDRFGQAAADRFVDCYRAAAELAPARFVDPRYAYRLLALFLIDKASYELCYEAANRPDWLSVPVGGLAALVERLLDGGAASDDGDTP

SEQ ID NO: 13744 - DNA, 1776 bp, Listeria monocytogenes str. 4b H7858
  CDS (1)..(1776): transl_table=11
atggaaaaagcagggatttatcatcaaccagcgagtagctatgcttatagttatgacgctaaaacactacatattcggattagaacgaaacgcttggatattagcgaggttactctaattgctgccgacccttacttatggaaagatggaaaatggcaaagtgaatcttatacaatgcgcaaaatcgcagaaacagaagagcacgattattggttttttgcaattacaccagaacatagacgtcttcaatatggctttttactaacagatacagaaggagaaacaacattttacggcggacgtggtttctttgagccaactgaggctaatttagctacgatggattattactttaaatttccatttatccatgcggtggatacttttgaggcgcctgaatgggttgggaatactatttggtaccagattttcccagaacgttttgcaaatgggaatccggctatttctccggaaaatgccttgccgtggggaagtaaagatccgaacacaacagactttttcggcggggatatagaaggaattatcgagcatttagattatttagcagagcttggtattaatggggtttatttgacacctgtgtttgaagcaccaaccaatcataaatacgatacggttgattataaaaaaattgatccacattttggagataaagaaacgtttagaaaattagttcaggaagcgcataaacgtgggattcgcattatgttagatgcggtgttcaatcacattggcgatacttcagcagagtggcaagatgttgtcttaaatgaagaaaaatctgcatatcgtgattggttccacatccatagtttccctgttcgtcaaaatgaaaatggcaatattgaaggagaaccaacactttcttacgatacatttgctttcacgacgcatatgccaaaattaaatacggctaacccagaagttcagaagtatctactggatattgcaacttactggattcgcgaatttgacattgatggttggcgcttagatgttgctaatgaagtagatcatgctttctggaaagaatttaaaaaggctgtccaagcggaaaaagaagatatttatattcttggtgaaatttggcatgattcgtggatttggttacttggagatgaattccacgccgtaatgaactatccatttacacaaacgattattgagaactttattgaagaaaaaatcacaccggagcaaatggtttctggtattaatgaacaatatatgcgctacccaaatcaagtgaatgaagtaatgtttaatatgcttgatagccatgatacggcgcgtattttaactcgtgctaataatgatgaggataaagtgaaacaagcgcttgccttcatgttcgcgcacactggttcgccgtgtatttattacggaactgaaatcggcatggacggaggaaatgacccaggttgccgtaagtgtatggaatgggatgaaacgaagcaaaaccaagatatgctagcgtttacgaaacaattaattgccctaagaaaagataaccaagcaattatcacatccggcgaattaacttggctaggtgcaagtagcgaaacgggcattacagcattttctaaagaattaaatggtgaaaaactgcatttccttttcaatcaagcaaaagaagataaagatttcacaatttcatttgaaaatacagcgacagatatttggaacaaccgagctgtaacagaaaatcttgttgtcccagcaaaaggatttcttgttgttaaagaaaacagctaa

SEQ ID NO: 13745 - protein, 591 aa, Listeria monocytogenes str. 4b H7858
MEKAGIYHQPASSYAYSYDAKTLHIRIRTKRLDISEVTLIAADPYLWKDGKWQSESYTMRKIAETEEHDYWFFAITPEHRRLQYGFLLTDTEGETTFYGGRGFFEPTEANLATMDYYFKFPFIHAVDTFEAPEWVGNTIWYQIFPERFANGNPAISPENALPWGSKDPNTTDFFGGDIEGIIEHLDYLAELGINGVYLTPVFEAPTNHKYDTVDYKKIDPHFGDKETFRKLVQEAHKRGIRIMLDAVFNHIGDTSAEWQDVVLNEEKSAYRDWFHIHSFPVRQNENGNIEGEPTLSYDTFAFTTHMPKLNTANPEVQKYLLDIATYWIREFDIDGWRLDVANEVDHAFWKEFKKAVQAEKEDIYILGEIWHDSWIWLLGDEFHAVMNYPFTQTIIENFIEEKITPEQMVSGINEQYMRYPNQVNEVMFNMLDSHDTARILTRANNDEDKVKQALAFMFAHTGSPCIYYGTEIGMDGGNDPGCRKCMEWDETKQNQDMLAFTKQLIALRKDNQAIITSGELTWLGASSETGITAFSKELNGEKLHFLFNQAKEDKDFTISFENTATDIWNNRAVTENLVVPAKGFLVVKENS

SEQ ID NO: 13746 - DNA, 1533 bp, Listeria monocytogenes str. 1/2a F6854
  CDS (1)..(1533): transl_table=11
ttggagttttggcgtcgtagtgtgttttatgaaatttatatgaaatcatttcaagatagtaatggtgatggtttgggtgattttaaaggtttaacgagcagattagattatctggtggatttgggaattgatggtatttggctgactccattttatccttcaccgcaagtagataatggctatgatgtttcggattactgtgacataaatccggattacggcgatatgactgattttcgagcgtttatgaaagcggcggattcacgaggaataaaagttattatcgacttagtgttaaatcattcatcaacagagcatgcttggtttaaggaatcgcgtagtagtaagacgaattctaaacgagattattatatttggagagaaaaaccaaataattgggagtcgttttttggtggttctgcttgggaaatggatgaacttactggcgagtactactatcatagttttgcaaaagaacaggctgacttaaactgggcgaatgaagctgttcgcgcagaaatagaggaagttttagcgttttggttgaatgaaggagtggcggggttcaggttagatgttatcaataatttaacgctcgcacttgaatttccggataatccagtcgcatctggtgaaatggagcatgtttatgaccgtaatcagaatggattagaacaagcgttagaggatatcgcttccttttgtcgaaaagagcgcgacgtgtttttagtaggcgaaattagctcggataaattacctgaaattacgcgatatagctcgaaaaaaatgctagatgtcacgtttaattttaattttggcagtgttgatcagctagatgcagaatctgtatttacgacattgaatgagatggaaacggcattaaacgaagggcagtggccgacgcttttctttggaagtcatgatatgagcaggttcagaagtcgcctcgcatctggagacttagtaaagacccaattgctcgcatttttgatgttaactgcgaaaggcgtgccgtttatatactacggagaagaggtgggtatgcctgatttaacgttttcttccgtaaaagagatgcgcgatattcaaggaacagccgcgtactatcgagctttacaaactggtacagataaaaaacaagcactcgaaatcgctattgaaaaaacgcgtgacaaagcacgtgggccgatgattttcccagatggaaagccatttactctaggtgaaccatggattaaaatggctactttgccggaagaagaagcacggatgatgtgggatttttatcgagctttactcgcatttcgtaaagaaaatgattttaaagagatggaatatacttttttgaagttggatggagaagtactcagttatcagcgaggtgaatttatctttttacttcattttggtgaggaagaggtaacttatctgcttcaggggaactatcagcttgtttttggagaagcgatgatggtagaaaatggtattagaatgggcgcgcatactggaattgcgcttagagtggaggaataa

SEQ ID NO: 13747 - protein, 510 aa, Listeria monocytogenes str. 1/2a F6854
MEFWRRSVFYEIYMKSFQDSNGDGLGDFKGLTSRLDYLVDLGIDGIWLTPFYPSPQVDNGYDVSDYCDINPDYGDMTDFRAFMKAADSRGIKVIIDLVLNHSSTEHAWFKESRSSKTNSKRDYYIWREKPNNWESFFGGSAWEMDELTGEYYYHSFAKEQADLNWANEAVRAEIEEVLAFWLNEGVAGFRLDVINNLTLALEFPDNPVASGEMEHVYDRNQNGLEQALEDIASFCRKERDVFLVGEISSDKLPEITRYSSKKMLDVTFNFNFGSVDQLDAESVFTTLNEMETALNEGQWPTLFFGSHDMSRFRSRLASGDLVKTQLLAFLMLTAKGVPFIYYGEEVGMPDLTFSSVKEMRDIQGTAAYYRALQTGTDKKQALEIAIEKTRDKARGPMIFPDGKPFTLGEPWIKMATLPEEEARMMWDFYRALLAFRKENDFKEMEYTFLKLDGEVLSYQRGEFIFLLHFGEEEVTYLLQGNYQLVFGEAMMVENGIRMGAHTGIALRVEE

SEQ ID NO: 13748 - DNA, 1662 bp, Listeria monocytogenes str. 1/2a F6854
  CDS (1)..(1662): transl_table=11
atgaaagaaaaagactggtggaaaaaaagcgtagtgtaccaaatctatccaaaaagttttaatgattcgaatggcgatggagtcggtgatattcaaggaattatcgagaaattagattatttaaaagagcttggcgtggacgttatctggttgtcccctgtatacgattcgccacaagacgacaatggttacgatattcgtgattatcaaaaaatttacgaagaatatggcgacatggcgacttttgatcagttacttcaaggtttacacgaccgcgatatgaaactcgtaatggacttagttgtaaaccatacttctgatgaacataagtggtttgaagaatctcggaaatccaaagataacccatatcgcgattactatttctggcgcgaggaaaacgaaatcaacaactggggttccattttcagcggtccggcatgggaattagacgaaaaaacaggcgagtactatttacacctgttctccaaaaaacaacctgatttaaactgggaaaaccctaaattacgccaagatgtatataatatgatgaaattctggctagataaaggcattgatggtttccgcatggacgtaattaattttatttccaaaaacaccgatttcccagatggtccagtgccagatggtcaaatttacggcgatgctggcaatgatttctgcaatggaccgcggattcatgagttcttgcaagaaatgaaccaagaagttacttccaaatacgatgtgatgactgttggtgaaatgcctggtgctagtacaactgacgcgcagatttatacgaatccagcaaataacgaagtcgatatgatttttacatttgaacatatgaacttagattccgatggcgacaataaatgggatttgaaaccaatttacttaccagatttaaaagaaaacatgtccgaatggcaagtggcgcttcaagaaaatggctggaacagcttatactggaacaatcatgaccaaccacgaatcgtttctcgcttcggaaatgacaatcgtttccgcgttcgttcagcgaaaatgctcgcaacttgtctgcatatgatgaaaggaacgccgtacatttatcaaggtgaagaaatcgggatgacgaatgttcattttgaaacgctagatgattatcgtgatatcgaaacgctaaacatgtacaaagaacgcaaagagcaaggccacagtcacgaaagcatcatgcagtcgatttacacaaaaggtcgcgacaatgcgagaaccccttatcagtgggataatagcgagaatgctggcttcacaaccggaacgccttggcttaaagtcaacccgcgctatacagaaatcaacaacgaagaagcgctgaaaaaccctgattccattttctactactaccaaaatcttattaagttacgaaaaacgactgaaatcatcacaaccggtaattatcgcctgttattacctaaagacgaagcgattttcgcatatgaacgctacacagaaaatgaaaaattagttgttttatgtaatttcacagaagaagaacaagttatttttgatgaaaacattttgaacgaactccaaaaaggttccgtgcttgtaaacaatgttccaaatattatagaaggaactttacgaccttacgaagcaatcgtttatcaaatcaagtaa

SEQ ID NO: 13749 - protein, 553 aa, Listeria monocytogenes str. 1/2a F6854
MKEKDWWKKSVVYQIYPKSFNDSNGDGVGDIQGIIEKLDYLKELGVDVIWLSPVYDSPQDDNGYDIRDYQKIYEEYGDMATFDQLLQGLHDRDMKLVMDLVVNHTSDEHKWFEESRKSKDNPYRDYYFWREENEINNWGSIFSGPAWELDEKTGEYYLHLFSKKQPDLNWENPKLRQDVYNMMKFWLDKGIDGFRMDVINFISKNTDFPDGPVPDGQIYGDAGNDFCNGPRIHEFLQEMNQEVTSKYDVMTVGEMPGASTTDAQIYTNPANNEVDMIFTFEHMNLDSDGDNKWDLKPIYLPDLKENMSEWQVALQENGWNSLYWNNHDQPRIVSRFGNDNRFRVRSAKMLATCLHMMKGTPYIYQGEEIGMTNVHFETLDDYRDIETLNMYKERKEQGHSHESIMQSIYTKGRDNARTPYQWDNSENAGFTTGTPWLKVNPRYTEINNEEALKNPDSIFYYYQNLIKLRKTTEIITTGNYRLLLPKDEAIFAYERYTENEKLVVLCNFTEEEQVIFDENILNELQKGSVLVNNVPNIIEGTLRPYEAIVYQIK

SEQ ID NO: 13750 - DNA, 3342 bp, Pseudomonas fluorescens PfO-1
  CDS (1)..(3342)
atggcgaagaaacccaaggcagccaccttcatcaaggacccgctctggtacaaggacgcggtcatctatcaagttcacgtcaaatcctttttcgattcgaataacgacggaatcggcgactttcccggcctgatcgccaaactcgattacatagccgatcttggcgtcaacaccatctggctgttgccgttctacccctcgccacgccgcgacgacggttacgacatcgccgagtaccgaggcgtgcacagcgattacggaacgatggccgacgccaagcgtttcattgccgaggcgcataaacgcgggttgagggtcatcaccgagctggtcatcaaccacacgtccgatcagcacccgtggtttcagcgcgcgcgcaaggccaagcccggttcggccgcgcgggacttctatgtgtggtcggatgacgaccagaaatacgacggcacccggatcatttttctcgacaccgaaaagtccaactggacctgggatccggtggccggtcagtacttctggcaccgcttctattcgcaccagccggatctcaacttcgataacccgcaagtcatgaaagccgtgctgtcggtcatgcgctactggctggacatgggcatcgacggcctgcgactggatgcgattccgtacctgatcgaacgcgacggcaccaacaacgaaaacctcccggaaacccacgacgtcctcaagcagatccgtgccgagatcgacgccaactaccccgatcgcatgctgctggccgaagccaatcaatggccggaagacacccagctgtacttcggcgacaccgacgccgagggcgtgaatggtgacgagtgtcacatggcgttccacttcccgttgatgccgcgcatgtacatggcgctggcccaggaagatcgcttcccgatcaccgacatcctgcgtcagaccccggaaatcccggccaactgccaatgggcgattttcctgcgcaaccacgatgagctgacgctggagatggtgaccgacaaggagcgcgactacctgtggaactactacgccgctgaccgtcgtgcgcggatcaaccttggcatccgccgccgtctggcgccgttgatggagcgtgaccgccgccgcatcgagctgctgaacagtctgctgttgtcgatgcccggcacgccgaccctgtattacggcgatgaaatcggcatgggcgacaacatctacctcggcgaccgcgacggtgtacgcacgccgatgcaatggtcgatcgaccgcaacggcggtttctcccgcgccgatccagccagtctggtactgccgccgatcatggacccgcaatacggttatcaatcggtcaacgtcgaaacccaggccggtgacccgcattcgctgctgaactggactcgccgcctgctggcggtgcgcaagcaatccaaggcattcgggcgcggcacgctgaaaatgctttcgccagccaaccgccgggtgctggcctacacccgtgaatacaccgggccggacggcaagcacgaaatcattctgtgcgtggccaacgtgtcacgcagtgctcaggcagtggagctcgacctgtcggcctacgttggcatggtgccggtggagatgctcggcggtaacgccttcccgcccatcggccagttgagtttcctgctgaccctgccgccttacggtttttactggttcggcctggcggcggaaaaccagatgccgagctggcacgtcgaaccggcgcagagcctgccggacttcaccacgctggtactgaaaaaacgcatggaagagctgctcgaagcgccgtcccgggccaccctcgagcaggcgattctgccgagctggctgcagaaccgccgctggttcgccggcaaggatgctgatatcgaacaggtgaaactggcctacggcgtgcgcttcggcgatgcacagcatccggtgctgttcagcgaaatcgaagtgcagagcggcgggcagaccagtcgttatcaattgccgttcggctttatttcggaagatcaggtcgggccggcgttgccgcaacaactggctttggcgcgggtacgccgggtgcgtcaggtcgggttgattaccgatgccttcagtcttgaagcgtttattcgcgctgtgctgcaaggcatgcagggcggcacggtgctcgaatccattgagggcgagatccgtttcgaggcaacgccgcaactggaaaaacttggcctgggcgcagagtccgaagtgcgctatctgtccgccgagcaatccaacagttcggtggtgatcggcaacagtctggtgctcaagctgatccgcaaagtcgcttctggcgtacacccggaactggagatgagcgcttacctgaccgctgctggatttgccaatatctctccgctgctgggctcggtgattcgccgcgacgggaagggcgaggacaacttgctgatgattgcgcagggctatctgagcaatcagggcgacgcctgggaatggacgcagaacaacctcgaacgggcgctgcgcgacgagctggccgacgccgtgtccgagcaggcgcagcactacaacgccttgggtgaactgaaggatttcgccgggatgctcggccagcgtctgggggaaatgcatcaggtgctggcagcgccgagcgacaaccaggacttcgcgccgcaagtcagttcggccaaggatgcgcaggcgacgggtaaggatgtcgcggcgcaggtcgagcatgccctgaagctgctcaaacagcatcagggcgagctcgatgcggcggatcagaagctggtcggtcggctactcgaccacaagaaagccatccttgcccacgtgcaggaactggccaagcaatccgccggcggtctacggattcgtgtgcacggcgacctgcatttgggacaggtgctggtaatcaagggcgatgcctacctgatcgacttcgagggcgaaccggcgcggccactggccgagcgccgtggcaagcacagtccgtacaaggacgtcagcggagtgctgcgctccttcgactatgccgccgcgatggcgctgaatgtacacaacgtcgacaacagccccgaggccgaagccgcgcgtcggcgggtcacggagcgttacctgcgtgaagcccgggaagcatttctccaggcatatcgccaagcggcagctagtcttgatcatgcctggcaagatcctgaaggtgccgacgccgcactggcgttgttcggtctggagaaagcggcctacgaagtggcctatgaagccgaaaatcgccccacctggctgcccgtgccgctgcacggtctgtatgggttattgacggggctcaaacccttttccgatcttggtggagagtag

SEQ ID NO: 13751 - protein, 1113 aa, Pseudomonas fluorescens PfO-1
MAKKPKAATFIKDPLWYKDAVIYQVHVKSFFDSNNDGIGDFPGLIAKLDYIADLGVNTIWLLPFYPSPRRDDGYDIAEYRGVHSDYGTMADAKRFIAEAHKRGLRVITELVINHTSDQHPWFQRARKAKPGSAARDFYVWSDDDQKYDGTRIIFLDTEKSNWTWDPVAGQYFWHRFYSHQPDLNFDNPQVMKAVLSVMRYWLDMGIDGLRLDAIPYLIERDGTNNENLPETHDVLKQIRAEIDANYPDRMLLAEANQWPEDTQLYFGDTDAEGVNGDECHMAFHFPLMPRMYMALAQEDRFPITDILRQTPEIPANCQWAIFLRNHDELTLEMVTDKERDYLWNYYAADRRARINLGIRRRLAPLMERDRRRIELLNSLLLSMPGTPTLYYGDEIGMGDNIYLGDRDGVRTPMQWSIDRNGGFSRADPASLVLPPIMDPQYGYQSVNVETQAGDPHSLLNWTRRLLAVRKQSKAFGRGTLKMLSPANRRVLAYTREYTGPDGKHEIILCVANVSRSAQAVELDLSAYVGMVPVEMLGGNAFPPIGQLSFLLTLPPYGFYWFGLAAENQMPSWHVEPAQSLPDFTTLVLKKRMEELLEAPSRATLEQAILPSWLQNRRWFAGKDADIEQVKLAYGVRFGDAQHPVLFSEIEVQSGGQTSRYQLPFGFISEDQVGPALPQQLALARVRRVRQVGLITDAFSLEAFIRAVLQGMQGGTVLESIEGEIRFEATPQLEKLGLGAESEVRYLSAEQSNSSVVIGNSLVLKLIRKVASGVHPELEMSAYLTAAGFANISPLLGSVIRRDGKGEDNLLMIAQGYLSNQGDAWEWTQNNLERALRDELADAVSEQAQHYNALGELKDFAGMLGQRLGEMHQVLAAPSDNQDFAPQVSSAKDAQATGKDVAAQVEHALKLLKQHQGELDAADQKLVGRLLDHKKAILAHVQELAKQSAGGLRIRVHGDLHLGQVLVIKGDAYLIDFEGEPARPLAERRGKHSPYKDVSGVLRSFDYAAAMALNVHNVDNSPEAEAARRRVTERYLREAREAFLQAYRQAAASLDHAWQDPEGADAALALFGLEKAAYEVAYEAENRPTWLPVPLHGLYGLLTGLKPFSDLGGE

SEQ ID NO: 13752 - DNA, 1629 bp, Rhodospirillum rubrum
  CDS (1)..(1629)
atgtcgggtcaggaatggtggaaacgggccgttatctatcaaatctatccgcgcagtttccaggatgccgatggcgatggcatcggcgatttggccggcatcgcccaacgcctggattacctgtcgtggctgggggtggacgcgatctggatctcgcccttctatacctcgccgatgaaggatttcggctacgacattcaagactaccgcgatgtcgatccgatcttcggcaccctggccgatttcgacgccctggcggcgcgggcccgcgcgctggggctgaagctgatcttggatttcgttcccaaccacacctctgatcggcatccgtggtttctcgaatcccgccaatcgcccgccagcgccaagcgcgactggtacatctggcgcgacccggccgccgatggcggcccgccgaccaactggctggccgaattcggcggcagcgcctgggaatacgacgaagccagcggccagtattactaccacgccttcctcaaggagcagcccgacctcaattggcgcaatccagaagtccgcgcggcgatgtatgacgccatgcgcttttggctcgagcgcggggtggatggcttccgcgtcgatgtgatgtggcatctgatcaaggacgaccagttccgcgacaatccgcccaatccggcccgcccgcccaatgccggtccggccaatgccctgatcccgctctacaccgccgatcgccccgaagtgcacgacatcgtgcgcgagatgcgcgccgtggtcgacgcctatcccgaacgcgtgctgatcggcgagatctggctgcccaccgatcgcctggtcacctattacggccatgatctgcgcggtgcccatctgccctttaatttccaattgatcggcgccgcctgggacgccggcgtcatcaaagagatcgtcggcgactacgaaaaggccctgccccggggcggctggcccaattgggtgatgggcaatcacgacaagggccgcatcgccagccgcctgggcccccggcaggcccggctggccatgctgctgctgctcaccctgcgcggcacccccaccctttactatggcgacgagatcgccatgcgcgacgtgccgatcccccccgaccgggtctgcgatccttacgaaaagaacgtgcccggcctgggtctggggcgcgacccccagcgcacgccgatgcaatgggaggacgctccccaggccggcttcacccgcgcttcccgatcctggttgccgatcgccgccgatgcctcaacggtcaatgtcgccgcccaacgcgcggcgccggcctcgatgctgaccctcgtccaccgcctgatcgccctgcgcaaagccgaagcggccctaactatcggcgattatggggcgctcgacgctcccgagcgggtggtgatgttcctgcgccgcgttcccgggcgccgcctgctcatcgccctcaatctgggggaaagcgcccaaagcctgagcctgcccggcgacagccgccaagccaccaccctgctgtccaccgacccggagcgcccgctgggcgatctggccccggccttcacccttggcgggggcgagggcatcgtcgttttgctggccgaccgggaaacggcccccccgtccccggcggcgtaa

SEQ ID NO: 13753 - protein, 542 aa, Rhodospirillum rubrum
MSGQEWWKRAVIYQIYPRSFQDADGDGIGDLAGIAQRLDYLSWLGVDAIWISPFYTSPMKDFGYDIQDYRDVDPIFGTLADFDALAARARALGLKLILDFVPNHTSDRHPWFLESRQSPASAKRDWYIWRDPAADGGPPTNWLAEFGGSAWEYDEASGQYYYHAFLKEQPDLNWRNPEVRAAMYDAMRFWLERGVDGFRVDVMWHLIKDDQFRDNPPNPARPPNAGPANALIPLYTADRPEVHDIVREMRAVVDAYPERVLIGEIWLPTDRLVTYYGHDLRGAHLPFNFQLIGAAWDAGVIKEIVGDYEKALPRGGWPNWVMGNHDKGRIASRLGPRQARLAMLLLLTLRGTPTLYYGDEIAMRDVPIPPDRVCDPYEKNVPGLGLGRDPQRTPMQWEDAPQAGFTRASRSWLPIAADASTVNVAAQRAAPASMLTLVHRLIALRKAEAALTIGDYGALDAPERVVMFLRRVPGRRLLIALNLGESAQSLSLPGDSRQATTLLSTDPERPLGDLAPAFTLGGGEGIVVLLADRETAPPSPAA

SEQ ID NO: 13754 - DNA, 3303 bp, Rhodospirillum rubrum
  CDS (1)..(3303)
atgagcgacttcctatggtacaaggacgccatcgtctatcagcttcatgtaaaagccttttttgattcgaacggtgacgggttcggcgatttcaaggggctgaccgaaaagctggattacctctccgatcttggggtgacggcggtgtggatcttgccgttctatccctcgccgctgcgcgatgacggctatgacatcgccgattacaaggccatccaccgcgcctatggcaccatgggcgatttccgccgcttcgtgcgcgaggcccatgagcgcgggttgaaggtcatcaccgaactggtgatcaatcacaccagcgatcagcacgcctggttccagcgcgcccgcgaagccaagcccggcagcaaggcccgcgacatgtacgtgtggtccgacaccgaccagcgctatttggatacgcgcatcattttcaccgataccgaaacctcgaactgggcctgggatccgctggccaaggcctattactggcaccgcttcttcgcccatcagcccgatctcaactgggacaatccgcgaattttcgaggagatcacccgggtgatgaagttctggcttgattgcggcgtcgatggcatgcgcctggacgccattccttatttggtcgaacgcgacggcacgaataacgaaaacctgcccgaaacccatgtcgtcctcaagcggctgcgcgcttggcttgatgcccattatgaagaccggatgttcctggccgaggccaatcaatggcccgaggacgtgcgcgagtatttcggcgaagccggcgacgaatgccacatggccttccactttccggtgatgccgcgcatctatatggccgtggcccaggaagaccgccatccgatcaccgatatcatgcgccagaccccggagatcccagcggcttgccaatgggcgatcttcctgcgcaatcacgatgaactgacgctcgaaatggtcaccgaccgcgagcgcgactatatgaacaccttctatgccaatgattcgcgggcccgaatcaacgtcggcatccgtcggcgcctggcgcctttgcttgataacgatcgccgcaagatcgaattgctcaacagccttttgatgtcgatgccgggtacgccgatcatctattacggcgacgagatcggcatgggcgacaatattttcctgggcgatcgcgatggcgtgcgcacgcccatgcaatggtcgcccgaccgcaacggcggcttttcgcgggccgatcccgcctcgctttatctgccgacgatcatggatgcggtctatggcttcttcgccgtcaatgtcgaggcccagtcgcgctcgccatcctcgctgctcaactggatgcgccggctgatcgccgtgcgcaagcgccacccctccttcgggcgcggcaccttgcgctttctctatcccggcaaccgcaagatcctggcttacttgcgggaattcgagggcgaggtgatcttgtgcgtggccaatctgtcgcgtgccccgcagccggccgaattggggctggccgagttttccgggcgggttccggtcgagatgctgggcaacagcgtctttccgccgatcggcgagttgcactatttcatcaccctgccggcctatggcttctattggttccgcctgtcgaagggcgaggggccgagctggcatgaaccgccggtcgagcccttgcccgatctttcgaccctggttcttccccgtatctgggacagcctgggcagcgatgggcccttgcgccagatccagggggatatcctgccggccttcctgcccaagcaacgctggttctctggcaaggagcattccctgcgcggcgtcgagatgaccgaccacgcggtgatttcggcccccggcgccgcttcgggctggatgctcgccctgtggcgcgccgattacaaggatggcgccccggggcaaaccttccaattgccccttgatatcgcctgggaaagtcgcgaggacgatcccttgtcccggctgctgccctttaccttggcccgggtgcggcgggtcaaccgcgttggcgccctctatgacgccatggccggcccggctttcccgctcgccttggtgcaggcgatggccgaaggcgcgaacgtgacgacggccaagggcggcggtttgcgcttcacccggacccaggccttccccgccggcccgcttcccggccccgaagcggtggcccgcctggggcgtgagcaatccaacacctcgatcaaacttggcgaggatatggttctcaagctctatcgccgggtcgaggccgggattcatccagaaatcgaaatcggccgcttcctgaccgatgtcgccggcttcgccaacgccccgccgctgcttggcgcgctcgagcatatcgatgctaagggcgccatctcggccctggcggtgctgcagggcttcgtgcgcaatcagggcgatggctgggactacatgctggcctatctcgaccgcttcctcgacgacagggcccaggcgccggccgaggtcggcgagggcggcgggccggccggctcgccccatggcatcatccacgcccaggccgatatccttggccagcgcgtcgccgagcttcaccacgccttcgccaccccgaccgaggacccggccttttccgccgaagccgtcgggccggaggatctggcgagctggcgcgagcaagtgcgcacccaggcggcccaggcccgtcaggcccttgacaccgccttgcccgggctgtccgcagaggtggcggggctggtcacccgactgctggactgctgggagcggatcgacgcccgcgtcgacgcgccgatttctttggccgaggggctggtcaaaacccgcatccatggcgaccttcatctggggcaggtggtggtggtgcgcgatgacttccatattctcgatttcgagggcgagccggtgaagggactgagtgagcggcgcgacaaacactgcccgttgaaagacgtggccggcatgcttcgctcgttcgattacgcggcgtggtcggcggcgctgagcttccgccaaacccatgccgaggtgcggatcgacgtactgcccgcgcttggcgtttggcaggaggaaatccgcgaggctttcctcgccggctatgaccgggccatcgccggatgtccctcggttccggcccttgaggaggggcgaagggacctcctttcactattcatgctggaaaaagccctctatgaggtatcttacgaagccgccaatcgtccggactggttacgaattcccatcggcggcgttttgcgcctgcttggagaggggccatcggacgagatcaaaccgcgttga

SEQ ID NO: 13755 - protein, 1100 aa, Rhodospirillum rubrum
MSDFLWYKDAIVYQLHVKAFFDSNGDGFGDFKGLTEKLDYLSDLGVTAVWILPFYPSPLRDDGYDIADYKAIHRAYGTMGDFRRFVREAHERGLKVITELVINHTSDQHAWFQRAREAKPGSKARDMYVWSDTDQRYLDTRIIFTDTETSNWAWDPLAKAYYWHRFFAHQPDLNWDNPRIFEEITRVMKFWLDCGVDGMRLDAIPYLVERDGTNNENLPETHVVLKRLRAWLDAHYEDRMFLAEANQWPEDVREYFGEAGDECHMAFHFPVMPRIYMAVAQEDRHPITDIMRQTPEIPAACQWAIFLRNHDELTLEMVTDRERDYMNTFYANDSRARINVGIRRRLAPLLDNDRRKIELLNSLLMSMPGTPIIYYGDEIGMGDNIFLGDRDGVRTPMQWSPDRNGGFSRADPASLYLPTIMDAVYGFFAVNVEAQSRSPSSLLNWMRRLIAVRKRHPSFGRGTLRFLYPGNRKILAYLREFEGEVILCVANLSRAPQPAELGLAEFSGRVPVEMLGNSVFPPIGELHYFITLPAYGFYWFRLSKGEGPSWHEPPVEPLPDLSTLVLPRIWDSLGSDGPLRQIQGDILPAFLPKQRWFSGKEHSLRGVEMTDHAVISAPGAASGWMLALWRADYKDGAPGQTFQLPLDIAWESREDDPLSRLLPFTLARVRRVNRVGALYDAMAGPAFPLALVQAMAEGANVTTAKGGGLRFTRTQAFPAGPLPGPEAVARLGREQSNTSIKLGEDMVLKLYRRVEAGIHPEIEIGRFLTDVAGFANAPPLLGALEHIDAKGAISALAVLQGFVRNQGDGWDYMLAYLDRFLDDRAQAPAEVGEGGGPAGSPHGIIHAQADILGQRVAELHHAFATPTEDPAFSAEAVGPEDLASWREQVRTQAAQARQALDTALPGLSAEVAGLVTRLLDCWERIDARVDAPISLAEGLVKTRIHGDLHLGQVVVVRDDFHILDFEGEPVKGLSERRDKHCPLKDVAGMLRSFDYAAWSAALSFRQTHAEVRIDVLPALGVWQEEIREAFLAGYDRAIAGCPSVPALEEGRRDLLSLFMLEKALYEVSYEAANRPDWLRIPIGGVLRLLGEGPSDEIKPR

SEQ ID NO: 13756 - DNA, 3465 bp, Burkholderia fungorum LB400
  CDS (1)..(3465)
atgaagcgtgacgatccagcccaaaccacgtcgcaagcccactcgagcgccgccaccggcggcgtcgcgaaagcgcgcacgcatcggcgcggcaaacccgcggccttgagcgacgatccgctctggtacaaagacgcgatcatttaccaggtgcacatcaagtcattcttcgacgcgaacaacgacggcgtcggcgactttcccggcctgatcgcgaagctcgactacatcgccgaactcggtgtgaacgcgatctggctgctgccgttctatccgtcgccacggcgcgacgatgggtatgacattgccgattaccgcaacgtgcatccggactacggcaatctgtccgacgtaaagcgcttcattcaggaagcgcacgcacgcggcattcgtgtgattaccgaattggtgatcaaccacacgtcggaccagcatccgtggtttcagcgcgcgcgccgcgcgaagccgggttcgaaccaccgtaactactacgtgtggtccaacaccgatcagaagtatctggaaacgcggatcatcttcatcgattcggagccgtccaactggacgcacgatccggtagcgggcgcgtattactggcaccgcttctactcgcatcagcccgatctgaatttcgacaatccggccgtgttgagggaggtgctgcaggtcatgcgcttctggctcgatatgggcatcgacgggttacggctcgacgcggtgccgtatctggtggaacgtgaaggcaccaacaacgagaacctgccggaaacgcacgcggtgctcaagaagattcgcgccacgatcgacgccgaatatccgaaccggatgctgctcgccgaagccaaccagtggccggaagacgtgaaggaatatttcggcgacgaagacgaatgccacatggcgttccacttcccgctgatgccgcgcatctacatgtcgattgcgagcgaagaccgcttcccgatcaccgacatcatgcggcaaacaccggacctcgccgaaacgaaccagtgggcgattttcctgcgcaatcacgacgaactgacgctggaaatggtcacggattccgagcgcgactatctgtggaacacctacgcgagcgatcgccgcgcgcgcctgaatctcggcattcgccgccgtctcgcgccgttgatggaacgcgaccgccgccgtatcgagctgatcaattcgctgctgctctccatgcccggcacgcccgtgatctattacggcgacgaactcggcatgggcgacaacattcacctcggcgaccgcgacggcgtgcgcacgccgatgcaatggtcatcggaccgcaacggcggtttttcgcgcgccgaccctgagcaactcgtgctgccgccggtcatgggctcgctgtatggtttcgacgcggtgaatgtggaagcgcaaagccgcgacccgcattcgctgctgaactggacccggcgcatgctcgccacgcgtcgcgcgaagcagactttcgggcgcggcacgatccgtttcctgaagccggaaaaccgcaagattctcgcgtacctgcgcgagatgccgggcgagccgccgattctctgcgtggcgaatctctcgcgcgcgccgcaagcggtggagctcgatctgtccgaattcgacggctccgtgccgatcgaaatgaccgcggactccgtgttcccgccgatcggccaactgacgtatctgctgacgttcccgccgtacggcttcctgtggttcatgctgtgccccggcggccaacgtcctacctgggctcaagcgccttctgagccgctgcctgaattcgtcacgatcgtgattcgcgaaggccaggtcggtccgacgccggagaacgtgcgcctgctcgaatcggaagtgctgccttcatggctgagccggcgccgctggtttgcgtcgaaggatcagaagctcaatgcggtgcggctcgcggcattgaccacgattccgaacggcggctttgcgttcaccgaaatcgaagcggacgtgggcaagcataccgaacgctacgtggtgccgatcgcgattacgtggggcggcgaaaccactttcccgctgttcaagcaactggcgttggctcgcgtgcgacgcggccgcaatgtcggtcatctgacggacgcgttcgccctgccgatcttcgctcatggcgtgatgcgcaagctgcgcgaacgcgccgtggtgccgaccgtgcagaagagcgaaatcaggttcctgccgaccgaacgtttcgccgaactcgaaggactcggcgaacggcccgagatccgctggctcgcggcggagcagagcaacagttcgctgatcatcgcggacgccgcggtgctgaaactggtgcgccgtctcgtgagcggcattcatccggaagccgaaatcagccgctatctgacgcaattgggctatgcgaacaccgcgccgctgtatggcgaagtggtgcgcgtggatccggaaggcgtgccgcacaccctctgcattctgcaaggctatatcgacaatcagggtgacgcgtggaactggtcgctcgactatctgcgccgctcggtggacgaactcgccattgccgtcgataccgaaacgcagtcggtgccggaccgttccaacgaggcgattctggtggaaggctacagcacgctggccggcatcatcggcagacgcctgggcgaactgcacgtggcgctcgcctcgccgacggacgacccggcattcgcgccggaacccgccagcgcggagcaggtgaaggcatgggtcgacggcacgcaggccatgctcgccagcgcgctggatctgctcgcgccgcgtatcgagcagatgagcgatacggaaacccgggcgctggcgcagagcctgatagaccgtcgtgcggcattggttgccgctgtcgactcgctggtttccgccaacgcgggcgcgctgcgcattcgcattcacggcgatttccacctcggccaggtgctggtcgcgcagggcgacgcgtatctgatcgactttgaaggcgagccggcacggacgctcgaacaacgtcgtcagaaatcgagcccgttgcgcgacgtggccggtctgctgcgctcgctctcatatgccagcgcggccgcgcaatccaccacggaagccgcgccgcaacagaccgccgatcgcaagcgcgcgctgttcgaccgtttccgcgcgcatgccgcggagaagttcctcaacgagtaccgcgcggccgctgcggaagcggcaacgccgctcgtcgcgcccgaagccgaacaggccttgctcgatctgttcctgatcgaaaaagccgcgtacgaaatccgttacgaagcggccaaccgcccgacgtggctcagcctgccggtacgcggccttgccgcgctcaccagccgcctgctcggcgataccggcgcgccgggccacgattcctcaaaccaggcgccaggcgccgccacaccgcctaatccggccgagggcgactatgagtga

SEQ ID NO: 13757 - protein, 1154 aa, Burkholderia fungorum LB400
MKRDDPAQTTSQAHSSAATGGVAKARTHRRGKPAALSDDPLWYKDAIIYQVHIKSFFDANNDGVGDFPGLIAKLDYIAELGVNAIWLLPFYPSPRRDDGYDIADYRNVHPDYGNLSDVKRFIQEAHARGIRVITELVINHTSDQHPWFQRARRAKPGSNHRNYYVWSNTDQKYLETRIIFIDSEPSNWTHDPVAGAYYWHRFYSHQPDLNFDNPAVLREVLQVMRFWLDMGIDGLRLDAVPYLVEREGTNNENLPETHAVLKKIRATIDAEYPNRMLLAEANQWPEDVKEYFGDEDECHMAFHFPLMPRIYMSIASEDRFPITDIMRQTPDLAETNQWAIFLRNHDELTLEMVTDSERDYLWNTYASDRRARLNLGIRRRLAPLMERDRRRIELINSLLLSMPGTPVIYYGDELGMGDNIHLGDRDGVRTPMQWSSDRNGGFSRADPEQLVLPPVMGSLYGFDAVNVEAQSRDPHSLLNWTRRMLATRRAKQTFGRGTIRFLKPENRKILAYLREMPGEPPILCVANLSRAPQAVELDLSEFDGSVPIEMTADSVFPPIGQLTYLLTFPPYGFLWFMLCPGGQRPTWAQAPSEPLPEFVTIVIREGQVGPTPENVRLLESEVLPSWLSRRRWFASKDQKLNAVRLAALTTIPNGGFAFTEIEADVGKHTERYVVPIAITWGGETTFPLFKQLALARVRRGRNVGHLTDAFALPIFAHGVMRKLRERAVVPTVQKSEIRFLPTERFAELEGLGERPEIRWLAAEQSNSSLIIADAAVLKLVRRLVSGIHPEAEISRYLTQLGYANTAPLYGEVVRVDPEGVPHTLCILQGYIDNQGDAWNWSLDYLRRSVDELAIAVDTETQSVPDRSNEAILVEGYSTLAGIIGRRLGELHVALASPTDDPAFAPEPASAEQVKAWVDGTQAMLASALDLLAPRIEQMSDTETRALAQSLIDRRAALVAAVDSLVSANAGALRIRIHGDFHLGQVLVAQGDAYLIDFEGEPARTLEQRRQKSSPLRDVAGLLRSLSYASAAAQSTTEAAPQQTADRKRALFDRFRAHAAEKFLNEYRAAAAEAATPLVAPEAEQALLDLFLIEKAAYEIRYEAANRPTWLSLPVRGLAALTSRLLGDTGAPGHDSSNQAPGAATPPNPAEGDYE

SEQ ID NO: 13758 - DNA, 1821 bp, Thermobifida fusca
  CDS (1)..(1821)
atgaccacacagccggctcctggtgcgcgcccgacgccgaccgggtccgttcccgacacgttcacccacgcaaagccgcgcgacccctactggtacaagcacgcggtgttctacgaagtcctcgtccgcggcttctacgactccaacggggacggcaccggcgacttgcggggcctcatcgaaaaactggactacctgcagtggctcggcatcgactgcctctggctgctgccgatctacgagtccccgctccgcgacggcggctacgacgtctccgactacatgaagatcctgcccgagttcggccggatctccgacttcgtggaactcgtcgaaaaagcccaccagcggggcatccgggtcatcaccgacctggtcatgaaccacaccagcgaccagcacccgtggttccaagcctcccggcacgaccccgacggaccgtacggcaacttctacgtctggtcggacaccacggaacgctacagcgacgcgcgcatcatcttcatcgacaccgagcagtccaactggacctacgacgaagtgcgcggacagtactactggcaccgcttcttctcccaccagcccgacctcaacttcgagaacccggacgtccaggacgccatcctcgaagtgatgcggttctggctggaccttggcatcgacggtttccgcttggacgccgtgccctacctgtacgagcgggaaggcacgaactgcgagaacctcaaggagacccacgagttcctcaaacgcatccgcgccgaagtcgaccggctctaccccgaccgggtcctgctcagcgaagccaaccagtggcccgccgacgtcgtcgactacttcggcgactacgaatccggcggcgacgaatgccacatgaacttccacttcccgctgatgccgcgcatgttcatggcggtccggcgcgaacagcgctaccccatctcggaaatcctcgcgcagaccccgcctattccgcgcaactgccagtgggcgatcttcctgcgcaaccacgacgagctgaccttggagatggtcagcgatgaagagcgggactacatgtactccgaatacgccaaagacccgcggatgcgcgccaacatggggatccgccgccggctggcacccctcctggaaaacgacctcaaccagatcaaactgttcaccgcgctgctgctgtcgctgcccggctccccggtgctctactacggcgacgagatcgggatgggcgacaacatctggctgggggaccgcgacagcgtgcgcacccccatgcagtggaccccggaccgcaacgccggattctcccgctgcgacccgggccgcctctacctgccggtgatcatggacccgatctacgggtaccaggcgatcaacgtcgaagcacagcagaacaacccgaactcgctgctgaactggacccgcaacatgatccagatccgcaagcagcacccggtgttcgggacgggggacttcaccgaactccacgcgagcaaccccagcgtgttcgcgttcgtgcgcgaatacggcgacgaccggatgctgtgcgtcaacaacctgtcccggtttccccaaccggtggaactggacctccgccgcttcgaagggatcaccccgatcgaatgcacggggggagtgcacttcccgcccatcggggaactgccctacctgctgactctccccgggcacggcttctactggttccagcttccgcccgtcgccgaagagcagccgctcgcccagcccgtcaccaccgtccccgcagccccgcagcctcctgctccggcagaccgtcccgcgtccgacccgacccagcggtcctga

SEQ ID NO: 13759 - protein, 606 aa, Thermobifida fusca
MTTQPAPGARPTPTGSVPDTFTHAKPRDPYWYKHAVFYEVLVRGFYDSNGDGTGDLRGLIEKLDYLQWLGIDCLWLLPIYESPLRDGGYDVSDYMKILPEFGRISDFVELVEKAHQRGIRVITDLVMNHTSDQHPWFQASRHDPDGPYGNFYVWSDTTERYSDARIIFIDTEQSNWTYDEVRGQYYWHRFFSHQPDLNFENPDVQDAILEVMRFWLDLGIDGFRLDAVPYLYEREGTNCENLKETHEFLKRIRAEVDRLYPDRVLLSEANQWPADVVDYFGDYESGGDECHMNFHFPLMPRMFMAVRREQRYPISEILAQTPPIPRNCQWAIFLRNHDELTLEMVSDEERDYMYSEYAKDPRMRANMGIRRRLAPLLENDLNQIKLFTALLLSLPGSPVLYYGDEIGMGDNIWLGDRDSVRTPMQWTPDRNAGFSRCDPGRLYLPVIMDPIYGYQAINVEAQQNNPNSLLNWTRNMIQIRKQHPVFGTGDFTELHASNPSVFAFVREYGDDRMLCVNNLSRFPQPVELDLRRFEGITPIECTGGVHFPPIGELPYLLTLPGHGFYWFQLPPVAEEQPLAQPVTTVPAAPQPPAPADRPASDPTQRS

SEQ ID NO: 13760 - DNA, 1563 bp, Microbulbifer degradans 2-40
  CDS (1)..(1563)
atggataccaatgccgatggtgtgggtgatattccaggaattgtgcaaaagctcgattacatagccagtttaggtgttgatgcgatatggatatcgccattttttaaatcgcctatgcacgactttggctacgacattagcgactatcgcgacgtagacccattatttggcaccttggatgacttcgatctacttatcgatgaagcgcataagcgcggcattaaagtaatgatcgaccaagtgctaagccacacttctgccgagcatgaatggtttaaagagagccgccaatcacgcgataaccccaaagccgattggtatgtttgggccgaccctaatgaagatggcacgccccctaataactggctcgctatttttggcggcagcgcttgggaatgggattcgcgtcgcggtcagtactacctgcataactttttgaaaagtcagccagatttaaacttccactgcgaagatgtacaaaaccaaattttgcaggaagtagagttttggctaaaacgcggtgtagatggcctgcgtttggatgctattaacttttgtttccacgataagcagttgcgcaacaacccgcctaaaagtgcaagtgagcgcaaagcgcgcgggtttagtgaagataacccctacgcttttcagtggcatacctacaacaacacccagccagaaaacctcgcgtttttgcagcgcctgcgcagcttgatggataagtaccccaataccgttaccttgggcgaaatatcttcagacgattcgctggcaacaatggctgagtacaccgccgataacgacaagttacatatggcttacagctttgagctactagccgatgagttttctgcggcttatattcgcgaaaccgttggcacacttgagtcgcgcttaaacgatggctggccctgttggtctattggcaatcacgatgtaccacgtgtggctagtcgctggggcaaagaagatgcatgcgatgcgctttctattgtactcaacgccatgttgctctctttgcgtggcagcgtatgttgttatcagggtgaagagctgggtttgaaagaagccgagctaaccttcgagcaattacaagacccatacggcattaccttctggcccaagtttaaaggtcgcgatggctgccgcacacctatgccgtgggatagccagcaacatgcaggctttagtaacggcgcgccatggctgccagttgcagacgatcacaaagccaaaaacgtgaccgttcagcagcaagcggatttatcggtactacaggcgtacaaacaatttattgcttggcgaaaaacgcagccagaaattttgtacggcgatatcgcgttcctttcgtcgcatgaatccaccttggcgtttacgcgcagctacgaaggcagcacattatttgccgcgtttaatttatctaacaccgaacaagtagtaaacctacctgcaggtgagtggaccgcactggaaggccacggccttagcgccgcagtgagtgccactcaaatcacattacctccttttggcggttttttcgccaagcaggcaagcaacagttag

SEQ ID NO: 13761 - protein, 520 aa, Microbulbifer degradans 2-40
MDTNADGVGDIPGIVQKLDYIASLGVDAIWISPFFKSPMHDFGYDISDYRDVDPLFGTLDDFDLLIDEAHKRGIKVMIDQVLSHTSAEHEWFKESRQSRDNPKADWYVWADPNEDGTPPNNWLAIFGGSAWEWDSRRGQYYLHNFLKSQPDLNFHCEDVQNQILQEVEFWLKRGVDGLRLDAINFCFHDKQLRNNPPKSASERKARGFSEDNPYAFQWHTYNNTQPENLAFLQRLRSLMDKYPNTVTLGEISSDDSLATMAEYTADNDKLHMAYSFELLADEFSAAYIRETVGTLESRLNDGWPCWSIGNHDVPRVASRWGKEDACDALSIVLNAMLLSLRGSVCCYQGEELGLKEAELTFEQLQDPYGITFWPKFKGRDGCRTPMPWDSQQHAGFSNGAPWLPVADDHKAKNVTVQQQADLSVLQAYKQFIAWRKTQPEILYGDIAFLSSHESTLAFTRSYEGSTLFAAFNLSNTEQVVNLPAGEWTALEGHGLSAAVSATQITLPPFGGFFAKQASNS

SEQ ID NO: 13762 - DNA, 1671 bp, Oenococcus oeni PSU-1
  CDS (1)..(1671)
atgtcaaaaaaacaatggtttaaagatacagtagtttatcaagtatacccaatgagtttccaggatagcgataacgatggaattggcgacctgccggggattacaaaacgacttgactatatcaaaaaactaggtgccgatgtcatttggttaaacccgatttatgagtcacccaacaaagacaacggatatgatattgccaattatcgagctatcaacccggagtacggatcgatgaatgattttgatgatttacttaacaaagctcaccaattaaaccttaaaattatgatggatctagtcgttaaccatacttccgatcaacatcattggttccaggaaagtaaaaaaaccaaagacaatccgttttccgatttttatatttggagagatccggtagatggtcacgaacctaataattggttggccgcatttggtggttcagcatggacttatgttccggaacgcaaacaatattatttgcatttgtttgcaaccggtcaaccggatctcaattgggagaatccggatgttcgccaagcagtctttgatatagaacgtttttggctcgataaaggggttgatggttttagaatggacgttattaatcttatttcaaaaccaaagggtctgcctgatgttccggaacctgccaccgcaggaaagacgatggatttcgtagcggatgggcatcgcctaaatgagtttttgagtcaaatgaacagcgaagtattgtccaaatatgacactataacggttggtgaaatgcctggatcaactactgaagacgctattaaatacacgggccttaacagccatgaactgaatatggtatttcagtttgagcatgtcggtttaagtcccaatccggatgttagattgggaaagtggaatgaccagcctgttaaactgactgaattaaaagcctcgttgaacagatggcaaactggtcttgacggcaaaggatggaacagcctttactggaacaatcacgatcaacctcgggcagtatcccgttttggaaatgacgatcctaagtatcgtgttctatcggccaaaatgctggctacaactcttcacttgatgcagggcactccttatgtatatcagggtgaggagcttggaatgacaaatgctcacttcacaaaattaaatcaatacgaggatatcgaatctattaatttttatcatgagttggtcgaacaagaaaaaattgtcgatgggccaacaatgctaaaatatctggcaaatatttcacgtgataatgcccgtacgccaatgcaatggaacgataaaaacaatgccggattctcaagtgcaaaaccatggtttgcccttaaccctaattacaaatcaattaacgttgaggattcattggctgacaaaaattccgtattctattattatcaaaaattaattaagcttcgtcacaataatgaaataatcaaatatggaagcttcgaggaaatagaccccgatgacgatcaagtatacgcatatcgtcgtcattacgaaggaaaaactttgttacttataagcaattttaccgataaaatcgtaagtcgcgattacggtcaatcgaacgcttcaagtttgcttatagataattatgaagatgataaagtaaacgagttaagaccgtatgaggcgaaagcttatctatttaaatga

SEQ ID NO: 13763 - protein, 556 aa, Oenococcus oeni PSU-1
MSKKQWFKDTVVYQVYPMSFQDSDNDGIGDLPGITKRLDYIKKLGADVIWLNPIYESPNKDNGYDIANYRAINPEYGSMNDFDDLLNKAHQLNLKIMMDLVVNHTSDQHHWFQESKKTKDNPFSDFYIWRDPVDGHEPNNWLAAFGGSAWTYVPERKQYYLHLFATGQPDLNWENPDVRQAVFDIERFWLDKGVDGFRMDVINLISKPKGLPDVPEPATAGKTMDFVADGHRLNEFLSQMNSEVLSKYDTITVGEMPGSTTEDAIKYTGLNSHELNMVFQFEHVGLSPNPDVRLGKWNDQPVKLTELKASLNRWQTGLDGKGWNSLYWNNHDQPRAVSRFGNDDPKYRVLSAKMLATTLHLMQGTPYVYQGEELGMTNAHFTKLNQYEDIESINFYHELVEQEKIVDGPTMLKYLANISRDNARTPMQWNDKNNAGFSSAKPWFALNPNYKSINVEDSLADKNSVFYYYQKLIKLRHNNEIIKYGSFEEIDPDDDQVYAYRRHYEGKTLLLISNFTDKIVSRDYGQSNASSLLIDNYEDDKVNELRPYEAKAYLFK

SEQ ID NO: 13764 - DNA, 1482 bp, Trichodesmium erythraeum IMS101
  CDS (1)..(1482)
atgcaaattcaaacaccagaatgggttaaacaggctgtattttaccaaatttttccagatcgttttgctaaagctcaaccaacgactgaaactggaaaaggaatagacaaaggttggtatcccagcagtctagaaccttgggatgaatatcctactcctcaaggttataaaggagggaacctctggggtgtcattaaaaaacttgactatcttcaggaacttggtatcacagctatttactttacaccaatttttcagtcaacctgtaaccaccgctatcatactcatgactattatcgagtcgatccaattttaggaggtaatgaggctttaagggtattaatagatactgctcacgatcgcaatattaaagtggttcttgatggagttttcaaccacgctagccggggtttttatttctttaacgatatcctggaaaacggtccttattctccctggttgcattggttcaaaatagaaaattggcctctgtctgcttacgatggtagtttacctgctaattatgtgggttggttagataaccgtgctttacctgtttttaatcatgacaacccagaggtcaaagaatacattatggaaattggagaatattggttaaaatttggtattgatggttggcggttggatgtaccttttgaagtgaagactcccgggttttggcaagaatttcgcgatcgcgttaaggctattaacccagaagcatatattgtgggtgaagtctggagtaactgcgcacaatggttggatggtactcagtttgatggagtgatgaattacttatttactggtccaactattgcttttactgtaggcgatcgtgtggatcttgagcaaattgaaggccgtgactatgtagcttatccggctatatctgctgttgaatacggtcaaaaaatgcaggagttactgcaactttacccttgggaaattcaattaactcaactcaatttattagatagtcatgatacagctagagttttgagtattgctaaaggggataaagcaagtgttgaattagcgactctgttgttaatgacttttcccggagcaccaagtatttattatggtgatgaggtaggtttaccgggtaagtttgaccctgactgtcgtcgtagttttcctactactgaaaaatgggatcgtgaagttctggaatatcataaacagttaattgctattagaaaagaatattcagctttgcgcactggtaattacgaagtgttgtttgccgagggaaatgtttatatttttgctcgtattttagaagaggaagaaattattgtagctgttaacattggtatagaagcagcaaaagtaaatgttatttttaataagcttaaatctcaacctaataaagttgtttatggtagttgtaaaatttcctggcaaggaggagatgaagctagtaaattagagttatatttgccaggaagaaaaggttgtattttggttaaagattaa

SEQ ID NO: 13765 - protein, 493 aa, Trichodesmium erythraeum IMS101
MQIQTPEWVKQAVFYQIFPDRFAKAQPTTETGKGIDKGWYPSSLEPWDEYPTPQGYKGGNLWGVIKKLDYLQELGITAIYFTPIFQSTCNHRYHTHDYYRVDPILGGNEALRVLIDTAHDRNIKVVLDGVFNHASRGFYFFNDILENGPYSPWLHWFKIENWPLSAYDGSLPANYVGWLDNRALPVFNHDNPEVKEYIMEIGEYWLKFGIDGWRLDVPFEVKTPGFWQEFRDRVKAINPEAYIVGEVWSNCAQWLDGTQFDGVMNYLFTGPTIAFTVGDRVDLEQIEGRDYVAYPAISAVEYGQKMQELLQLYPWEIQLTQLNLLDSHDTARVLSIAKGDKASVELATLLLMTFPGAPSIYYGDEVGLPGKFDPDCRRSFPTTEKWDREVLEYHKQLIAIRKEYSALRTGNYEVLFAEGNVYIFARILEEEEIIVAVNIGIEAAKVNVIFNKLKSQPNKVVYGSCKISWQGGDEASKLELYLPGRKGCILVKD

SEQ ID NO: 13766 - DNA, 3288 bp, Thiobacillus denitrificans ATCC 25259
  CDS (1)..(3288)
atggaagaaaatgacccgctctggtacaaggacgcaattgtctacgaactgcacgtcaaggcgttcttcgacgccaacggcgatggcgcgggcgacttccggggcctgatcagcaagctcgactatctccaggaactcggcgtcaacgcgctctggctgttgccgttctacccgtctccgggccgcgacgacggctacgacatctcggattaccacaacctccacccctcgttcggcgacatggccgacttccgcaggttcatccgcgaagcgcaccagcgcggactgcgtgtcatcaccgagctcgtcgtcaaccacacctccgaccagcatccgtggttccaggcggcgcggcgcgcgccgcctggttcggtcaagcgcaactattacgtgtggagcgataccgacacgcgcttcagcgaaacgcgcatcatcttttcggataccgagaaatcgaactgggcgtgggatgaagtcgcgcaggcctactactggcatcgcttcttctcccaccagcccgatctcaacttcaacaacccgcacgtcttcaaggccatcatgcgcacgatgcgcttctggttcgatgcgggcgtcgatggcatgcggctcgacgccgttccctacctgtgcgagcgcgacggcacgagcaacgaaaatctgcccgagacgcacgcggtcatccgaaggatgcgcgccgaactcgacgcgcgctacagcaaccgcatgttcctcgccgaagccaaccagtggcccgaggacgtgcgcgagtatttcggcaacggcgacgagtgccacatggcctaccacttcccgctgatgccgcgcatgtacatggcgatcgcgcaggaggatcgccacccgatcgtcgaaatcatggaacagacaccggacatccccgacctttgccagtgggccgtgtttctgcgcaaccatgacgaactgacgctcgagatggtgaccgaccgcgaacgcgactatctctatcaggcctacgcgagcgacccgcaggcccgcctcaatctcggcatccgccgccgcctggcgcccttgctcgacaacgaccgccaccgcatcgagttgatgaatctgctgctgatgacgatgccgggctcgccgatcgtctattacggcgacgagatcggcatgggcgacaacctcctgctcggcgaccgcaacggcgtgcgcacgccgatgcaatgggacggcggccccaacggcggattctcgtccgcgccgaccgagcgtctgttcctgccgccgatcaccgatccggtctacggctacggcgcggtaaacgtcgaggcgcagcagcgcaatccctcgtcgctgctgaactggacccggcggctgatcgcaatgcgcaaggcgcaccgcgcgctcggtcgcggcacgctgcgcttcctgcggcctggcaaccgcaaggtgctcgcctatctccgcgaatacgagggcgagacgattctgtgcgtggccaacgtcgcgcgtgcgccgcaggccgtcgaactcgatctctcgcccttcaagggacacgtgccggtcgaactgatggggcgcagcagcttcccgccgatcggcgagttgccctatctgctgacgctcggcggatacggctgtttcgtgttccggctcgcgaccgacgtcgaggcgccggcctggcacgaagaaaggccggtgccgcccgatctgcccgtgctcgttttggtcgacgcgggctggcgcacgctcttcgcgcggaccgacgaaggcgtgaaccagctcatggtgcggcgtgcacgcgagcagctcgagcgccagatcattccgcgctacttccggacgcagccgtggttcgtctacagcgaggccgcgctcgagaaattcgagttcgggaccttgcgcgagtgggggaccgacagcggaacctggctgctcgcgaccgtcaccgtcacgctcctcgacggcagcatttatcactacgcgctgccgctgggcctcgcctgggaagacgaagacgaaggccgcgtcgccgccctgctgcacgtgacgctcgccaaggtgcggcggctggcgcgggtcggcatcctgttcgacgccttctgggacgacggcttctgttgcgcgatcgtctccgccatggagcgcggcgagacgcttgcctacggcgacggccacctgacgttccgcacggccagcgcctaccccggattcttctgtccgcttgtcacgtcgtcgatcacccgtacggtctccgaacacgggcgtctgcgcgtgaatctcaacgaccagctggtcctgaaaagctatccgcgacaaatgcagggcacgcatcccgagctcgagatgtcccggttcctcaccgagaccgcgaagtttgcgcacatcccgcaactcggcggcacggtcgaatacgtcgcgagcagcggcaggcactccacgctcgcgatcctcgagcgctatgcgcccaaccagggcgacgcctgggcctacacgctcaactacctcgaacgttttctcgatctcagccgcacgacgggcgagcaggcgcccgacggccggcacggtcgctacatggggctgatgaagacgctcggcgagcgcacggccgagttccatcgcgcgctcgcgaccccggatcgctcgggcgacttcggcagcgagccgatcgcgccgccggatattctggagtgggtcaacaaggtacggcacgagatgggcgtgatgtacgagctgctcgaacgtgccttgccggctttgccggagcccgtggccgtcgccgcgcagcagctttttctcgttcgccccaagctctaccggcgcgtcatccgcgcctcgcgcgtgcgtgtcgacgcgagcaagacgcgctgccacggaaactatcacctcggtcaggtctggctcgtgcaaaacgatttcctgatcgcgaattacggcggcatacccggccgcagctgggaagaacgccgcgcaaagcacgcgccgctgcgcgacgtcgctagcatgctgctttcgctgtcgcaggcgggcgcggccgcgctcgcgcgtgtcgccggcgactccgtcgatgtgatggcggccctgcagccccatgtcgacgcatgggagctggcggcgcgcaaggcgttctaccgcggttaccgcaagggcatggacggtcatgccgcgtacccgacggacgcgaccgcggccgaggccttgctgactttgttcctggctgaaaaagcgattgcggagctgaccgaggcgctcgaacgccgcgccgtcggcagcgctgctgcaatgcgtcggctggttcaggtgacacgccgttga

SEQ ID NO: 13767 - protein, 1095 aa, Thiobacillus denitrificans ATCC 25259
MEENDPLWYKDAIVYELHVKAFFDANGDGAGDFRGLISKLDYLQELGVNALWLLPFYPSPGRDDGYDISDYHNLHPSFGDMADFRRFIREAHQRGLRVITELVVNHTSDQHPWFQAARRAPPGSVKRNYYVWSDTDTRFSETRIIFSDTEKSNWAWDEVAQAYYWHRFFSHQPDLNFNNPHVFKAIMRTMRFWFDAGVDGMRLDAVPYLCERDGTSNENLPETHAVIRRMRAELDARYSNRMFLAEANQWPEDVREYFGNGDECHMAYHFPLMPRMYMAIAQEDRHPIVEIMEQTPDIPDLCQWAVFLRNHDELTLEMVTDRERDYLYQAYASDPQARLNLGIRRRLAPLLDNDRHRIELMNLLLMTMPGSPIVYYGDEIGMGDNLLLGDRNGVRTPMQWDGGPNGGFSSAPTERLFLPPITDPVYGYGAVNVEAQQRNPSSLLNWTRRLIAMRKAHRALGRGTLRFLRPGNRKVLAYLREYEGETILCVANVARAPQAVELDLSPFKGHVPVELMGRSSFPPIGELPYLLTLGGYGCFVFRLATDVEAPAWHEERPVPPDLPVLVLVDAGWRTLFARTDEGVNQLMVRRAREQLERQIIPRYFRTQPWFVYSEAALEKFEFGTLREWGTDSGTWLLATVTVTLLDGSIYHYALPLGLAWEDEDEGRVAALLHVTLAKVRRLARVGILFDAFWDDGFCCAIVSAMERGETLAYGDGHLTFRTASAYPGFFCPLVTSSITRTVSEHGRLRVNLNDQLVLKSYPRQMQGTHPELEMSRFLTETAKFAHIPQLGGTVEYVASSGRHSTLAILERYAPNQGDAWAYTLNYLERFLDLSRTTGEQAPDGRHGRYMGLMKTLGERTAEFHRALATPDRSGDFGSEPIAPPDILEWVNKVRHEMGVMYELLERALPALPEPVAVAAQQLFLVRPKLYRRVIRASRVRVDASKTRCHGNYHLGQVWLVQNDFLIANYGGIPGRSWEERRAKHAPLRDVASMLLSLSQAGAAALARVAGDSVDVMAALQPHVDAWELAARKAFYRGYRKGMDGHAAYPTDATAAEALLTLFLAEKAIAELTEALERRAVGSAAAMRRLVQVTRR

SEQ ID NO: 13768 - DNA, 1815 bp, Chloroflexus aurantiacus
  CDS (1)..(1815)
atgtatctgcgcttcagtggcagaccaggtgacacagcggtatttcggctccgtatggccgcagacgcaccggtcagtggggtcttcctccgcacctgcccggatggggaacagcattttacgccactgcgcgatctgggagtgcgcggggtgtgccggtggtgggaaggtgagctaccgatccgcatgctccgcaccaattaccgcttcctgatccgcgcagatgactgttcgcgctggtacagcgctggtggcatcacccgtcactaccccaccgacgcaaatgatttcgtggtactggccaactatcacgcgccagcctgggtacgtgatgcggtcttctaccagatttttccggatcggtttgccgatggcgacccgacgaataatgtccgcgatggtgcgtatctctaccacggacgaccggttgttgcgcgccgctgggatgaacgacccaaccgggcgaccggatcgatagagttctacggtggcgatttgcaagggatcgcgcagcgcatcgactatctgaccgatctgggagtctcggcactgtatctcaatcctatcttccgagcaccatcgaaccacaaatacgatgtcgaagactataccagcattgatccacacctgggaggtgaagcagggttactccgcttacgtgaggtactcgacgagcgagccatgaagctggtgcttgacatcgtaccgaaccattgtggagtgacccatccgtggtttgtcgctgcccaggccaacccacgagcaccaacagccgagttcttcatgttccgtcgtcatcccgacgactacgagagctggctgggggtcaagaccctgcccaaactcaattaccgcagtgtccgcctccgcgacgtgatgtacgcaggccaggatgcgattatgcgctactggttacgaccaccctatcggatcgacggctggcggattgatgttgccaatatgctggggcggttggggacagacaaccttggccacaagattggacgcgggatttggcgggcagtgaaggcagagcaaccggaagcctatctgctgggtgaacacttcttcgacggtactccccatctgcaaggtgaagagcttgatgccacaatgaattatcaaggcttcacctttcccatctggcgctggttgggagggtttgagttcaatccgcagcggcctgaagccgatccacgaccgattgcaaccgagacggtcgttgcgcaatggacggcatttcgggcagcgataccgtggcagatcgccagtcagcaattcaacctgttgggaagtcatgacaccccgcgtctacggacaatcgtaggcgatgatctggcgcgagtgcgggtagcgatgacgttactcttctgctatccgggggtgccgtgtatctactacggtgacgaaattggactgacgggcggcggtgatcctgattgtcggcgaccgatgccgtgggatgaacgagagtgggatcacgacctgcgggcgttcgtgcaacggctggcacgcttacggcgtcagtcgccggcgttgcgctggggcggctttcagcagctctacgcaaacggggaaacgattgccttccagcgcgaagcacctgaggagcgcatgatcattgtggtacggcgcagtgatgatgggcaacgcctgctgccggtgcgtcacggcgggctggctgatggggttcacctgcgggaactcttcagtggtgccgagacggttgtacgcaacgggatgctggacattgggaatttgccggccaccggtgcgcaaatctggcaaaccacagacaaagacaacgtgttctga

SEQ ID NO: 13769 - protein, 604 aa, Chloroflexus aurantiacus
MYLRFSGRPGDTAVFRLRMAADAPVSGVFLRTCPDGEQHFTPLRDLGVRGVCRWWEGELPIRMLRTNYRFLIRADDCSRWYSAGGITRHYPTDANDFVVLANYHAPAWVRDAVFYQIFPDRFADGDPTNNVRDGAYLYHGRPVVARRWDERPNRATGSIEFYGGDLQGIAQRIDYLTDLGVSALYLNPIFRAPSNHKYDVEDYTSIDPHLGGEAGLLRLREVLDERAMKLVLDIVPNHCGVTHPWFVAAQANPRAPTAEFFMFRRHPDDYESWLGVKTLPKLNYRSVRLRDVMYAGQDAIMRYWLRPPYRIDGWRIDVANMLGRLGTDNLGHKIGRGIWRAVKAEQPEAYLLGEHFFDGTPHLQGEELDATMNYQGFTFPIWRWLGGFEFNPQRPEADPRPIATETVVAQWTAFRAAIPWQIASQQFNLLGSHDTPRLRTIVGDDLARVRVAMTLLFCYPGVPCIYYGDEIGLTGGGDPDCRRPMPWDEREWDHDLRAFVQRLARLRRQSPALRWGGFQQLYANGETIAFQREAPEERMIIVVRRSDDGQRLLPVRHGGLADGVHLRELFSGAETVVRNGMLDIGNLPATGAQIWQTTDKDNVF

SEQ ID NO: 13770 - DNA, 4140 bp, Chloroflexus aurantiacus
  CDS (1)..(4140)
atgtttctccgcctgatgcacctcatccttgcgattggggtgctctttggtgcaacgattgcaccactctcctcggttgcgttcgccgatcacacgccattaccagcgtcagttaacctggcaggtgatttacagtcggaagcgaccggcggcgcctgtggcgattgggatccgggatgtgccgcagcggccttcagcgctcagggtaacggtgtctatctgttcgtctcgcagacgattccagcagggagctacgaatacaagatcgcaatggggagctgggctgaaaactatggggctaattttcagcagaatggccccaacatcccggtgacgctcggcagtgcacagagtgtacggttctactacgatcacaaaacccattatatcgccgacagcgtgcgtaacactatctacaccgtaccgggtaacttcaacgacgagatcgggtgcagtggtgactggcaaccagattgtctgcgcacgttcatgagtgatgttgatggtgatggtgtctttacatttgccactgacgccattccacccggcaattatgagttcaagattgccacaaatgagagctgggcaaacccaaattatggcgcatttgggaacaatgttccctttacagttaccggcccggcaaccgtcatttttagcttcaatacggcaactacgtatgttggtgtggaagtacgtagtgcactcccgcagcctgacaacaatgtggagtgggacggcgtttaccacaactcgcgcgatcctctttatcgcacgccgggaggtgctgtacctgccggtacaccggtgacaattcggctccgcaccttccacaatgatgtcacggcggtaaccctgcgggtgtacgatgtcaatgccggggcacagcggttcattccgatgagtgtcgtcgctgccaataccgactgttacggcgattatgggccacgtcggtgcgatttctgggcggctacgctgaatgaggcgcaaccgaacaacctctggtaccgctttattgtcaccgatggcagtgataccgactattacgccgataacaccgcagcgctcgatggcggcagcggacgtatgacggatgatgtcgttgacttcagttatgccttgatgttctacgatccggcattcacctcgccaaactgggcacgaacggcagtcatctaccagattttccctgatcgttttcgcaatggcgatccgcataacgatccgcaagacggtgacatccggtacgatgatccggtgattacgttgggttggggtgaattacctgaaggctattgccgtcactatgccgacgcaaccaccaattgtccgtggcggtttgacacgaccccaccggcctggagtccaactatcgaagggccacggggacgtgattactacggcggtgatttggccggcgtgatcgagcaacttgactacctccagcaattgggcatcacgaccatctacttcaatcccatctttgccgccggatcgaaccatcgctacgatacccgtgattactatcgcatcgatccctatcttggcaataacggcacctttgcgcacctggttcaggaggcgcggcggcgtgggatgcgagtgatcctcgatagcgtcttcaatcacatgtcgtcggatagccccttcttcgaccgctatagccattacacgaccctgggtgcctgcgagtcactggcctcgccatatcgcacctggttcaacttccgcacgaataatgttccgtgtacgagcgacgattatgtcggctggtttggcttcgactccatccccgaaatcaacaaatcaaacccggatgtgcagagctacttcttaaccggagccaacagtgtgacacgcttctggctacgacgcggtgccgccggttggcgcctggatgtgatgggagatgccagcttcccggcaggctattgggagacattccgcaccgtcgtgcgccagaccaaacgagacggtctgattattggtgagttgtggcagaaggactcaacattgctgcgccacctccgtgggcagactgccgatacaacgatgaactaccgtctgcgtgatgcggtgatcggcttgctcctgcctgggggaacgtttgacagcaaagggtttggtgacagtggccgggtcatcagtccatcagaattcttgagtcgactggcctcgatccgtgaagactacccggatgcagcctactacacgctcatgaatctgctcggcagccacgatacggagcggattctgtggacgcttacgcctggacaggagacacgcgccgataaggaattcaatgccgctaatctggcagaaggtaagcggcgtgtccaactggcctctctgatccaattcaccgtacccggtgcaccgaccgtgtattacggcgatgaagtaggagtcaccggcgatgatgatccagatgaccgccgcacctatccctggcctgatcagggtggtacacccgacaccaaccttctgaaccattaccgcagcctgaccgagctgcgcaaccgttatccggtgctggcgaagggtgatttcacaccgctgctggccgacgatgccgcaggcgttgtggcctatggtcgaaagtatcgcaataaagccgcgttggtgctgatcaatcgcagctcaacaacgcagacgatcacggtacccgtacagggctttctgcccaatggggtagaactctgcgcgctgtttaccgttggcaatcagctcgacgagacggtacaggtcgtgaacgggagcatccagatcacgctgaacccgctgagcggtacggtgctgatcagcgagccgggagccgatctcacgccaccggcggcccccaccaacctccaggtcaccgaagagggtgatcggtcggtaagcctgagctggcagcggcccagtggtggagcacaggcgtacaacatctaccgcagcccggttagtggcggtggttgggtcaaggtcaatactgcgccggtaagcggtctgagctttaccgacaccacggtagagaacgggcgaacctactacttcgttgtccgtgcgcttgacgccgtcgggaacgaagggccagcttcggcggaagtgagcgctctgccgcactaccggattgggtgggccaatttgcaatggccaccggcgatctcacacaccgtgtcggccatcaacaccaccccggatatttacgggcaggtctggatcgacggtgtaaccagtcagcccggcgcgacacctggcctgcgtgctcaggtgggatacggcccgcagggcagtgatccccgtgggagcaactgggtgtgggtggaggctaccttcaacgttgatgccggcaacaacgacgaattcaaggcgcaactccagcccgaaacggttggcaccttcgattacgtcttccgctacagcaccaccaacggacgcgactggctctacgccgacagcagtgggccgttcagtggcttaccgccacaaccaggcgtactcaccgttctttccagtggtgacacaacaccgccggcagtcccaaccggcctgcaagtgatcagcgcgtccccggcaggaatcgtcttgagctggaatgccgtcggtgatgcctatgcctacgaagtacgccgtatcgatggcaacggcaatgaactcatctttgcccgtacaactgcaaccaccttcaccgacaccggtgtcatgcagggggcaacgtacacctatgacgtgcgttctttagacatctccttcaaccgttcagccttcagcgcaccggtaacggctaccgccgaactccgcacggttacgctggtgatgaatgtgacggtaccgaccccggttgaagacgcgattgggcgcagcgtctacattgccggcttccttgaccggctcgacggtggtttaccgcagtggaatccgggtggtgtggtgatgacgcaggtctcggcaacacagtggacaatcaccttcaccggacgcgagggcacgcaactcgaatacaagtacaccctcggatcgtgggactacgttgagaagggtgcgacttgtgaagagctggccaaccggcaattgacgctgacctacggtacgagtggcgtgcagacggtcaatgacactgtgctcaactggcgaaatgtagacccgtgtgggaattag

SEQ ID NO: 13771 - protein, 1379 aa, Chloroflexus aurantiacus
MFLRLMHLILAIGVLFGATIAPLSSVAFADHTPLPASVNLAGDLQSEATGGACGDWDPGCAAAAFSAQGNGVYLFVSQTIPAGSYEYKIAMGSWAENYGANFQQNGPNIPVTLGSAQSVRFYYDHKTHYIADSVRNTIYTVPGNFNDEIGCSGDWQPDCLRTFMSDVDGDGVFTFATDAIPPGNYEFKIATNESWANPNYGAFGNNVPFTVTGPATVIFSFNTATTYVGVEVRSALPQPDNNVEWDGVYHNSRDPLYRTPGGAVPAGTPVTIRLRTFHNDVTAVTLRVYDVNAGAQRFIPMSVVAANTDCYGDYGPRRCDFWAATLNEAQPNNLWYRFIVTDGSDTDYYADNTAALDGGSGRMTDDVVDFSYALMFYDPAFTSPNWARTAVIYQIFPDRFRNGDPHNDPQDGDIRYDDPVITLGWGELPEGYCRHYADATTNCPWRFDTTPPAWSPTIEGPRGRDYYGGDLAGVIEQLDYLQQLGITTIYFNPIFAAGSNHRYDTRDYYRIDPYLGNNGTFAHLVQEARRRGMRVILDSVFNHMSSDSPFFDRYSHYTTLGACESLASPYRTWFNFRTNNVPCTSDDYVGWFGFDSIPEINKSNPDVQSYFLTGANSVTRFWLRRGAAGWRLDVMGDASFPAGYWETFRTVVRQTKRDGLIIGELWQKDSTLLRHLRGQTADTTMNYRLRDAVIGLLLPGGTFDSKGFGDSGRVISPSEFLSRLASIREDYPDAAYYTLMNLLGSHDTERILWTLTPGQETRADKEFNAANLAEGKRRVQLASLIQFTVPGAPTVYYGDEVGVTGDDDPDDRRTYPWPDQGGTPDTNLLNHYRSLTELRNRYPVLAKGDFTPLLADDAAGVVAYGRKYRNKAALVLINRSSTTQTITVPVQGFLPNGVELCALFTVGNQLDETVQVVNGSIQITLNPLSGTVLISEPGADLTPPAAPTNLQVTEEGDRSVSLSWQRPSGGAQAYNIYRSPVSGGGWVKVNTAPVSGLSFTDTTVENGRTYYFVVRALDAVGNEGPASAEVSALPHYRIGWANLQWPPAISHTVSAINTTPDIYGQVWIDGVTSQPGATPGLRAQVGYGPQGSDPRGSNWVWVEATFNVDAGNNDEFKAQLQPETVGTFDYVFRYSTTNGRDWLYADSSGPFSGLPPQPGVLTVLSSGDTTPPAVPTGLQVISASPAGIVLSWNAVGDAYAYEVRRIDGNGNELIFARTTATTFTDTGVMQGATYTYDVRSLDISFNRSAFSAPVTATAELRTVTLVMNVTVPTPVEDAIGRSVYIAGFLDRLDGGLPQWNPGGVVMTQVSATQWTITFTGREGTQLEYKYTLGSWDYVEKGATCEELANRQLTLTYGTSGVQTVNDTVLNWRNVDPCGN

SEQ ID NO: 13772 - DNA, 3363 bp, Chloroflexus aurantiacus
  CDS (1)..(3363)
atgaaccgtgtacgcccggccaagacgccgactctgttagccgatgatccgctctggtacaaagatgcggtcatctacgaattgcacgtgcgcgctttttgcgatagcaatggtgatggtatcggagattttcccggtctgaccagcaagctcgactatctgcaagatttgggcgtaacggcaatctggctgctccccttctatccctcaccgctgcgcgatgatggctacgatatagccgattatacgaacattcatcccaattacggcacgctggccgattttaaggtgtttattcgcgaagcccatcggcgtgggctgcgcgtcatcaccgagcttgtctgtaaccacacctctgaccagcacccctggtttcaacgtgcccggcgggctaagcccggtacttcagcccgcaacttttatgtctggtcggatacacccgaccgctacaaggacgcccggatcatcttcaaagattttgagaccagtaactggacgtgggatccagtggcgcaggcgtactactggcaccgcttctacagccatcaacccgatctcaactttgaaaatccggctgtccagcgggctgtcttcaaggcgatggagttctggctcgatctgggagtcgatggcatgcgtctcgatgccatcccctacctctacgaagcagagggcaccaattgcgagaacctgccggaaacccacgcctttctcaaacgcttacgtaagcatatggacgaaaagtaccaggggcgtatgtttctcgccgaggccaatcaatggccagaagacgcggttgcctatttcggggatggcgatgagtgccatatggcctttcacttcccggtgatgccccgcctctttatgtcggttcaccttgagaatcgctatccgatcattgatattatgcggcaaacgccgccaatacccgacaattgccagtgggcaatctttctgcgcaatcacgatgaactgaccctcgaaatggtcaccgatgaagagcgcgactatatgtaccgggtctacgctcgcgatccccaggcccggattaatctcggcattcgccgacgactggcaccattgctcggcaaccatcgccgcaagatcgagttaatgaacggattgctcttctcgctgcccggtacgccggtgatctattacggtgatgagatcgggatgggcgataacatctacctcggcgaccgcaacggtgtgcgcacgccgatgcagtggagcggtgatcggaatgccggtttttcgcgggctaatcctcagcaactctatctgccggtaattaccgatccggagtatcactacgagacggtcaacgtcgagacgcaaagcgccaatcagcattcattgttatggtggacgaaacgcctgattgcactacggaagcgttacgccgcatttggccggggcacgctcgaatttctctatcccgaaaatcgtaaggtgctctgtttcctgcgcaaaaccgaggatcagattctcctggccgttttcaatctgtcgcggtttgttcagggtgtcgaactcgatctctcgccgtaccgtggcctgatgccggttgagctattcggtcaggtggaatttccaccgattggcgatcagccctatttcctgacccttggcccacacagcttctactggtttacgctaacaccgcaacggattgaaggagtacgcttgcccacaccccaacctgaaaccgaactggttgagattccggttgatgcgattgagtgggatgcgatcttctacgatggccggcaggcgcggcttgagcgagtcttacccgattacctgcgttatcggcgctggtttggggccaaaacacgcaagatcaaacaggtgcaggtaagcgagtttgcccgtctcgattatgccggtggcccagcctacctgacactgttgcaggtcacctatgttgaaggcgccccagaaacctacttgttgccgatggcgtatgccgaaggcgagcgcgccgaccagatactggccgatcaacgccacatggtgattgcccgcctacgggttggccgtcgacctgaagccggtatcctgtacgacccactcggtgagcgtcgctttgcgtcggcgctcctggaactgataatcggacgacgccgtctacggggtgaagccggtggagagctggtgggtggcacgacccgtgcgctccgcaagcttctcggcggtagtgatggcctggaaccgagtttgatgcgtggcgagcagagcaattcatcgatcaattttggtggtcggctcattatgaagctcttccgtaagatcgagctgggccgcaatcccgatctggaactgggacgtttcctgaccgaagaggttgggttcccccatacaccaccggtagccggctacattgaatatctgcgcggcaaagatgaaccgttgacgctggcaatcgttcagggctatgtgcagaacgaaggtgatgccttcgattacgcgctcgatgtcgtgcgccgctactatgatacggtgctcacccgtaccgatgtcgtgccaccggttgtgaaggcaagcgttgccggcatgctcgcggctgcgcatcagccaccgccagccctggttgaggaattgatcggtggttacctcgagtcggcacgcctgctcggtcagcggactgcggagatgcatcaggctctggccaaaggaagtggaccggcaatggcacctgaacccttctcgaccctctaccagcgctcaatctaccagagtattcggagtctgatcgggcaaaccctgcaagatttgcggaaactgctgccgtcgttgccggcaaccgttcgtccggcggcagagcgtgttacccagagtgaagaggcgctcctggcgcggttgcaacggattaccggtgacaagatcgagacggtgcgtattcgcattcacggtgactaccatctcgaacaggtgctcttcaccggcaaagattacatgattatcgacttcgagggtgaaccactgcgcccaatcagcgagcggcggatcaaacgctcaccgttgcgtgatgtggccggcatgttgcgctcataccagtatgtcgcctatgccgctctatatgcccataatggtgcaagcagaagcgctgaagagatcgagcgacttcagcgctgggctgatatgtggagtttctgggtctgtgcagcctttcttaatggctatctgaccacagccggccatgaagcattcgtcccccaggatcaggccgatctcgaagccctgctcgagacgtttgtcgtcgaaaaagccgtctacgaactgggttacgagatgaacaatcgccctgactggctgccgatcccgatcaacggcatcttacgccagattgaagaatga

SEQ ID NO: 13773 - protein, 1120 aa, Chloroflexus aurantiacus
MNRVRPAKTPTLLADDPLWYKDAVIYELHVRAFCDSNGDGIGDFPGLTSKLDYLQDLGVTAIWLLPFYPSPLRDDGYDIADYTNIHPNYGTLADFKVFIREAHRRGLRVITELVCNHTSDQHPWFQRARRAKPGTSARNFYVWSDTPDRYKDARIIFKDFETSNWTWDPVAQAYYWHRFYSHQPDLNFENPAVQRAVFKAMEFWLDLGVDGMRLDAIPYLYEAEGTNCENLPETHAFLKRLRKHMDEKYQGRMFLAEANQWPEDAVAYFGDGDECHMAFHFPVMPRLFMSVHLENRYPIIDIMRQTPPIPDNCQWAIFLRNHDELTLEMVTDEERDYMYRVYARDPQARINLGIRRRLAPLLGNHRRKIELMNGLLFSLPGTPVIYYGDEIGMGDNIYLGDRNGVRTPMQWSGDRNAGFSRANPQQLYLPVITDPEYHYETVNVETQSANQHSLLWWTKRLIALRKRYAAFGRGTLEFLYPENRKVLCFLRKTEDQILLAVFNLSRFVQGVELDLSPYRGLMPVELFGQVEFPPIGDQPYFLTLGPHSFYWFTLTPQRIEGVRLPTPQPETELVEIPVDAIEWDAIFYDGRQARLERVLPDYLRYRRWFGAKTRKIKQVQVSEFARLDYAGGPAYLTLLQVTYVEGAPETYLLPMAYAEGERADQILADQRHMVIARLRVGRRPEAGILYDPLGERRFASALLELIIGRRRLRGEAGGELVGGTTRALRKLLGGSDGLEPSLMRGEQSNSSINFGGRLIMKLFRKIELGRNPDLELGRFLTEEVGFPHTPPVAGYIEYLRGKDEPLTLAIVQGYVQNEGDAFDYALDVVRRYYDTVLTRTDVVPPVVKASVAGMLAAAHQPPPALVEELIGGYLESARLLGQRTAEMHQALAKGSGPAMAPEPFSTLYQRSIYQSIRSLIGQTLQDLRKLLPSLPATVRPAAERVTQSEEALLARLQRITGDKIETVRIRIHGDYHLEQVLFTGKDYMIIDFEGEPLRPISERRIKRSPLRDVAGMLRSYQYVAYAALYAHNGASRSAEEIERLQRWADMWSFWVCAAFLNGYLTTAGHEAFVPQDQADLEALLETFVVEKAVYELGYEMNNRPDWLPIPINGILRQIEE

SEQ ID NO: 13774 - DNA, 1803 bp, Lactococcus lactis subsp. cremoris SK11
  CDS (1)..(1803)
atgtattactataatccatggaatttagattataagcaaccttttggtgcagtaaaagtagggcaagccattttattgaaatttgacgcaaatcaaactcaagtagaagtgaagtgcattattcgacgtgattttggaaaaagatatgaattccttatgagcagagatgagtcaggtttttttacagtcactatcccatttgatgaaaatgctggtctttatttttactattttgaaattttggagggctcagattgggaacaaaacaagcgtttttatgggagttctggaataggtggggaagggctgctctatactaacgaaaatgatattaaaccctatcagctgacagtttttgaaaaagaggacaaggcaccagcttggtatcgtgacgctgttttttaccagatttttcctgatcgtttccataatggaaatgaaaatgggcaagtcagccatccaaaaccgaattcttttatttatggaactaaatctgatacccctttttatgtgaaagaggaaaatggtgatattgctcgttgggatttctttggtggaaacctaagaggaatcattaacaaaatttcatatttaaaagaacttggaatcaatgccatttatcttaatccagttttttctgggacaagtaaccatcgttatgacaccaacgattatctaaaaatagattccatgttaggaactcaagaagattttcaagaattaatcaatttacttcatcaagaacaaatgcatttagttttggacggtgtcttttcacatgtaggtaaaaattcactttacttcaatatcaatggagattatggagatgatgaaggagcggcgaaaaatcctgactctccttattttgactggttcaagtttgaaaattatccttttgattataaatcttggtggggaattaaagatttacctgaaattgataaagataatgaatcctttcgtgattttatttatggtaggaaaaactctgttttatcaaagtggaatgacttgggaatagatggttggcgattagatgttgctgatgaattgcctgattcatttattaaagggattcgtgagaatcttgaccgttattcagaaaaaattctaataggagaaatttgggaggatgcttctaataagatttcttatggaacaagacgcaaatatattcttggcgggagcttacaggcttgtatgaactatccgtttcgtgatttaatcatcaatttattaaacggaaatcgctcatgtcaggatgtagctcatcaattgatgactttgcaggaaaactatcccaaagatattttttataacaacttaaataatttggggacccatgatacggaacgtattttaacaatggtcggaaaagaaaatctgccattagctgtttcactcttatttgttttaccaggaatcccttgtatttattatggtgacgaagcgggactttctggaggaaaggatccagaaaatcgtaaatattttccttgggatgatatttcaccagaaatatatgattattataagagttggacgaaaaagcgtctattagaaaatagtttgaaagaaggagaattttctagcttttatagtgacagactactaggaattttgcgctatacagattcagaagtttttgtcgaggtgattaatcccagtgaagatgaaatcaagatagattattcagaaattacttttttacaaaagtttgattttatgccaaaactaaaagatttactgacagagcaagtgattagtggaaaatcaaacatagatttgaaaatagaaagataa

SEQ ID NO: 13775 - protein, 600 aa, Lactococcus lactis subsp. cremoris SK11
MYYYNPWNLDYKQPFGAVKVGQAILLKFDANQTQVEVKCIIRRDFGKRYEFLMSRDESGFFTVTIPFDENAGLYFYYFEILEGSDWEQNKRFYGSSGIGGEGLLYTNENDIKPYQLTVFEKEDKAPAWYRDAVFYQIFPDRFHNGNENGQVSHPKPNSFIYGTKSDTPFYVKEENGDIARWDFFGGNLRGIINKISYLKELGINAIYLNPVFSGTSNHRYDTNDYLKIDSMLGTQEDFQELINLLHQEQMHLVLDGVFSHVGKNSLYFNINGDYGDDEGAAKNPDSPYFDWFKFENYPFDYKSWWGIKDLPEIDKDNESFRDFIYGRKNSVLSKWNDLGIDGWRLDVADELPDSFIKGIRENLDRYSEKILIGEIWEDASNKISYGTRRKYILGGSLQACMNYPFRDLIINLLNGNRSCQDVAHQLMTLQENYPKDIFYNNLNNLGTHDTERILTMVGKENLPLAVSLLFVLPGIPCIYYGDEAGLSGGKDPENRKYFPWDDISPEIYDYYKSWTKKRLLENSLKEGEFSSFYSDRLLGILRYTDSEVFVEVINPSEDEIKIDYSEITFLQKFDFMPKLKDLLTEQVISGKSNIDLKIER

SEQ ID NO: 13776 - DNA, 1755 bp, Lactococcus lactis subsp. cremoris SK11
  CDS (1)..(1755)
atgaacaaagctgcaatttatcatcgtcctgagtcggaatttgcttatctttatgcaaaaaatctgatgcatgttcgtcttcaaacacaaaagtctgatgtggaaaaagtcgaattattttatggcgatccttattcgtgggaagggcttgacaaccctgaaacacagtattgggctagtcaaaaagtagagatgaaaaagtatctttctactaatattagcgattattttgaggccgaaattactgttgcaacgaaacgagttgattacttatttgtcattacaggtttggatggagaaaaagtagtttacacagaccaaggaatgtttgattatgatgagagcttggtgactaaaaaatatggggctttccgtttgccttatttccatgaaagtgatcgttttaaagcacctgaatgggtcaaagaaacggtttggtatcaaattttccctgaacgttttgccaatggggatacaagcaatgaccctgaaggaacgaaagcttggaatacccaagatgttcccgaccgtcaagatttttatgggggagatttgcaaggggtgattgatcatctggaacatttgactgaacttggtgtgaatggtatttactttacccctattttccaagctttttctaatcataaatatgatacagaagattatatggaaattgataagcaatttggggataaggaattgtttaaaactttggtgaaagaagcacatgcgcgtggtattaaagtcatgttagatgcggtctttaatcacatcggagatacgtctgctcaatggcaagatgtattgaaaaatcaagaaaaatcaaaatttgcggattggttccatgttaatagttggccagcaacttatactccgactgatgattttgaaaatgctgagaatgcaacttatgatacttttgcctttactccacacatgccaaaactgaatacggctaacccagaggttgaagcttatcttttgaaagtagctgattattggatttctgagtttgatattgatgcatggcgtttggatgtggcggatgaagtggatcatactttctggaaaaaattccgcacaacttgtgatgcggaaaaagatgatttttatattttaggtgaggtttggcattctgcacaaccttggttagttggtgacgaattctctgccgttatgaactatgcttatactgatgcgattaaagatggtttgattacgaagaagatttctttggaacaaatggtttctaatattaatacgcaactgacattataccgtaagcaagtgaatcaactgatgtttaatgttttagattctcatgatacacccagaattttgactgttgcaaaaaataataaaaatttgatgaaattggtggaaacgttcaccttcatgcaaccaggtgtgccttgtatttattatggagatgagtatgcgttgacaggtggaatggatcctgagtgtcgtaaggtgatgccttgggaagaaaaagatcaagatttagagatgtttgacttctttaaaaatctgattgctctacgcaaacaatatcaaggaattttaagtgattcagaagtagaatggaaaatcgtagattcagaaaatggcattgtgaaatttgaacgtggatctttgaaagctattttcaatattggcgaaaaaccggcttatttttcggctgatgaagtgattttctctaatttggttgaccaaaataatattttacaatatggttttgtaatctataaatag

SEQ ID NO: 13777 - protein, 584 aa, Lactococcus lactis subsp. cremoris SK11
MNKAAIYHRPESEFAYLYAKNLMHVRLQTQKSDVEKVELFYGDPYSWEGLDNPETQYWASQKVEMKKYLSTNISDYFEAEITVATKRVDYLFVITGLDGEKVVYTDQGMFDYDESLVTKKYGAFRLPYFHESDRFKAPEWVKETVWYQIFPERFANGDTSNDPEGTKAWNTQDVPDRQDFYGGDLQGVIDHLEHLTELGVNGIYFTPIFQAFSNHKYDTEDYMEIDKQFGDKELFKTLVKEAHARGIKVMLDAVFNHIGDTSAQWQDVLKNQEKSKFADWFHVNSWPATYTPTDDFENAENATYDTFAFTPHMPKLNTANPEVEAYLLKVADYWISEFDIDAWRLDVADEVDHTFWKKFRTTCDAEKDDFYILGEVWHSAQPWLVGDEFSAVMNYAYTDAIKDGLITKKISLEQMVSNINTQLTLYRKQVNQLMFNVLDSHDTPRILTVAKNNKNLMKLVETFTFMQPGVPCIYYGDEYALTGGMDPECRKVMPWEEKDQDLEMFDFFKNLIALRKQYQGILSDSEVEWKIVDSENGIVKFERGSLKAIFNIGEKPAYFSADEVIFSNLVDQNNILQYGFVIYK

SEQ ID NO: 13778 - DNA, 1695 bp, Lactobacillus casei ATCC 334
  CDS (1)..(1695)
atgacgatgatgaatgaaataccatggtggaaaaagagcgttgtctatcaggtttatccgaaaagcttcaatgatagtaacggtgatggcgtcggggacttaaatggtatcagtgaaaaattggattatttagccgatttgggcgtagatgtgctctggctgaatccgatttaccgatcgccacaggttgataacggctacgatatttcgaattatcgcgatgttgaaccacaattagggacaatggccgattttgaacacttgttgcaggcagcacatgatcgacatctaaagattatcttggacttggttgtgaatcacacgtctgatcaacatccgtggttcaaagccgccaaatcatcagtgagcgatccgcatcacgattactacatctggaagaagccagttgacgatcatgagcctaataattggggctcaagctttggtggttcagcttgggaatacaaaaaagatctgggcgagtattacctgcatctttttgccaagcaacaaccggatctcaactgggaaaatcctaaggtacgccaagaagtttatgatctcatgcgcttttggctagataagggagttgatggcttccggatggatgtcatatcactgatttctaaagatccggcttatccagatggcccgctcattcaaggcaaggcatacggtagttattatgccggagcggcaaatggccctaaggttcatgattacttgcaggaaatgcacgagcaagtgttgtcgcactacaatatcatgacggtcggcgagacgccccatacaacggcacagcaggcgcaattatacacggcggcagatcgtcacgagttggatatggtttttcattttgaccatatgcatcttgactatggccaatatggcaagttctcgacaaatcgatttaaattagttgatctcaaagaagtcttggcacgttgggagaacacattagcgcaagtcgatggctggaacagcctttactggagcaaccacgatcagccacggcctgtgacacgatttggagatgaaggccagtatcgaattcgatcagccaaaatgctggggactgtgctgcacatgttgcagggaacgccttatatttttgagggagaagaactcggtctgaagaatgttcattttgatcaattaagcgattataacgatcttgagaccaagaacattttcaaagaactcacccaacagcatcatgaaagtcctgaggcggccatgaaggccatttatctgcattcgcgcgataatgctcgtacgccgatgccttgggatggcagtgaaaaaggtggtttcaccaccggacaaccatggctgggactaaatccagatcacaaagacattaatgcagctgaagacttggcagatagtgacggtgtttaccactattatcaacacctgattaaattacgacatgaagagccattgattaccactggtgtatttgagctacttgctcctgatgatccgaacttgtttatttacctgcgcaaaggggaacatgagaccttgctggtggcaggtaacttctcaagtgaggaacgcacatggtcagtgccggatgacttgcaagctaaggatgtggatgtgttgattcggaatagtgaaatttccgattcactagagaaaacactgacattaccaccatttggcgcagtggtgtacaagcttcaatag

SEQ ID NO: 13779 - protein, 564 aa, Lactobacillus casei ATCC 334
MTMMNEIPWWKKSVVYQVYPKSFNDSNGDGVGDLNGISEKLDYLADLGVDVLWLNPIYRSPQVDNGYDISNYRDVEPQLGTMADFEHLLQAAHDRHLKIILDLVVNHTSDQHPWFKAAKSSVSDPHHDYYIWKKPVDDHEPNNWGSSFGGSAWEYKKDLGEYYLHLFAKQQPDLNWENPKVRQEVYDLMRFWLDKGVDGFRMDVISLISKDPAYPDGPLIQGKAYGSYYAGAANGPKVHDYLQEMHEQVLSHYNIMTVGETPHTTAQQAQLYTAADRHELDMVFHFDHMHLDYGQYGKFSTNRFKLVDLKEVLARWENTLAQVDGWNSLYWSNHDQPRPVTRFGDEGQYRIRSAKMLGTVLHMLQGTPYIFEGEELGLKNVHFDQLSDYNDLETKNIFKELTQQHHESPEAAMKAIYLHSRDNARTPMPWDGSEKGGFTTGQPWLGLNPDHKDINAAEDLADSDGVYHYYQHLIKLRHEEPLITTGVFELLAPDDPNLFIYLRKGEHETLLVAGNFSSEERTWSVPDDLQAKDVDVLIRNSEISDSLEKTLTLPPFGAVVYKLQ

SEQ ID NO: 13780 - DNA, 1779 bp, Lactobacillus casei ATCC 334
  CDS (1)..(1779)
atgtttcaatttgattcatttaccgatcgccgaccttttggcgcggtgcaaaaaggcacggctgtcacattgacggcacaggctgatggtgcggtgacacaagccacacttgtcattatgccagatgaacattgcgatcaaacgcagtccttgccgatgacgaaaagccctaacggctacacagtgacgtttacgcctcctaatgccggtctttggttttatcattttgagttgcaaagcgacaatggccgcgaacgctttggtgcggtcggcggtggttttggcgggctaggtcagctttaccctgaaaatgtggatgtggttaattatcagatgaccgttgtgaccgcatttgatccggttccggcgtggtatcaaaatgcccgtttttatcatatcttcgtagatcgcttcaataatgggaatgctgacggtcacgtgaatgctccgaaggaaaactcttttctgtatgggcgaaaaaccgatcggcccatgtatattcgcgggaacgatggcgagatcattcgctgggatttttacggcggtaatctgactggcattcaacaaaagctgccattattggcagcccgtggcatcaacgccttatatttaagtccaatttttcaggcgcggagcaatcatcggtatgacaccggcgattattttgcaattgatgaagtcttaggttcgctgcatgactttaagcagtttttggcggcagcgcatcagttggggatgcatgtcattctggatggcgtgtttaaccacgtcggcgctgatagccgctacttcaatgccgtcaatgaatattcagacgtgggtgcggctaatagcttggattccccatatgcctcgtggttttcattcaagcgatttcctgatgactacaatagctggtggggcgtgaaggatctgccagccatcaataaggataatcaagattttcatgacttcattgcggctaaaaaaggttcggtgatcagttattggactgacttaggcgttgatggctggcgcttagatgttgccgatgaattgatggacgattttatccggcagattcgcagcacgcttgatcaatttccggagcgggtgctgatcggcgaagtctgggaggatgcctccaataaacaggcttatggcaagcggcggcaatattttgaaggcggcgaattgaatgcagtcatgaattatccgttgcgatccatgttgattgacctgacaaatgggcaattaaacgcggcaggattcgttcgtcaattgatgacgttgaaggagaattatccaacaaatgcgtttgcgttcaatttcaacaacattggcagtcatgatacaccacggattttaacgatgttggatggtgatcggcgtaagttgcagtttatcgtctcgctattttactggctgcctggggtgccgtgcctttactacggggatgaggccgggttaactggcggtaaagacccggataaccgcgccttttatccatggggccatgaagatcaggctgttttggatatttatcaaatcgcgcttcagacccgcatcgaccagcccgccttagcagccggcgccgcttttttcccatttacgtttgaagacagttttggcttcgtccgccaaaatgatacccaaacgctggtggttctggccaatccaactggatcaccacaagtgttacaggatccgcatgctgaattagtgccaaaaagtttgcgcgctttattgccagtaggcacgatggtaccggcaggcggtgtgatttggcagcagatttaa

SEQ ID NO: 13781 - protein, 592 aa, Lactobacillus casei ATCC 334
MFQFDSFTDRRPFGAVQKGTAVTLTAQADGAVTQATLVIMPDEHCDQTQSLPMTKSPNGYTVTFTPPNAGLWFYHFELQSDNGRERFGAVGGGFGGLGQLYPENVDVVNYQMTVVTAFDPVPAWYQNARFYHIFVDRFNNGNADGHVNAPKENSFLYGRKTDRPMYIRGNDGEIIRWDFYGGNLTGIQQKLPLLAARGINALYLSPIFQARSNHRYDTGDYFAIDEVLGSLHDFKQFLAAAHQLGMHVILDGVFNHVGADSRYFNAVNEYSDVGAANSLDSPYASWFSFKRFPDDYNSWWGVKDLPAINKDNQDFHDFIAAKKGSVISYWTDLGVDGWRLDVADELMDDFIRQIRSTLDQFPERVLIGEVWEDASNKQAYGKRRQYFEGGELNAVMNYPLRSMLIDLTNGQLNAAGFVRQLMTLKENYPTNAFAFNFNNIGSHDTPRILTMLDGDRRKLQFIVSLFYWLPGVPCLYYGDEAGLTGGKDPDNRAFYPWGHEDQAVLDIYQIALQTRIDQPALAAGAAFFPFTFEDSFGFVRQNDTQTLVVLANPTGSPQVLQDPHAELVPKSLRALLPVGTMVPAGGVIWQQI

SEQ ID NO: 13782 - DNA, 1668 bp, Lactobacillus casei ATCC 334
  CDS (1)..(1668)
atgacgaacgaaactagccgtacttggtggcaacaagaaattttctaccaaatctatccggcctcattcaaagatagcaataatgacggcataggcgatctgcctggcatcactgccgaattaccgaagttaaaagaattaggcattaccacgatttggttatcgccggtttataagagccccatggttgacaatggttatgacattgccgactatcaggcgattgatccgcgctttgggaccatgactgactttgatcagctcatggcaactgccaaagatctcggtatcaaagtggtaatggatttggtggtcaaccatacgtccgatcagcaccggtggtttcaagcggcgctcaagaatccggcctcaccatatcgggacttctatattttccgccaaggtcatgatggtcagccgccgaacaactggcgctcaaacttcggcgctggctcgtcatggacggcggttcccggtgagcccaacacctattatcaccacgtcttttccccacaacaaccggacctgaattgggaaaatccgaagttgcggcaagccatttatagcatgatcaactggtggctagccaaaggcctcgccgggttccgggttgacgccattacgtttatcaaaaaggatcaggattttgcttccatcacgccagatggcagcgatgggttaggcaaagttaagcgcaaaacggaaaatcgaccgggtctggatcaatttctcaaagagttgaacgttgccacctttaagccggccaatgccgtcacgatcggggaagcgtctggcgttgcatacgatcaactcggcgacttcattggcgaaaacggctacttctcaatgatttttgattttcattacgccgacattgacgtcgcttctgggtctgagtggttcaagcaaaccaactggacgccaaaaatgcttggcaaggcgattgccaaaagccagctggcaattcaaaaagttggctggggggctaatttccttgaaaatcatgatcaaccgcgaagcctaagcaagtatatccgtgagccgcaatatcgcaatgcgatcggggcaaaagcattagcactgttatacttcggtttacgtggctgcccgtttatctatcaaggccaagaactcggcatggtcaatgcggtgcgaaccaacattgatcaattcaacgacctttccgcgcacgacaactatcgccgtgcattggcagaaggttactccgaagctgatgcccttgcttgtgtcaaccgacgctcacgtgacaatgcccgtacgccatacccatgggacgacagccaaaatggcggcttcaacgctggtcatgaaccttggttaccgctggccaagcaagctgctggcgtgaactggcaggcagaacacgatgatcccaattcggtctggacgttttatcaaacgctctgccgcctgcggaatgcatcaccattgcgcgccgatttgatcgaaggcgactttgccccgctggatgcacacaacgacaacgtgattgcctatgcccgcgggcaacatgtccaaatttttgtgaatcttagctcgaagccagccgcagttgacttaccagccggtcacgtttggctgaacaattactcggatgttggaacgagcttacaaccctatcaagcgattcttattgaggtgaaatga

SEQ ID NO: 13783 - protein, 555 aa, Lactobacillus casei ATCC 334
MTNETSRTWWQQEIFYQIYPASFKDSNNDGIGDLPGITAELPKLKELGITTIWLSPVYKSPMVDNGYDIADYQAIDPRFGTMTDFDQLMATAKDLGIKVVMDLVVNHTSDQHRWFQAALKNPASPYRDFYIFRQGHDGQPPNNWRSNFGAGSSWTAVPGEPNTYYHHVFSPQQPDLNWENPKLRQAIYSMINWWLAKGLAGFRVDAITFIKKDQDFASITPDGSDGLGKVKRKTENRPGLDQFLKELNVATFKPANAVTIGEASGVAYDQLGDFIGENGYFSMIFDFHYADIDVASGSEWFKQTNWTPKMLGKAIAKSQLAIQKVGWGANFLENHDQPRSLSKYIREPQYRNAIGAKALALLYFGLRGCPFIYQGQELGMVNAVRTNIDQFNDLSAHDNYRRALAEGYSEADALACVNRRSRDNARTPYPWDDSQNGGFNAGHEPWLPLAKQAAGVNWQAEHDDPNSVWTFYQTLCRLRNASPLRADLIEGDFAPLDAHNDNVIAYARGQHVQIFVNLSSKPAAVDLPAGHVWLNNYSDVGTSLQPYQAILIEVK

SEQ ID NO: 13784 - DNA, 570 bp, Lactobacillus delbrueckii subsp. bulgaricus ATCC BAA-365
  CDS (1)..(570)
atggtctaccagatattcccggactgcttcaacaacggcaacccgcatggggagatccagggccgcaagaaggacagtttcatctacgcgaccaaggaagacagtccttactatattaaggatgagcatggcgatatagcccgctgggacttttttggcggcaacctcgaaggtatccggcaaaagattccctatttaaaggatttgggagtgacggccatctacttgaacccgatcttccaggcttccagcaaccaccgctatgacacccaggacttcatgaagatcgaccccatgctggggaccgaggaggacttcaagaacttgatcaaggacctgcacaaaaacaggattgccttgatcttagacggggtcttcaaccatgtcggggccgacagcaagtacttcttgagcgcggtcactgacaagacgggcccttactactcctggttcaacttcatcaattatccgactaagtaccagtcctggtggggggaaccacgcttcctgaagtcaacaagagtaatgctgactaccagaacttcatctgcgggcccgacggcgttttag

SEQ ID NO: 13785 - protein, 189 aa, Lactobacillus delbrueckii subsp. bulgaricus ATCC BAA-365
MVYQIFPDCFNNGNPHGEIQGRKKDSFIYATKEDSPYYIKDEHGDIARWDFFGGNLEGIRQKIPYLKDLGVTAIYLNPIFQASSNHRYDTQDFMKIDPMLGTEEDFKNLIKDLHKNRIALILDGVFNHVGADSKYFLSAVTDKTGPYYSWFNFINYPTKYQSWWGEPRFLKSTRVMLTTRTSSAGPTAF

SEQ ID NO: 13786 - DNA, 1827 bp, Deinococcus geothermalis DSM 11300
  CDS (1)..(1827): transl_table=11
atgaacatcatctttgccgacctgcccgcgacccacgaccacacgcccgcctacacctctcggctcggtgccgctgtgggtgagctggtgacgctgcgcctcaagacgacgctgccggtgatcgcagtgtttctcaaactgctcgaacacggtgaaatcacgacccaccctgcccgcgagatcgggccgctcgacggcgagggccgctggttcgagttcgacctgcgcctgcacgcccgccgggtgcattatgcctggcaactccagaccgctgaagacaactggcacttcaccatggcgggcctgcaccacacccgccgaccctaccgcgactggtttcactacgtggcggactaccaggcgcccacctgggtctggaaaagcgtcttctatcagatctttcccgaccgcttccgcaacggaaaccctgcaaacgacgtgcagaccggcgagtatgtctacagcggtgccccggtggttcacgtgccctgggacgtgccacccacccgcgaactcgacattcacgcccactacggcggcgacttggagggggtcgcccaggccatgccctacctggccgatctcggcgtcaacgcgctgtggctgacccccatcttcgtgagtcccagcgcccaccgctacgacatcaccgactaccgcaccattgatccacacctgggcggcgaggcggcctttggcgagatgctgcgcgcggcgaatgcatacgggatccggatcgtgttggacggcgtgtttaaccataccggcagcgagcatgcgcttttccaacgggcgctccatgacgcctcggctcccgagcgcgagctgttcaccttccgcgaggccacaggcggcaagcctccctacgcggcctttttcgacgtgcccaccctgcccaagatcgactaccgctcggcagtcgccgtgaacgagttcctggcgggcgaggagagcgtggtgcgcttctggctgcggcggggggcggcgggctggcggctggatgtggcgcagcagatcgggcggggcggcaccgacgagggcaacctcgaactgcatcgccagcttaagcaggccgcccgcgaggaacggcctgacgcctacatcttcggagagcgcttctttgattcagaagcggcgctgaccggcgagggcgaggacggcgtgatgaattatcacggtttcggcctgccgctgatggagtggtttgcaggcgaacattacctgggctttcgctcgcgcatgacgacggcagaactgctcgacctgctgtgggacgcttaccacgtgttggcgccgcagctggcgctgaaccagttcaacctgctcgactcgcacgacatcccgcgtgccctctcgcggctgggggagaacaagaccaagctgcgcgccgccctcacgctgctgatgggttatcccggcgtgccctgcctctactacggcaccgagatcggcctctcgcagctcgagcgcggcctgatgccctttaaccgcgctccaatgccctgggacgaaacccgctgggaccttgacctgcgcggctttgtgcaggccctgatccgggttcgccgctccgcacgggtcttgcaggagggagcactgcgctttttgttggaggagtcggacgctctcgggtatctgcgagcctacacccaccctgacggacggcgtgaactggccgccgtgctgggcagccgccgagggagccagcacgaggtcaccgtcacattgcctcggggtgactggcgggacgcgctgaccggcgagcttgtctcccggggcggtgagacgcggctcgacgtggcccaggggcggttgctgttggcctga

SEQ ID NO: 13787 - protein, 608 aa, Deinococcus geothermalis DSM 11300
MNIIFADLPATHDHTPAYTSRLGAAVGELVTLRLKTTLPVIAVFLKLLEHGEITTHPAREIGPLDGEGRWFEFDLRLHARRVHYAWQLQTAEDNWHFTMAGLHHTRRPYRDWFHYVADYQAPTWVWKSVFYQIFPDRFRNGNPANDVQTGEYVYSGAPVVHVPWDVPPTRELDIHAHYGGDLEGVAQAMPYLADLGVNALWLTPIFVSPSAHRYDITDYRTIDPHLGGEAAFGEMLRAANAYGIRIVLDGVFNHTGSEHALFQRALHDASAPERELFTFREATGGKPPYAAFFDVPTLPKIDYRSAVAVNEFLAGEESVVRFWLRRGAAGWRLDVAQQIGRGGTDEGNLELHRQLKQAAREERPDAYIFGERFFDSEAALTGEGEDGVMNYHGFGLPLMEWFAGEHYLGFRSRMTTAELLDLLWDAYHVLAPQLALNQFNLLDSHDIPRALSRLGENKTKLRAALTLLMGYPGVPCLYYGTEIGLSQLERGLMPFNRAPMPWDETRWDLDLRGFVQALIRVRRSARVLQEGALRFLLEESDALGYLRAYTHPDGRRELAAVLGSRRGSQHEVTVTLPRGDWRDALTGELVSRGGETRLDVAQGRLLLA

SEQ ID NO: 13788 - DNA, 1491 bp, Deinococcus geothermalis DSM 11300
  CDS (1)..(1491): transl_table=11
atgccgccctctacaccctcttccgaagcacaccctctcacgcccgaatgggtcgcggacgccgtcttctatcagattttccccgaccggttcgcacgcagcgggcgagtgccgggcctgaaccttcagccctggggcagcccgccgcaggtgcacgggtatatgggcggcgacctgtggggggtcacccagcatctggaccacatcggggcactgggggtaaacgcgatctacttttgcccggtatttcagtcggcttccaaccaccgctaccacacccacgactactaccgggtagatcccatgctggggggcaacgaggcgctgcgggcgctgatcgaggcggcgcatgcgcggggcatccgcatcgtgctggacggcgtctttaaccatgccagccggggcttttttcagttcaacgacctcttggaacagggcgaggcgagcgcctaccgtgactggttccatgtggagggatggcccctgcacgcctacgacgacacccgaccggcgaactatcaggcgtggtggggccttcgcgcgctgccgaaattcaacaccggcaacccggccgtccgcgagttcttgtgggacgtgggcacgtattggatggagtttgggattgacggctggcggctcgacgtacccaacgaaatcgatgacgacgagttctggcgcgagttccgccgccgcgtgaaggccatcaatcccgacgcctacatcgtgggcgaaatctggggcgacgcgcaccgctggcttgccggggaccagttcgacgcggtgatgaattatcacttcacccggccctgtctggcgttttttgcggcgcgaaccctcgcacaggcggccaacgagtccaccggcctaggccgtgtggagccactcgacgctgccgccttcgcccgccgcatgaccgagatcacagcgctgtatcaccccgagatcgtccgcgcgcagctcaacctgctcgactcacacgacacagcccgcttcctgaccgccgcgggcggcgacgcgaccgcctttcgcctcgccagcatctttcagatgacctacgtgggggcgccgtgcatctactacggtgatgagatcggtcttcccggcggccctgaccccgactgccgccgcgctttcccctggcacgacgaggcgagctgggacaaagagacgctgagcctgctgcaaaagctcaccgccacccgccacgccacccccgccctgcgccggggagcattccgcttcacccacgcggaaggcgaggcgctggtctacgtccgcgaacacgccgccggcaacgcctacatcgccatcaatgccgcccaagcccccgcccgcctgcccctcagcgacgtgcagcccggccgataccgcgacgccctgagcgggcagcgtcacgagttgagcggagaaacggaggtcgaggttccggggcgcgcggcggtggtgctggtccgggcggaggaggattcgcggcacaccgcgcggcactga

SEQ ID NO: 13789 - protein, 496 aa, Deinococcus geothermalis DSM 11300
MPPSTPSSEAHPLTPEWVADAVFYQIFPDRFARSGRVPGLNLQPWGSPPQVHGYMGGDLWGVTQHLDHIGALGVNAIYFCPVFQSASNHRYHTHDYYRVDPMLGGNEALRALIEAAHARGIRIVLDGVFNHASRGFFQFNDLLEQGEASAYRDWFHVEGWPLHAYDDTRPANYQAWWGLRALPKFNTGNPAVREFLWDVGTYWMEFGIDGWRLDVPNEIDDDEFWREFRRRVKAINPDAYIVGEIWGDAHRWLAGDQFDAVMNYHFTRPCLAFFAARTLAQAANESTGLGRVEPLDAAAFARRMTEITALYHPEIVRAQLNLLDSHDTARFLTAAGGDATAFRLASIFQMTYVGAPCIYYGDEIGLPGGPDPDCRRAFPWHDEASWDKETLSLLQKLTATRHATPALRRGAFRFTHAEGEALVYVREHAAGNAYIAINAAQAPARLPLSDVQPGRYRDALSGQRHELSGETEVEVPGRAAVVLVRAEEDSRHTARH

SEQ ID NO: 13790 - DNA, 2097 bp, Deinococcus geothermalis DSM 11300
  CDS (1)..(2097): transl_table=11
atgcctgccgtgcagttcctacggtgggggaatggagcctgccacgatcagcgccttccgcgtccgacgcaagcggctcgggccaagcctcgacttcggaagtttctttctgttcttcggcatctcgggaaccgacgagggccggggagaacgcctgcaaaaacgcttcgagggcgagtactaccgccacctcgtgacgctgaagctctcggggagcgtcccgccgggccggtactggttgcgcgacctgacggaggaagcgaacaaacggggctggacggttcgggcggacggcagagccaccagcgacctgagcgacgagggtctccgcgacctgaacacctggctggcgagtggcgcgcgccaggttcacctggacccgctgaacgagtcatccccgcgccgataaggcacggccttcgccggaggccgtcggggaaccgatcgggaactgaatcgattcagtcgcctgcttttcctgctacgctttcaggtatgacccagcccagcgaactgaagtggtggcagcgcggcatcatctaccagatttacccccggtcgtttcaggacgcctccggagacggagtaggggacctgcgcgggatcacctccaggctgccctacgtggcgggcctgggggtggaggcggtgtggctctcccccatcttccgcagcccgatgcgcgacttcggctatgacgtggccgattactgcgacatcgaccccctcttcggcacgctggaggacttcgatgcgctggtggccgaggcgcaccggttggggctgaaggtgatgctcgactacgtgcccaaccacacctcctcagaccatccctggttccaggaggcccttgcgggcaaggacagtccgaagcgggactggtacgtctggcgcgatccggcaccagacggcgggccgcccaacaactggaagtcatttttcgggggggacgcctggaccttcgatccccacagcggccagtattacctgcatcagtttctgccggggcagccggacctgaactggcgcaaccccgaggtgcgcgcggcaatggcggacgttctgcgcttctggatgcgccggggcgtggacggcttccgggtggacgtgatctggctgctggccgaggacgccgagtttcgcgacgagccggaaaatcctgagtggcagccggggcagatcgaacacgcccgtctgctgcacatctacacccaggaccaaccggagacgcacacctatatccgcgagctgcggcaggtgctcgacgagttcgacgaccgcatgatggtgggagaaatttacctgccgctgaagcagctgttgccctacgcgggcacgccggacgcgccgatggtgcatctccccttcaacttccacctgatcctgctgccctgggatgcccgcgagattcgcgccttcgcggacgagtacgacgcggcctgccgggcggcgggcacctggccgaactgggtgctcggcaaccacgaccagccccgcttcaagtcgcgggtgggcgcagaccagtaccgggtcgcacagacgctgctgctcaccctgcgcggcacccccactgcctactacggcgacgaaatcggcatgcacgatgtccccatcccccccgagcggcggatggacccggcgggcctccagcagcccgacgtgccgagtgcgggccgcgatcccgagcgcaccccgatgcagtgggacagcggccccaacgcgggcttcacagcccccgacgtgcaaccctggcttcccctggcagacgacgctgaccgggtgaacgtgcaggtggaggaggcagaccccaccagcgacctgaactacttccgggcactcacagcgctgcgccgcgcccatccggcgctggtggccggtgactaccgctcgctggatacggaacacgcggacgtcttcgccttcgagcggacgctggcgggggaacagctggtcgtgctgctgaatttcggcggggaggaacgcgcgttggggcctcttgtgggcgagggacagaccctcctgagcagccggaatgactccccggcaagcaccgctcccctgcgccccaatgaggcgcgcatcatccgccgccagtag

SEQ ID NO: 13791 - protein, 698 aa, Deinococcus geothermalis DSM 11300
MPAVQFLRWGNGACHDQRLPRPTQAARAKPRLRKFLSVLRHLGNRRGPGRTPAKTLRGRVLPPPRDAEALGERPAGPVLVARPDGGSEQTGLDGSGGRQSHQRPERRGSPRPEHLAGEWRAPGSPGPAERVIPAPIRHGLRRRPSGNRSGTESIQSPAFPATLSGMTQPSELKWWQRGIIYQIYPRSFQDASGDGVGDLRGITSRLPYVAGLGVEAVWLSPIFRSPMRDFGYDVADYCDIDPLFGTLEDFDALVAEAHRLGLKVMLDYVPNHTSSDHPWFQEALAGKDSPKRDWYVWRDPAPDGGPPNNWKSFFGGDAWTFDPHSGQYYLHQFLPGQPDLNWRNPEVRAAMADVLRFWMRRGVDGFRVDVIWLLAEDAEFRDEPENPEWQPGQIEHARLLHIYTQDQPETHTYIRELRQVLDEFDDRMMVGEIYLPLKQLLPYAGTPDAPMVHLPFNFHLILLPWDAREIRAFADEYDAACRAAGTWPNWVLGNHDQPRFKSRVGADQYRVAQTLLLTLRGTPTAYYGDEIGMHDVPIPPERRMDPAGLQQPDVPSAGRDPERTPMQWDSGPNAGFTAPDVQPWLPLADDADRVNVQVEEADPTSDLNYFRALTALRRAHPALVAGDYRSLDTEHADVFAFERTLAGEQLVVLLNFGGEERALGPLVGEGQTLLSSRNDSPASTAPLRPNEARIIRRQ

SEQ ID NO: 13792 - DNA, 1662 bp, Anaeromyxobacter dehalogenans 2CP-C
  CDS (1)..(1662): transl_table=11
atggcgatctcgcagcgcaggcgggcggtcgatccgctctggttcaaggacgcggtcatctacgagacgcacgtgaagtcgttctacgactccaacggcgacggcgtgggcgacctgcgcgggctcgtggagaagctcgactacctccaggacctcggcatcacctgcctgtggctgctgccgttcttcccgtcgccgctgcgcgacgacggctacgacatcgccgactacaagggcatccaccccgactacggcacggtggacgacttccgccagctggtcgcggcggcccacgcccgcggcatccgggtggtggtggagctggtggtgaaccacacctccgaccagcacccctggttccagcgggcgcgccgcgcgccggccggctccccggagcgcgcctactacgtgtggagcgacaccgacgagcgctaccgcgacgcccgcatcatcttcaccgacaccgagaagtcgaactggacctgggaccccgaggccaagcagtactactggcaccgcttcttctcgcaccagccggacctcaacttcgagaacgcggtggtgctgggcgaggtgctggacgcgctgcgcttctgggcggagatgggcgtggacggcttccggctcgacgcggtgccgtacctgatcgagcaggacgggacgagctgcgagaacctgcccggcacgcacgaggtcatccggaagatccgggcctacgtggaccagcacttccccgggcgcatgctgctcgccgaggcgaaccagtggccggccgacgtgcgcccctacttcggcgagggcgacgagtgccacatggcgttccacttcccgctcatgccgcgcatcttcatggcgctgcggctcgaggacgtggagccgatcgtcgagatcatgcggcgcaccccggccatcccggacacctgccagtgggcgctgttcctgcgcaaccacgacgagctgacgctggagatggtgaccgccgacgagcgcgactacatgtacctcgcgtacagccaggatccgcgcatgaagctgaacgtcgggatccggcgccgcctcgcgccgctggtggacaacagccgccggcgcatggagctgctcaactcgctcctgttctccttccccgggacgcccatcgtctactacggcgacgagctcggcatgggcgacaacatctacctgcacgaccgcaacggcgtgcgcacgcccatgcagtggagcccggaccgcaacgccggcttctcccgcgccgaccccggccggctctactccgcgcccatctccgacgcggtgtacggctaccaggcggtgaacgtcgaggcccagctccgcgacccctcctcgctgctgcactggatgcgcaacaccatcgcgctgcgcaagctgttccgggcgttcgggcggggcaccatggagttcctgccggtgcagaaccgcaaggtcctcgcctacgtgcgccgccacgacgaggacgtgatcctgtgcgtggcgaacgtgtcgcgcttcgcgcagccggcgcagctcgacctctcccacctcgagggctacgtgccggtggagatggtcggctacaccgagttcccgcgcatcgggcggcagccctacgcgctcacgctcgcgccctacggctacttctggttcgagctgcgcaagcccgcctga

SEQ ID NO: 13793 - protein, 553 aa, Anaeromyxobacter dehalogenans 2CP-C
MAISQRRRAVDPLWFKDAVIYETHVKSFYDSNGDGVGDLRGLVEKLDYLQDLGITCLWLLPFFPSPLRDDGYDIADYKGIHPDYGTVDDFRQLVAAAHARGIRVVVELVVNHTSDQHPWFQRARRAPAGSPERAYYVWSDTDERYRDARIIFTDTEKSNWTWDPEAKQYYWHRFFSHQPDLNFENAVVLGEVLDALRFWAEMGVDGFRLDAVPYLIEQDGTSCENLPGTHEVIRKIRAYVDQHFPGRMLLAEANQWPADVRPYFGEGDECHMAFHFPLMPRIFMALRLEDVEPIVEIMRRTPAIPDTCQWALFLRNHDELTLEMVTADERDYMYLAYSQDPRMKLNVGIRRRLAPLVDNSRRRMELLNSLLFSFPGTPIVYYGDELGMGDNIYLHDRNGVRTPMQWSPDRNAGFSRADPGRLYSAPISDAVYGYQAVNVEAQLRDPSSLLHWMRNTIALRKLFRAFGRGTMEFLPVQNRKVLAYVRRHDEDVILCVANVSRFAQPAQLDLSHLEGYVPVEMVGYTEFPRIGRQPYALTLAPYGYFWFELRKPA

SEQ ID NO: 13794 - DNA, 1638 bp, Anaeromyxobacter dehalogenans 2CP-C
  CDS (1)..(1638): transl_table=11
atgaccccgtcccgccgccccgccgcgctcctcgccgtcgccctcgccgtcgccctcgccgcgctcgcctgcgcgcatgcgcccgccggccccccggccgccggcggcgcgcgggcggcctccgcaccggcggcgccctggtggaagggcgcggtcttctacgaggtgttcgtgcgcagcttcgcggactccgacggcgacgggaagggcgacctccgcggcctcaccgcgaagctcgactacctgaacgacggcgacccggccacctccaccgacctcggcgtggacgcgctctggctcatgccggtgttcgcctcgccgagctaccacggctacgacgtcaccgattacctgaaggtcaaccccgactacggcaccgaggccgacctcgaccggctcgtcgccgaggcgcaccggcgcggcgtccgcgtggtcctcgacctcgtcctcaaccacacctccgaccagcacccctggttccgcgagtcggcgtcgtcgcgcacctcgccgcgccgcgactggtacgtgtggcgccaggacgacccgggctggacgcagccgtggaacccggcgcagggcacctggtaccgccgcggcggcgagtggtactacgccgtcttctggagcgggatgccggacctgaactaccggaacccggcggtgcgcgaggaggcgaagcggatcgcggcgcgctggctggcgaagggcgtggacgggttccgcctggacgccatccgccacctcatcgagaccggcccgggggcgggccagtccggctcggcggagaaccacgtgttcctgcgcgagttcgcggcggcggtttgggccgcgaagccggacgcggtgctggtgggcgaggtctggtcggagaccgacgacatcgcccgctactacggggacgggaaggacgagttgcagctcctgttcgacttcccgctcgcgaaggcgatcgtggagggggtggacgcgggcgacggcggcttcaccgcgcacgtgctccgcgaggtcgccgcggcctacccgccgggcgcggtggacgccccgttcctcaccaaccacgaccagttccgggtcgcgacgcagctcgcgaacgacgccgggaagctccggctcgcggcggccatcctgctcacgctgccgggcgcgccgttcgtctactacggcgaggagctggggatgcagaacggccccggccgcgaggacgagtggaagcggacgcccatgccctgggaccgctcggagcacggcggcttcaccaccggtgacccgtggatgccgctcgcgccggggcacgagagcgccaacgtggccgcggaggcgggcgatccggcgtcgctgctgtcgaggtaccgggcgctggtccgggcgcggagggcgtcggcggcgctgtcgcgcggggatgcggtgccgctgtccacgccgggggcggcgctcgcgtacgtgcggcgggccgagggggagacggtgctggtggtgcacaacatgggcgccgcgccgctcgagctgggcgggctggaggcgccgggggcggcggcggaggcggtgttcgtggatgcgggggccgtggcggtgcgggaggcgggtgggtggcgggtcgtgctgccgccgcgggcctccggggtttggagggtgaggtag

SEQ ID NO: 13795 - protein, 545 aa, Anaeromyxobacter dehalogenans 2CP-C
MTPSRRPAALLAVALAVALAALACAHAPAGPPAAGGARAASAPAAPWWKGAVFYEVFVRSFADSDGDGKGDLRGLTAKLDYLNDGDPATSTDLGVDALWLMPVFASPSYHGYDVTDYLKVNPDYGTEADLDRLVAEAHRRGVRVVLDLVLNHTSDQHPWFRESASSRTSPRRDWYVWRQDDPGWTQPWNPAQGTWYRRGGEWYYAVFWSGMPDLNYRNPAVREEAKRIAARWLAKGVDGFRLDAIRHLIETGPGAGQSGSAENHVFLREFAAAVWAAKPDAVLVGEVWSETDDIARYYGDGKDELQLLFDFPLAKAIVEGVDAGDGGFTAHVLREVAAAYPPGAVDAPFLTNHDQFRVATQLANDAGKLRLAAAILLTLPGAPFVYYGEELGMQNGPGREDEWKRTPMPWDRSEHGGFTTGDPWMPLAPGHESANVAAEAGDPASLLSRYRALVRARRASAALSRGDAVPLSTPGAALAYVRRAEGETVLVVHNMGAAPLELGGLEAPGAAAEAVFVDAGAVAVREAGGWRVVLPPRASGVWRVR

SEQ ID NO: 13796 - DNA, 1602 bp, Anaeromyxobacter dehalogenans 2CP-C
  CDS (1)..(1602): transl_table=11
atgccgctcatgcccggtctccgccgcgcccgcagcgcgccccgcctcgcgaccgtcgcgctcgccgcctgcgcggtcctcgggctcgtggggctcgcggcctgcgcgccgcgcgcaccctccggcccgccggccggcgccgccgcggcggccgcgctcgccgaggcgccgccccggccgctgccgccgcgcccgtggcaggacgaggtcctctacttcgtgctggtggaccgcttcgccgacggcgaccgcggcaacgaccaggacgtggacctcgccggcaagggcacgttccacggcggcgacctgcgcggcctcaccgcgcacctcgacgacctcgccgcgctgggcgtgaccgcgatctgggtgaacccgctggtgcgcaacatccccggctacgtgagcggcgccgggttcccggactgggcctaccacggctactggatggacgacctgtcgcgcctcgacccgcgcttcggcagcgaggccgacctggccgccttcgtgaacgcctgccacgcgcgcggcatccgcgtgctgctcgacgtggtctacaaccacgccggctacgacaccgcctacctgcgcgatccccgcacgcgcccgtggctgcgcaacaacgtggtgggcgactgcggcgacgacgacctgacgagctgcctggccggcctgcccgactggaagaccgagctgcccgaggtccgcgagttcctgctcgccgcccagttcggctgggcgaagcgctcgggcgtggacggcttccggctcgacaccgtgaagcacgtcgagccggacttctgggcgctccaccggcggcgggtgcgcgccgagctcgtcccggggttcttcctgctcggcgagctgtggggcggcgaccgcgagtccctcgatccgtacttcgccgccgacacgctcgacgccggcctcgacttcggcttccagggctcgaccgtgggctggctgctcgggcgcggccgcaccatcgcctacgagcggtacctcgcgtcgcgccacaaggtccggcccgggcacctcctcgcgcactacctctcctcgcacgaccagcccggcgcgctgcacctgctcggcggcgaccgcgcgctgttccgcctcgccgcgctcctgcagctcaccaccctgggcgtcccgacgatcttctacggcgaggaggtggcgcggcccatcggcgagtggccggacaatcgttccgacatgccatgggggcaaatggacgtgctccccggcgccggaaagccgcgcgacgaggcaatgcgcgcgttctaccgacgggtcatcgccctgcgtcgcgcccaccccgccctgtcccgcggaacccacgagccggtgtccaccgacggtgacggcctggccttcctgcggcgcgacggggacgacgcggtgctggtcgcggtgaaccgcggcaagtcgccactctcgctgcggatccccgtgccggccggctgggaggggcgggagctggaggacgccctggagggcgaggcgatatcggtcggcgccggcggggtggcgctggagctcccgggtcacggcgcccgcgtcgtggtggcgaggccagcacccggcgcggcgattcgtcgctaa

SEQ ID NO: 13797 - protein, 533 aa, Anaeromyxobacter dehalogenans 2CP-C
MPLMPGLRRARSAPRLATVALAACAVLGLVGLAACAPRAPSGPPAGAAAAAALAEAPPRPLPPRPWQDEVLYFVLVDRFADGDRGNDQDVDLAGKGTFHGGDLRGLTAHLDDLAALGVTAIWVNPLVRNIPGYVSGAGFPDWAYHGYWMDDLSRLDPRFGSEADLAAFVNACHARGIRVLLDVVYNHAGYDTAYLRDPRTRPWLRNNVVGDCGDDDLTSCLAGLPDWKTELPEVREFLLAAQFGWAKRSGVDGFRLDTVKHVEPDFWALHRRRVRAELVPGFFLLGELWGGDRESLDPYFAADTLDAGLDFGFQGSTVGWLLGRGRTIAYERYLASRHKVRPGHLLAHYLSSHDQPGALHLLGGDRALFRLAALLQLTTLGVPTIFYGEEVARPIGEWPDNRSDMPWGQMDVLPGAGKPRDEAMRAFYRRVIALRRAHPALSRGTHEPVSTDGDGLAFLRRDGDDAVLVAVNRGKSPLSLRIPVPAGWEGRELEDALEGEAISVGAGGVALELPGHGARVVVARPAPGAAIRR

SEQ ID NO: 13798 - DNA, 1188 bp, Streptococcus pneumoniae TIGR4
  CDS (1)..(1188)
atgaattacttgcaagacttgggtattactggactatatctttgtcccatctttgaatctacaagcaatcacaagtacaatacgacagattactttgaaattgaccgtcattttggagacaaggagacctttcgggaactggtggatcaagcgcatcatcgtggcatgaaagtcatgctggatgcggtatttaatcatattggttcgcaatctcttcaatggaaaaatgtcgtcaaaaatggtgaacagtctgcttataaggattggttccatattcaacaattcccagtgacaactgaaaagctagttaataagagagacttaccctatcatgtttttggtttcgaggactatatgcctaagctaaatacagccaatccagaggtcaagaattatcttttaaaggttgcgacttattggattgaagagtttaatatcgatgcttggcgtttggatgtggctaatgagattgaccatcagttctggaaggattttcgtaaggcagttttagctaaaaatcctgatctttatatcctaggagaagtctggcatacatctcagccttggctaaatggagatgagttccatgccgtcatgaattatcctttatctgatagtatcaaggactatttcttacgaggaattaagaagacagaccagttcatcgatgaaatcaatggagagtctatgtattacaagcagcagatttcagaggtcatgtttaatctcttggattcacatgatacagagcgaatcctgtggacggccaatgaagatgttcaactggttaaatcagccttagcctttctctttttacaaaaaggaacaccgtgcatttattacggaaccgagctagccttgactggaggaccagatccagattgtcgtcgttgtatgccttgggaacgtgtatcaagtgacaatgatatgctgaactttatgaagaggctgattaaaattcggaaatacgcgtcagtaatcatttcgcatggcaagtatagccttcaagaaatcaactctgatctagtagctctggaatggaaatacgaaggacggatcctcaaagcaatattcaaccaatcaacagaagattatcttttagagaaagaagcagtagcactagcaagcaattgccaagaattggataatcagcttgtcatctctccagatggatttatgattttctaa

SEQ ID NO: 13799 - protein, 395 aa, Streptococcus pneumoniae TIGR4
MNYLQDLGITGLYLCPIFESTSNHKYNTTDYFEIDRHFGDKETFRELVDQAHHRGMKVMLDAVFNHIGSQSLQWKNVVKNGEQSAYKDWFHIQQFPVTTEKLVNKRDLPYHVFGFEDYMPKLNTANPEVKNYLLKVATYWIEEFNIDAWRLDVANEIDHQFWKDFRKAVLAKNPDLYILGEVWHTSQPWLNGDEFHAVMNYPLSDSIKDYFLRGIKKTDQFIDEINGESMYYKQQISEVMFNLLDSHDTERILWTANEDVQLVKSALAFLFLQKGTPCIYYGTELALTGGPDPDCRRCMPWERVSSDNDMLNFMKRLIKIRKYASVIISHGKYSLQEINSDLVALEWKYEGRILKAIFNQSTEDYLLEKEAVALASNCQELDNQLVISPDGFMIF

SEQ ID NO: 13800 - DNA, 1407 bp, Arthrobacter sp. FB24
  CDS (1)..(1407): transl_table=11
atgacggaaccggactgggtaaaacacgcaatctggtggcaggtctacccgatcggctttgtcggcgcggagcaggctgccgctgaacgggcgtccaaggcgccgacgtccgaggcgccgggccagactgtggcccatcggctggggcagctggttccctggcttgactacgtgctggaactcggcgcgtccgggctcgcgctggggcccgtcttcgcctcggaaacccacggctatgacaccacggactacttcaggatcgatccccggctgggcgatgacgcggactttgacgagctcatcgcccagtgccacgcccgcggactgaaagtcctgctggacggcgtcttcaaccacgtggggcgcagcttcggggcgttccagggtgtgctcacggacggtcccgggtctcctgccgcctcctggttccgcctgcggtggccggagtccggatgggcgccggggaccgaaccgggctacgaggattttgagggccatcatcacctggtggcgctcaaccacgatgaaccggcagttgccgccctggtcacggacgtgatgaagcactggctaggccggggagcggacggctggcggctggacgcggcgtacgctgtgccggcgtcgttctgggccccggtgctggctgaggtgcgccgcgagtatccggactcctatttcgtgggcgagtacatccacggcgacttcgccgaggaggtggagcggagcacgctcgactcggtcacgcagtacgaactgtggaaggccgtctggagttcactcaacgatgccaacttctacgaactcgcatccgcgctcgagcggcacaacgggttcctggacaccttcgtgccgctcacgttcgtgggcaaccacgacgtcacccgcctggccagcaagctgacgaacccggaccagctggcgcttgcgctcacagtcctcctgaccgtgggcgggacgccctgcatctactacggagacgagcaggctttccgcggcgtcaaggaggaccgggccggcggagatgacgccgtccgtccggcgttccccgcggggcccgcagaactggcggaggacggctggtccgtctaccacctgcaccaggaactgatcagcctccgacggcggcatgcctggctgcaccgggcccgcaccacggtcctggcgctcagcaacgaacacctcgtttaccaggtccgcggcgacggtaaggcagcagcaggtagcacagaggagggcggcgcaggcgccgcgctgacagtcgcgctgaacctttccggcacgccggcggacctgcccgtaccgtccgggtcaggcggcctcctggccgggcgggcccaccggcatccggatcgggatgccgtgggcctgcccggttacgggtgggcagtgctcgggaacagctag

SEQ ID NO: 13801 - protein, 468 aa, Arthrobacter sp. FB24
MTEPDWVKHAIWWQVYPIGFVGAEQAAAERASKAPTSEAPGQTVAHRLGQLVPWLDYVLELGASGLALGPVFASETHGYDTTDYFRIDPRLGDDADFDELIAQCHARGLKVLLDGVFNHVGRSFGAFQGVLTDGPGSPAASWFRLRWPESGWAPGTEPGYEDFEGHHHLVALNHDEPAVAALVTDVMKHWLGRGADGWRLDAAYAVPASFWAPVLAEVRREYPDSYFVGEYIHGDFAEEVERSTLDSVTQYELWKAVWSSLNDANFYELASALERHNGFLDTFVPLTFVGNHDVTRLASKLTNPDQLALALTVLLTVGGTPCIYYGDEQAFRGVKEDRAGGDDAVRPAFPAGPAELAEDGWSVYHLHQELISLRRRHAWLHRARTTVLALSNEHLVYQVRGDGKAAAGSTEEGGAGAALTVALNLSGTPADLPVPSGSGGLLAGRAHRHPDRDAVGLPGYGWAVLGNS

SEQ ID NO: 13802 - DNA, 1968 bp, Arthrobacter sp. FB24
  CDS (1)..(1968): transl_table=11
atgccggcattcctcccgccctgccccctcccgcaccacgacggttcgccgcttcatgtgcctcggcgcgccggcctcggcgatgatgccgggctctgcgtgcggatacccgcggcatggggccgtgccgcccgggtctgggtgcggtcggtccaggacggtgaaccccggtacgacgccgcgcgcagcctgggggagcttgacggctgggtttggtgggaagcggaaatgaccgtcaccaacccggtggcccggtaccgcttcctgctggaagtcgcggatagcgagcacgacggcggtactcccggcagcggacagacgggtagtggacatgggggcagcaccccggggtactggagcctcaacgcccagggcctgttccgccgcgacgtctccgactacgcggacttccgcctgaccaccttcccggcagcgccgcagtggctgcgccggggaacgatgtaccaggtgtttccggaccgcttcgcgcgctccgccgacgccggttcgcgtccggtgcctgactgggccataccgtccgcatgggaccacacgcccgtggagggaaccggaccggccacgccgttccagttctacggcggcgacctcaacggggtggccgaaaaactggaccatatccagcaactcggcgccgacgtcatctacctgacacccttcttcccggcacgctccaatcaccgctacgatgcctccaccttcaacgcagtggatccgctcctgggcggcgatgatgccctcgtgacgctggtggaagcggcccatgcccgcgggatcaaagtgatgggcgacctcacggccaaccattcgggcgatgcccacgagtggttccggcaggcgctggccgatcccgcatccgccgaggccggctactactacttcacagggaccgggaaacaaggcgccaccgaagcgggtgccagggcctacgaatcctggtacggcgtcgcctcgctgcccaagctcaactggtcttcagggggcctgacggacaagttcgtcctggacgatgactcgccggtggcgcgctggctcaggcccccgttcaacctggacggctggcggatcgacgtcggcaacatgaccggccggctgggcgccacggacctcaaccgggaggtggcctgcctgatcgcggaccgggtcagggacatcaacccggaagccgcactgctggccgaagccaccaacgatgccgcgccggacttcaccggcgaacactggcacggggccatgacctacgccaacttcacccgcccgctgtggtcctggctggcaggggacgccgcgcacgtcaattttttcggcaccccccttgcgggccccaaccggatgggagccgaggacttcctcgccacccacctggacctggcatcggccttcagctgggatctccggctgcagaacatgaacgccttgaacagccacgacaccgcccgtgcagccacggtgatgatcgacggcgggcagctgcttggggccgtcatgatgttcacgattcccggtgtcccggtggtcttcgccggagacgagtttggcctcaaggggtacaacggcgaagactccaggacgccgatgccgtggaacgacccttcccggattggggcggacctccgtgccagctattcggccatggcagccctgcggcggaagcagccggcgctcaccggaggcggaatccgctggttgcatgccgacggcgacgcgctcgcctatatccgcgagacagcagagagcgcggtcctggtgttcgtggcccgcgcacccgcccgggccgacctcgcggccggcgcactgtctccggcccagttctccgccctcgcggcagatcccgcattctgcacggccgacgtccggaccgatgcggcggcccggagtgccggcacccggatcagcgcgggccaagcagcggccgcggtgtggatacttcccggaacccggacaccgtaa

SEQ ID NO: 13803 - protein, 655 aa, Arthrobacter sp. FB24
MPAFLPPCPLPHHDGSPLHVPRRAGLGDDAGLCVRIPAAWGRAARVWVRSVQDGEPRYDAARSLGELDGWVWWEAEMTVTNPVARYRFLLEVADSEHDGGTPGSGQTGSGHGGSTPGYWSLNAQGLFRRDVSDYADFRLTTFPAAPQWLRRGTMYQVFPDRFARSADAGSRPVPDWAIPSAWDHTPVEGTGPATPFQFYGGDLNGVAEKLDHIQQLGADVIYLTPFFPARSNHRYDASTFNAVDPLLGGDDALVTLVEAAHARGIKVMGDLTANHSGDAHEWFRQALADPASAEAGYYYFTGTGKQGATEAGARAYESWYGVASLPKLNWSSGGLTDKFVLDDDSPVARWLRPPFNLDGWRIDVGNMTGRLGATDLNREVACLIADRVRDINPEAALLAEATNDAAPDFTGEHWHGAMTYANFTRPLWSWLAGDAAHVNFFGTPLAGPNRMGAEDFLATHLDLASAFSWDLRLQNMNALNSHDTARAATVMIDGGQLLGAVMMFTIPGVPVVFAGDEFGLKGYNGEDSRTPMPWNDPSRIGADLRASYSAMAALRRKQPALTGGGIRWLHADGDALAYIRETAESAVLVFVARAPARADLAAGALSPAQFSALAADPAFCTADVRTDAAARSAGTRISAGQAAAAVWILPGTRTP

SEQ ID NO: 13804 - DNA, 1797 bp, Arthrobacter sp. FB24
  CDS (1)..(1797): transl_table=11
gtgagttttagtccgcaaaacccgagccagcatttcacccccaagggcacgtttgagctcaacgcccccggcctgcaacacgatcccgtctggtaccgcaaagcagtgttctacgaagtcctggttcgcggctttgcggacggaaacggcgacggatccggcgacttccacgggctcatcgacaaactggactacctgcagtggctgggcgtcgactgcctctggctgccgccgttcttccagtcgccgctccgtgacggcggctacgacatctcggactacaactccgtcctggacgagttcggcaccatcagcgacttcaagcggctcgtggccgaggcccatgcccgcggcgtccgcgtaatcatcgacctgccgctgaaccacacctcggaccagcacccgtggttccaggagtcccgcaaggacccggacggaccgttcggcgacttctacgtctggagcgataccgacgagaagtaccaggatgcccgcatcatcttcgtggacaccgaggaatccaactggaccttcgaccccatccggcggcagttcttctggcaccggttcttcagccaccagcccgacctgaactttgagaacccgaaggttatcgacgcccttttcgacgtcgtccggttctggctggaccaggggatcgacggttttcgcgcggacgccatcccgtacctgtacgaggaagagggcaccaactgcgagaacctccccgccacgcacgatttcctgcgcaagctgcggaaaatggtggatgagaactacccgggcagggtcatcattgccgaggccaaccagcctccggtcgaggtggtggagtacttcggcaccgaggaagaacccgagtgccacatggccttccacttccccatcatgccgcgcctctactacgcgctgagggaccagaaagcggcgcccatcatcgagacgatgaaggacaccccggacattcccgaaggcgcccagtggggtaccttcctgcggaaccacgacgaactcaccctggaaatggtcaccgccgacgaacgcgcggccatgctcggctggtacgcaccggacccccgcatgcgcgccaacatcggcatccgccgaaggctggcgccgctgctggataattccaggtccgagattgagctcatcaatgccctgctgctttctctgccggggagcccgttcctgtactacggggatgaaatcggcatgggcgacaacatctggcttgaggaccgcgacgccgtccgcactcccatgcagtggaaccctgaccggaacgcgggcttctcgcacgcggatccgggcaagctctacctgccggtcatccagtcgctggtgtacaactacggcatggccaatgtggaggccgaggccgcgcactccggatcgctgctccgttggacccggcagatcctcagcgtccgtaagaaccaccccgtcttcgggcttggcacgttcaagcacgtcgaggcagatcacgacgtcgtgcttgcttacctgcgggaactggccccggacaatgcggcgggtgaagacgccgaatcgatcctgtgcgcgttcaacctctcgcagcatcccgtggccaccacgctgcggattccgcagtacgccggccgcggcctccgggacgtcttcggcggccagccgttccccgccatcggcgacgacgggcgtcttacgctgacgctcggcagccatgatttcttctggctgcggatccgttccgctgcttccaacccggcctcgccgttcacccaggccatgccggtcctgtccatcgaaggctga

SEQ ID NO: 13805 - protein, 598 aa, Arthrobacter sp. FB24
MSFSPQNPSQHFTPKGTFELNAPGLQHDPVWYRKAVFYEVLVRGFADGNGDGSGDFHGLIDKLDYLQWLGVDCLWLPPFFQSPLRDGGYDISDYNSVLDEFGTISDFKRLVAEAHARGVRVIIDLPLNHTSDQHPWFQESRKDPDGPFGDFYVWSDTDEKYQDARIIFVDTEESNWTFDPIRRQFFWHRFFSHQPDLNFENPKVIDALFDVVRFWLDQGIDGFRADAIPYLYEEEGTNCENLPATHDFLRKLRKMVDENYPGRVIIAEANQPPVEVVEYFGTEEEPECHMAFHFPIMPRLYYALRDQKAAPIIETMKDTPDIPEGAQWGTFLRNHDELTLEMVTADERAAMLGWYAPDPRMRANIGIRRRLAPLLDNSRSEIELINALLLSLPGSPFLYYGDEIGMGDNIWLEDRDAVRTPMQWNPDRNAGFSHADPGKLYLPVIQSLVYNYGMANVEAEAAHSGSLLRWTRQILSVRKNHPVFGLGTFKHVEADHDVVLAYLRELAPDNAAGEDAESILCAFNLSQHPVATTLRIPQYAGRGLRDVFGGQPFPAIGDDGRLTLTLGSHDFFWLRIRSAASNPASPFTQAMPVLSIEG

SEQ ID NO: 13806 - DNA, 3327 bp, Azotobacter vinelandii AvOP
  CDS (1)..(3327): transl_table=11
atggatcaatcgctcaagtccgtcgcctttctcgaggacccgttctggtacaaggacgcggtgatctaccaggtgcacgtcaagtcgttcttcgactcgaacaacgacggcatcggtgatttcccggggctgatcgccaagctggactacatcgccgacctgggggtcaacaccatctggctgctgccgttctacccttcgccgcgtcgcgacgacggctacgacatcgccgaataccgcggcgtgcatccagactacggcagcctcgccgacgtgcgacgcctcatcgccgaggcgcaccggcgcggcctgcggttgatcaccgaactggtgatcaaccacacctccgaccagcatccctggttccagcgggcgcggcaggccaggaagggctcggcggcgcgcaacttctacgtctggtcggatagcgacgacaagtaccgggacacccggatcatcttcctcgataccgagaagtccaactggacctgggacccggtggccggccagtacttctggcaccgcttctattcgcaccagccggatctcaacttcgacaacccgcaggtgatgaaggcggtgctcggcatcatgcgctactggctcgatctgggcgtcgacggtctgcgcctggacgccattccctacctgatcgagcgcgacggcaccaataacgagaacctgcccgagacccaccaggtgctcaagcgcatccgcgccgagctggatgcccgctatccggaccgcatgctgctggccgaggccaaccagtggccggaggacactcagctctacttcggcggcgccccggaggggaagggcgacgaatgccacatggccttccacttcccgctgatgccgcgcatgtacatggccatcgcccaggaagaccgcttcccgatgaccgacatcctgcgccagaccccggacatcccgtccgactgccagtgggcgatcttcctgcgcaaccacgacgaactgaccctggagatggtcaccgaccgcgagcgcgactacctgtggaacttctacgccgccgaccgccgcgcgcggatcaacctggggatacgccggcgcctggcgccgctgctggagcgcgaccggcggcgcatcgaactgctcaacagcctgctgctgtcgatgccaggtacgccggtgatctactacggcgacgagatcggcatgggcgacaacatctacctgggcgaccgcgacggggtgcgcacgcccatgcagtggagcaccgaccgcaacggcggcttttcccgcgccgatccggccggactggtgctgccgccgatcatggacccgctgtacggcttccagagcgtcaacgtcgaagcccagcagcgcgacagctactcgctgctcaactggacccggcgcatgctcgccgtacgcaagcagcagaaggccttcggccgcggctcgctgcggctgctggcgccggccaaccggcgcatcttcgcctacctgcgcgaataccatggcgcggacggcagcagcgagaccatcctctgcgtggccaacgtctcgcgctcggcccaggcggtggaactggaactgccccagttcgccgacatggtgccggtggagatgaccggcggcagcgccttcccgccgatcggccagttgccctacctgctgaccctgccgccctacggcttctgctggttcctgctggcgcccgcgtcgcagatgcccagttggcacatcaagcccaccgaaggcatgccggaattccagaccctggtgctgcggcgtctcgacgatctgctggtggaccccaaccggcgcatcctggagaaggaggtgttgccggcctacctgcccaagcgtcgttggttcgccggcaagggcgcgccctcgggcaacgtgcacatcgcctatacggtgaccttcggcaatctgccgcgccccgtgctgctcagcgagatcgaggtcggcggcgagggcggcccgcagcgctaccagttgccgctgggttttctccccgaggaggagttcggcagcgccttgccccagcaactggccatgacccgggtgcgccgtggccggcgggtgggcctgttgaccgatgccttcaccctggagggcttcgtccgcgcgacggtccaggcgctgcgcgagcgccgcgtgctggccttcgagcagggcgagctgcgctttctgcccaccgcgcaactggacaaggtcgagctgccggccgacgccgaggtgcgctacatctccgccgagcaatccaacagctcggcggtgcttggcaacgccctggtgctcaagctgatccgccgggtgtccgtcggcgtgcatcccgaactggagatgggcctgcacctcaccggatacggcttcgccaacatcgccagcgtgctcggcgaggtgtgtcgggtcgatgcccagggcggctgcaccgtgctgatgatcctgcagcgctacctggagaaccagggcgacgcctgggagtggacgcagaacaccctcgaccgggccatccgcgacgaactggccggcggcgagtcgaccctggagagccagtacagcgcgctgcacgagctggagagcttttcccgccagctcggccagcgcctcggcgagatgcacatggccctggccgcgcccaccgaggacccggatttcgctcgcgaaaccgccggtcccgagcaagcggcgcagtggaccgagagcatcggcgcgcaactggggcgggccctggaaatcctcgcccagcgccaggcgacgctggccgaggaggaacgggccgccgtcgagcagttgctgctgcagcgtgatgccctgctggagaaagtcggcgaactggccggggcctgcgtcggcagcctgcgcatccgcgtgcatggcgatctgcacctcggccaggtgctggtggtgcagggcgacgcctatctgatcgacttcgagggcgagccgtcgcggccgctcgccgcgcgccgcgccaagcacagcccttacaaggacgtcagcggcgtgctgcgctcgatcggctacgccgccgacatggccatgcgcaacgcgcagagtgtcgacagctccgaggcggccgaccaggcccgtcggcgcatcgcctcgctgtaccaggcgaacgcccgccaggccttcctcgccgcctaccgccaggcggcggccgagatcggccatgcctgggccgtgccggacggcgaggaggccgcgctggcgctgttcagcctggaaaagaccgcctacgaaatcgcctacgaggccgaaaaccgccccgcctggctggccgtaccgctgcggggcctggcgaatctggcgcaacagctactggatggagaggcgcaatga

SEQ ID NO: 13807 - protein, 1108 aa, Azotobacter vinelandii AvOP
MDQSLKSVAFLEDPFWYKDAVIYQVHVKSFFDSNNDGIGDFPGLIAKLDYIADLGVNTIWLLPFYPSPRRDDGYDIAEYRGVHPDYGSLADVRRLIAEAHRRGLRLITELVINHTSDQHPWFQRARQARKGSAARNFYVWSDSDDKYRDTRIIFLDTEKSNWTWDPVAGQYFWHRFYSHQPDLNFDNPQVMKAVLGIMRYWLDLGVDGLRLDAIPYLIERDGTNNENLPETHQVLKRIRAELDARYPDRMLLAEANQWPEDTQLYFGGAPEGKGDECHMAFHFPLMPRMYMAIAQEDRFPMTDILRQTPDIPSDCQWAIFLRNHDELTLEMVTDRERDYLWNFYAADRRARINLGIRRRLAPLLERDRRRIELLNSLLLSMPGTPVIYYGDEIGMGDNIYLGDRDGVRTPMQWSTDRNGGFSRADPAGLVLPPIMDPLYGFQSVNVEAQQRDSYSLLNWTRRMLAVRKQQKAFGRGSLRLLAPANRRIFAYLREYHGADGSSETILCVANVSRSAQAVELELPQFADMVPVEMTGGSAFPPIGQLPYLLTLPPYGFCWFLLAPASQMPSWHIKPTEGMPEFQTLVLRRLDDLLVDPNRRILEKEVLPAYLPKRRWFAGKGAPSGNVHIAYTVTFGNLPRPVLLSEIEVGGEGGPQRYQLPLGFLPEEEFGSALPQQLAMTRVRRGRRVGLLTDAFTLEGFVRATVQALRERRVLAFEQGELRFLPTAQLDKVELPADAEVRYISAEQSNSSAVLGNALVLKLIRRVSVGVHPELEMGLHLTGYGFANIASVLGEVCRVDAQGGCTVLMILQRYLENQGDAWEWTQNTLDRAIRDELAGGESTLESQYSALHELESFSRQLGQRLGEMHMALAAPTEDPDFARETAGPEQAAQWTESIGAQLGRALEILAQRQATLAEEERAAVEQLLLQRDALLEKVGELAGACVGSLRIRVHGDLHLGQVLVVQGDAYLIDFEGEPSRPLAARRAKHSPYKDVSGVLRSIGYAADMAMRNAQSVDSSEAADQARRRIASLYQANARQAFLAAYRQAAAEIGHAWAVPDGEEAALALFSLEKTAYEIAYEAENRPAWLAVPLRGLANLAQQLLDGEAQ

SEQ ID NO: 13808 - DNA, 3414 bp, Burkholderia vietnamiensis G4
  CDS (1)..(3414): transl_table=11
atgatgaaacgcgaagattccctcgacgacgtgcgccgcgcgcagttcgcgtccgtcgcaccggccggcaccgcgcgcgcgcgccgcgcgcggcgccgcgagcccgcgctgagcacggacgatccgctgtggtacaaggacgcgatcatctatcaggtgcacgtgaagtcgttctacgactccaacaacgacgggatcggcgacttccccggcctgatcatgaagctcgactacatcgccgagctgggcgtcgacacgatctggctgctgccgttctatccgtcgccgcgccgcgacgacggctacgacatcgccgactatcgcggcgtgcatccggactacggcacgctcgccgacgtgcgccgcttcatccgcgaggcgcatgcgcgcggcatccgcgtgatcgccgagctggtgatcaaccacacgtccgaccagcacccgtggttccagcgcgcgcggcgcgccaagcccggctcgacgcatcgcgactactacgtgtggtccgacaccgacacgaagtacgcgggcacgcgcatcatcttcctcgatacggaaacctcgaactggacccacgatccggtcgccggccagtactactggcaccgcttctactcgcaccagccggacctgaacttcgacaacccggccgtcgtgcgcgaggtgatccaggtgatgcgcttctggctcgacctcggcatcgacgggctgcggctcgacgcggtgccgtatctggtcgagcgcgaaggcaccaacaacgagaacctgcccgagacgcacgcgatcctgaagcggatccgcgcgacgatcgacgccgagtatccgaaccgcatgctgctcgcggaagcgaaccagtggccggaagacgtgcaggagtatttcggcaacgaggacgaatgccacatggcgttccacttcccgctgatgccgcgcatctacatgtcgatcgcgagcgaggaccgcttcccgatcctcgacatcatgcggcagacgccggcgctcgcgccgagcaaccagtgggccgtgttcctgcgcaatcacgacgagctgacgctcgagatggtgaccgactccgagcgcgacctgctgtggcagacctacgcgagcgaccggcgcgcgcggctgaatctcggcattcgccgccgcctcgcgccgctgatggagcgcgaccggcgccgcatcgagctgatcaactcgctgctgctgtcgatgcccggcacgccggtgatctactacggcgacgagctcgggatgggcgacaacatccacctcggcgaccgcgacggcgtgcgcacgccgatgcaatggtcgtcggaccgcaacggcggcttctcgcgcgccgatccggaattgctggtgctgccgcccgtgatgggctcgctgtacggctatgacgcgatcaacgtcgaggcgcagacgcgcgacccgcactcgctgctgaactggacccgccgcattctcgcgacgcgccgcgcgacccaggtgttcggccgcggcacgatccgcttcctgcgccccgagaaccgcaaggtgctcgcctacctgcgcgagctggacggccacgagccggtgctgtgcgtcgcgaacctatcgcgcgcgtcgcaggcggtcgagctcgatctgtccgaattcgcgggccgcgtgccgatcgagatgacgtcggactcgccgttcccgccgatcgggcagctcacctacctgctgacgtttccgccgtacggcttcctgtggttcgtgctgtccgagcacggccgcgagccgtcgtggcggcagccgcaggccgagccgctgcccgagtacgtgacgatcgtgatgcggcgcggcgagcagcggcccgacgtcggccagctgcatacgctcgcgcacgacgcgctgtcgtcgtggctcacgcggcgccgctggttcgcgtcgaaggaccgcaagatcggcgacgcgcggctgaacgtcgtcacgccgatgcctgacgagccgttccagtatgcggaggcatgggtgacgacccacggcggcgacgtcgaacgctacgtggtgccgctcgcggccgcatggggcggcgaaacgtcgaacccgctgttcgcgcagctcgcgctcgcgcgcgtgcggcgcggccacacggtcggctatctgaccgacgcgttcgcgctgccggccttcgggcgcgggatgttgcggatgctgcgcgacggcgcgaccgtgccgacttccgacggcggccgcctcgagttcctgcccgagcaggcgctcgccgcgctcgatcccggcgacgatgccgaagtgcgctggctcgccgccgagcagagcaacagctcgctcgtgatcggcgatgcgatcgtgctgaagctggtgcgcaaggtcgcgcacggcgtgcatccggaggcggagatgagccgttacctgacgcggatcggctatgcgaacaccgcgacgctcgccggcgaggtcgtgcacgtcgatcccgacggcacgccgcacacggtcgcgatcctgcaacgctacgtcgacaaccagggcgacgcgtggacgcgctcgttcgacttcctcaagcgcgcgatcgacgagctggcgctgccggccgtcggcgacggcgagcccgcggagcgcgacggcgagcccgatgcgctgctcggctacgcggcgttcgcgggcgtcgtcggcacgcggctcggcgagttgcacgtcgcgctcgcgcagccgtcggacgacgccgcgttcgcgccggagcgcgcgacgcccgagcacgtcgacggctggtgcgtcgacgcgattgcctcgttcggccatgcgctcgacgtgctggccacgcggctcgacgcgctcgacccgagcgcccgcgacgcggccgagacgctgctcgcgtcgcgcgacgcggccgtgcaggcgctcggcgcgctggtgccgcgcacgctcgacgcggtctgcacgcgcatccacggcgacttccatctcggccaggtgctcgacgtgcagggcgacgcgctgctgatcgatttcgaaggcgagccggcgcgcgcgctcgagcgccgccgcgcgaagtcgcatccgctgcgcgacgtcgccggcttgctgcgttcgctgtcgtacgtgagcgcgaccgcgcagttcgcgatcgagaaggtgccgccgcaggcggccggccgcaagcgcgcgttgttcgaccgcttcgggcaggcagccgcggaccgcttcgtcgagtgctatcgcgcggcggccgagcatgcgccggaacgcttcgtcgatccgcgctacgccgatcgcctgctcgcgctgttcctgatcgacaaggcgtcgtacgagctctgctatgaagccgcgaaccgccccgactggctcggcgtgccggtcggcgggctcgccgcgctcgtcgaacgcctgctggacgcgcacgccgcgtccgaccacggaggcacccgatga

SEQ ID NO: 13809 - protein, 1137 aa, Burkholderia vietnamiensis G4
MMKREDSLDDVRRAQFASVAPAGTARARRARRREPALSTDDPLWYKDAIIYQVHVKSFYDSNNDGIGDFPGLIMKLDYIAELGVDTIWLLPFYPSPRRDDGYDIADYRGVHPDYGTLADVRRFIREAHARGIRVIAELVINHTSDQHPWFQRARRAKPGSTHRDYYVWSDTDTKYAGTRIIFLDTETSNWTHDPVAGQYYWHRFYSHQPDLNFDNPAVVREVIQVMRFWLDLGIDGLRLDAVPYLVEREGTNNENLPETHAILKRIRATIDAEYPNRMLLAEANQWPEDVQEYFGNEDECHMAFHFPLMPRIYMSIASEDRFPILDIMRQTPALAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAINVEAQTRDPHSLLNWTRRILATRRATQVFGRGTIRFLRPENRKVLAYLRELDGHEPVLCVANLSRASQAVELDLSEFAGRVPIEMTSDSPFPPIGQLTYLLTFPPYGFLWFVLSEHGREPSWRQPQAEPLPEYVTIVMRRGEQRPDVGQLHTLAHDALSSWLTRRRWFASKDRKIGDARLNVVTPMPDEPFQYAEAWVTTHGGDVERYVVPLAAAWGGETSNPLFAQLALARVRRGHTVGYLTDAFALPAFGRGMLRMLRDGATVPTSDGGRLEFLPEQALAALDPGDDAEVRWLAAEQSNSSLVIGDAIVLKLVRKVAHGVHPEAEMSRYLTRIGYANTATLAGEVVHVDPDGTPHTVAILQRYVDNQGDAWTRSFDFLKRAIDELALPAVGDGEPAERDGEPDALLGYAAFAGVVGTRLGELHVALAQPSDDAAFAPERATPEHVDGWCVDAIASFGHALDVLATRLDALDPSARDAAETLLASRDAAVQALGALVPRTLDAVCTRIHGDFHLGQVLDVQGDALLIDFEGEPARALERRRAKSHPLRDVAGLLRSLSYVSATAQFAIEKVPPQAAGRKRALFDRFGQAAADRFVECYRAAAEHAPERFVDPRYADRLLALFLIDKASYELCYEAANRPDWLGVPVGGLAALVERLLDAHAASDHGGTR

SEQ ID NO: 13810 - DNA, 3414 bp, Burkholderia cenocepacia HI2424
  CDS (1)..(3414): transl_table=11
atgatgaaacgcgaagattccctcgacgacgtgcgccgcgcgcaattcccgtcgctcgcgccggccggcacgccgcgccggcgccgcgcgcgccgccgcgaacccgcgctctgcgcggacgatccgctgtggtacaaggacgcgatcatctaccaggtgcacgtgaagtcgttctacgactcgaacaacgacggcatcggcgatttccccggcctgatcgcgaagctcgactacatcgccgaactcggtgtcgacacgatctggctgctgccgttctatccgtcgccgcgccgcgacgacggctacgacatcgccgattaccgcgacgtgcatcccgactacggcacgctggccgacgtgcggcgcttcatccgcgaggcgcatgcgcgcggcatccgcgtgatcgcggagctcgtgatcaaccacacgtcggaccagcatccgtggttccagcgcgcgcgccgcgcgaagccgggctccacgcatcgcgactactacgtgtggtccgacaccgacacgaaatacgcgggcacgcggatcatctttctggataccgaaacgtcgaactggacccacgacccggtggccggccagtactactggcaccgcttctactcgcaccagccggacctgaacttcgacaacccggccgtcgtgcgcgaagtgatccaggtgatgcgcttctggctcgacctcggcatcgacgggctgcggctcgacgcggtgccgtatctcgtcgagcgcgaaggtaccaacaacgagaacctgcccgagacgcatgcgatcctgaagcggattcgcgcgacgatcgacgccgagtacccgaaccggatgctgctcgcggaagcgaaccagtggccggaagacgtgcaggaatacttcggcaacgaggacgaatgccacatggcgttccacttcccgctgatgccgcgcatctacatgtcgatcgcgagcgaggatcgcttcccgatcctcgacatcatgcggcagacgccggcgctcgcgccgagcaaccagtgggccgtgttcctgcgcaaccacgacgagctgacgctcgagatggtcaccgattcggagcgcgacctgctgtggcagacctatgcgagcgaccgccgcgcgcggctgaacctcggcatccggcgccggctcgcgccgctgatggagcgcgaccggcgccgcatcgagctgatcaattcgctgctgctgtcgatgcccggcacgccggtgatctactacggcgacgaactcgggatgggcgacaacatccacctcggcgaccgcgacggcgtgcgcacgccgatgcagtggtcgtcggaccgcaacggcggcttctcgcgcgccgaccccgaactgctggtgctgccgccggtgatgggctcgctgtacggctatgacgcgatcaacgtcgaggcgcagacgcgcgatccgcactcgctgctgaactggacccgccgcatcctcgcgacgcgccgcgcgtcgcaggcgttcgggcgcggcacgatccgcttcctgcgcccggagaaccgcaaggtgctcgcgtacctgcgcgagctggacggccacgagccggtgctgtgcgtcgcgaacctgtcgcgcgcgtcgcaggcggtcgaactcgacctgtccgaattcgcgggccgtgtgccgatcgagatgacgtccgattcgccgtttccgccgatcggccagctcccgtatctcctcaccttcccgccgtacgggttcctgtggttcgtgctcgccgagcatggccgcgagccgtcgtggcggcagccgcatgcggagccactgcccgaatacgtgacgctcgtgatgcggcgcggcgatacgcggccagacgtctcgcaactgcacgcgctggcgcacgacgcgctcgcgtcgtggctcgcacggcggcgctggttcgcatcgaaggatcgcaagatcggcgacgcgtggctgaacgtcgtcacgccgattccggacgagccgttccagtatgcggaggcgtgggtgtccgcgagcgacggcggcgtcgagcgctacgtggtgccgctcgcgaccgcgtggggcggcgagacgtcccatccgctattcgcgcaactggcgctggcgcgcgtgcggcgcggccatacggtcggctacctgaccgatgcgttcgcgctgccggcgttcgcgcgcgggatgctgcgcaagctgcgcgacggcgcgacggtgcccacgtccgacggcggccggctcacctttctcccggaagacgcgctcgccgggctcgatccgggcgacgacgcggaagtgcgctggctcgcggccgagcagagcaacagttcgctcgtgatcggcgacgcgatcgtgctgaagctggtgcgcaaggtcgcgcacggcattcatccggaagcggaaatgagccggcacctgacgcgcatcggctatgcgaacactgcgacgctggtcggcgaagtcgtgcacgtcgacccggacggcacgccgcatacggtcgcgatcctgcagcgctacgtcgacaaccagggcgacgcgtggacgcgctcgttcgacttcctgcgccgcgcgatcgacgagctggcgctgccggccgcggacgaaggcgaggcggccgaaacggacgaggaacccgacgcactgctcggctacgcggcgttcgccggcatcatcggcacgcggctcggccagttgcacgtcgcgctcgcgcagccgtccgacgatcccgcgttcgcaccggagcgcgcgacgcccgatcacgtcgacggctggtgcgtggacgcgatcgcgtcgttcgaacgcgcgctcgacgtgctgcgcacgcggctcgacgcgctcgatgcgcccacccgcgcgtcggccgacgcgctcctcgcatcgcgcgacgcggccgtcgaggcgctcggcgaactggtgccgcgcacgctcgacgcgcaatgcacgcggattcacggcgattttcatctgggccaggtgctcgacgtgcagggcgacgcgctgctgatcgacttcgaaggcgaaccggcgcgcccgctcgagcggcgtcgcgcgaaatcgcatccgctgcgtgacgtggccggcctgctgcgctcgctgtcgtacgtgagcgcgaccgcgcagttcgcaatcgagaaggcgccgccgcaagcggccggccgcaagcgtgcgctgttcgaccgcttcggacaggccgccgccgaccgcttcgtcgaatgctatcgcgcggcggccgacctcgcgcccgcgcgcttcgtcgatccgcactatgcggaccgcctgctcgcgctgttcctgatcgacaaggcgtcgtacgagctgtgctacgaagccgcgaaccggcccgactggctgagcgtgccggtcggcgggctcgcggcgctggtcgaccggctgctcggcgacggcgcgctgcccgacgacggaggaaacccatga

SEQ ID NO: 13811 - protein, 1137 aa, Burkholderia cenocepacia HI2424
MMKREDSLDDVRRAQFPSLAPAGTPRRRRARRREPALCADDPLWYKDAIIYQVHVKSFYDSNNDGIGDFPGLIAKLDYIAELGVDTIWLLPFYPSPRRDDGYDIADYRDVHPDYGTLADVRRFIREAHARGIRVIAELVINHTSDQHPWFQRARRAKPGSTHRDYYVWSDTDTKYAGTRIIFLDTETSNWTHDPVAGQYYWHRFYSHQPDLNFDNPAVVREVIQVMRFWLDLGIDGLRLDAVPYLVEREGTNNENLPETHAILKRIRATIDAEYPNRMLLAEANQWPEDVQEYFGNEDECHMAFHFPLMPRIYMSIASEDRFPILDIMRQTPALAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAINVEAQTRDPHSLLNWTRRILATRRASQAFGRGTIRFLRPENRKVLAYLRELDGHEPVLCVANLSRASQAVELDLSEFAGRVPIEMTSDSPFPPIGQLPYLLTFPPYGFLWFVLAEHGREPSWRQPHAEPLPEYVTLVMRRGDTRPDVSQLHALAHDALASWLARRRWFASKDRKIGDAWLNVVTPIPDEPFQYAEAWVSASDGGVERYVVPLATAWGGETSHPLFAQLALARVRRGHTVGYLTDAFALPAFARGMLRKLRDGATVPTSDGGRLTFLPEDALAGLDPGDDAEVRWLAAEQSNSSLVIGDAIVLKLVRKVAHGIHPEAEMSRHLTRIGYANTATLVGEVVHVDPDGTPHTVAILQRYVDNQGDAWTRSFDFLRRAIDELALPAADEGEAAETDEEPDALLGYAAFAGIIGTRLGQLHVALAQPSDDPAFAPERATPDHVDGWCVDAIASFERALDVLRTRLDALDAPTRASADALLASRDAAVEALGELVPRTLDAQCTRIHGDFHLGQVLDVQGDALLIDFEGEPARPLERRRAKSHPLRDVAGLLRSLSYVSATAQFAIEKAPPQAAGRKRALFDRFGQAAADRFVECYRAAADLAPARFVDPHYADRLLALFLIDKASYELCYEAANRPDWLSVPVGGLAALVDRLLGDGALPDDGGNP

SEQ ID NO: 13812 - DNA, 1614 bp, Chromohalobacter salexigens DSM 3043
  CDS (1)..(1614): transl_table=11
atgaaggacaacactttctggtggcgcggtggtgtcatctaccaaatctatccgcgcagctttctggacagcaacggcgacggtatcggcgacctgccgggcatcatcgaaaagctcgattacgtggcgtcgctcggtgtcgatggcatctggctgtcgcctttctttacatctccgatggcggattttggctacgacatcagcgattatcgcgacgtcgaccccatgttcggcaccctggacgacttcaagtcactgctcagtcacgcccatgctctggggctcaaggtgatcatcgatcaagtgatcagccatacgtcggaccagcatccctggtttcaggaaagtcgtcgcgaccgacaaaatgctcgtgccgattggtacgtatgggccgaccccaagcccgacggcacgccgcccaacaactggctgtctatctttggcggttcggcgtggacattcgactcgcgacgtcgtcagtattacctgcataatttcctgatcgagcagccggatcttaattttcataatccggccgtgcgtgacgctcagctcgacaacatgcgcttttggctggaacttggtgtcgatggctttcgcctggataccgtcaacttctatttccatgatgccgaactgcgcgacaacccggctatcgagcccggcgatacaaagacgctgggtgctccggaggccaacccttacacgtggcaacgccatgtccatgacataagccgccccgaaaacctcgacttcctcaaacgattacgcgcgttgatggatgagtttccgggcacggcgacggtcggtgagatcagcgaagatagtccactcgagcgcatggcggagtacaccgccaatggtgacaagctgcacatggcctacaccttcgatctgcttaatgcaccgcgctccccggcctacattcatgaggtgattgaacgcttccagcgactggcgggcgatgcctggccttgctgggcactgtccaaccacgatgtgatgagaagcgccacgcgctggggagccgaggaagacgccgaggcgtatcccaaggtcacgttggccatgctcttgtcattgcgcggcagcgtttgcctttatcaaggtgaggaactcggtctgcccgaggccgaagtgcctttcgagcgtattcaggacccctacggcaaggtcctttggcctgacttcaagggacgtgacggctgccggacgccgatgccctggcatgacggtattcatggcggtttttcgcgtgtcgagccttggttgccggtggatgcccgccacctgcagcgtgctgtgtcgcgtcagcaggcgagtctcgattccatgctcaacagcgtgcgggcgctgatcgcatttcgtcacgaccacccggcgctgttcgacggtgacctgcgattgctcgatgtcggcgatgccctgcttggcttcgttcgtgagcatgctcaggaacgccttgtgtgcgtgttcaacctgactgaccaggcgcaggcgtgttgcctgcccgagccagggcacctgctagacgctcccgggttcacggcgcacgtggaaaacgaccgcttgaccctgccggcctatcaggcggcctatctgcgccttgactga

SEQ ID NO: 13813 - protein, 537 aa, Chromohalobacter salexigens DSM 3043
MKDNTFWWRGGVIYQIYPRSFLDSNGDGIGDLPGIIEKLDYVASLGVDGIWLSPFFTSPMADFGYDISDYRDVDPMFGTLDDFKSLLSHAHALGLKVIIDQVISHTSDQHPWFQESRRDRQNARADWYVWADPKPDGTPPNNWLSIFGGSAWTFDSRRRQYYLHNFLIEQPDLNFHNPAVRDAQLDNMRFWLELGVDGFRLDTVNFYFHDAELRDNPAIEPGDTKTLGAPEANPYTWQRHVHDISRPENLDFLKRLRALMDEFPGTATVGEISEDSPLERMAEYTANGDKLHMAYTFDLLNAPRSPAYIHEVIERFQRLAGDAWPCWALSNHDVMRSATRWGAEEDAEAYPKVTLAMLLSLRGSVCLYQGEELGLPEAEVPFERIQDPYGKVLWPDFKGRDGCRTPMPWHDGIHGGFSRVEPWLPVDARHLQRAVSRQQASLDSMLNSVRALIAFRHDHPALFDGDLRLLDVGDALLGFVREHAQERLVCVFNLTDQAQACCLPEPGHLLDAPGFTAHVENDRLTLPAYQAAYLRLD

SEQ ID NO: 13814 - DNA, 3396 bp, Burkholderia pseudomallei S13
  CDS (1)..(3396)
atgaagcccgcagacacgctcgaagacgtcggccgcgcgcagttcgtcgcgcacatggcccgaaggccgcgcggcgcgcgcaggcgagaggcgccgggcgtcgccgacacgccgctgtggtacaaggatgcgatcatctaccaattgcacgtgaagtcgttcttcgacgccaacaacgacggcgtcggcgatttcgccggcctgatcgcgaagctcgactacatcgcggagctcggcgtcgacacggtgtggctgctgccgttctatccgtcgccgcgccgcgacgacggctacgacatcgccgactaccgcggcgtgcatcccgactacggcacgctcgcggacgtgcgccgcttcatccgcgaggcgcacgcgcgcgggctgcgggtgatcaccgagctcgtgatcaaccacacgtcggatcagcatccgtggttccagcgcgcccggcgcgcgaagcgcggctccgtccaccgcgactactacgtgtggtccgacaccgatctcaagtacgcgggcacgcggatcatcttcctcgataccgagacgtcgaactggacgcacgatccggtcgcgggccagtactactggcatcgcttctattcgcatcagcccgacctgaacttcgacaatccggccgtggtgcgcgaagtgctgcagatcatgcgcttctggctcgatctcggcatcgacgggctgcggctcgacgcggtgccctacctcgtcgagcgcgagggcacgagcaacgagaacctgccgcagacgcacgcgatcctcaagctgatccgcgcgacgatcgacgccgagtacccgaaccggatgctgctcgccgaagcgaaccagtggcccgaggacgtccaggaatatttcggcgacgaggacgagtgccacatggccttccacttcccgctgatgccgcgcatctacatgtcgatcgcgagcgaggaccgctttccgatcatcgacatcatgcggcagacgcccgccctcgcgccgagcaatcaatgggcggtgttcctgcgcaaccacgacgagctcacgctcgagatggtcaccgattcggagcgcgacctgctctggcaagcctacgcgagcgagcgccgcgcgcggctgaacctcggcatccgccgccggctcgcgccgctgatggagcgcgaccgccgcaggatcgagctgatcaactcgatcctgctgtcgatgcccggcacgcccgtcatctactacggcgacgagctcggcatgggcgacaacctgcacctcggcgatcgcgacggcgtgcgcacgccgatgcaatggtcgtcggaccgcaacggcggcttctcgcgcgccgatcccgagctgctcgtgctgcctccggtgatgggcacgctgtacggctacgacgcgatcaacgtcgaggcgcagacgcgcgatccgcattcgctgctgaactggacgcggcgcatcctgtcgacgcgccgcgcgacgcgcgtgttcggacgcggcgcgatccgcttcctgcgcccgggcaaccgcaagatcctcgcgtatctgcgcgagctcgacggcgaaacgccggtgctctgcgtcgcgaacctgtcgcgcgcgtcgcaggcggtcgagctcgacctgtcggaattcgccggctgcgtgccgaccgaaatgacgtcggactcgccgttcccgccgatcggccaactgccgtatctgctgacgttcccgccgtacggcttcctgtggttcgcgctgtccgagcacggccgcgagccggcctggcatcagcagtacgccgagccgctgcccgaatacctgacgctcgtgatgcggcgcggcgagacgcagccgggcgccgcgctgctcgacacgctcgcgcaggacgcgctgccgtcatggctcgcgcggcggcgctggttcgcatcgaaggagcggcgcgtcgacagcgcgcgcttcgacgcgctcacgccgattccgggcgagccgtttcagtatgcggaggcgcgcgtcgccgtcgacggccgcgaagaacgctacgtggtgccgctcgcgagcgcctggggcagcgagacgcctcagccgctgttcgcgcagctcgcgctcgcgcgcgtgcggcgcggccatacggtcggcctgctgaccgacgcgttcgcgctgccgtcgttcgcgcacggcgtgctgcgccagctgcgcgcgggcgcggccgtgccggtggcgggcggcgggcgtctcgaattccggcccgagccggacctggcgcggctcgatcccggcgatgcgcccggcgtgcggtggttcgccgccgagcagagcaacagctcgctcgtgatcggcgaggcgatcgtgctgaagatcgtgcgcaagctcgccgcgggcgtccacccggaagcggagatgggccggcacctgcggcgcatcggctaccggaacgtcgcgccgctcgtcggcgaggtcgtgcgcatcggcgcggacggcgcgccgcacaccgtcgcgatcctgcaggaatacgtcgacaatcagggcgacgcgtggacgcgctcgtgcgattttctcaagcgcgcgatcgaggagctcgcgctgcccgcggcaaacgacgccgacgcggcggcgccgagcgccgagccggagatgatcgacggctacgcgacgttcgcgggcatcgtcggcaagcggctcggcgaactgcacgcggcgctcgcgcagccgagcgacgatgcggcgttcgcgccgcagcgcgtgtcgcccgcgcgcgtcgacggctggatcggcgatgcgctgggctggttcgaacgcgcggcgagcctgctggccgaacggctcgacacgctcgaaggccaaacgcgcgcggccgccgagctgctcgtcgcgcagcgcgccgcggtggccgaggcgctgcgtgcgctggtgccgcgcgagctcgacggatgctgcatccggattcacggcgacttccacctgggccaggtgctcgacgtgcaaggcgacgcgcttctcatcgatttcgagggcgaacccgcgcgcccgctcgagcagcgccgcgcgcaatcgcatccgttacgcgacgtggccgggttcctgcggtcgctgtcgtacgcgagcgcggccgcgcagttcacgatcgaaaaggcgccgcagcaggccgccgagcgcaagcgcgcgctgttcgagcgcttcgggcaggcggccgcggaccgcttcgttgcgcaataccgcgaagcgctgtcggccgcgtcgcgcgaattcgtcgagccgcgctatgcggaccggctgctcgcgctgttcctcatcgagaaggcgtcctacgagctgtgctacgaagccgcgaaccggccggactggctgagcgtgcccgcaaacggcctcgccgcgctcgtcgcgcgcctgatcggcggcgccgcgccgcagcaggaggacgcgcgatga

SEQ ID NO: 13815 - protein, 1131 aa, Burkholderia pseudomallei S13
MKPADTLEDVGRAQFVAHMARRPRGARRREAPGVADTPLWYKDAIIYQLHVKSFFDANNDGVGDFAGLIAKLDYIAELGVDTVWLLPFYPSPRRDDGYDIADYRGVHPDYGTLADVRRFIREAHARGLRVITELVINHTSDQHPWFQRARRAKRGSVHRDYYVWSDTDLKYAGTRIIFLDTETSNWTHDPVAGQYYWHRFYSHQPDLNFDNPAVVREVLQIMRFWLDLGIDGLRLDAVPYLVEREGTSNENLPQTHAILKLIRATIDAEYPNRMLLAEANQWPEDVQEYFGDEDECHMAFHFPLMPRIYMSIASEDRFPIIDIMRQTPALAPSNQWAVFLRNHDELTLEMVTDSERDLLWQAYASERRARLNLGIRRRLAPLMERDRRRIELINSILLSMPGTPVIYYGDELGMGDNLHLGDRDGVRTPMQWSSDRNGGFSRADPELLVLPPVMGTLYGYDAINVEAQTRDPHSLLNWTRRILSTRRATRVFGRGAIRFLRPGNRKILAYLRELDGETPVLCVANLSRASQAVELDLSEFAGCVPTEMTSDSPFPPIGQLPYLLTFPPYGFLWFALSEHGREPAWHQQYAEPLPEYLTLVMRRGETQPGAALLDTLAQDALPSWLARRRWFASKERRVDSARFDALTPIPGEPFQYAEARVAVDGREERYVVPLASAWGSETPQPLFAQLALARVRRGHTVGLLTDAFALPSFAHGVLRQLRAGAAVPVAGGGRLEFRPEPDLARLDPGDAPGVRWFAAEQSNSSLVIGEAIVLKIVRKLAAGVHPEAEMGRHLRRIGYRNVAPLVGEVVRIGADGAPHTVAILQEYVDNQGDAWTRSCDFLKRAIEELALPAANDADAAAPSAEPEMIDGYATFAGIVGKRLGELHAALAQPSDDAAFAPQRVSPARVDGWIGDALGWFERAASLLAERLDTLEGQTRAAAELLVAQRAAVAEALRALVPRELDGCCIRIHGDFHLGQVLDVQGDALLIDFEGEPARPLEQRRAQSHPLRDVAGFLRSLSYASAAAQFTIEKAPQQAAERKRALFERFGQAAADRFVAQYREALSAASREFVEPRYADRLLALFLIEKASYELCYEAANRPDWLSVPANGLAALVARLIGGAAPQQEDAR

SEQ ID NO: 13816 - DNA, 1728 bp, Clostridium thermocellum ATCC 27405
  CDS (1)..(1728): transl_table=11
atgaaacttgaggcaatatatcacaaaccttacagcgagtttgcatttcctgttgctcccgacactctggtaatacggctcaggacggctaaaaacgatgtaaacacctgcattctcatctatcatgaaaagtatgatacgtcacaaagaggaaaagtgaaaatggataaagttgcaagcgatggaatgtttgactattacgaggtggagcttaatgtcggtataaagagaattaagtatatgttttatcttgaggataattattcaataaaatggtacagcagcgacggattttttgattatatgcctcagtggggacattttacctattcttatatatgcaaagacgacatatttcatgaggttgaatggtttcgtaattcaacaatatatcagatatttcccgacagatttgcaaagtttccgccggataccgaaaattcgggcaaaagaacgatacatgggggcaatattaaagggataatcgaccggtttgatcatttagtcaaacttggagttgatgtggtttatttaaatcccatattcaaatcggaatcttatcatcgctatgatgttgtcgattattatgaaattgacccgatgtttggaagtaaagaagagctcagggaattgatggacttgtgtcacaaaaacggtataaaagtaatatttgacggagtttttaatcactccggagacaagttttttgcattcagagatgttgtggaaaaaggagaaaaatcaaagtatgcaaactggtattttataaattcttttcccgttcagggatatccaagacccaattatgaatgcttttccttttatggaggaatgccgaagcttaacaccggaaatcctgagacggcaaaatactttcttgatgtggtaaagtattggacagtggagtttggggtggacggatggagacttgatgcggcggatgaggtggaccgaaagttttggagaaagcttagggatatgctgaaagatttgaacaaggatgtggtgctgattggcgaaatatttgacgaggcgtcttcgtggctttggggagaccagtttgactcggtgataaattatccgttgaaagccatgataaatgacctttttgcctataggtccattgatgtggagactttcaggaacagaataagcggctatattatgaagtttaacaaaaaggtgctaagcagcctggtaaatataataagcactcatgacacgccaaggtttttgactctttgcaacggagatgaaaagaggtttgagatggcagtagtgttccagtttacctttcctggagttcccctcatatactacggcgatgaaatagggatggaaggcgaaggagaccctgattgcagaagaccgatgatatgggacgaagcgaaatggaacaaaaaaactctcgagttgtataaattcctgattggcttgaggaagaggttcgatgccttgagaactggagaatatggagaacttcctgtaacaggatgcaatgggatactggcatacagaaggggccggggagaaaacggaattattgttgccatgaatacattggaccgaaaggaaaatgtcgtagtagaaacaggagattcttttgacacggtaaaagcttttgagtctttgaaagacgaagaaagactgaatgttgacaaaaaaaggataaacatatgcttaaatccgtttgagtggaggatttacaaagcctgcggcgaattataa

SEQ ID NO: 13817 - protein, 575 aa, Clostridium thermocellum ATCC 27405
MKLEAIYHKPYSEFAFPVAPDTLVIRLRTAKNDVNTCILIYHEKYDTSQRGKVKMDKVASDGMFDYYEVELNVGIKRIKYMFYLEDNYSIKWYSSDGFFDYMPQWGHFTYSYICKDDIFHEVEWFRNSTIYQIFPDRFAKFPPDTENSGKRTIHGGNIKGIIDRFDHLVKLGVDVVYLNPIFKSESYHRYDVVDYYEIDPMFGSKEELRELMDLCHKNGIKVIFDGVFNHSGDKFFAFRDVVEKGEKSKYANWYFINSFPVQGYPRPNYECFSFYGGMPKLNTGNPETAKYFLDVVKYWTVEFGVDGWRLDAADEVDRKFWRKLRDMLKDLNKDVVLIGEIFDEASSWLWGDQFDSVINYPLKAMINDLFAYRSIDVETFRNRISGYIMKFNKKVLSSLVNIISTHDTPRFLTLCNGDEKRFEMAVVFQFTFPGVPLIYYGDEIGMEGEGDPDCRRPMIWDEAKWNKKTLELYKFLIGLRKRFDALRTGEYGELPVTGCNGILAYRRGRGENGIIVAMNTLDRKENVVVETGDSFDTVKAFESLKDEERLNVDKKRINICLNPFEWRIYKACGEL

SEQ ID NO: 13818 - DNA, 1461 bp, Crocosphaera watsonii WH 8501
  CDS (1)..(1461): transl_table=11
atggtcataaaaacccctgaatgggtaaaaaacgccattttttatcaaatttatcccgatacctttgcgagaaaggttccagatcgccaaaaatggttattagatgtacccttggaagactgggaagcccccccaacctcccaaggatacaaaggaggcaacctctggggtgtgatcgataaattggattatttacaagatttaggggttgatgctctctatttgacccctatttttcgctctgcttgtaaccatcgctatcatactcaagattattatgcgatcgatcctttattgggagacagagaagcttttgatcacttgttgaaaactgcccatgataaagggtttaaggtggttttagatggggtatttaatcacgctagtcgtggctttttcttttttaacgatatcctggaaaatggaccgaattccccttggttagattggtttaaaatcgaagggtggcctttatctgcctacgatggcagtcgtccggctaattacgtctcctggatagattatcgtgctttaccccagtttaaccacgataacccggcagtgagggaatatatcatgcaagtgggggaatattggttacaacaagggatcgacggttggcggttagatgtacccaactgtgttgaagcagagggtttctgggaggaatttcgagaacgggttaaagctgtcaaccctgaagcctatatcgtcggagaaatcgtttctgatgctactcaatggctagatggcaagcaatttgatggggtgatgaattatccttttgctcgtttaaccgcttgttttgtcatcggcgatcgccttgacaaggagactatccccagtttttataaaccttacgaaaccctcgatgcagccgaatacgcaaagggacttgaggaattattagcccgtcatccttgggaaattcaattaacccagctaaacctacttgatagtcacgatacttctcgttttctaactatggcaggaggcgatcgcacttccttacagttagctacgttattgttgtttacctttcctggcactcccaacatattttatggggatgaaattggtattgaaggtggcaaagatcccgatgggagaaaaggtttccctacagaagaaaagtgggagcaagaaaccttaacctatcataaacaattaatccaaatcaggaaaaaatacacggctttacggacaggagaatatagagttatcactgctcaagaaaatgtctatgtctttgcccgtattttaggagaagaagggttgattattgcagttaataatggagaagataaaacagaaatacaaatagataaattcgacaaagtgtcctcaatattacagactaaaccgagtcagattatttatggagaagggtcaattaattggcatgataaccagttaaaaataacaatgcatcctcgttctggcctagttatagccccttaa

SEQ ID NO: 13819 - protein, 486 aa, Crocosphaera watsonii WH 8501
MVIKTPEWVKNAIFYQIYPDTFARKVPDRQKWLLDVPLEDWEAPPTSQGYKGGNLWGVIDKLDYLQDLGVDALYLTPIFRSACNHRYHTQDYYAIDPLLGDREAFDHLLKTAHDKGFKVVLDGVFNHASRGFFFFNDILENGPNSPWLDWFKIEGWPLSAYDGSRPANYVSWIDYRALPQFNHDNPAVREYIMQVGEYWLQQGIDGWRLDVPNCVEAEGFWEEFRERVKAVNPEAYIVGEIVSDATQWLDGKQFDGVMNYPFARLTACFVIGDRLDKETIPSFYKPYETLDAAEYAKGLEELLARHPWEIQLTQLNLLDSHDTSRFLTMAGGDRTSLQLATLLLFTFPGTPNIFYGDEIGIEGGKDPDGRKGFPTEEKWEQETLTYHKQLIQIRKKYTALRTGEYRVITAQENVYVFARILGEEGLIIAVNNGEDKTEIQIDKFDKVSSILQTKPSQIIYGEGSINWHDNQLKITMHPRSGLVIAP

SEQ ID NO: 13820 - DNA, 3318 bp, Chlorobium phaeobacteroides BS1
  CDS (1)..(3318): transl_table=11
atgccgcgagcatctgcatcctatcagcctgaaccgctctggtacaaggacgccatcatttatgaggcacatgtaaagactttttttgacagtaacaatgacggtgtcggtgattttgaagggttgcgccagaagctgccctatctggaaagtctcggtataaccgcaatctggctgcttcctttttatccttcacccctgagagatgacggctacgatattgccgattacatggaggtcaatcctgactacggtaccatcgaggatttcaaagcctttctcgatgacgcgcataagctcggactgaaggtgattaccgagcttgtcatcaaccatacgtccgatcagcacgcatggttccagagggccagacaggcagagccgggatcggtcgaacgggatttttacatgtggagcagtgatcccaagaaatactccggcgtccgcatcattttccaggatttcgaggcctcgaactggacatgggaccctgtcgccggagagtattactggcatcggttctatcatcatcagcctgatctgaacttcgaaaatcccgcggttgaaaaagccatttacaaggtgcttgattactggctggagatgggcgtcgacgggttgcggctcgacgcggttccctatctctatgcagaggaaggaaccaactgtgagaaccttccccgcacgcacaagtttctgcagaggctgcgcaagcatgtagacggcaagttcccgaaccgtatgcttcttgccgaggcaaatcagtggccggaagatgccgccgagtatttcggcgaaggtgacgaatgtcatatgaatttccatttccctctgatgccgaggatgtacatggcgctggaaatggaagatcgttttccgatcatagatattctcgaccagacacccgggattccggaagagtgccagtgggcttccttccttcgcaatcatgatgaacttactcttgagatggtgaccgatgaggagcgtgactatatgcgccgggtgtacgcgcatgatccgaaggcgcgcatcaatctcggtatacgccgccgtctggcgccgcttatgtcgaatgaccgcagaaaaatcgagctgatgaacatcatgctcctttccctgcccggcactccggttctctactacggtgacgagataggtatgggcgataatttttacctcggtgatcgtgacggcgttcgtactcccatgcagtggaacggtgaccggaatgcaggtttttccagagccaatccccagcagttgcagctgccggtgatcattgatccggaataccattacgagggagccaatgtcgaggtacaggaaagcaacatcaattcgctgctctggtggacacgccacatgctctccacctcccgcaggtacaaagccctcagtcgcggggatattatctttattcagtctcagaatcctcaggtcctgatttttaccaggacatacaaggatgagaccatgctgtgcatcatcaacctgtcgcgtaacgcacaggcggtcaccatggatctgtcggaatacgaaggatatattcctgaagaggtgttcagcctcagtcattttcccgggatctctgcaaggccgtatacggttacgctgggtccttacggatatttctggttcaagcttgtcaggagtgaagatgagatcgggagccgacgctatatcgacaagccgtttgcgaaagtagccgccatggatgacctcttttccggcaaggttcttgaccgtcttgaatccagagtgctgcctcagtatatacggggttgcagatggtttggcggcaaggcccgcaagatcgtcagggtcagcgtcaacgatagcattcctgtgccagcctgtcaaaacacggtctacctgattgtcgaggtacgctatccgagcggctcgaacgatctgtatcagcttccggtgacatttctgcctacaggagagttcaatcctgacgaagactttttcatgaagcaggttatctgcagtgtgaagatcggagagaacgaggggtatctctgcgatgcgacctatcagaaggagttccatcgtttccttctcgacgttatcatcgccggaaaaggcctgaagggggggattttcaaactgacagccgaaaagggctcgactctggaggagtatctgccgcaggaagaggatgatagtatgaactccgtgattttcggtctggagcagagcaatacgtcgatcatgtatgatgacaagctctgtctgaagctctaccgcaagatctcttcagggatttctcctgaagttgaaatctgccgcaccttgactgaaaagacatcgtttgagagttctccgggctatcttggagcgctttacctttccagaagccgcaaggatacctcttctctgggcatcctgcagaactttatccccaatgagggagatgcctggagccagaccctgcactatgtgcaccgttactatgaagaggtgcttgttctgttgccgcagctcgaagagatcccggaaattcccccgataggaggagagacagtcgagatgccggagatcatgcacgggctgataggtgaaatctacctcgggatggttaacaagcttgctgagcgaacagcagaaatgcatctttctctggcctcgccggatcttggtcctgattttctgcctgaagcatttaccacgctctatcagcgctccatataccagtccatgcgtgaacaggtgaaaagaggtatggtgatgctcaaggagcagatgaaagggatcgcgaaagattataagggaatcgcggctgatctgcttggacgggagcaggagatactggaccggctttcacatatcaaagctcgcaggatcccggcatcaaagatcaggattcatggtgactatcatctcggtcaggtactctggaccggtaaggattttgtgatcattgactttgaaggcgaaccggcacgctctatcagcgagcgcaggatcaagcgtgccgtgttccgtgatcttgcaggaatgatgcggtcgttccattacgctgccttcaacgtcctgatccaggatcgttctataaggcctgaggatgctgaaaagcttgagccatgggcggagttgtggagtttttataccgggcagcatttctatgatgtgtatgcggccgctgttggaggacacggtctgattcctgaaaatattacagaacagcaccttctgcttcgctcctatctcatggacaaggctatttatgaattgaactatgagctgaacaaccgtcctgagtgggtaggcatagccctgaagggtctgcagcggctgctcgaatcctga

SEQ ID NO: 13821 - protein, 1105 aa, Chlorobium phaeobacteroides BS1
MPRASASYQPEPLWYKDAIIYEAHVKTFFDSNNDGVGDFEGLRQKLPYLESLGITAIWLLPFYPSPLRDDGYDIADYMEVNPDYGTIEDFKAFLDDAHKLGLKVITELVINHTSDQHAWFQRARQAEPGSVERDFYMWSSDPKKYSGVRIIFQDFEASNWTWDPVAGEYYWHRFYHHQPDLNFENPAVEKAIYKVLDYWLEMGVDGLRLDAVPYLYAEEGTNCENLPRTHKFLQRLRKHVDGKFPNRMLLAEANQWPEDAAEYFGEGDECHMNFHFPLMPRMYMALEMEDRFPIIDILDQTPGIPEECQWASFLRNHDELTLEMVTDEERDYMRRVYAHDPKARINLGIRRRLAPLMSNDRRKIELMNIMLLSLPGTPVLYYGDEIGMGDNFYLGDRDGVRTPMQWNGDRNAGFSRANPQQLQLPVIIDPEYHYEGANVEVQESNINSLLWWTRHMLSTSRRYKALSRGDIIFIQSQNPQVLIFTRTYKDETMLCIINLSRNAQAVTMDLSEYEGYIPEEVFSLSHFPGISARPYTVTLGPYGYFWFKLVRSEDEIGSRRYIDKPFAKVAAMDDLFSGKVLDRLESRVLPQYIRGCRWFGGKARKIVRVSVNDSIPVPACQNTVYLIVEVRYPSGSNDLYQLPVTFLPTGEFNPDEDFFMKQVICSVKIGENEGYLCDATYQKEFHRFLLDVIIAGKGLKGGIFKLTAEKGSTLEEYLPQEEDDSMNSVIFGLEQSNTSIMYDDKLCLKLYRKISSGISPEVEICRTLTEKTSFESSPGYLGALYLSRSRKDTSSLGILQNFIPNEGDAWSQTLHYVHRYYEEVLVLLPQLEEIPEIPPIGGETVEMPEIMHGLIGEIYLGMVNKLAERTAEMHLSLASPDLGPDFLPEAFTTLYQRSIYQSMREQVKRGMVMLKEQMKGIAKDYKGIAADLLGREQEILDRLSHIKARRIPASKIRIHGDYHLGQVLWTGKDFVIIDFEGEPARSISERRIKRAVFRDLAGMMRSFHYAAFNVLIQDRSIRPEDAEKLEPWAELWSFYTGQHFYDVYAAAVGGHGLIPENITEQHLLLRSYLMDKAIYELNYELNNRPEWVGIALKGLQRLLES

SEQ ID NO: 13822 - DNA, 3339 bp, Geobacter metallireducens GS-15
  CDS (1)..(3339): transl_table=11
atggcacgcagagaaccgttgcggggcggcaatcccctctggtaccgggacgccattatctaccagctccacgtcaaggccttcgccgactcggacggcgacggcatgggggacttccggggcctcatggggaagctcgactatctccaatccctggggatcaccgccatctggatcctccccttctacccttcgccgctacgggatgacgggtacgacatcgccgactattacagcgtgaaccccagctacaacaccctgcgggaattccgggagttcctccgggcggcacacgcccgccgcatccgggtcatcactgagctggtcctcaaccacacctcggaccagcacccctggttccagcgggcccgccgggccaaaccgggatcggcccaccgcgactactacgtctggagtgacaaccccgaccgctaccaaggaacccggatcatcttccaggacttcgaaacctccaactggagctgggatccggtggccaaggcctactactggcaccggttctactcccaccagcccgatctcaactacgacaaccccaaggtccaggcggagatgctccgggtcatcgactactggctcgggatgggagtggacggggtgcgcctcgacgcggtcccctacctcttcgagcgcgaggggaccaactgcgagaacctccccgaaacccacgccttcctgaagaagctccgggcccacgtggacgcctcgttccccaaccggatgctcctcggcgaggccaaccagtggcccgaagacgccatcgcctacttcggcgagggggacgagtgcaacatgctcttccacttccccctcatgccccgtatgtacatggccatcgaaatggaggaccgcttccccgtaatcgacatcatcgaccagacccccgccatccccgaggggtgccagtgggccatcttcctccgcaaccacgacgagctgaccctggagatggtcaccgacgaagagcgggactacatgtaccggatctacgccgccgacccgaaagcgcggatcaacctggggatccggcggcgcctcgctccgctcatggagcgggaccggcggaagatcgagctgatgaacgcccttctcttctcgctccccggcacccccatcatctactacggcgacgagatcggcatgggggacaactactacctgggggaccgcaacggcgtccgcacccccatgcagtggagccctgaccgcaacgccggcttctccggcgccaacccccagcggctctacctgccggtcatcatcgaccccgaataccactacgaggcggtaaacgtggagattcaggagcgcaaccccacgtcgctcttatggtggatgcgccgcaccatcgccgtgcgccgccgccaccgggccttcagcagcggcaccctggagatgctctatccggccaatcaccgggtcctcgcctttctccggcgccacgaagacgaggtgatcctcgtagtgggaaacctctcccgcttcgcccaggccgtgagcctcgacctgaaggagttcgccggcatatcgccagcagacctcttcagccggaaccggtttccggtcatccgcgaaatcccctaccccctcaccctgggcccccacgatcatttctggttcatcctgagccgtgcagagtcgccacgcctgccagagggagaactgccgcggatcaacctcccgggaggactcccgtggtgggaggccctccagcataccggaggggacacccgcctggaacgggcgaccaccgactacctgaaccgaagcggctggttccgggggaaagcccgggcaatcatcggctatgccctgcgcgacaccgtgcttctgcggacatcagaccaggtctttcccctgttcttcctggaggtccgctaccagaacggcgcgccggaaacctacctgatccccgttgcgtttctccggggccccggggcgaaacgggtcgatgccgaatcgccacaggcggccattgcatccctctccgtgggggacgaagcagggatcctctgcgatgcgctccatgaccgggagttcagggacgcgctcctcgcccttgcccttggccggcgccgactccatggtaaacgggagagcctcgtcgtaccgctccatgggagaggaggccacgccgaaggaatgcgggaaacggagcatctcatttccgagctcgtcacgggggaagaggcgagcagtgtcatcctctatggcgatcggcacgtgttcaagctgtaccgcacggtggaaccgggggtgaattcggaggtggagctggtccggtttctgacggaaaagtcccgctaccccaacattgtccccttccaggcgagtctcgagttgcgccatcccggcaccgaaccatgcaccattggccttgtgcaggaatatgtgaaaaaccagggtaacggctggcggctcgcgctccacctcctcggccagtacttcgagcggattctctcccgccggggcgagatccctcctccgccgaagcggttctcgagcctcatagacggcagcgcctgcaccgttccggaaccggtcgcgaatctcattggcggcttctatctggaaatggcgggacttctcgggcgtagaaccgccgaactccacctggcccttgccgcggggggaaacgatccggcctggaaaccggaggcgtattcaaccatttaccagcgctccgtgtaccagtccatgcgcaaccaggcacggcgcacccttcagctcctgtcccagaaccgcaatcttctgccgatcgacgaccagggaccggctgaccgggtcctgggggccgaaaaggagattctctcctggctggcccaaatcgtcggccggcggatagggacgatgaagatccgcatccacggcaattttcacctggggaaagtgctcttcaccggcaaggatttcgtaatcctcgacttcgagggggagccggaccggaccctcagcgagcgccgcatcaagcgctctcccctgagggacgtggcatcaatgatccgctccttccacgctgccacgctgactgccctcgcacggcatgggaacggccgttccggagacgtccagcttctggagccgtgggcggatgcctgctattaccacgtgagctgccgctacctcgcggggtacctcgaacggatggggaacagtcccctcgttccggcagaccggaacgacctggcgaccctcctccgctcgttcctgctcgacagggcgctccgcgacctcgggttcgccctgggcaaccgccccgaaacggcctcgtcccccctgaaggggatcgagacggtgctgcgggaatacggggaatag

SEQ ID NO: 13823 - protein, 1112 aa, Geobacter metallireducens GS-15
MARREPLRGGNPLWYRDAIIYQLHVKAFADSDGDGMGDFRGLMGKLDYLQSLGITAIWILPFYPSPLRDDGYDIADYYSVNPSYNTLREFREFLRAAHARRIRVITELVLNHTSDQHPWFQRARRAKPGSAHRDYYVWSDNPDRYQGTRIIFQDFETSNWSWDPVAKAYYWHRFYSHQPDLNYDNPKVQAEMLRVIDYWLGMGVDGVRLDAVPYLFEREGTNCENLPETHAFLKKLRAHVDASFPNRMLLGEANQWPEDAIAYFGEGDECNMLFHFPLMPRMYMAIEMEDRFPVIDIIDQTPAIPEGCQWAIFLRNHDELTLEMVTDEERDYMYRIYAADPKARINLGIRRRLAPLMERDRRKIELMNALLFSLPGTPIIYYGDEIGMGDNYYLGDRNGVRTPMQWSPDRNAGFSGANPQRLYLPVIIDPEYHYEAVNVEIQERNPTSLLWWMRRTIAVRRRHRAFSSGTLEMLYPANHRVLAFLRRHEDEVILVVGNLSRFAQAVSLDLKEFAGISPADLFSRNRFPVIREIPYPLTLGPHDHFWFILSRAESPRLPEGELPRINLPGGLPWWEALQHTGGDTRLERATTDYLNRSGWFRGKARAIIGYALRDTVLLRTSDQVFPLFFLEVRYQNGAPETYLIPVAFLRGPGAKRVDAESPQAAIASLSVGDEAGILCDALHDREFRDALLALALGRRRLHGKRESLVVPLHGRGGHAEGMRETEHLISELVTGEEASSVILYGDRHVFKLYRTVEPGVNSEVELVRFLTEKSRYPNIVPFQASLELRHPGTEPCTIGLVQEYVKNQGNGWRLALHLLGQYFERILSRRGEIPPPPKRFSSLIDGSACTVPEPVANLIGGFYLEMAGLLGRRTAELHLALAAGGNDPAWKPEAYSTIYQRSVYQSMRNQARRTLQLLSQNRNLLPIDDQGPADRVLGAEKEILSWLAQIVGRRIGTMKIRIHGNFHLGKVLFTGKDFVILDFEGEPDRTLSERRIKRSPLRDVASMIRSFHAATLTALARHGNGRSGDVQLLEPWADACYYHVSCRYLAGYLERMGNSPLVPADRNDLATLLRSFLLDRALRDLGFALGNRPETASSPLKGIETVLREYGE

SEQ ID NO: 13824 - DNA, 1785 bp, Exiguobacterium sp. 255-15
  CDS (1)..(1785): transl_table=11
atgaataaagcagctgtgtttcaccgggccctgtctccgtatgtctatacatacgatcaagaagcggttcatatccgcttgatgtcagccaaaggggacctggaccgtattgaactgatccacggggatccttatgaatgggatgcagaaaaagaggaagatcgggactggaactttgatccggataaagaaaaattttggaaaacggagacgacagacatgacgtttgccggatcggatgcgacacatgatttttggttcgttgccatccggcccccaaagaagcgggtccgctacggctttaacgttcatgctaacggtgaatcggccgtctatacggaacgcggctggtacgatgaagtaccgctcgatcatccgggctactactttgccgtcccatatatgaatgcggtcgatgtatttgatgcgccgtcatgggtcaaagacaccgtctggtatcaaatttttcccgatcggttcgcgaacggggatttgacgaatgatcgtccgggtaccatcgcctggggtgccgaagcaccggcgtttgacaatcatttcgggggcgattttcaaggagtgattgatcatatcgattacttaaaagagctggggattaccggaatttatttttgtccggtctttgtcgcaccgtcgaatcataaatacgatacgttagattatttacgactcgatccggcctttggaacagaagagacgttccgggaaatgattcatttgctccatcaaaatgggattcggattttactggacgccgtctttaatcacgtcagcgttgatcatccggccttccaagacgtcattgcgcatggcaatgagtcgcagtatgcgaattggtttatgatggactcgttcccggtccaatcgacaccagtgccgaactatgaagtttttgcctttgaagggaatatgccgaaacttaatacggcgcatcctgatgtaaaagagtacttgttaaaagttgggcgttactgggtggaagagttccacgtcgacggatggcgactggatgtcgcgagtgaagtggatcatgctttttggcgtgagttccggcgtgaagtccgggcagcgaatccggaagcctatattgtcggcgagtgttggacagattcacaaccgtggttgctcggcgatcagtttgatgcggtcatgaactacggattgacggaagctttcttaacattttttgcgacgaatgaaagtacggcgtctgaattcagtcatgcaatcgtcaggaatctgaacagcaatacgatgaatgtcaacgaagtgatgttcaatctggtggattcgcatgatacaccccgtgccttgacgcgggcgaatggggaccgtgatcggatgaaactgttgatgctgtcactgctgacattcacgggaagtccggtcatctattacggagatgaaatcggtatgacaggcggtcaggatccggataaccggaagtgtatggtctgggatcaggcggaacaggacagggatctcttggcgtatatcacaaagttggttgatttacggaaatcgcaccccgctctcgccaacgcgagcggctatcaattcgaacaaatggatgatgagacggcaagtttcctcgttcgtcgtcagtctgatgaagcgacctatttgattggatttaacaatggttcagaagaaatccgctttgacttggacaaagcagcggttgatttaatggacggacaacggtatttgggaaccgtcaccgtacgtccgttgtccggaaaaattctccgggtggaaacaacataa

SEQ ID NO: 13825 - protein, 594 aa, Exiguobacterium sp. 255-15
MNKAAVFHRALSPYVYTYDQEAVHIRLMSAKGDLDRIELIHGDPYEWDAEKEEDRDWNFDPDKEKFWKTETTDMTFAGSDATHDFWFVAIRPPKKRVRYGFNVHANGESAVYTERGWYDEVPLDHPGYYFAVPYMNAVDVFDAPSWVKDTVWYQIFPDRFANGDLTNDRPGTIAWGAEAPAFDNHFGGDFQGVIDHIDYLKELGITGIYFCPVFVAPSNHKYDTLDYLRLDPAFGTEETFREMIHLLHQNGIRILLDAVFNHVSVDHPAFQDVIAHGNESQYANWFMMDSFPVQSTPVPNYEVFAFEGNMPKLNTAHPDVKEYLLKVGRYWVEEFHVDGWRLDVASEVDHAFWREFRREVRAANPEAYIVGECWTDSQPWLLGDQFDAVMNYGLTEAFLTFFATNESTASEFSHAIVRNLNSNTMNVNEVMFNLVDSHDTPRALTRANGDRDRMKLLMLSLLTFTGSPVIYYGDEIGMTGGQDPDNRKCMVWDQAEQDRDLLAYITKLVDLRKSHPALANASGYQFEQMDDETASFLVRRQSDEATYLIGFNNGSEEIRFDLDKAAVDLMDGQRYLGTVTVRPLSGKILRVETT

SEQ ID NO: 13826 - DNA, 1674 bp, Exiguobacterium sp. 255-15
  CDS (1)..(1674): transl_table=11
atggaacgtaaatggtggcacgacagtgtagtctatcaaatttatccgcggagtttcaatgattcaaacggagacggaatcggggatctcgtcggtatcattgaaaaactggattacttaaaagaacttggaattgatgttatttggctgagtccggtctatgactcaccaaatgatgataacggatatgatattcgggattatgaagccatcatgagcgaattcggaacgatggcggactttgatcgtctgctcgatcaggcgcatgagcggggaatcaaaatcgtaatggatttggtcatcaaccattcgtcggacgagcacgcctggtttgcagagtcacgaaagagtaaggacaatccataccgggactattacatttggagaagcgccaatgaagacgggacgctcccgaacaactggggctcgattttttccggaccggcttgggaactggatgaggcgacaaacgaatattacttgcacctgttttctaaaaagcaacctgatctgaactgggaaaacgaaaaactgcgtcaagaagtctatcagatgattacgcgctggttggatcgcgggattgacggtttccggatggacgtcatcaacttaatctcgaagacacccggtcttccggatgcgacggttcctcccggtgctctatacggggacggcggacaacattatattaacggaccaagaatccatgagtttttaaaagaaatgaatgatgcttcttttggtaattatgatgtcttgacggttggtgaaatgccgggggcgacaactgacgacgccattctttatacagatccagaacgcaaagaagtcaacatggtgtttacgttcgaacatatggacttggattccggtccgggtgggaaatgggatgtaaaaccatttgaccttcagaaactgaaagaaaacttcacgaaatggcaagtcgccttacacgaaaaagggtggaactcgctgtactggaataatcacgaccagccacgcgttgtcagccgattcggaaatgatacgacgtatcgcgtcgaatccgctaaaatgttagcgactctgctccacttgttaaaaggaactccctacatttatcaaggggaagaaatcggcatgacgaacgtggcctttgaatcgattgaggactatgaggatatcgaaatccgtaatatgtggaaagaacggaccgagcaaggggcttcaccggcagagttattgcgtgctgtccatgtgaagggacgggacaatgcccggacaccaattcaatgggatgcgacggagcatgccggatttacgacgggtacaccctggttaaaagttaatccgaactatccgaccatcaatgtcgaacaggccttggaggatccggattccatcttctattactataaacagctgattgcgttacgtcatcagcacgatgtaatcgtatacggtgaatatgccttgattttagaagaggaaacggacatctatgcgtacacaagaacatatgaaaatgaaacatggtacatttactgctccttcagtcaggaagaagtaacggttccgctgtctcacgatacttctgatccggtcatcggaaattacagtgaatcaccggcaggatcaaaagaagaattggttcttcgaccgtatgaagcaatcgtctaccggacgacgcggtaa

SEQ ID NO: 13827 - protein, 557 aa, Exiguobacterium sp. 255-15
MERKWWHDSVVYQIYPRSFNDSNGDGIGDLVGIIEKLDYLKELGIDVIWLSPVYDSPNDDNGYDIRDYEAIMSEFGTMADFDRLLDQAHERGIKIVMDLVINHSSDEHAWFAESRKSKDNPYRDYYIWRSANEDGTLPNNWGSIFSGPAWELDEATNEYYLHLFSKKQPDLNWENEKLRQEVYQMITRWLDRGIDGFRMDVINLISKTPGLPDATVPPGALYGDGGQHYINGPRIHEFLKEMNDASFGNYDVLTVGEMPGATTDDAILYTDPERKEVNMVFTFEHMDLDSGPGGKWDVKPFDLQKLKENFTKWQVALHEKGWNSLYWNNHDQPRVVSRFGNDTTYRVESAKMLATLLHLLKGTPYIYQGEEIGMTNVAFESIEDYEDIEIRNMWKERTEQGASPAELLRAVHVKGRDNARTPIQWDATEHAGFTTGTPWLKVNPNYPTINVEQALEDPDSIFYYYKQLIALRHQHDVIVYGEYALILEEETDIYAYTRTYENETWYIYCSFSQEEVTVPLSHDTSDPVIGNYSESPAGSKEELVLRPYEAIVYRTTR

SEQ ID NO: 13828 - DNA, 1611 bp, Exiguobacterium sp. 255-15
  CDS (1)..(1611): transl_table=11
atgaatcgggcctggtggaaagaagccgttgtctatcaagtgtattggcgcagttttaaagattcgaacggagacgggatgggcgatttacgcggagtaattgaaaaactcgattacatcgcttccctggatgtcgatatcatctggttaaatccctgttatacatcaccggatgtcgataacggatacgacatttcggattattactcgattatgccgaaggcgggaacgatgtcggatctggaagaactgattgcgtccgcccatgaacgaggactgaaactgattcttgatttggtcgtcaatcatacgagtgatcaacatacgtggtttaaagaatcccgcagcagtcggacgaacgagaaagccgattggtacatttggcgggacggggtcaaaggaacgccgccgaacaattggcggtcgtatttcgcgccgagtccctggacgtgggatgagacacgcgagcagtattatttccattcctttgcatcggagcaaccggacttgaactgggagcatcctgctgtccggcaggccgtatatacgatgatgcggtggtgggccgataaaggaatcgacggcttccggatggatgtcatcaatctgatcaagaaacgggcgacgtatgatgatgtcgcagatcctttggaattatcctacttagggaatcaaccgggcattcacgagttcttacaggagatgcaccaagaagtactggcgggaaccgatctctttaccgtcggtgagattccgtttgtcggcccggaagacgggttgctgtatgtcggggaggaacggaatgagctgcgaacgctgtttcacttcgaagtcgcggacgacatggagacgatggatttaccgcgctttaaacaaatccagaagcgttggtatgaggcgctttatccgagcggtgtcgcgtcccaattcttgaataaccatgaccacacccgtcaggtgacccggttcggaagcgaacggtatcgcgtcgaaagtgccaagttactgggtttgatgctccacacgttaccgggcattccgtacatttatcagggcgaagaaatcggtatgaccggcattcgtttttctgatccggagtcctatcaggacgttgcgtttcgaaatcagtacgccgaacggattgcggccggtgaatcacccggaacggtcctgtcatcgatgcagttgcgggcgcgtgacaactcacgaacaccgatgcagtggaatacggaccaatcagccggatttactatagggacaccatggatggcggtcaatccgaactaccgtgacattaacgtcgaagcagcggaacaggatccgcattccgtgctggctttttaccggcaactgattgatttacggaagactcatccggtcatggtttacggggtttatcgtgatttggcgattcaagatccgtacctgtatgtctatgaaagggtcctagacggagtggtttggcggattgtcttaaacgtccatgatgaaccggtgacgacgacgttcggtttaccggaagaacagttgattttgacgaattatgagacggcggacatcaatcgattggcaccgtacgaagcccggttgtaccaatacgagatgccttaa

SEQ ID NO: 13829 - protein, 536 aa, Exiguobacterium sp. 255-15
MNRAWWKEAVVYQVYWRSFKDSNGDGMGDLRGVIEKLDYIASLDVDIIWLNPCYTSPDVDNGYDISDYYSIMPKAGTMSDLEELIASAHERGLKLILDLVVNHTSDQHTWFKESRSSRTNEKADWYIWRDGVKGTPPNNWRSYFAPSPWTWDETREQYYFHSFASEQPDLNWEHPAVRQAVYTMMRWWADKGIDGFRMDVINLIKKRATYDDVADPLELSYLGNQPGIHEFLQEMHQEVLAGTDLFTVGEIPFVGPEDGLLYVGEERNELRTLFHFEVADDMETMDLPRFKQIQKRWYEALYPSGVASQFLNNHDHTRQVTRFGSERYRVESAKLLGLMLHTLPGIPYIYQGEEIGMTGIRFSDPESYQDVAFRNQYAERIAAGESPGTVLSSMQLRARDNSRTPMQWNTDQSAGFTIGTPWMAVNPNYRDINVEAAEQDPHSVLAFYRQLIDLRKTHPVMVYGVYRDLAIQDPYLYVYERVLDGVVWRIVLNVHDEPVTTTFGLPEEQLILTNYETADINRLAPYEARLYQYEMP

SEQ ID NO: 13830 - DNA, 1788 bp, Exiguobacterium sp. 255-15
  CDS (1)..(1788): transl_table=11
atgctgaaagaagctgttttccaccgcgcgatgtcaccgttcgtctataagtatgatgacaaaaccattcatgttcgactgcagacgaaaaaaaatgacgtcgaccatgttgatcttatttggggagatccgtacgactggcataccgaaaacccggatgatgccgattggaactttgatccgtccaaatcaaactattggaatactttcgaaacccctatgaaacggagcgggtcagatgagttattcgattattggttcatcgatgtcgttcctcctttccgccgacttcgttacggattccggcttcacgacggacattcgagtcaagtctttaccgaacgtggctggtttgatgaaaagccgctagatgataccggatactacttctgtgttccttttttaaacaaagtggatgtgttccatgctccggactgggtgaaggatacagtgtggtatcaaatcttccccgaccgctttgccaacggagattcgacgaatgatccggccggtacccttccatggaatagtacggcacctacaacgacaaatctgttcggcggtgattttcaaggcgtcattgataaaatcgattacttagtggatctcggcatcacaggcatttacttctgtccaattttcgaagccaagtccaatcataaatacgacacgattgattatttggaaattgatccgcagttcggaactaaagaaaagtttaaggaaatggttgatttactgcatgcaaatggaattcgcatcatgctggatgccgtctttaatcatgccggtttccaccataaagcattcgccgacattcgggaacacggcagcaattcttcttaccgggattggttccacctccggaacttccctctcgtaaccgagccgatgccgaactatgacacgtttgcgtttgttccggaaatgccgaagttcaatacggaaaatccggaagtaaaagaatacttacttcatgtcgcccgttactgggtcgaagaattcgggatcgacggctggcggcttgatgttgccaacgaagtcgatcatgccttctggcgtgacttccgttctgtcgtcaaggaagcggatccggagacgtatattctcggtgaaatttggcacgattcacaggaatggttgctcggtgaccaatttgatgccgttatgaactatccgttcacgaatgctgcacttaatttctttgcactcgataagacatctgcttccacctatgccaatgacatgtcgcatgtcttattctcaaacacggtcaacgtcaacgaagtatcgtttaacttaatcggttcacacgatacgccgcgtgccttgacccgtgccggaaacgacaaaaacaagatgcgtctgctgctgttatccatgctgaccttctccggaagtccggttatctattacggagatgaaatcggactcgacggtgatcaggatccgggttgccggaaatgtatgccgtggaatccggaagagcaggatttgaatctgttgatgtacacgaaacatctgcttcagttacgaaagcagcacaggacacttgccaatcacggacagatttcattcgtccatgccgacgatgaaaccaataccatcgtcatgcgtcgtatgagtcaggatgggacgtattacgtctatttcaataactcgaatcatcaggcgacaatcccggctcctcagtccggccaaggaatggatctcttttcgaacacaccacttccttcattagaagtgacgctcgctccgtatacaggaactatcattcaagtgatttga

SEQ ID NO: 13831 - protein, 595 aa, Exiguobacterium sp. 255-15
MLKEAVFHRAMSPFVYKYDDKTIHVRLQTKKNDVDHVDLIWGDPYDWHTENPDDADWNFDPSKSNYWNTFETPMKRSGSDELFDYWFIDVVPPFRRLRYGFRLHDGHSSQVFTERGWFDEKPLDDTGYYFCVPFLNKVDVFHAPDWVKDTVWYQIFPDRFANGDSTNDPAGTLPWNSTAPTTTNLFGGDFQGVIDKIDYLVDLGITGIYFCPIFEAKSNHKYDTIDYLEIDPQFGTKEKFKEMVDLLHANGIRIMLDAVFNHAGFHHKAFADIREHGSNSSYRDWFHLRNFPLVTEPMPNYDTFAFVPEMPKFNTENPEVKEYLLHVARYWVEEFGIDGWRLDVANEVDHAFWRDFRSVVKEADPETYILGEIWHDSQEWLLGDQFDAVMNYPFTNAALNFFALDKTSASTYANDMSHVLFSNTVNVNEVSFNLIGSHDTPRALTRAGNDKNKMRLLLLSMLTFSGSPVIYYGDEIGLDGDQDPGCRKCMPWNPEEQDLNLLMYTKHLLQLRKQHRTLANHGQISFVHADDETNTIVMRRMSQDGTYYVYFNNSNHQATIPAPQSGQGMDLFSNTPLPSLEVTLAPYTGTIIQVI

SEQ ID NO: 13832 - DNA, 1803 bp, Frankia sp. CcI3
  CDS (1)..(1803): transl_table=11
gtggggcaagcagaactacgtgcggctggacccggcggtcgagcccgcgcacgtcttcgctgtgcgggcccggtcgtgatggattctgagcctctcagcgaaccgatcggcgaccacacccccggcccggcccccgccatgccggtcggggggactttacgcgacccacactggttcaagcgagccgtgttctacgaggtgctcatccgcggcttcgcggactccaacggcgacggcacgggggacattcgcggcctgatctccaggctcgactacctggagtggctcggtgtcgactgtctgtggctgctaccgatctactcctcgccgttgcgtgacggcggctacgacatcagtgactactttcagatcctgccggaattcggtgacctcggcgacttcgttagcctggttgacgaggcccaccgccggggcatccggatcatcgcggatctggtgatgaaccacacctcggacgcccatccctggttccaggcgtcccgctccgaccccgacgggccgttcggggacttctacgtctggtccgacagcgacgagctgtacccggacgcccggatcatcttcgtggacaccgagaagtcgaactggtcgtgggatccggtccgcggtcagtactactggcaccgtttcttctcccaccagcccgacctgaactatgacaaccccgaggtccaggaggcgatgctggaggttctgcgcttctggctcgatctcggcatcgacgggttccggctcgacgcggtcccctacctctatgtccgggagaacaccaacggcgagaacctgccggagacccacgagtacctcaagcgggtccgcaaggaggtcgacgccaagtacgccgaccgggtgctgctcgccgaggcaaaccagtggccctccgacgtcgtcgagtacttcggcaacgacgacgagtgccacatggcgttccacttcccgttgatgccgcgcatcttcatggcggtccggcgggagtcccgctacccaatctcggaaattcttgctcagacaccccagatcccgccgaactgccagtggggcatcttcctgcgcaaccacgacgagctgacgctcgaaatggtgaccgacgaggaacgggactacatgtgggccgaatacgcgaaagatccgcgtatgaaagccaacatcggcattcgtcgccggctggcgccgctgctggacaacagccgtgaccagatggagctgttcaccgcgctcctgctctcgctgcccggctcgccagtgctgtactacggcgacgagatcgggatgggcgacaacatctacctgggcgaccgggacagcgtccggactccgatgcagtggtcaccggatcgtaacgccggtttctccaccgcggacccggcccgactgtaccttcccctgatcatggatccggtctacggttatcaggccctgaacgtcgaggccggacagcgcatgccgacctcgttcctggcctggaccaagcggatgatcgaggtacgcaagcgtcatccggtcttcgggctcggcgactacaccgagctcggcgcgtccaatccctcgatcttcgccttcgtccgcgagttcggcgacgaccgggtcctgtgcgtcgcgaatctgtcccgcttcgcccagccggtggagctcgatctgcgtcgtttcgagggaatggttccggtggagctgctcggccgggtgcacttcccgccgatcggcgagcttccctacctgctgacactgccaggtcacggacattactggttcgcggtgaccagaccgggggaattcaccccctag

SEQ ID NO: 13833 - protein, 600 aa, Frankia sp. CcI3
MGQAELRAAGPGGRARARLRCAGPVVMDSEPLSEPIGDHTPGPAPAMPVGGTLRDPHWFKRAVFYEVLIRGFADSNGDGTGDIRGLISRLDYLEWLGVDCLWLLPIYSSPLRDGGYDISDYFQILPEFGDLGDFVSLVDEAHRRGIRIIADLVMNHTSDAHPWFQASRSDPDGPFGDFYVWSDSDELYPDARIIFVDTEKSNWSWDPVRGQYYWHRFFSHQPDLNYDNPEVQEAMLEVLRFWLDLGIDGFRLDAVPYLYVRENTNGENLPETHEYLKRVRKEVDAKYADRVLLAEANQWPSDVVEYFGNDDECHMAFHFPLMPRIFMAVRRESRYPISEILAQTPQIPPNCQWGIFLRNHDELTLEMVTDEERDYMWAEYAKDPRMKANIGIRRRLAPLLDNSRDQMELFTALLLSLPGSPVLYYGDEIGMGDNIYLGDRDSVRTPMQWSPDRNAGFSTADPARLYLPLIMDPVYGYQALNVEAGQRMPTSFLAWTKRMIEVRKRHPVFGLGDYTELGASNPSIFAFVREFGDDRVLCVANLSRFAQPVELDLRRFEGMVPVELLGRVHFPPIGELPYLLTLPGHGHYWFAVTRPGEFTP

SEQ ID NO: 13834 - DNA, 3582 bp, Desulfitobacterium hafniense DCB-2
  CDS (1)..(3582): transl_table=11
gtggtattggcttatcataattctcacgatcccttcttccgcagcccctttggggctgttccatgcggcggcctgctgcgcttaagactgcttatgcagccggaggattcttctggtgcgggcagtccggttcaggaatgctttttgcgcttatgggtgcaggaccgggaggagcggctgcccatgctcagggtggaagagccgatcctgtgggagataaatagggaaggaactgttacaggggaagaggctattacaggggaaggggtccttacgggagaaggagtcgtttatgaggtggaatatcctcttccccatgaaccgggaatcatctggtattactttattttcagggcagggggagaaacctgtttctatggcaataatcaggaagaactgggaggcgtgggtgagcttcgatcctccgagcctcccggttatcaaatcaccgtttaccggcccatggccttgccaggctggtacacccagggcatcatgtatcagatctatgtggatcgcttctttaacggggatgaacagggaaaagtcctcaatccccgcccccgctccctgatccatggggactggtctgatacccccttctatattaaaaatgaaaagggcgaagtcctacgctgggattttttcggcggcaaccttgccggtgtgatcaaaaagcttccttatcttaaggaattaggagtgagtatcctttatttgaaccccatcttcgattcctccagcaaccataagtatgacacgggggattatctcactcttgatcccatgtatggggacgaggagatctttgcccaattgatcaaggaagcccaaagcttaggaatcgcgattattctggatggggtgttcagtcataccggtgatgacagtatttattttaaccgttatgggagatatcctggtctgggcgcctatcaatccccggattccccctattactcctggtatcaatgtcatggggaaggacaggaaaaagaatattcctgctggtggggagtgtccactctccctgaagtttgggagatggagccctcttatcgcgagtttatcattcactctcctcaaggagttctccaatcctggatgaaacggggtattaaaggctggcgtctggacgtggctgacgagcttcccgatgaatttatccaggagttccgccaaatgatgaaaacaatggaccctgagggagtcctgatcggtgaagtctgggaggaccccacccataaattcagctatggcaagctcaggcagtatttctggggggaagaactggatgccaccatgaattatcctttgcggaatatctttctccagtacttccttgggcagatcgatgccggtcaggcccataaacgcatcatgaatctctatgaaaactacccccgggaaaactttttcgggcagatgaacttgatcggcagccatgaccgggcccggattctcaccctcctcggtgaagcgccgccgccggagcagctctccgccgtggaacaggagcagtatcgcttgcctgcccctgcccgggatctggctgtccagcggttgaaactgctgactttgctgcagatgagctttcccggtgttccctgtctgtactacggtgatgaagcgggctgtgaaggatatcccgatccctataaccgggggacctacccttggggaagggaagatcaggagatcctccaatggtttaaacgggtgcttcgttatcgccgggaatatgaggtgctgcggcaaggcgagttctcttcctggttcgagggaaaagagatctatgtcttgcaaaggaagggtgaaaaagaggagattattgtcctggttaatcgcagtgctgaggagtccacggaaatgacattgaagctggagcagaacgtggggcaggtgatcgatatctttgcgggggaagtgctgcacagtctttcgcttatcctaccccccttatccgcaaaggcccttttctatcagaaatatgagcgtggtcactattttaaacaggagatcatgacccgtgcctgcggcatccttatgcatatctcctctttgccgtctccctggggcattggcgatctgggggaagaggcctatgcttttgtggatttcctggctgaaggagggcaaagcctctggcaggtgctgcctttgaaccctctagggctgggagattccccttaccaaagtgagtccgccttagccggtaattttttgctgatcagtcttgatttgcttattgaggccgggctgctgaccgaaggggaggcccgcagggaatgggccgactatggtcaagaggttaaaaagactgagggaagcgaaggaagcgaaggaagcgaaggaagcgaaggaagcgaaggcctcgggagcgagggctttgcctgggtggaacgctataaggagaagctgctgcgcaaggcttatgaacgtttcaaggagaaattgcccaggtaccctttggatttaagcagtccggagggaggcagccagcctggaactaaggggtacttggaccctcagggttatgaccggtttatagaagagaatcaggactggctgcaagactacgctctctataagtgtttaaagcttaagttccccggcaaggcgtggcaccaatgggaagaaagctatcgcttgcggaagcctgaggccctggaggctgtgactgaagattatgccgaggagataaactatattttctttgttcaatatactttcgctgatcagtggcaaaggctgaaggactatgctcaggaaaaaggggtaaaaataatcggcgatctgcccatttatgtggcctatgacagttgcgacacctgggctaaccgggagtgctttgctctggatgaaaataatgctcccgcaggaaccgctggggtgccccccgactatttcaaccctgaagggcagaactggggaaatcccttatacgattgggatgctctccgggccgccgattatgcctggtggaagctgcgtttccggcaagggctggagcgctttgatgccttaagactggatcatttccgtggctttgagggctattgggaagttccccctcaggccgggagcgccaaggaaggccgctggctgaaagggccggggaaagaatttttcgaaagcctggtccgtgaattggggcctctgcccgtcatcgctgaggatttagggtgcattacccctgaagtcaataccctgagagctattttaggatttccggggatgagggtgacgcagttttcacccttgcagcaagaagggaattatgttgattattccggaacccatgataacgataccctgttgggctggtatcgctcccaaggctatagcgataaggattccctggcgcaagtggaaaggactatcgaggagctttatcaggggaatggtatctgggtcattttcccccttcaggacattcttaaactggattcccgggcgaggatgaatactcccggcacaattaaagggaattggcagtggcgtgtagaaagaggaaccttaactcaggaggtttgtgcgcgattaaggggtttggcggaaaagtatgggcggttatcctga

SEQ ID NO: 13835 - protein, 1193 aa, Desulfitobacterium hafniense DCB-2
MVLAYHNSHDPFFRSPFGAVPCGGLLRLRLLMQPEDSSGAGSPVQECFLRLWVQDREERLPMLRVEEPILWEINREGTVTGEEAITGEGVLTGEGVVYEVEYPLPHEPGIIWYYFIFRAGGETCFYGNNQEELGGVGELRSSEPPGYQITVYRPMALPGWYTQGIMYQIYVDRFFNGDEQGKVLNPRPRSLIHGDWSDTPFYIKNEKGEVLRWDFFGGNLAGVIKKLPYLKELGVSILYLNPIFDSSSNHKYDTGDYLTLDPMYGDEEIFAQLIKEAQSLGIAIILDGVFSHTGDDSIYFNRYGRYPGLGAYQSPDSPYYSWYQCHGEGQEKEYSCWWGVSTLPEVWEMEPSYREFIIHSPQGVLQSWMKRGIKGWRLDVADELPDEFIQEFRQMMKTMDPEGVLIGEVWEDPTHKFSYGKLRQYFWGEELDATMNYPLRNIFLQYFLGQIDAGQAHKRIMNLYENYPRENFFGQMNLIGSHDRARILTLLGEAPPPEQLSAVEQEQYRLPAPARDLAVQRLKLLTLLQMSFPGVPCLYYGDEAGCEGYPDPYNRGTYPWGREDQEILQWFKRVLRYRREYEVLRQGEFSSWFEGKEIYVLQRKGEKEEIIVLVNRSAEESTEMTLKLEQNVGQVIDIFAGEVLHSLSLILPPLSAKALFYQKYERGHYFKQEIMTRACGILMHISSLPSPWGIGDLGEEAYAFVDFLAEGGQSLWQVLPLNPLGLGDSPYQSESALAGNFLLISLDLLIEAGLLTEGEARREWADYGQEVKKTEGSEGSEGSEGSEGSEGLGSEGFAWVERYKEKLLRKAYERFKEKLPRYPLDLSSPEGGSQPGTKGYLDPQGYDRFIEENQDWLQDYALYKCLKLKFPGKAWHQWEESYRLRKPEALEAVTEDYAEEINYIFFVQYTFADQWQRLKDYAQEKGVKIIGDLPIYVAYDSCDTWANRECFALDENNAPAGTAGVPPDYFNPEGQNWGNPLYDWDALRAADYAWWKLRFRQGLERFDALRLDHFRGFEGYWEVPPQAGSAKEGRWLKGPGKEFFESLVRELGPLPVIAEDLGCITPEVNTLRAILGFPGMRVTQFSPLQQEGNYVDYSGTHDNDTLLGWYRSQGYSDKDSLAQVERTIEELYQGNGIWVIFPLQDILKLDSRARMNTPGTIKGNWQWRVERGTLTQEVCARLRGLAEKYGRLS

SEQ ID NO: 13836 - DNA, 1719 bp, Frankia sp. EAN1pec
  CDS (1)..(1719): transl_table=11
gtgaacgagtcggaaccgttcgcggagcagccgctgcgcgagaccgcggccgagggcggcgacacggggacgtcccaggacccgctgtggttcaagcgggccgtgttctacgaggtcctcgtccgcggcttcgccgactccaacggcgacggcaccggtgacctggccgggctggtctcgaaactggactacctcgagtggctcggcgtggactgcctgtggctgctgcccatctactcctcgccgctgcgcgacggcgggtacgacatcagcgactacttccagatcctccccgagttcggggacctgggcgacttcatcaacctcgtcgacgaggcgcaccggcgcgggctacggatcatcgccgacctggtgatgaaccacacctccgacgagcacccgtggttccaggcgtcgcgctcggacccggacgggccgtacggcgacttctacgtctggtccgacaccgacgagaagtaccccgacgcccggatcatcttcgtcgacaccgagaagtcgaactggacctgggacccggtgcgcgggcagtactactggcaccggttcttctcccaccagcccgacctcaactacgacaacccggacgtccaggaggcgatgctggaggtcctgcgcttctggctcgacctcggcctcgacgggttccgcctggacgccgttccctacctgtacgtgcgcgagggcacgaacggggagaacctgccggagacgcacgagtacctgcgccgggtccgcaaggagatcgacgccaagtacgccgacagggtcatgctggccgaggcgaaccagtggccctcggacgtcgtccagtacttcggcaatgacgacgagtgccacatggccttccacttcccgctgatgccgcgcatcttcatggcggtgcggcgggagtcgcgctacccgatctcggagatcctggcgcagaccccggagatcccgccgaactgccagtggggcatcttcctgcgcaaccacgacgagctgaccctggagatggtcaccgacgaggagcgggactacatgtacgccgagtacgcgaaggacccgcgtatgaaggcgaacatcgggatccgccgacgcctcgccccgctgctggacaacagccgcgaccagatggagctgtttaccgccctgctgctctccctgcccggcagtcccgtgctctactacggcgacgagatcggtatgggcgacaacatctatctcggtgaccgcgacggcgtgcgcaccccgatgcagtggtccccggaccgcaacgccgggttctcgacaaccgacccggcccggctgtacctgccggtgatcatggacccggtgtacggctaccaggcgctgaacgtcgaggccgagcagcggatgccgacgtcgttcctgtcttggaccaggcggatgatcgaggtccgcaagcggcatcccgtcttcgggctcggcacctacgaggagctcggcgcgtcgaatccgtcggtcttcgcgtatgtccgggagttcggtgacgacagggtgctctgcgtcgcgaacctctcccggttcgcccagcccgtcgagcttgacctgcggagattcgccggcctggtgccggtggagctgctcggccgggtccatttcccaccggtcggcgagcttccgtacctgctgacactgcccggtcacggacactactggttcgctctgtccaatccgggggaattcactcagtag

SEQ ID NO: 13837 - protein, 572 aa, Frankia sp. EAN1pec
MNESEPFAEQPLRETAAEGGDTGTSQDPLWFKRAVFYEVLVRGFADSNGDGTGDLAGLVSKLDYLEWLGVDCLWLLPIYSSPLRDGGYDISDYFQILPEFGDLGDFINLVDEAHRRGLRIIADLVMNHTSDEHPWFQASRSDPDGPYGDFYVWSDTDEKYPDARIIFVDTEKSNWTWDPVRGQYYWHRFFSHQPDLNYDNPDVQEAMLEVLRFWLDLGLDGFRLDAVPYLYVREGTNGENLPETHEYLRRVRKEIDAKYADRVMLAEANQWPSDVVQYFGNDDECHMAFHFPLMPRIFMAVRRESRYPISEILAQTPEIPPNCQWGIFLRNHDELTLEMVTDEERDYMYAEYAKDPRMKANIGIRRRLAPLLDNSRDQMELFTALLLSLPGSPVLYYGDEIGMGDNIYLGDRDGVRTPMQWSPDRNAGFSTTDPARLYLPVIMDPVYGYQALNVEAEQRMPTSFLSWTRRMIEVRKRHPVFGLGTYEELGASNPSVFAYVREFGDDRVLCVANLSRFAQPVELDLRRFAGLVPVELLGRVHFPPVGELPYLLTLPGHGHYWFALSNPGEFTQ

SEQ ID NO: 13838 - DNA, 1761 bp, Moorella thermoacetica ATCC 39073
  CDS (1)..(1761): transl_table=11
ttgctccaccatcgcccgggaatccgtttctgccagcccctggcacccgaccggctcctcctgcgcttaaaaattggccgccgggaacagcaaagctgccaggtaatctatgaagaccggggccttaaaacggcccccatgcatgcctatgcccgaacaccccgttacctttattaccaggctgagatcagcctctcccgtccctggcgctgccgttattttttccggctgcgggaaggggatggggatgaccgctatatctttgccggtggtaccggccaacagggccgcccctttacctatcagtggaccccggcagatatctttaccgttcccgactggatctacgacgccgtttcctatcaaatatttcccgatcgcttttacaacggcaacccggccaacgacccgccgggaaccaggccctggagcgaagcccctaccagggaaaacttcttcggcggcgacctggagggtatccaggcgaagataccctatctaaagtttctgggggtcaatgtcctgtggctcaaccccatttttgccgcctcctccaaccatcgctataacacccgcgattacctggccgtggacccggccctgggagataccgataccctgcgccgcctggtggcatccctccatggcgccggcatacgcatcatcctggatggtgtcttcaaccatacggggaccgatttctttgcttttaaagacgtggtcgcccggggagccggttccccgtataaggactggtactacttctatgacttcccggtacggagtgaaccccgggccaattatgcctgctggtgggatatccccagcctgcccaagctcaacgtcagaaaccccgaggttcgtaattaccttcttcacgtggcgacctactggctgtgggatgccggtaccgacggctggcgccttgacgtgcccaatgagatcgagccgcccttctggcgggagttttaccagcaggttaaagggaccaatccggaagcctacattgtcggcgagatctggcgcgacgcccgtttctggctgaacggccgttactttgacggggtgatgaattacctcttccgggacctggtccttgcatacttcgcccggaggctttttcccatttccaccctggatatgctcctgggcctggtgcgcctgcgctaccctgaggcggccaatttcgccctgttaaacctcctgggcagccatgacacggcgcgaattatcaccgccttccaggaagggttggccggcgttcccggacactccggcagctacgccgaggccgtagcccacctgcgaccggccctcatcctgcagctcacctatcccggtgcgcccctgatctactacggcgacgaggtaggcctcaccggcggcccggaccccgactgccgccggaccatgccctgggaaccccgggactgggaccgggatctcctgaacttttaccggtgcctgataaggttgcggcaccagttgcggcctttgcgacggggatttttccagcccctttttaccgacgaccaggccgaggtctacgcctatgcccggcgcctggagggagagaaggtaattataattctcaatgccagcgacctcccccagacggttaccctggcggcagccgtcgcgggactggctgaggatagtacctggcgggacggcctgagcaaccgcctcctggaggtgaagggcggccagatcagcctgcccctggacgccaattccggggccgttctctaccaggagtaa

SEQ ID NO: 13839 - protein, 586 aa, Moorella thermoacetica ATCC 39073
MLHHRPGIRFCQPLAPDRLLLRLKIGRREQQSCQVIYEDRGLKTAPMHAYARTPRYLYYQAEISLSRPWRCRYFFRLREGDGDDRYIFAGGTGQQGRPFTYQWTPADIFTVPDWIYDAVSYQIFPDRFYNGNPANDPPGTRPWSEAPTRENFFGGDLEGIQAKIPYLKFLGVNVLWLNPIFAASSNHRYNTRDYLAVDPALGDTDTLRRLVASLHGAGIRIILDGVFNHTGTDFFAFKDVVARGAGSPYKDWYYFYDFPVRSEPRANYACWWDIPSLPKLNVRNPEVRNYLLHVATYWLWDAGTDGWRLDVPNEIEPPFWREFYQQVKGTNPEAYIVGEIWRDARFWLNGRYFDGVMNYLFRDLVLAYFARRLFPISTLDMLLGLVRLRYPEAANFALLNLLGSHDTARIITAFQEGLAGVPGHSGSYAEAVAHLRPALILQLTYPGAPLIYYGDEVGLTGGPDPDCRRTMPWEPRDWDRDLLNFYRCLIRLRHQLRPLRRGFFQPLFTDDQAEVYAYARRLEGEKVIIILNASDLPQTVTLAAAVAGLAEDSTWRDGLSNRLLEVKGGQISLPLDANSGAVLYQE

SEQ ID NO: 13840 - DNA, 1623 bp, Shewanella baltica OS155
  CDS (1)..(1623): transl_table=11
atgagtgagttaacttggtggcgtggtgcggtaatttaccaaatttatccgcgtagccttttagatacgaatggtgatggcgttggtgatttgcgtggcattatcactaagctggactacattgcgagcctcaatgtcgatgccatctggatttcacctttctttaaatcgcctatggcagattttggctacgacatcagtgattaccgcgaagttgaccctctttttggcactatgcatgatttcgatgaattgattgaaaaagcccacggcttaggcattaaggtcattatcgatcaagtattaagtcatacctctgatcagcatgcgtggtttgttgaaagccgcgagagccgtacgaatcccaaagcggattggtacgtgtgggccgatcctaaggaagacggcactgcgcctaacaactggctcgcgatttttggcggttgtgcttgggaatgggaaccgcgcagacaacaatactatttacataacttcctgcgtagccagcccgatatcaacttccataatcctgacgtgcgccaagctgtgctggataatgtcgagttctggcttaaaaaaggcgttgatggctttcgcttagatgcgattaccttctgttatcacgatgaacagctcagggacaatccggcaaaacctaaggataaacgtcagggccgaggtttcagcgaagataacccctacgcctatcaatatcattactacaataatgaccgtccgcaaactatcgcgtttatcgaagacttacgccaactcattaatcgttatcctggtgcggtgaccttaggtgaagtgtctgcagaagactctttagctgtgatggcggcttacactaagggtgaagatcgcctgcacatggcctacagttttgagctattaaccgacgattacagtgctgcttatattcgccaaaccgtagaagcattagaagcgagcataggtgatgggtggccttgttgggctatcggtaatcatgatgtgcagcgcgtggcgagtcgttgggggcagggcaaacagaattcagacatggtcaaaatactcaatgccatgctaagttcactgcgcggtagtgtgtgtagttatcaaggtgaagaacttggtttaaccgaagcgccgattgaataccatgagttgcaagatccctttggcaaaaccttctggcctatgtttaaaggccgtgatggttgccgtacgccaatgccatggcaacaaggcgccgattttagcggttttagtgaggtttcaccctggttgccgatcgcccctgcgcatcaagcgttagcggtggatgtacaagaatcagatgcagattccatgcttaacggttatcgacgttttcttgcttggcgtaaattacatccagtgttggttgaaggcgatatccaatttgtggataccaacgagcccatcttggccttcatccgcaccttaggagagctcaaaatattcgtcggattcaacttaggcgataccaatgttgagttggatttatcacagttggaattgggtgaaatattaacgggacacggcctgaaaatcgcacaaatagaaaacaatcagctgaagttttcggcatttgccagcttttatgcagttttaaactga

SEQ ID NO: 13841 - protein, 540 aa, Shewanella baltica OS155
MSELTWWRGAVIYQIYPRSLLDTNGDGVGDLRGIITKLDYIASLNVDAIWISPFFKSPMADFGYDISDYREVDPLFGTMHDFDELIEKAHGLGIKVIIDQVLSHTSDQHAWFVESRESRTNPKADWYVWADPKEDGTAPNNWLAIFGGCAWEWEPRRQQYYLHNFLRSQPDINFHNPDVRQAVLDNVEFWLKKGVDGFRLDAITFCYHDEQLRDNPAKPKDKRQGRGFSEDNPYAYQYHYYNNDRPQTIAFIEDLRQLINRYPGAVTLGEVSAEDSLAVMAAYTKGEDRLHMAYSFELLTDDYSAAYIRQTVEALEASIGDGWPCWAIGNHDVQRVASRWGQGKQNSDMVKILNAMLSSLRGSVCSYQGEELGLTEAPIEYHELQDPFGKTFWPMFKGRDGCRTPMPWQQGADFSGFSEVSPWLPIAPAHQALAVDVQESDADSMLNGYRRFLAWRKLHPVLVEGDIQFVDTNEPILAFIRTLGELKIFVGFNLGDTNVELDLSQLELGEILTGHGLKIAQIENNQLKFSAFASFYAVLN

SEQ ID NO: 13842 - DNA, 1635 bp, Shewanella amazonensis SB2B
  CDS (1)..(1635): transl_table=11
atgagcattcatccctggtggcgcggcgctgccatctatcagatttacccgcgcagtcttaaggacagtaacggcgatggtattggcgatctgcaagggatcatcgagcgtctggactatattgccagcctcaatgtggatgcgatttggatctcgcccttcttccgctctcccatgaaggactttggttacgatatcagtgactatcttgatgtggaccccatgtttggcaccatggacgactttgatgagcttattgccaaggcccattctctggggttgaaggtggttatcgatcaggtactcagccacacttccgacgaacatgcctggtttgccgagagccgccagagccgcgacaatccaaaggccgactggtatgtgtgggccgatccccgagaagacggtacccctcccaacaattggctggcgatattcggtggctgcgcctgggaatgggagccaagacgccagcagtattacctgcacaattttttgaagagccagccggatcttaactttcactgtgaagccgttcgtcaggcggtgctcaataacgtagagttctggctcaaaaagggcgtggatggtttccggctcgatgccattactttttgtttccacgataaggcgcttcgtgacaacccggcgaaaccggccgataagcgccagggccgaggtttttctgaagacaacccctacgcctatcagtatcactggtacaacaacgaacgtcccgaaacccttggttttatcgaagatttaagagcgctgattgatcgctacccgggtgccgtgaccctcggtgaagtctcaagcgaagactcccttgccaccatggccgaatacacccggggcgataaccgcctgcacatggcctacagctttgagcttttaaccaaggactacagcgctgggtatatccgcagcacagttgaagcactcgaaggtgccatcggtgacggctggccgtgctgggccataggcaaccacgatgtggagcgggtcatcagtcgatgggggcagggtaagggcacacctcaaatggccaagatgctgtcggccatgctgggatgcctgcggggcagcctgtgcgtgtatcagggcgaagagttggggcttaccgaagccgacatcccctttgatgcgctgcaggacccctttggtatcgcattctggcctaactttaaaggccgcgatggctgtcgtacccccatgccctggcaagccgaaggcgaatacatgggattcggtgcgacagcctctggtgccatgccctggttaccgctgccagaagaacatcgtgcactgaacgttgccgcccagagtgcgaacccggactcggtgctcaatcagttcagccgctttatggcatggcgccgcactcagccggctttggtaactggtgaaattaaatttattgatagcaaagagcccgttctggcgtttgaacgtgtgagctctgataaaaaagtgctttgtgtgttcaatttatctgataagccgcaaacgatgactgttcctggcagtgagccatggaagctccttgaaggccatgggcttgaaggtggtagtctggacggcgctggcactgttcgccttgcaccccacggggctctgttactgggcaactaa

SEQ ID NO: 13843 - protein, 544 aa, Shewanella amazonensis SB2B
MSIHPWWRGAAIYQIYPRSLKDSNGDGIGDLQGIIERLDYIASLNVDAIWISPFFRSPMKDFGYDISDYLDVDPMFGTMDDFDELIAKAHSLGLKVVIDQVLSHTSDEHAWFAESRQSRDNPKADWYVWADPREDGTPPNNWLAIFGGCAWEWEPRRQQYYLHNFLKSQPDLNFHCEAVRQAVLNNVEFWLKKGVDGFRLDAITFCFHDKALRDNPAKPADKRQGRGFSEDNPYAYQYHWYNNERPETLGFIEDLRALIDRYPGAVTLGEVSSEDSLATMAEYTRGDNRLHMAYSFELLTKDYSAGYIRSTVEALEGAIGDGWPCWAIGNHDVERVISRWGQGKGTPQMAKMLSAMLGCLRGSLCVYQGEELGLTEADIPFDALQDPFGIAFWPNFKGRDGCRTPMPWQAEGEYMGFGATASGAMPWLPLPEEHRALNVAAQSANPDSVLNQFSRFMAWRRTQPALVTGEIKFIDSKEPVLAFERVSSDKKVLCVFNLSDKPQTMTVPGSEPWKLLEGHGLEGGSLDGAGTVRLAPHGALLLGN

SEQ ID NO: 13844 - DNA, 3297 bp, Pelodictyon phaeoclathratiforme BU-1
  CDS (1)..(3297): transl_table=11
atgtatcaacccgaaccgctctggtacaaagacgccattatttatgaggcgcatgtcaagacgttctatgacagcaacaatgatggtgttggagattttcagggactgcgccagaagcttggttacctgcaaagtctcggtgttactgccatctggctgcttcccttttatccatcgcctttacgagatgatggttacgatattgccgattatatgagtgtcaatcccgattacgggacgatggaagatttccgggagtttattgaagaggcacactctcttggtataaaggtgattaccgagctggtcgtgaaccacacttccgaccaacatgcctggttccagcgtgcccggaaggctccggcaggctctccagagagaaacttctatgtctggagtgacgattccagcaaatattctgaagcccggattattttccaggacttcgaggcttcaaactggacatgggatccggttgccgggcaatatttctggcatcgcttctaccatcaccagcccgacctgaactttgaaaaccccgaagtacacaaggctctgctcggtgtgcttgatttctggcttggcatgggcgttgatggtctccgccttgatgctgttccctatctctatgaagaggaggggagtaactgcgaaaatttaccgaggacttatgagtatctgagggcgttgcgctcctatgtggatgagcactatcccaaccggatgctgcttgccgaagccaaccagtggcctgaagattctgcagcctattttggtaccggtgacctctgtcacatgaacttccactttcccctgatgccgcgcatgtatatggcgcttgctaccgaagatcgttttcccattctcgatattctggaacagacaccggaaattccggagatctgccagtgggcttcgttccttcgcaatcatgatgagctgacgcttgaaatggttactgacgaggagcgcgactacatgcgcagggtctatgccaacgatcccaaggcccgtatcaatcttggtatccgccgccgtcttgcaccgctcatggccaatgatcgccgcaagattgaactgatgaacatcatgctgctctcactgcccggaactccggtactctactacggtgacgaaattggcatgggcgataacttttatcttggtgatcgagatggagtacgtacacccatgcagtggaactctgaccgtaatgcagggttttcgcgtgccaatccccagcggctgcagctcccggtcatcatcgatccggaatatcattatgaggcggtcaacgtagaggtgcaggagagcaatgtcaactccctgctctggtggatgcgccataccatatcaactgctcatcgctacaaatcgctcagccgtggtaccattgagttcctgcaggtgagcaaccccaaagtgctgatttttattcgtcagttcgaggatgaaaccatgcttagtgtgatcaacctctcaagaaatgcccaggcggtgatgattgatctatcccgctttgacggctatatccctgaagaggtgttcagcatgaaccgttttccgaaaatcaggaaaattccctacatggtggccctgggatcctatggatatttctggttgcagttggtcaaggataccgaaaatacggatggtcgtccatacctcgacaaaccttttgcgacaccctctcgctggcaaagcctctttaccggcaaaagccgcgaacggcttgaaacagagattctgccccagtacttcaaggtaagccgctggtttggcggcaaggtgcgtcatatcatgcgtatctccatcgtcgataccattcctgtggcgggaatggcaaaagccaagttgctggttacggaagtgcgctattcaagtggtgagaatgaacgctatcaactcccggtatgcttttctccgctttccctggtttctctccaggatgataatttctacaagcgcgttattgcaagggtcgttattggcgatgaagagggttatctgtgcgacgccacctttgatgggcgtttcctgaaccatctctatcagcttgttaccggcaaggagagttggcagggtaaagagggcactgtttccggaatgaagtccatgaagatggatgctgttgcggaagagggaatggagcatgagcccctcctgatgggtgtcgaacaatcgaatacctcaattcgcttcaataatgatctctgcctgaagctctatcgccgcattgaaatcggaatctctcccgaagtggagatgtgccgtgcgctgagtgagcatacttcgttcaaaaacctgccgggctatcttggttcactgaactatgagcagagtcgcaccaacggctattctctcggtattttgcagcattttgtgaaaaacgaaggggatgcctggcagctttcgcttagtcaggtgaaacgctattatgatgatatccttgcaaaaatcaactccggcatggtattgcctgcgttgccgaaactcagtggtgatcccgtgcagcttcccgaaatcatgcatgaactgattggtgaagcctatcttggcatgcttgaaaagcttgcagaacggactgctgaaatgcacctctcccttgcttcgctcgacagcgatccggcatttgcgccagaggcttttactacactctatcagcgttctatctaccaggcgatgtgcgaacaggtgaagcgggcggttcttcttatccgtgaaatcatgcatcagatggctccggagcagcagcagcttgcatctctttttgtgcagaggcagaaacagattttgcagcagtttgatcccatcaggatagagaaaatcgatacactcaaaatcaggattcacggcgattttcatcttggccaggtactctttaccggcaaggattttgtgattatcgattttgagggagagcctgcccggcccctctccgaacggaaaatcaaacgttcggttttccgtgatatttcaggcatgttgcgctccttcgactatgcggcctttaatgtgctgcagcaggacaacaccctcttccgtccggaagagcggcttgcccttgagccttgggctgaccgctggagtttctatgctggccagtactttctcgacagctattttgcaaagaccggaggcagtaatattgttccggcagatccgaagcagcgtgaacatctgatgcgggcctatttgatgaacaaggcggtctacgaactcaattatgagctcaacaatcgtcctgactgggcctccataccgcttcggggtattatgaagattctggagtcgtaa

SEQ ID NO: 13845 - protein, 1098 aa, Pelodictyon phaeoclathratiforme BU-1
MYQPEPLWYKDAIIYEAHVKTFYDSNNDGVGDFQGLRQKLGYLQSLGVTAIWLLPFYPSPLRDDGYDIADYMSVNPDYGTMEDFREFIEEAHSLGIKVITELVVNHTSDQHAWFQRARKAPAGSPERNFYVWSDDSSKYSEARIIFQDFEASNWTWDPVAGQYFWHRFYHHQPDLNFENPEVHKALLGVLDFWLGMGVDGLRLDAVPYLYEEEGSNCENLPRTYEYLRALRSYVDEHYPNRMLLAEANQWPEDSAAYFGTGDLCHMNFHFPLMPRMYMALATEDRFPILDILEQTPEIPEICQWASFLRNHDELTLEMVTDEERDYMRRVYANDPKARINLGIRRRLAPLMANDRRKIELMNIMLLSLPGTPVLYYGDEIGMGDNFYLGDRDGVRTPMQWNSDRNAGFSRANPQRLQLPVIIDPEYHYEAVNVEVQESNVNSLLWWMRHTISTAHRYKSLSRGTIEFLQVSNPKVLIFIRQFEDETMLSVINLSRNAQAVMIDLSRFDGYIPEEVFSMNRFPKIRKIPYMVALGSYGYFWLQLVKDTENTDGRPYLDKPFATPSRWQSLFTGKSRERLETEILPQYFKVSRWFGGKVRHIMRISIVDTIPVAGMAKAKLLVTEVRYSSGENERYQLPVCFSPLSLVSLQDDNFYKRVIARVVIGDEEGYLCDATFDGRFLNHLYQLVTGKESWQGKEGTVSGMKSMKMDAVAEEGMEHEPLLMGVEQSNTSIRFNNDLCLKLYRRIEIGISPEVEMCRALSEHTSFKNLPGYLGSLNYEQSRTNGYSLGILQHFVKNEGDAWQLSLSQVKRYYDDILAKINSGMVLPALPKLSGDPVQLPEIMHELIGEAYLGMLEKLAERTAEMHLSLASLDSDPAFAPEAFTTLYQRSIYQAMCEQVKRAVLLIREIMHQMAPEQQQLASLFVQRQKQILQQFDPIRIEKIDTLKIRIHGDFHLGQVLFTGKDFVIIDFEGEPARPLSERKIKRSVFRDISGMLRSFDYAAFNVLQQDNTLFRPEERLALEPWADRWSFYAGQYFLDSYFAKTGGSNIVPADPKQREHLMRAYLMNKAVYELNYELNNRPDWASIPLRGIMKILES

SEQ ID NO: 13846 - DNA, 3414 bp, Prosthecochloris aestuarii DSM 271
  CDS (1)..(3414): transl_table=11
atggcgaatggaattttgtttcgctcaatcccgcatcgactccggcacatatttttaacgttcttcttcattcataattatttttatcgggattttatgccgaaaacacgcacaaccggccagcctgagccgcaatggtacaaggatgccatcatttatgaagcgcatgtcaaaacattttttgacagcaacaatgacggtgtcggtgattttgaggggcttcgtcagaagctgccctatcttgaaagtcttggtattacggcgatctggctgttgccgttttatccttctccgctgagagatgatgggtatgatattgccgattatatggatatcaatcccgattacggtacgatcgacgactttagagcatttctcaatgaagcgcatgagcgcgggctgaaagttattaccgagctggttatcaaccatacctccgatcagcatgcatggtttcagagggcccgtcgtgcagaacagggctccgacgagcgcaatttctatgtgtggactgacgatccgaaaaagtattcggaaacacggattattttccaggacttcgagtcgtcaaactggacttgggacccgatcgccggacagtatttctggcatcgtttctaccaccatcagcccgatcttaattttgagaacccctcggttgaaaaggcgctctacaaggtgcttgactactggctggagatgggtgtggacgggttgcgccttgacgctgtaccgtatttgtacgaggaagagggctccaactgcgagaacctgccgcgtacgcatgagtttttgaagcgtcttcgcaagcatgtcgacgacaagttccctaaccggatgctgcttgccgaggcaaaccagtggcctgaagatgctgccgagtatttcggggatggcgacgagtgccatatgaattttcattttccgctcatgccgaggatgtatatggccctggaaatggaggaccgttttccgatcatcgatattctcgaccagacgcccgagattgccgaaacctgccagtgggcttcgttcctgcgtaaccacgatgagcttaccctcgaaatggtgaccgatgaggagcgcgactacatgaggcgggtctacgctcatgatccgaaggcaaggatcaatctcggtatccgccgcagacttgcgcccctgatgtcgaacgaccggcgcaagatcgaactgatgaacatcatgctgctttccttgccgggaacaccggtactctattacggtgacgagatcggcatgggggataacttctaccttggagaccgtgatggtgtgcggacccccatgcagtggaacggggaccgcaatgccggtttttcgcgggccaatccgcaacagctgcagctgcccgttattatcgaccccgagtatcactacgaggcaaccaatgtcgaggtgcaggacagcaacatcaactctcttctgtggtggactcgtcacatgctctcaacctcgcgccgttacaaggcgctgagccgtggagatatacgctttatcgcatgtcagaatccccagatcctgattttcagcaggacttttgaggatgaaacgatgctttgtatcatcaacctttcccgtaacgcccaggcggccacggtcgatctgtcggagtatgagggccatactcccgaggaggtgttcagtctcagccacttcccaggcattacgtcgaggccctatacggtaacgcttggcccgtacggttatttctggttcaagctcatcaggaccgaagaggagatcggctcacgccgctatgttgacaagccctttgctcaggttgcttctctgaaggaccttttcgccggtaaagccctcgaacgtcttgaaacgaaagttcttcctgaatatatcagggggtgcaggtggttcggtggcaaagcgcgcaagattgtcagagtgagtgtcgaagagcatattcctgtgacggcatgcgacaacacggtctacatgattgtcgaagtacgttatcccagcgggtcgaacgatacctatcagcttccggtgacgtttctcccggctggagagttcaatcctgatgatgactactttctcaagcaggtcgtctgcagcgtaaaaataggtgatgaggagggttatctctgcgattcggcttatcagaaatcgttccacagcttcctgctcgataccattgtcagcagtaaggggctgaaaggatcgaccggtaaactgacgggtgaaaagggttcccgtgttgaagagtttcttgaaacccaagacgatggagagatgaattccgtgcttttcggggccgagcagagcaatacgtcgatcatgtatggcgacaggctttgcctgaagatctatcgtaagatctcttcaggggtttctcctgaggtggagatctgccgtatgctgacagaaaagacatcgttcgaaagttcgcccgcgtatcttggtgcccttcattttacccggagccgtaaagaccagtgctccctcgggattctgcagaatttcattccgaacgagggtgatgcatggagccagacgctgcatttcgtgcatcgttattacgaagatgtgctcgtcatgctgccgcagatttcagaggtacccgtcctcccatctaccggaggagagtctgtcgaaatgccggaaattattcatggccttatcggagaaccttacctcgagatggtgtcgagactggctgaaaggactgccggaatgcaccttgcactggcctcaccggaccttggtcaggactttatcccggaacccttcaccacgctttaccagcgttcgatctatcagtccatgagggagcaggtgaagcgcggcatggtgcttctgcgcgagcagatgggaggtgtcgctgaagagtaccaggggttggctgccgggcttttgaagcgcgaaggggagatcctcgaacaactgtcgcatatcaaagcccgcaagatcgccgcgtccaagatccggatccatggcgattatcatctcggtcaggtactgtggaccggtaaggactttgtgattatcgattttgagggcgagcctgcccgatcgttgagcgaacggcgtatcaagcgttcagcgttccgtgatcttgcaggtatgatgcgttccttccattatgcggcattcaacgtgctgattcaggatcgttcgatcaggcaggaagatgttgaacgacttgagccgtgggctgaactgtggagcttctataccgggcagcacttcttcgatgtctacgaagatgccgtcaggggacaggggctcattcctgaagatgttaaggagcagcatctgcttcttcgcgcttatcttatggataaggcgatttatgagttgaactatgagctgaacaaccgtcctgaatgggtcgggattgcgctcaagggtctcagcaggctgctcgagttgtag

SEQ ID NO: 13847 - protein, 1137 aa, Prosthecochloris aestuarii DSM 271
MANGILFRSIPHRLRHIFLTFFFIHNYFYRDFMPKTRTTGQPEPQWYKDAIIYEAHVKTFFDSNNDGVGDFEGLRQKLPYLESLGITAIWLLPFYPSPLRDDGYDIADYMDINPDYGTIDDFRAFLNEAHERGLKVITELVINHTSDQHAWFQRARRAEQGSDERNFYVWTDDPKKYSETRIIFQDFESSNWTWDPIAGQYFWHRFYHHQPDLNFENPSVEKALYKVLDYWLEMGVDGLRLDAVPYLYEEEGSNCENLPRTHEFLKRLRKHVDDKFPNRMLLAEANQWPEDAAEYFGDGDECHMNFHFPLMPRMYMALEMEDRFPIIDILDQTPEIAETCQWASFLRNHDELTLEMVTDEERDYMRRVYAHDPKARINLGIRRRLAPLMSNDRRKIELMNIMLLSLPGTPVLYYGDEIGMGDNFYLGDRDGVRTPMQWNGDRNAGFSRANPQQLQLPVIIDPEYHYEATNVEVQDSNINSLLWWTRHMLSTSRRYKALSRGDIRFIACQNPQILIFSRTFEDETMLCIINLSRNAQAATVDLSEYEGHTPEEVFSLSHFPGITSRPYTVTLGPYGYFWFKLIRTEEEIGSRRYVDKPFAQVASLKDLFAGKALERLETKVLPEYIRGCRWFGGKARKIVRVSVEEHIPVTACDNTVYMIVEVRYPSGSNDTYQLPVTFLPAGEFNPDDDYFLKQVVCSVKIGDEEGYLCDSAYQKSFHSFLLDTIVSSKGLKGSTGKLTGEKGSRVEEFLETQDDGEMNSVLFGAEQSNTSIMYGDRLCLKIYRKISSGVSPEVEICRMLTEKTSFESSPAYLGALHFTRSRKDQCSLGILQNFIPNEGDAWSQTLHFVHRYYEDVLVMLPQISEVPVLPSTGGESVEMPEIIHGLIGEPYLEMVSRLAERTAGMHLALASPDLGQDFIPEPFTTLYQRSIYQSMREQVKRGMVLLREQMGGVAEEYQGLAAGLLKREGEILEQLSHIKARKIAASKIRIHGDYHLGQVLWTGKDFVIIDFEGEPARSLSERRIKRSAFRDLAGMMRSFHYAAFNVLIQDRSIRQEDVERLEPWAELWSFYTGQHFFDVYEDAVRGQGLIPEDVKEQHLLLRAYLMDKAIYELNYELNNRPEWVGIALKGLSRLLEL

SEQ ID NO: 13848 - DNA, 1593 bp, Rubrobacter xylanophilus DSM 9941
  CDS (1)..(1593): transl_table=11
gtgacggagagaagagggcacctgtggtggcagcgcggggtggtctaccacatctacccccgcagcttcgccgacgcgagcggcgacggggtgggcgacctcgagggcatcgcctcccgcctggactacctggagtggctcggggtcgacgccatctggctctcccccttctacccctcccccatggcggacttcggctacgacatctccgaccactgcgccgtggaccccctcttcggcacgctcgcggacttcgacgagctggtcgcggagacgcaccggaggggcatgcgcctcatcgtcgactacgtccccaaccacacctcggacgagcacccgtggtttttggagtcccgcgcctcgcgcgagagcccgaggcgcgactggtacatctgggccgacccgaagcccgacggctcgccgcccaacaactggcggagcgtcttcgggggttctgcgtgggagtgggacgagagaacggggcagtactactaccacgccttccaccgcaagcagccggacctcaactggcgcaaccccgcggtgagggaggcgatgcacggggtgatgcgcttctggctggagaggggcgtggacggcttccgggtggacgccctgcgccacctcgtaaaagacgagaagctccgggacaacccgcccaacccggcctacgaggagggtcggccctcctacgaggcccatctccccgtctacaccaccgaccgcccggaggtgcaccggatgatctccgggatgcgccgcgtcctcgacggctgcggcggggagcgggtgatgatcggcgagctctacctgccgttcgacaggctcgtgctctactacggggagggggggcgcggggtccacctgccgacgaacatgcacctcatcacgacgccctggagcgccccctccctcgccgccctcatctccgagtacgaggcggccctccccccgcacggctggcccaactgggtcctgagcaaccacgacaacccccgcgtcgccacccgggtcggcccggagagggcgcgggcggccgccgtgctgctcctcaccctgcgcgggacccccacggtctactacggcgacgagatcggcatggtcgacgggaagatcccgccggagcgtctccgcgacccggccggctcgcagaacccgcgcctcagccgcgacccggcccgcaccccgatgcagtgggacgcctccccgaacgccgggttctgcccgccggacgccgagccctggctcccgctctcccccgaccgccgccaccgcaacgtcgccgcgcagagggagagccggggctccctcctctgcctctaccgcaggctcctgcgcctccgccgctcggagcccgccctctccgtgggctcctacgagccgctcgaggccgggggctccctgctggcctacgcccgcagccacgccgggcgccgcctcctcgtcgccctgaacctgggcgaggcccccgagcccctgccgccggtcctccgggggcgcgtcctgctctccacctctcccgggcaggagggcggagacctccgcccccccgcccggctcggccccggcgaggccctcgtcgtggcgccctag

SEQ ID NO: 13849 - protein, 530 aa, Rubrobacter xylanophilus DSM 9941
MTERRGHLWWQRGVVYHIYPRSFADASGDGVGDLEGIASRLDYLEWLGVDAIWLSPFYPSPMADFGYDISDHCAVDPLFGTLADFDELVAETHRRGMRLIVDYVPNHTSDEHPWFLESRASRESPRRDWYIWADPKPDGSPPNNWRSVFGGSAWEWDERTGQYYYHAFHRKQPDLNWRNPAVREAMHGVMRFWLERGVDGFRVDALRHLVKDEKLRDNPPNPAYEEGRPSYEAHLPVYTTDRPEVHRMISGMRRVLDGCGGERVMIGELYLPFDRLVLYYGEGGRGVHLPTNMHLITTPWSAPSLAALISEYEAALPPHGWPNWVLSNHDNPRVATRVGPERARAAAVLLLTLRGTPTVYYGDEIGMVDGKIPPERLRDPAGSQNPRLSRDPARTPMQWDASPNAGFCPPDAEPWLPLSPDRRHRNVAAQRESRGSLLCLYRRLLRLRRSEPALSVGSYEPLEAGGSLLAYARSHAGRRLLVALNLGEAPEPLPPVLRGRVLLSTSPGQEGGDLRPPARLGPGEALVVAP

SEQ ID NO: 13850 - DNA, 5328 bp, Rubrobacter xylanophilus DSM 9941
  CDS (1)..(5328): transl_table=11
ttgcgagagcgacggaggcccggaggtgcccagacccagacccccgatcatcatagaggacgtctacccggagctggactgcggccgctaccccatcaagcgggaggtcggcgaccggctggaggtgtgggccgacatcttcaaggacgggcacgatgccgtctcggcggtcgtccggtaccgggagaggggggcgcgccgctggtccgaggtgcccatgcgccaccacgagaacgaccgctggaccgcgagcttcccgctcaccaggaacacgcgctaccagtacaccatcgaggcctggccggacgagttcgagacctggcgctccgaggtggggaagaagctcgaggccgggcagcgggtggaggtggagctgctggaggggcgcgagatcctcgagcgggcctactcgcgctcgaaggacgggcgcctccggcagacgctcgacgccttcgacgccgccgggtacgaggggcggctcgcgctgctgcgctccgaggaggtgcgcgggctgatgcgcgagcaccccgaccgctcgctcgcgaccgcctacggcaagaccctcgaggtggtggtggaccgggtgcgggcccgctacggggcctggtacgagatgttcccccgctcgcaggggagcgtcccgggcaggagcgccaccttccgggaggccgaggggcggctggacgagctctcgtggatgggcttcgacgtggtgtacctcacgcccatccaccccatcgggaagaccaaccgcaaggggcgcaacaacgccctcgtggccgggcccggcgacccgggcagcccctacgccatcgggagcgaggagggcgggcacaaggccgtccaccccgagctcgggacgctggaggacttccggcgcttcgttgcggccgcccgcgagcgcgggatggaggtcgcgctcgacctcgccctgcagtgctcgcccgaccacccctacctcagggagcaccccgggtggttcaggcggcggcccgacggcaccataaagtacgccgagaacccgcccaaaaagtacgaggacatcgtcaacgtggacttctactgcgaggagtgggaggctctctggcgggagtggctggaggtcatcctgttctgggtggggcagggcgtcaggatcttccgggtggacaacccgcacaccaagcccttccccttctgggagtgggtgataggggaggtgcagcgggagcaccccgacgtcatcttcctctccgaggccttcacccggcccaaggtgatgcgcgctctggccaagctcggcttcacccagtcctacacctacttcacctggcgcaacaccaagcaggagctcaccgagtacctcaccgagctcaccatggactggcccaaggagtacatgcgccccaacttcttcgccaacacccacgacatcctcccgcacatcctgcagttcggggggcggcccgccttcatgatgcggctggtgctcgcggccaccctctcccccagctacggcatctacagcgggtacgagctgtgcgagaacaccccgcgcggggagcggggcaccaccgtctactaccaggactccgaggtctacgagtacaaggtctgggactgggacaggcccgggaacataaagggctacatccggagggtgaacgagatccggcgcgagaaccccgcgctgcaggagctgaccaacctctccttcctccccgccccggacgacaacatcatcttctacggcaagaggagcggggagaacgccgtcttcgtggcggtcaacctggacccgcacaacccccacgacacccacgtgcagttcccgctgtgggagctcggcatcggggaggaggagccctacgtggtcgaggagctcatcacccgccgcgagatcccggcccgcggcagctggttctgggtgcggctcgacccccaccagaacccggccgagatcttccgcctcaggagggcgggatgacccagacggcccgcaggggggcggcgcgccgggaggaggcctaccgggaggacccgctctggtacaaggacgccatcatctaccagctgcacgtaaaggccttcttcgactcggacaacgacggcatcggggacttcaggggcctgacgcagcggctggagtacataaaagacctcggggtcaacgccatctggctcatgcccttctacccctccccgatgcgcgacgacggctacgacatctccgagtacaagaacgtccaccccgagtacggcacccgccgcgacttccgcaacttcgtgcgccgggcgcacgccctgggcctcaaggtcataaccgagctggtcataaaccacacctccgatgcgcacccctggttccagcgggccagaaaggcgcccaggaactccgtctggcgcaacttctacgtctggagcgacaccgacaagaagtacgccgacgcccggatcatcttcaccgacaccgagacctccaactggacctgggacccggtcgcccagcagtactactggcaccggttcttcagccaccagccggacctcaaccacgacaacccccgggtcttcgacgccatcatgcgggtgatgcgcttctggctggacgccggggtggacgggctgaggctggacgccatcccctacctcatagagcgcgaggggaccgactgcgagaacctcccggagacccacgagatcctcaggcggatgagggccgagctggacgcccgctaccagaacaggatcttcctggccgaggccaaccagtggccggaggacgtgctgccgtacttcgggaagggcgacgagtgccacatggccttccacttccccctgatgcccaggatctacatggccgtggcgcaggaggaccggcaccccatcgtggagatcatgcagcagaccccggagatccccgaggtctgccagtgggccatcttcctcagaaaccacgacgagctgacgctggagatggtcaccgaccgcgagcgggactacatgtaccagacctacgccgccgacccccgcgcccggataaacctgggcatccggcgccggctcgcccccctcatggagaacgaccgggcccgcatagagctgctcaacagcctgctcatgagcatgcccggcacccccatcatctactacggggacgagatcgggatgggggacaacgtcttcctcggggaccgcaacgcggtgcgcacgcccatgcagtggacctccgaccgcaacgcgggcttctcccgggccgacccccacagcctctacctgcccccgatcatggacccggtctacggctacgaggccctcaacgtggaggcccagagccgcagcccgggctcgctgctgaactggatgaagcggatcatcgcggtgcgcaaggcccacaaggccttcgggcgggggacgctggagttcttgcaccccggcaaccggaaggtgctggcctatttgcgggagtacggggacgagacgatcctctgcgtggccaacctctcccgctccgcccagccggtggagctggacctctcccggttcagcgggcgggtgccggtcgagatgatcggggggagcagcttcccgcccatcggctcgctgccgtacttcctcaccctccccgggcacagcttctactggttcaacctcaccaccgaggccgaggccccgagctggcaccaggagagcccccgcttcttcgagccgccggtggtggtgctgcccgccggccgccagacggcccgggacatccgccggctgccgctgcgcctgcagcaccgccaggtggcgcagctggagcaggaggcgctgccggccttcctgagcgtccggcggtggttcgcggcgaagggcagcgagatagagcgggtgagcctcctcgcccgggcggagttcggcccggaccgcctgctggcgctgctgcgggtgggggccgggggcgccgaacacacctacttcctgccgctcgccgccgcctgggaggacgaggacggcgagcgggtctcgggcctcatgccgcacgccctggccaagatccggcgccgctaccgggtcggcgtcctcttcgacgcgctcgcggacgagggcttctgccgggaggtggtcgccgcgatggccggggggcgggagctggagatgggggaggggcgggtgcgcttctacgccaccggcgccctcgaggagctgctggcgggggagccggtgggggagctcgcggtccggcgggcctcggtggagcagagcaacacctcggtgatcctgggcgagcggctggtgctgaaggcctaccgccggctgcagccgggcgtcaacccggagctggagatcgggcgctacctcaccgaggtgcggcgcttcccgaacaccccgccgctcgcgggggccgtggagtacgaggacccgcgctcggggacggtctccctggccctcctgcagggcttcgtccccagccagggcgacggctggtcctacgtgctgggctacctggaccgctacctggagcggcgcctgctctccgcctcctggagcccggaggaggagggcccggcggagccccccgggcaggagggtcaggaggccgacgagggctttttcatggagctgatgcggaccctcggggtgcgcaccggcgagctgcacgctgccctggccgcccccaccgacgacccctccttctcccccgagcccgccccgcccgcggaggtctcccgctgggtcgaggccgtgctggacgacctgcggctcaccctgagcctcctggagcgccgccggtccgggctgccagaggaggtgcgccccgaggtggaccgcctgctccggatggaggcccgggccttcgaccggctggaggcgatctccgcccgggggatacgggccgtgaagacccgccaccacggggactaccacctcgggcaggtgctcgtcgccgggaacgacttccagatcatagacttcgagggcgagcccgcccgcaccctggaggagcgccgccgcaagcactcccctctgcgcgacgtggccggcatgctccgctccttcgactacgccgcccagaccgccctgatgaacctgggggccgaccgggccgtcggggaggacccggagcccgtggtgcgccgctgggagcggagcgtgcgggaggccttcctcgggggctacgccgagggcgtgcggggcgccggggtcctcccgggggagggcgaggaggccgccgccctcgtcgagcttttcgccctggagaaggcgctctacgagatccgctacgagctggacaaccgcccggactggatcgggataccggtccggggcgtcctggaccttctgacgagggaggagagcccgtga

SEQ ID NO: 13851 - protein, 1775 aa, Rubrobacter xylanophilus DSM 9941
MRERRRPGGAQTQTPDHHRGRLPGAGLRPLPHQAGGRRPAGGVGRHLQGRARCRLGGRPVPGEGGAPLVRGAHAPPRERPLDRELPAHQEHALPVHHRGLAGRVRDLALRGGEEARGRAAGGGGAAGGARDPRAGLLALEGRAPPADARRLRRRRVRGAARAAALRGGARADARAPRPLARDRLRQDPRGGGGPGAGPLRGLVRDVPPLAGERPGQERHLPGGRGAAGRALVDGLRRGVPHAHPPHREDQPQGAQQRPRGRARRPGQPLRHRERGGRAQGRPPRARDAGGLPALRCGRPRARDGGRARPRPAVLARPPLPQGAPRVVQAAARRHHKVRREPAQKVRGHRQRGLLLRGVGGSLAGVAGGHPVLGGAGRQDLPGGQPAHQALPLLGVGDRGGAAGAPRRHLPLRGLHPAQGDARSGQARLHPVLHLLHLAQHQAGAHRVPHRAHHGLAQGVHAPQLLRQHPRHPPAHPAVRGAARLHDAAGARGHPLPQLRHLQRVRAVREHPARGAGHHRLLPGLRGLRVQGLGLGQAREHKGLHPEGERDPAREPRAAGADQPLLPPRPGRQHHLLRQEERGERRLRGGQPGPAQPPRHPRAVPAVGARHRGGGALRGRGAHHPPRDPGPRQLVLGAARPPPEPGRDLPPQEGGMTQTARRGAARREEAYREDPLWYKDAIIYQLHVKAFFDSDNDGIGDFRGLTQRLEYIKDLGVNAIWLMPFYPSPMRDDGYDISEYKNVHPEYGTRRDFRNFVRRAHALGLKVITELVINHTSDAHPWFQRARKAPRNSVWRNFYVWSDTDKKYADARIIFTDTETSNWTWDPVAQQYYWHRFFSHQPDLNHDNPRVFDAIMRVMRFWLDAGVDGLRLDAIPYLIEREGTDCENLPETHEILRRMRAELDARYQNRIFLAEANQWPEDVLPYFGKGDECHMAFHFPLMPRIYMAVAQEDRHPIVEIMQQTPEIPEVCQWAIFLRNHDELTLEMVTDRERDYMYQTYAADPRARINLGIRRRLAPLMENDRARIELLNSLLMSMPGTPIIYYGDEIGMGDNVFLGDRNAVRTPMQWTSDRNAGFSRADPHSLYLPPIMDPVYGYEALNVEAQSRSPGSLLNWMKRIIAVRKAHKAFGRGTLEFLHPGNRKVLAYLREYGDETILCVANLSRSAQPVELDLSRFSGRVPVEMIGGSSFPPIGSLPYFLTLPGHSFYWFNLTTEAEAPSWHQESPRFFEPPVVVLPAGRQTARDIRRLPLRLQHRQVAQLEQEALPAFLSVRRWFAAKGSEIERVSLLARAEFGPDRLLALLRVGAGGAEHTYFLPLAAAWEDEDGERVSGLMPHALAKIRRRYRVGVLFDALADEGFCREVVAAMAGGRELEMGEGRVRFYATGALEELLAGEPVGELAVRRASVEQSNTSVILGERLVLKAYRRLQPGVNPELEIGRYLTEVRRFPNTPPLAGAVEYEDPRSGTVSLALLQGFVPSQGDGWSYVLGYLDRYLERRLLSASWSPEEEGPAEPPGQEGQEADEGFFMELMRTLGVRTGELHAALAAPTDDPSFSPEPAPPAEVSRWVEAVLDDLRLTLSLLERRRSGLPEEVRPEVDRLLRMEARAFDRLEAISARGIRAVKTRHHGDYHLGQVLVAGNDFQIIDFEGEPARTLEERRRKHSPLRDVAGMLRSFDYAAQTALMNLGADRAVGEDPEPVVRRWERSVREAFLGGYAEGVRGAGVLPGEGEEAAALVELFALEKALYEIRYELDNRPDWIGIPVRGVLDLLTREESP

SEQ ID NO: 13852 - DNA, 1755 bp, Mesorhizobium sp. BNC1
  CDS (1)..(1755): transl_table=11
gtgcttttttttatcagctcagcgcagctctccagcaaccttcgccattcgccgatttgcgcagcggaacataagcgacttgcgtgtgttcaccgcgtcatggggaacccaggaccagcgcggaaggagctcatgaaaggcacaagccctgacgttgaggtgcactcatcgcaagagccatggtggcggcgcggcgtcatctaccaaatctatccgcgctcctttcaggacagcaatggcgacggcatcggcgacatccgcggcatcatagatcgcctggactacctcgtctggctcgggatagatgccgtctggatttcgccgatcttcttctcgccaatggccgatttcggctatgacatcgcggattatcgcaagatcgaccctcttttcggtacgctcacggatttcgaccagctcattgaagccgcgcatcggcgtggaattcggatattgctcgactatgtgccgaaccactcctcagaccgtcatcaatggtttctggaggcgcgcagctcccgcgataatcctcggcgcgatttctacatatggcgggatgcggcgccggacgggggaccgccaaacaactggcaaagcgaattcggcggcagcgcatgggaactggatgccgcaaccggccaatattactaccatgccttcctgaaagagcagcccgatctaaactggcgcaatccagaagtgcgccgtgaaatgtacgacgtgctccgcttctggctggaccggggcgtcgacggttttcgcgtcgatgtcatgtggcatctcatcaaggacgcggagtttcgcgacaatccgcagaaccccgactggaccgaagacatgccgccgcacaagtcggtgctttcgatctattcctgcgatcaggaggaggtgcacgacgtagtctccgaaatgcgcgccgtgctggacgaatacgggggcgaccggctgcttatcggagaaatatatctgccgattgcccggctcgtcgcctattatggccgggatcttcgcggtgcgcacctgccgttcaatttccgccttattgaggcgcaatgggacgctcgccacatcgagcggcagattgtcgaatacgaggccgctctgccggagggcggctggccgaactgggttttgagcaatcacgataagccgcgtatcgcctcccgtgtcggccgggaccaggcgcgtgttgccgccatgatgctacttacgttgcgcggcacgccaaccatctattatggcgacgagatcgggatgaacgacgctcccattccgcctgagcgcgtgcaggacccgttcgagctgcgcgttcccggacgcggtttcgggcgtgatccccaacgcacgcctatgcagtgggacaatacggtgaatgcaggcttcagcaccggctcgccttggcttcctcttgccccggacaaggacagcttcaatgtggaggcggaacgcagcgatccgcactcaatgctgtcgctctatcgcaggctgattgcattccggcgagaaaatgatgcgctgaaccttggccgttacgcctccgtcgaggcagacagctgcgtgctcgcttacctccgggagacggagaatgatcgctatttgattgcacttaatctcgggcccgagccggcggtgctggaaacacccgggcaatgccggattgtgatcagcacggaaggcaaggcggaaggcgagattgtcgaggaaaagctccacctgcaaggcaatgagggcgtgctggcggagatgatgagttag

SEQ ID NO: 13853 - protein, 584 aa, Mesorhizobium sp. BNC1
MLFFISSAQLSSNLRHSPICAAEHKRLACVHRVMGNPGPARKELMKGTSPDVEVHSSQEPWWRRGVIYQIYPRSFQDSNGDGIGDIRGIIDRLDYLVWLGIDAVWISPIFFSPMADFGYDIADYRKIDPLFGTLTDFDQLIEAAHRRGIRILLDYVPNHSSDRHQWFLEARSSRDNPRRDFYIWRDAAPDGGPPNNWQSEFGGSAWELDAATGQYYYHAFLKEQPDLNWRNPEVRREMYDVLRFWLDRGVDGFRVDVMWHLIKDAEFRDNPQNPDWTEDMPPHKSVLSIYSCDQEEVHDVVSEMRAVLDEYGGDRLLIGEIYLPIARLVAYYGRDLRGAHLPFNFRLIEAQWDARHIERQIVEYEAALPEGGWPNWVLSNHDKPRIASRVGRDQARVAAMMLLTLRGTPTIYYGDEIGMNDAPIPPERVQDPFELRVPGRGFGRDPQRTPMQWDNTVNAGFSTGSPWLPLAPDKDSFNVEAERSDPHSMLSLYRRLIAFRRENDALNLGRYASVEADSCVLAYLRETENDRYLIALNLGPEPAVLETPGQCRIVISTEGKAEGEIVEEKLHLQGNEGVLAEMMS

SEQ ID NO: 13854 - DNA, 3348 bp, Mesorhizobium sp. BNC1
  CDS (1)..(3348): transl_table=11
atgaacacgatggaaaaggtcgcctcggaactcatgtctccagaagaggccgaagctgtccaggtcgtgccgcctgccggcccgcggccgcccgattggtataaggacgcggtcatctatcagctccacatcaaggccttccacgattccaatggcgatggaatgggggatttcaatggcctgatgcagcggctcgattatgtcgaacggctgggcgtcaacaccatatggcttctgccgttctatccctcaccgctccgggatgacggttacgacatcgcggattaccgctccatcaatccttcctacggcaccatgcgcgattttcgccgcttcgtggccgaagcgcaccggcgcggcatccgggtgatcacggaactggtcatcaaccacacctccgaccagcatccctggttccagcgggcaaggcacgccaagaagggttccgccgcgcggcaattctatgtctggaacgacgatgacgagcgctatcccgagacacgcatcatcttcctcgatacggaaaaatccaactggacctgggatccggtcgccggccaattcttctggcaccgcttctattcgcaccagccggatctcaattttgataatccccgggtgctcgacgctgtcatcaggatcatgcgtttctggctggatatgggggtggacgggctgaggctcgacgcgattccgtatctcgtcgagcgcgacgggacgaacaacgagaacctgcccgagacgcatgagatcctgaagaaaatacgaaaggcgctggacgagaaatatcccgaccggatgctgcttgccgaagccaatcagtggccggaggacacgcgcccctatttcggcgagggggacgagtgccatatggctttccacttcccgctaatgccgcgcatctatatggcgctggcgcaggaagaccggcatccgatctccgatatcatgcggcagacgccggaaatcccggaatcatgccaatgggcgattttcctgcgcaaccacgacgaactgacgcttgaaatggtgaccgaccgcgagcgcgactacctttggcgcacctatgcggaggacgtgcgggcgcgcatcaatctcggcatccgccgccggcttgcgccgctgatgcagaacgaccggcgcaagatcgagctgatgaatgcgctgctcttctccatgcctggcacgccgatcgtctattatggcgacgagctcggcatgggcgacaatatctatctcggcgaccgggacggggtgcgcacacccatgcagtgggcgcccgaccgcaatggcggcttctcacgcgccaacccgcaaatgctttacctgccgcccatcatggacccggtctacggttaccagaccatcaatgtggaggcgcaggaggcagatccatcgtcgcttctcaactgggtgcggcgtgtgatcggcgtgcgcaagcaacactcggccttcggacgtggcgatttcaccatgctctatccgagaaaccgccgcatccttgcctatacgcgcagcgatgcaaacgagacgatcctgtgcgtggccaatctctcgcgctcgcctcaggcagtggaactggatctttcgaaataccgcaattgcgtgccgatcgaacttgtcagccagtcgccattcccgccgatcggcgatctgccctacatgcttacgctgacgggttacggtaccttctggttcgtgctcgcgagcgaggcgcaggcgcccgaatggcacaacaatgtgccggagcctttgcctgaattcataacgcttaccatggtggacgggcgcatcgagcgcgcgctggaagggcgcgagcggcggcagctcgaacaggatgttctgccgcaattcatgcagcgccaacgctggtatggcgccaagggcgaggggatacgctccgccgggataagtgatatcgccaaactgggtgatgaaggggggcttctcaccatcgtggatgtcgatctgtccgtctcgggcaggcagcgctacctcctgccgcttaccgtcctctggggcgaagaaaacgtgcagttcggggcgcccaaactttccgtaacgctggcacgtgtgcgcaaaggttcgcgtctcggcgccctgatcgacggcgcctatgacgaccgcttcgcctcggagctgatgcggcggatgcaggaaaaccaggagatgcaggtgccaggcgggactctgcgcttctatggaaatgaacagctcacggccatgcatttcgaggagacgccttcccccctgatgggagagcagagcaatgtgtcagtcgccttcgaccggcaggtgctgctcaagattttccgccggttgaggccgggcgaccagcctgaggtggaggtggcgcgcttcctgacggaggtcgcgggcttcaggaatacgcccgcctttctcggcatggtcgaatatgaggagcagggcgcccgtaccgttctggccagcgtttccggtttcgtcgagaatcagggcgatgcatggggcgtcttcgtgcacgcgctggagcggcagatcgaagacgaaacccttgcaccgcctgccccggccggcgccacgccggctgaggggaccacggcacagctcctctatccgctcgacctgcttcggcgcctcggcgaacgcacgggcgaaatgcacgctgccctcgcgattgaaaccgacatggaggctttccggtgcgagccgatccgccgggcggacatcgcaagctgggtcaaggacctgaaacagcaggcggcgagcgcccgcgcggccctggagcgcaacaaggatcgccttcccctcaacataagggaaagcgtggagcaccttctgtctctgagacaacggatcgacaggcgcatcagcgagttcggaaaaatcacgccttccgggaagaagtcacgcatccatggcgactatcatcttggccaggtgctggtctcaaagcaggacctctacatcatcgatttcgagggtgagccgcgccgaagcctggaggaacgccgcggcaagagctctccgttgcgggatgtggcgggaatgctgcgctccttcgattatgccgcatggacggcggtgcgccaggtcgccgcgcgcctgccggaccagacgcgggatggcagctcgctcgcgcgccaatggcgagagcggatgagcgcggaattcctggaaggataccgcgcggctgcctccgtcgcgcagaaccagccagcagacggagccacatgggaagccctgctcgaacttttcctgttgcagaagggtttctacgaaatcaactacgaactctccaaccggccggactgggtgggcatccccgtgcagggcgtgctcgacctgatcgaaaggaggagcggatga

SEQ ID NO: 13855 - protein, 1115 aa, Mesorhizobium sp. BNC1
MNTMEKVASELMSPEEAEAVQVVPPAGPRPPDWYKDAVIYQLHIKAFHDSNGDGMGDFNGLMQRLDYVERLGVNTIWLLPFYPSPLRDDGYDIADYRSINPSYGTMRDFRRFVAEAHRRGIRVITELVINHTSDQHPWFQRARHAKKGSAARQFYVWNDDDERYPETRIIFLDTEKSNWTWDPVAGQFFWHRFYSHQPDLNFDNPRVLDAVIRIMRFWLDMGVDGLRLDAIPYLVERDGTNNENLPETHEILKKIRKALDEKYPDRMLLAEANQWPEDTRPYFGEGDECHMAFHFPLMPRIYMALAQEDRHPISDIMRQTPEIPESCQWAIFLRNHDELTLEMVTDRERDYLWRTYAEDVRARINLGIRRRLAPLMQNDRRKIELMNALLFSMPGTPIVYYGDELGMGDNIYLGDRDGVRTPMQWAPDRNGGFSRANPQMLYLPPIMDPVYGYQTINVEAQEADPSSLLNWVRRVIGVRKQHSAFGRGDFTMLYPRNRRILAYTRSDANETILCVANLSRSPQAVELDLSKYRNCVPIELVSQSPFPPIGDLPYMLTLTGYGTFWFVLASEAQAPEWHNNVPEPLPEFITLTMVDGRIERALEGRERRQLEQDVLPQFMQRQRWYGAKGEGIRSAGISDIAKLGDEGGLLTIVDVDLSVSGRQRYLLPLTVLWGEENVQFGAPKLSVTLARVRKGSRLGALIDGAYDDRFASELMRRMQENQEMQVPGGTLRFYGNEQLTAMHFEETPSPLMGEQSNVSVAFDRQVLLKIFRRLRPGDQPEVEVARFLTEVAGFRNTPAFLGMVEYEEQGARTVLASVSGFVENQGDAWGVFVHALERQIEDETLAPPAPAGATPAEGTTAQLLYPLDLLRRLGERTGEMHAALAIETDMEAFRCEPIRRADIASWVKDLKQQAASARAALERNKDRLPLNIRESVEHLLSLRQRIDRRISEFGKITPSGKKSRIHGDYHLGQVLVSKQDLYIIDFEGEPRRSLEERRGKSSPLRDVAGMLRSFDYAAWTAVRQVAARLPDQTRDGSSLARQWRERMSAEFLEGYRAAASVAQNQPADGATWEALLELFLLQKGFYEINYELSNRPDWVGIPVQGVLDLIERRSG

SEQ ID NO: 13856 - DNA, 1653 bp, Silicibacter sp. TM1040
  CDS (1)..(1653): transl_table=11
atgaacgctcagaccacaatcaaccctgcttcggtgctgtccaatgacccggattggtggcgcggtgcggtgatctaccagatttatccgcgcagctaccaagacagcaatggcgacggcatcggggatctgcagggtatcacgtcacgtctggaccacatcgcctctcttggggtggatgccatctggatttcgccctttttcacgtcaccgatgaaagactatggctacgatgtcagcgactactgcgatgttgatccgatgtttggcaacctcgcagattttgacgcgctggtggcgcgggcgcatgatctcggcctgcgggtgatgatcgatctggtgctgtcgcatagttcggatcagcacccttggttcgccgagagccgtcagagccgcgacaacccaaaggccgactggtacgtctgggccgatccccaagaagacggcacgccgccgaacaactggctgtcgatctttggcggttccgcctggcattgggacgcgcgccgcgagcaatattatctgcacaattttctggtctcgcagcctgacctaaatttccattgtccggacgtgcagaatgcgcttttggatgtgacccgcttctggctcgagcggggagtcgatgggttccgcttggacaccatcaatttctacatccacgacaaggagttgcggtcgaacccagcgcttcccaaggatcagcgcaatgccaatatcgccccttcggtgaacccctataaccatcaggaacacctctactccaagaaccagccggaaaacctcgattttctcgcgcggttccgtgcgcttttggacgaatacccggccaagaccgcggttggcgaagtcggcgatgcgcagcgcgggctggaactattgggacagtacacggccggcaacaccggtgtccacatgtgctatgccttcgagttcctggccaaagatccgctaaccgccgcgcgcgtggctgaggtttttgagcgcacagatgaggtagcagccgatggttgggcctgttgggccttctccaaccatgatgttcagcggcacgtcagccgatgggggttgtcggacgctgcgctgcgcctccatgcgactttgatcatgtgcctccgcggctctgtctgcatctatcagggcgaagaactggggctgccagaggccgatatttcctttgaagatctgcaagatccctatgggattgagttctggcctgaattcaaaggacgcgatggatgccgcactccgatggtctggcgcagcgacaatacgcatggcggcttctccgaggcgcgtccttggctgccggtcagcctcgagcatgcggcgctgtccgtagcagagcaagaagcaaaccccgatgcgttgctgcaccactaccgccgcgtgattgccctgcgacgcgcccacgcggcactgtcgcacggaacccacgacaaggtcgtggcaagcgggtctgtcgttcattttctgcgcagcgccgagtccgaggacatcttctgtgccttcaatcttggcgaggcggcggcagaggtcagcttgcccgcgggaacgtgggagcagcttggtgctgacatcggcactgccgaaatcaatggtgatctggtgaaacttggcccttggcaagcctgcctcgtacggcgcgtataa

SEQ ID NO: 13857 - protein, 550 aa, Silicibacter sp. TM1040
MNAQTTINPASVLSNDPDWWRGAVIYQIYPRSYQDSNGDGIGDLQGITSRLDHIASLGVDAIWISPFFTSPMKDYGYDVSDYCDVDPMFGNLADFDALVARAHDLGLRVMIDLVLSHSSDQHPWFAESRQSRDNPKADWYVWADPQEDGTPPNNWLSIFGGSAWHWDARREQYYLHNFLVSQPDLNFHCPDVQNALLDVTRFWLERGVDGFRLDTINFYIHDKELRSNPALPKDQRNANIAPSVNPYNHQEHLYSKNQPENLDFLARFRALLDEYPAKTAVGEVGDAQRGLELLGQYTAGNTGVHMCYAFEFLAKDPLTAARVAEVFERTDEVAADGWACWAFSNHDVQRHVSRWGLSDAALRLHATLIMCLRGSVCIYQGEELGLPEADISFEDLQDPYGIEFWPEFKGRDGCRTPMVWRSDNTHGGFSEARPWLPVSLEHAALSVAEQEANPDALLHHYRRVIALRRAHAALSHGTHDKVVASGSVVHFLRSAESEDIFCAFNLGEAAAEVSLPAGTWEQLGADIGTAEINGDLVKLGPWQACLVRRV

SEQ ID NO: 13858 - DNA, 3267 bp, Nitrobacter hamburgensis X14
  CDS (1)..(3267): transl_table=11
atgaacgagatgaccaaaatcgatgctgaccgatatgtccagaccgacgatctctggtacaaggacgccatcatctatcagcttcatgtcaaggccttcgccgacagcaacaacgatggcatcggcgacttcgccgggctgaccaacaagcttgactaccttcaggaactgggcgttacgacgctgtggctgctgccgttctatccgtccccgggacgcgacgatggatacgacatcgccgattacggttcggtcaaccccgacttcggcacgatgaaggatttccgtcgcttcatctccgaggcgcggcggcgcggccttcgggtgatcacggaactcgtcatcaatcacacctccgaccagcacagatggttcaaacgcgctcagcgcagcccgcccggatcgagcgcacgcaactggtatgtctggagcgacaccgacaaaaaataccaggacacgcggatcattttcaccgacacggaaaaatcgaactgggcctgggatgccgaggccaaggcttactactggcatcgtttcttcacgcatcagccggacctcaatttcgacaatccgcgcgtggtcagggcggtcattcaggtgatgaagcgatggctcgacgcaggcgtcgacggctttcggctggatgccattccctacctctgcgagcgcgacggcaccaacaacgaaaatcttcccgaaacccatgcggtgatcaagcacattcgtgcggagctcgacgcctacgccaagggcaaggtgcttctggccgaagccaatcaatggccggaggatgtccagtcctatttcggcgatggcgacgagtgccatatggcctatcatttcccgctgatgccgcgcatctatatggcgatcgcgcaggaggatcgctttccgatcaccgacatcttgcggcagacgcccgatatcccgcccaattgccaatgggcgatgttcctgcgcaaccatgacgagctgacactcgaaatggtgacggacatcgagcgcgattatctctggtcgatctatgccgccgatccacgcgcacgcatcaatctcggcattcgccgccgcctcgcgcctttgatggacaatgaccggcggaaaatcgagctgatgaattcgttgctgatgtcctttcccggcacccctatcatctattacggcgacgaaatcgggatgggcgacaacatctatctcggcgaccgcaacggcgtccgtaccccgatgcaatggacgccggaccgcaacggcggcttttcgcgatgcgatcccgcgcggctctatgcacctccggtcatggacgccgtctacggctacgagtccgtcaatgtcgaagcacagtcgcgaagcctgttctcgctgttgaactggatgaaaaagctgatctcggttcgcaaatcgagccacgtcttcggccgtggcaccatgtccttcgtgcgctcctcgaatcgcagcgttctcgcttacgtgcggaaaaataacgacgaggtcgtgctctgcgtcgccaacctgtcgcgatcggcacaggcttccgaactcgatctgtcgcactggaaaggccgctcgccgatcgaaatgctgggacgaacgacgtttcccgatatcggcgaactgccttatctgatcacgctcgcgccttacggtttctactggttccgcctgaccgaaaagccgccgtcgccgaacgttgcggcggtgatcgttcccgactatgagaccctcgtggtgccgctgggcgcgacctggatgtcactggcgcggacccgctcgatcttcgagcgcgatgtcctgccttcgcatctcgcccgctcgcgctggttccccgagcggtcggccagcgccatcgccgcgcgtgtcccggcagcgataccgctcatgaaagaccaggtttcacggccatggctggtgatcttcgacgtcacccatcgcgggcagtcggggcgatacgcgatgccgatccgaatccgatgggatcggctcgaccgccgcaactatgacgccaaaaacatcgccgccgtgcggcaggggtcgcgcgagggaacgctgatcgacgccgcctatgagaacgacctgatcgccggcatcatcgacggtctgcgccaccggacgacctttgaggaaggcgaattgcggcttgcctaccatcccacggaacggctggcctcgattgcagaggagccgattggcaacgtgcgcgcggtgcagaccgaacaatcgaacagcaccgcgctggtagaccagaggttcgtcgtcaaaatctatcgcaagcttgaaaacggtatcaatccggaagtggaagtcgggcgcttcctgacggacgtcgccggattcgccaatacgcccgccctgctcggcagcgccgaactgaccggccccgatgtccaggccgccgttgccattgtccatgcctttgtcggcaaccagggtgacgcatggaccgtcagcaacgctgcactggatcgctttatcgacgagcagcggctggtcggcgctagcgattcggctccggcgcttgaagagaaggcggcgtatcagcgctcgatgaagcagatcggcaagcgcgtcgcggaaatgcacgtcgcgctggccagccgcaacgacatcgcgaatttccgtcccgaacctgtaacgccttcggacctcgcgcacctcatcgatcgtttgatgatgcgcgccgggcaaacgttcgaccgcctcgctcaagtcaagcttgccgattcggatcggcttcttgccgatgaaattctgagcatccgtccaacgttgcatggccggctcaccgagctgctgccgccctcgattcaaatgtacaacattcgacatcacggtgactttcatctcgggcagatcctcgtcgtccgcgacgatgtctttatcatcgactttgaaggcgaaccccgccgaagcctccccgagcggcgattgaaagcgccggcggcccgcgatgtcgccgggctgatccggtccatcgactattccgtcaccacagcgcaagagcgcgtcctcaagaccggaacggacgacgacggacgactggccgaggctttgtcggcatggcgcaacgaggcgacgcaaaccttcctgaccgcctaccgcgaagcgatgtccgatccccggctatggccgcaggataacgaccacgccgacaggacgctgcggttcttcctgctcgaaaaggcgttctatgaaatcgactacgagctcgcgcatcgcccggactggcttcgtgtcgcattgggcggcgcacttcgcgtgctgcgcaaatag

SEQ ID NO: 13859 - protein, 1088 aa, Nitrobacter hamburgensis X14
MNEMTKIDADRYVQTDDLWYKDAIIYQLHVKAFADSNNDGIGDFAGLTNKLDYLQELGVTTLWLLPFYPSPGRDDGYDIADYGSVNPDFGTMKDFRRFISEARRRGLRVITELVINHTSDQHRWFKRAQRSPPGSSARNWYVWSDTDKKYQDTRIIFTDTEKSNWAWDAEAKAYYWHRFFTHQPDLNFDNPRVVRAVIQVMKRWLDAGVDGFRLDAIPYLCERDGTNNENLPETHAVIKHIRAELDAYAKGKVLLAEANQWPEDVQSYFGDGDECHMAYHFPLMPRIYMAIAQEDRFPITDILRQTPDIPPNCQWAMFLRNHDELTLEMVTDIERDYLWSIYAADPRARINLGIRRRLAPLMDNDRRKIELMNSLLMSFPGTPIIYYGDEIGMGDNIYLGDRNGVRTPMQWTPDRNGGFSRCDPARLYAPPVMDAVYGYESVNVEAQSRSLFSLLNWMKKLISVRKSSHVFGRGTMSFVRSSNRSVLAYVRKNNDEVVLCVANLSRSAQASELDLSHWKGRSPIEMLGRTTFPDIGELPYLITLAPYGFYWFRLTEKPPSPNVAAVIVPDYETLVVPLGATWMSLARTRSIFERDVLPSHLARSRWFPERSASAIAARVPAAIPLMKDQVSRPWLVIFDVTHRGQSGRYAMPIRIRWDRLDRRNYDAKNIAAVRQGSREGTLIDAAYENDLIAGIIDGLRHRTTFEEGELRLAYHPTERLASIAEEPIGNVRAVQTEQSNSTALVDQRFVVKIYRKLENGINPEVEVGRFLTDVAGFANTPALLGSAELTGPDVQAAVAIVHAFVGNQGDAWTVSNAALDRFIDEQRLVGASDSAPALEEKAAYQRSMKQIGKRVAEMHVALASRNDIANFRPEPVTPSDLAHLIDRLMMRAGQTFDRLAQVKLADSDRLLADEILSIRPTLHGRLTELLPPSIQMYNIRHHGDFHLGQILVVRDDVFIIDFEGEPRRSLPERRLKAPAARDVAGLIRSIDYSVTTAQERVLKTGTDDDGRLAEALSAWRNEATQTFLTAYREAMSDPRLWPQDNDHADRTLRFFLLEKAFYEIDYELAHRPDWLRVALGGALRVLRK

SEQ ID NO: 13860 - DNA, 1926 bp, Shewanella denitrificans OS-217
  CDS (1)..(1926): transl_table=11
atgaaaaaattgaccttcactgtggctaccaccctgcttatgagtgcgatgaatttagctattgcagcgcaaagcccctcctcctttaccatcaatgctgagcctatgttttggtgggcgggaatggaaaatagtcaactagagctcttgatagaaggcgacaatgttgcggccttgacccctaagcttagccaacagcaaggcattacattagtcaagactgagcgcagcactagcccaaaccatttgtttgttactctggatctgcatcaagcccagccgcaaacattaaccattgatttttatgaattaaacaatcctaaaaaacccgctacagcgacattagcctatcaactaaaaccaagaacatcagactcaaagcagcgccaaggctttagcaataaagacgtgatataccttattaccccagacagattcgccaatggcaacccagataacgataaccataccaccatgttggaaaaggtgaaccgcagcgataaagatggccgtcatggcggcgacatccagggcataatcgaggcgctgccttatttagccgacttaggtgtgactcagctatggataaacccactactggaaaataaccaagaaaagtattcttaccatggttattccatcacaaacttttatcgaatagacccccgctttggcagcaatcaggactatgtcaatctagttcaacaggcgaataaattggggattggggtaattaaagacatagttgtcaatcatatgggcagcggtcatccttggatgacaaatttccccagcgccacctgggtcaacggccaagcaagtttgcagcaacaactgccattggattttaccaaccatagacgcaccacagtgcaagacccctatgccgcgagcaccgacacccaagccttcagcgacggctggtttaccgataccatgcctgacatgaaccagaccgaccctcactttgccacctatctcattcagaacagcatctggtgggtggagtacgcaggtttgagcggcattcgagaagacacttactcttatgctgataaagctttcttaactcagtggtctaaggccatcatgaccgaataccccaagttcaatattgtcggtgaagagtggagtcctaaccccatcaccgtcagctattggcaggcgggcaagcataataaagatggctatgtctcccatgtacctagcatgatggacttccccttgtatgagaaacttatcgcctcgctcacccaagtcgaaggctgggacacgggcctagtcaacctctatgagatgctcgccaacgatgtggtttatgccgaaccgacccaattggtgctgtttgaaggcaatcacgacaccaatcgcctctatagcttgatgaatgaagatcttgccctgtttaagatggccatggcttatgtgctcacgagtaatcgcattccacagattttttatggcacagaagtgttgatgacaagccccactaaagacagaaacgatggcctagttcgcagtgattttcccggtggttggcaaggcgatagccaaaatgccatcacaggcgataacctcagtccagctcaaatcgaagctcaacattttatcaagaccttgctcaattaccgtaagcactcagacgctatcataaacggcacccttagccattacgcccctcaagacggtgtgtatgtgcaattcagacaagctggggatgaaaccttgatgagtatctacaacaaaaattcggccccagtgaatttagccttaggccgttttgccgagcatataggcaagcacactcaagccagcaacatccttgaacacacagagtttgacttaaatgacagcatatcgctcacaaaaaaaggcgtgactctgctcaaattaagtacgctcaaattaagtacccacaagccctag

SEQ ID NO: 13861 - protein, 641 aa, Shewanella denitrificans OS-217
MKKLTFTVATTLLMSAMNLAIAAQSPSSFTINAEPMFWWAGMENSQLELLIEGDNVAALTPKLSQQQGITLVKTERSTSPNHLFVTLDLHQAQPQTLTIDFYELNNPKKPATATLAYQLKPRTSDSKQRQGFSNKDVIYLITPDRFANGNPDNDNHTTMLEKVNRSDKDGRHGGDIQGIIEALPYLADLGVTQLWINPLLENNQEKYSYHGYSITNFYRIDPRFGSNQDYVNLVQQANKLGIGVIKDIVVNHMGSGHPWMTNFPSATWVNGQASLQQQLPLDFTNHRRTTVQDPYAASTDTQAFSDGWFTDTMPDMNQTDPHFATYLIQNSIWWVEYAGLSGIREDTYSYADKAFLTQWSKAIMTEYPKFNIVGEEWSPNPITVSYWQAGKHNKDGYVSHVPSMMDFPLYEKLIASLTQVEGWDTGLVNLYEMLANDVVYAEPTQLVLFEGNHDTNRLYSLMNEDLALFKMAMAYVLTSNRIPQIFYGTEVLMTSPTKDRNDGLVRSDFPGGWQGDSQNAITGDNLSPAQIEAQHFIKTLLNYRKHSDAIINGTLSHYAPQDGVYVQFRQAGDETLMSIYNKNSAPVNLALGRFAEHIGKHTQASNILEHTEFDLNDSISLTKKGVTLLKLSTLKLSTHKP

SEQ ID NO: 13862 - DNA, 1419 bp, Thermotoga neapolitana
  CDS (1)..(1419): transl_table=11
atgtatcccataccaagttgggtatacgacagtgttgtgtaccagatattcccggacaggtttttcatcggcaaaggaaagaccgtcgaggacaaaaaagatctttatctgaaacgagggggaaccatcgaaaaatggggggttcctcctcgaaaacttcccggtgctcagcacgtgaaggtcttctacggaggagatctatggggaatagcagagaagatcgattacttagaagaactcggagttaacgcagtttacctcactcctatctttctttccgatacaaatcacaaatacgatacgatagattatttcaagatcgatccacagttcggaggaaaacgagcctttgtacaccttctgaaagttcttcacagcaggaacatcaaactcattctggacggtgtgttcaaccacgttggaagtcagcatccctggttcaaaaaggcaaggaagaaagatcctgaatacgtgaaccgtttctttctttacagagacaggcacagatcttggttcgacgtgggaagtttgcccgaactgaacgtggaagttgaagaggtgagagaatacatattgaaagtcgttcaacactacctggaagtgggtgtggacggctggaggctcgactgtggtcacgaccttggacctctggtcaacctgtggatcaacatgaaagtaaaggaattctcttctgaaaagtatcttgtgagcgagatatggacctacccggcaggatgggaaatggtcgatggattgatgaactacaatttcaggagccttgttttgagctatgtgaacggagaaacggattctatagggacagaactcgaaagggcttacagagaaacaaagaacatcttcgggtgctggaacatgctagacagccacgatactccaaggcttgcaacgacggtcccagtcaaagatctcagaaaactcgctatagtgcttcagttcacatatccgggcgttccgctcgtctattacggaacagagataggcctcacaggtggagaagatccggagtgtcgagccaccatggaatggaacagggaaaagtgggacatggagttgtttgagttttacaagaagatgatcaggttcaggagaaccgatcctggtttgaggtttggcgagttcatacttttgaaagaaaagccacttgccttcatgaggaaagccccgcatcctcttcaagacacgatcgttgtggtgaatcctgaagaggaaaaaaacgttgttctctcccttccggatggaaagatcatgaacgcaactcctcttttcgacatcttcaccggtgagaagttccatgtggatggaggagtcgtgaaggtgcccgttggaagaagatcgttcaggatcttaaagccgatcgacctcagagttggaaggtacagattgtacaagagagtgtga

SEQ ID NO: 13863 - protein, 472 aa, Thermotoga neapolitana
MYPIPSWVYDSVVYQIFPDRFFIGKGKTVEDKKDLYLKRGGTIEKWGVPPRKLPGAQHVKVFYGGDLWGIAEKIDYLEELGVNAVYLTPIFLSDTNHKYDTIDYFKIDPQFGGKRAFVHLLKVLHSRNIKLILDGVFNHVGSQHPWFKKARKKDPEYVNRFFLYRDRHRSWFDVGSLPELNVEVEEVREYILKVVQHYLEVGVDGWRLDCGHDLGPLVNLWINMKVKEFSSEKYLVSEIWTYPAGWEMVDGLMNYNFRSLVLSYVNGETDSIGTELERAYRETKNIFGCWNMLDSHDTPRLATTVPVKDLRKLAIVLQFTYPGVPLVYYGTEIGLTGGEDPECRATMEWNREKWDMELFEFYKKMIRFRRTDPGLRFGEFILLKEKPLAFMRKAPHPLQDTIVVVNPEEEKNVVLSLPDGKIMNATPLFDIFTGEKFHVDGGVVKVPVGRRSFRILKPIDLRVGRYRLYKRV

SEQ ID NO: 13864 - DNA, 1701 bp, Bacteroides thetaiotaomicron
  CDS (1)..(1701): transl_table=11
atgaaaaggaatttattattcattatcttactattattattacccggtcttcaccaggtattcgcaacaagcactataaagaaagtagccccgaccttttggtgggcaggaatgaagaatcccgaattgcagatactattatatggtgaccgcatatcatccgcagacgtcagtctttctgccgataatatcacgctgcaagaagtggtgaagcaggagaatcctaattatctggttctgtatttagacctttcgaaggctgctccacagaactttgacatcatcctgaaacaaggcaaaaagcagataaaaatcccttacgagcttaaacagcgccggccgaatgcttcggcagtagaaggttttgattcgagcgacgtgctttatcttattatgccggaccgttttgccaatggcaacccctccaacgacatcattcccggaatgctggaaggaaatgtagaccgtaatgagcctttcgcacgtcatggcggtgatttgaaaggaatagagaatcatctggattacatagcagacctcggagtcaccagtatatggctcaacccgattcaggaaaatgacatgaaagaaggatcgtatcacggttatgccattaccgattattatcaggtagaccgccgcttcggcagtaacgaagagttccgcaaacttactcaggaagctaatgccaaagggctgaaagtcgtaatggacatgatcttcaaccattgcggttcggacaactatctgtttaaagatatgccctccaaagactggtttaactttgaaggcaactacgtgcagaccagcttcaagactgccactcaaatggacccgtatgcttccgattacgaaaagaaaatcgctatcgacggttggttcacactgaccatgccggacttcaaccaaagaaaccgtcatgtagctacttatctgatacagagcagtatctggtggattgaatacgccggtatcaacggcatccgtcaggatacacacccttatgccgacttcgatatgatggcacgctggtccaaagcggtcaatgaagaatatcccaagttcaacattgtaggtgaaacatggctgggcaacaatgtactcatctcctactggcagaaagacagcagactcgcttatccgaagaacagcaatctcccgactgtcatggacttcccgctaatggaagagatgaacaaggctttcgacgaagagactaccgaatggaacggaggacttttcagactctacgaatatctatcacaggacatcgtctacagccatccaatgagcctgctgaccttcctcgacaatcacgatacttcccgcttctaccgttcggaagcagatacaaagaatctggaccgatacaagcaagccctgacgttcttactgacaacccgcggaataccgcagatatattatggaactgaaatcctgatggcagccgacaaggcgaatggagacggcctgctccgctgcgacttccccggaggctggccgaacgatacaaaaaactgctttgacgcagccaaccgcactccacagcaaaatgaagcattctcctttatcaaaaactgctccaatggagaaaaggaaacgaagtcattgccaaaggtcagctcaaacatttcgcaccgaataaaggtgtctacgtttacgaacccaaatacggtgataaatcagtcgttgttttcctga

SEQ ID NO: 13865 - protein, 566 aa, Bacteroides thetaiotaomicron
MKRNLLFIILLLLLPGLHQVFATSTIKKVAPTFWWAGMKNPELQILLYGDRISSADVSLSADNITLQEVVKQENPNYLVLYLDLSKAAPQNFDIILKQGKKQIKIPYELKQRRPNASAVEGFDSSDVLYLIMPDRFANGNPSNDIIPGMLEGNVDRNEPFARHGGDLKGIENHLDYIADLGVTSIWLNPIQENDMKEGSYHGYAITDYYQVDRRFGSNEEFRKLTQEANAKGLKVVMDMIFNHCGSDNYLFKDMPSKDWFNFEGNYVQTSFKTATQMDPYASDYEKKIAIDGWFTLTMPDFNQRNRHVATYLIQSSIWWIEYAGINGIRQDTHPYADFDMMARWSKAVNEEYPKFNIVGETWLGNNVLISYWQKDSRLAYPKNSNLPTVMDFPLMEEMNKAFDEETTEWNGGLFRLYEYLSQDIVYSHPMSLLTFLDNHDTSRFYRSEADTKNLDRYKQALTFLLTTRGIPQIYYGTEILMAADKANGDGLLRCDFPGGWPNDTKNCFDAANRTPQQNEAFSFIKNCSNGEKETKSLPKVSSNISHRIKVSTFTNPNTVINQSLFS

SEQ ID NO: 13866 - DNA, 3906 bp, Alicyclobacillus acidocaldarius
  CDS (1)..(3906): transl_table=11
atgcacgtgaagtggacgggtgccgcgagccttgcgacgaccatcgtcatgtctgcagcgcttccgttcgcggcgtttgaaaacacccgttccgtcggcacggaacgcgttctggcggcgaccgcggcggatagtactaacgcctcgcccccgaccggggcgtccgcaggcggtggcacagcaggagagacctactcgaatgccgtgcagattgtgagcggcaatggctttcgcgctggaaacggggccacggtcgtcctcgctgtgaatggactgaacttgaacccctcgagtttcaaggttgtggtatcgaatagcctcaacggcgtgatcgacgtcacaagtgattccgtgctaacggggccgaattcgattgccttgcaccttcctgccggggatgacgggcttggcgccggtacgtacacggtcaccgtcgaaagtggaggtgattcggtctcgacgccttcaggacagggacttcaggtcatgccttatacgacggccgacaccattcagtgggatggaatctacacatccgatggcgcgatgtacgtgtcagatccgaatccctcccctggacaagaggtgacgatcagccttcgagcgtacagcgggaacctgacgaaggtgatcctgaattgctgggacaccgcacaaaacaagggtttccaggtcgagatgtctccaggcagaacgtttggaccgtatcagctctggtctgccacgatccccgcttcaaacggcggaacgatctattatcgctttgacatatacgatggcaccagttttgcgtgtctctcaggtgacggactgcacacgtctgacgacatcaacaacaatttcccgttgcccgtggggacggtcacgctttcgacacttcaggcgaatcccggtgatacggtgacggtctccgaccctgtaggtgacttcgccggaagccaggatcaacccaatcacacggtgatacggtttgtcaactcgtcgggcgaaacggccgccacagtcaatgggacgaacgcgagctggaacagcgtgcagttcacagtcccacagagccttccaaacggcttgtatcgcgtcgagatcgacacggtcgccaaggacgcggatggggtggtcaatgtcgaattggacaggagtgcggagcttattgtagggcctctgcccgcgtggatgcaagcgtatgcacatgattcgtttcaggcgttctaccgatcgcctttcggagccgtgtccacaggaacccccatcacgcttcgcctgcgggctccgctcagcgtgaagagtgcgacgcttcgcctctggggggcagcggatcagtcaggcgagatcgacctgccgatgcagaagctccaaatgtcgggagacgagttggcgcaacaaaccggcgtgcaggacatcaacgactacacgtggtggacggtgaccatccctgcggcggatgtgaccacacccgggacgatgtggtatcagttcgtgacggagacggacactggccaggtggtctactacgatgacaatggagctcagcttgaagggcctggccaggttgggttgtcttccgacggaccgagctaccagatcagcgtatacgaacggggatttcagacgccagattggctgaagcacgccgtgatctacgaaatcatgccggatcggttctacaatggcaatatcgccacggaggagaatccgaatacgcaaaaggggatttatgtaggggccgatggaacggagtcattaggccccatccagttccacgagaactgggactcgccgccctatgatccgaatattcctccgttatctgatcccaaaattgccagtctgcgaggcaatggccaatggaacattgactttttcggaggtgatttgcagggcatcgaggataagctggactacctgaagagccttggagtcaatacgctgtatctgatgcccgtctttgaggcggaatccaatcacaaatatgacacagccgactatttcaagattgaccctggatttggaacgcagcaggactggctgaatctcgtacaggctgcgcacgcgaaggggttccatatcattctcgacggggtgttcgaagataccggaagtgacagcgtatatttcaacaagttcgggaacttccactccaacggtgcgtggcaggcgtacctgaagaaccagccgtcgctgtcgccctactactcgtggtacgtgtggacagggaacacctcaaacccatacgattcgtggtttcagatcgacacgctgccacttacggacacgtcgaaccccgcctatcagcgattcgtgtatgggagcgacaactcagtcgcgcgtgtgtggatccgggaaggtgcggacggatggcgcttggactcggccgacaacgggaatttcaacacggcatggtggggtggctttcggcaggccgtgaaatcgatcgatcccaacgcagcgatcatcggcgagatctgggacaatgcgacgaatgacaatggaacggattggttgacgggatcgaccttcgacagtgtaatgaactaccagttccggaacgccgtgatcgacttcttccgcggcacgtacaacgacggaaacgtgcagcaccacgccgtcgacgctgcgggattcaaccaggaactgatgcgcctgtacagtgaatatcctctgcagtcgttctactcgatgatgaaccttgtcgattcgcaagacaccatgcggatcctgaccatcttggagaacgcgccgcagccaggcgatctatccgcgctccagcaggatgagtacaggccgtctcctgcggctgaacagttggggatcgagaggctgaagcttgtatcggactttcaattcagcttcccgggcgatccgaccatcttctacggcgacgaggcagggctcactggttattcggatcccctcaatcgtcggacctatccgtgggacaaccagaatctcgatctcctgaaccactaccgcaagctcggggccattcgaaacgccaatcctgtgcttcagacgggggatttcacgccgttgtacgcacagggcatggtgtacgcatttgcaaggaccattcggaatgggcgagatgtcttcggtgtgccagcggaggatgccacggccattgtggcgatcaacaatcagaaccaagctatcaccgtgaccattccgacggatgggacggttgcggacgggtccacgatgctcgatgaactgaacaaccagtggtacaaggtgcagaatggtggcattacactcacgctgcaatcgtatcaaggtgccattttggtgacgccgagcgacgcgccgatggcttatctgcaagaggaggattctcagaacgagattgcgtggacgcctgtgcaaggtgccatcggttatcgcgtctggagacagaatccgaatggacaatgggtgccctttggacctgtgcttcctgccacggacttgagtgtcacggtggaacgcgatgcatatgcgcaaacgtttgctgtacaagcgctgttttcggcgtctgatcacgcccagtctccggtgtcggcacctaagacggtatcgcttgccgtcgatgtgcccgcggtacgcctgagtcagccgatcgttagtggtcgtgtggttggagatcgtgcgatggtctcgatcacgccggtttcaggcgcgacgcagtatgtgatctaccagagacagggcgacggatcgtatgctccggtcgcgacggtctccacaagtggcgattccgcagctataggggaagttcctgcgcaaggtccggccaactcgcctcacgcgacgattcgcgtgacagtgcccgtacctgcaggtttctcgtcggtgacctaccgcgtggctgcgcaaaacgaagatgggcaagctgtgaccaatccattgaccctatcgctctcgaaaaagtga

SEQ ID NO: 13867 - protein, 1301 aa, Alicyclobacillus acidocaldarius
MHVKWTGAASLATTIVMSAALPFAAFENTRSVGTERVLAATAADSTNASPPTGASAGGGTAGETYSNAVQIVSGNGFRAGNGATVVLAVNGLNLNPSSFKVVVSNSLNGVIDVTSDSVLTGPNSIALHLPAGDDGLGAGTYTVTVESGGDSVSTPSGQGLQVMPYTTADTIQWDGIYTSDGAMYVSDPNPSPGQEVTISLRAYSGNLTKVILNCWDTAQNKGFQVEMSPGRTFGPYQLWSATIPASNGGTIYYRFDIYDGTSFACLSGDGLHTSDDINNNFPLPVGTVTLSTLQANPGDTVTVSDPVGDFAGSQDQPNHTVIRFVNSSGETAATVNGTNASWNSVQFTVPQSLPNGLYRVEIDTVAKDADGVVNVELDRSAELIVGPLPAWMQAYAHDSFQAFYRSPFGAVSTGTPITLRLRAPLSVKSATLRLWGAADQSGEIDLPMQKLQMSGDELAQQTGVQDINDYTWWTVTIPAADVTTPGTMWYQFVTETDTGQVVYYDDNGAQLEGPGQVGLSSDGPSYQISVYERGFQTPDWLKHAVIYEIMPDRFYNGNIATEENPNTQKGIYVGADGTESLGPIQFHENWDSPPYDPNIPPLSDPKIASLRGNGQWNIDFFGGDLQGIEDKLDYLKSLGVNTLYLMPVFEAESNHKYDTADYFKIDPGFGTQQDWLNLVQAAHAKGFHIILDGVFEDTGSDSVYFNKFGNFHSNGAWQAYLKNQPSLSPYYSWYVWTGNTSNPYDSWFQIDTLPLTDTSNPAYQRFVYGSDNSVARVWIREGADGWRLDSADNGNFNTAWWGGFRQAVKSIDPNAAIIGEIWDNATNDNGTDWLTGSTFDSVMNYQFRNAVIDFFRGTYNDGNVQHHAVDAAGFNQELMRLYSEYPLQSFYSMMNLVDSQDTMRILTILENAPQPGDLSALQQDEYRPSPAAEQLGIERLKLVSDFQFSFPGDPTIFYGDEAGLTGYSDPLNRRTYPWDNQNLDLLNHYRKLGAIRNANPVLQTGDFTPLYAQGMVYAFARTIRNGRDVFGVPAEDATAIVAINNQNQAITVTIPTDGTVADGSTMLDELNNQWYKVQNGGITLTLQSYQGAILVTPSDAPMAYLQEEDSQNEIAWTPVQGAIGYRVWRQNPNGQWVPFGPVLPATDLSVTVERDAYAQTFAVQALFSASDHAQSPVSAPKTVSLAVDVPAVRLSQPIVSGRVVGDRAMVSITPVSGATQYVIYQRQGDGSYAPVATVSTSGDSAAIGEVPAQGPANSPHATIRVTVPVPAGFSSVTYRVAAQNEDGQAVTNPLTLSLSKK

SEQ ID NO: 13868 - DNA, 1797 bp, Klebsiella oxytoca
  CDS (1)..(1797): transl_table=11
atgattacaattagttcattaagccactccgcaaagagtgccgatagctacgcttataataaagaaaccctacatattagatttcgcacagtcaaaggcgaggtcgcgaaagtctctctgtggatcggcgatccctatcaatgggaggaaggtggcctagatggtggaaaccttggcggcagcgacgcgcatggatggagcggcggcaacgaagttcacatggaaaaagagggacaaagcgagagctatgaccactggtttgccgcatttactccgtgcaaacgacgtagccgctatggttttatattatacggaaataacggggaaaaattattatttggtgaacgacgctgtgttgatataagtaaaccacctgtagcagagacagaactgagtaacttgtccaactttttttgcttcccttatatcaatccaggtgatgtactttctacgccagaatgggttaaaaaaacaatatggtatcagatctttcctgaacgattttgcaatggcgatccatcgatatcgccagaaaacgtacaaccgtggggaacgcctccagattcaaaaaactttatgggcggtgatttgcagggcattattaacaaacttgattatttgcaagatcttggcgttaacggtttatacctttgtcccatatttacggctaacgctagccataaatatgataccgtagattattttaacgttgatccccatttcggtggcaacgatcggtttaaagaattggtgcaaaaagctcaccaacgaggaatgaaggtcatgctggatgcagtgtttaatcatattggtaatcaatcaccattatggttagatgttgtaaaaaatggtgataaatcaccttacgcagactggttctggattaaaaaattcccggtatacccatctggtgataaaaatgagtgggatttccgtaatttcaattacgaaacctttggtaatgttattgaaatgcctaaacttaatactgaaaaccccgcttgtcgtgattatctgctgcaggtggcgagatattggattgaagaatttgatattgatggctggcgccttgatgttgccaatgaagtcgaccacgaattttggcgagctttccgtagaacggtaaaaagcataaaacctgattgttatattctcggtgaaatttggcatgaaggcatgccatggctgcgcggagaccagtttgactccttgatgaactatcctctaatgcaagcaactactgactatttcgctttacaagcatatgacaaaaaaacatttatagatattgttacccatgcctatctttgctatccacgtaacgttaatgaagttatgtttaatcttcttgaaagccatgatacttcacgtttattaagtctgtgtggtaatgataaacgtaaagcccggttagcctatctctttatgtttagtcaggtgggttctccttgtatttattacggtagcgaagttggtatgaatggcagcagagcaatgggatcggaagataatcgtaaatgtatgatatgggatgaacaaaagcaggatttagagtttaagtcatttattaaagatcttattctatggaggaaaaaacattccgaatggaatgatcctaaaatacactggaataatgtcgaccatccggcagttgtcgcttttagcagaggagaagtacatttcctccttaataatagtgatgaatctttagctattaattatcagggcagaacactatctctgacaccttttgggttttatattatcggtctggaccataaggacatcatatcatga

SEQ ID NO: 13869 - protein, 598 aa, Klebsiella oxytoca
MITISSLSHSAKSADSYAYNKETLHIRFRTVKGEVAKVSLWIGDPYQWEEGGLDGGNLGGSDAHGWSGGNEVHMEKEGQSESYDHWFAAFTPCKRRSRYGFILYGNNGEKLLFGERRCVDISKPPVAETELSNLSNFFCFPYINPGDVLSTPEWVKKTIWYQIFPERFCNGDPSISPENVQPWGTPPDSKNFMGGDLQGIINKLDYLQDLGVNGLYLCPIFTANASHKYDTVDYFNVDPHFGGNDRFKELVQKAHQRGMKVMLDAVFNHIGNQSPLWLDVVKNGDKSPYADWFWIKKFPVYPSGDKNEWDFRNFNYETFGNVIEMPKLNTENPACRDYLLQVARYWIEEFDIDGWRLDVANEVDHEFWRAFRRTVKSIKPDCYILGEIWHEGMPWLRGDQFDSLMNYPLMQATTDYFALQAYDKKTFIDIVTHAYLCYPRNVNEVMFNLLESHDTSRLLSLCGNDKRKARLAYLFMFSQVGSPCIYYGSEVGMNGSRAMGSEDNRKCMIWDEQKQDLEFKSFIKDLILWRKKHSEWNDPKIHWNNVDHPAVVAFSRGEVHFLLNNSDESLAINYQGRTLSLTPFGFYIIGLDHKDIIS

SEQ ID NO: 13870 - DNA, 1581 bp, Bacillus sp
  CDS (1)..(1581): transl_table=11
atgaaacagctatgtaaaaaagggttggcttttattttggtgctcatttttgttaacgctctcattttgaatccacttaatggagcggctgcggaaaccgtacataaaggtaaatctccagctgcagataaaaacggtgtattttatgaggtgtatgtaaactctttttacgatgcaaataaagatggacatggtgatttaaaaggtcttacacaaaagctggactatttaaatgatggcaattctcatacaaagaatgatcttcaagtaaacgggatttggatgatgccggtcaacccttctcctagctatcataaatatgatgtaacggactattataacattgatcctcagtatggaaatctgcaagattttcgcaaactaatgaaagaagcagataaacgagatgtaaaagttattatggacctcgttgtgaatcatacgagcagtgaacacccttggtttcaagctgcgttaaaagataaaaacagcaagtacagagattactatatttgggctgataaagataccgacttgaatgaaaaaggatcttgggggcagcaagtatcgcataaagctccaaacggagagtatttttatggaacgttctgggaaggaatgcctgacttaaattacgataaccctgaagtaagaaaagaaatgattaacgtcggaaagttttggctaaagcaaggcgttgacggcttccgcttagatgctgccctccatatctttaaaggtcaaacacctgaaggcgctaagaaaaatctcctgtggtggaatgagtttagagatgcaatgaaaaaagaaaaccctaacgtatatctaacgggtgaagtatgggatcagccggaagtagtagctccttattatcagtcgcttgattccctatttaactttgatttagcaggaaaaattgtcagctctgtaaaagcaggaaatgatcaaggaatcgctactgcagctgcggcaacagatgaactgttcaaatcatacaatccaaataaaattgacggcattttcttaaccaatcatgaccaaaatcgcgtcatgagtgagttaagcggagatgtcaataaagcaaagtcagctgcctctatcttacttacgcttcctggaaatccgtatatttattacggtgaagaaatcggcatgaccggtgaaaagcctgatgaattaatccgtgaaccgttccgctggtacgaaggaaacggacttggacaaactagttgggaaacacctgtatacaataaaggcggcaacggcgtgtctgtagaagcacaaaccaaacaaaaggactctttgttaaatcattatcgtgaaatgattcgcgtgcgtcagcagcacgaagagttagtaaaaggaacgcttcaatctatttcagtagacagtaaagaagttgttgcttatagccgtacgtataaaggcaactccattagtgtgtatcataatatttcaaatcaacctgtaaaagtatctgtagcagcgaaaggtaaattgatttttgctagtgaaaaaggtgctaagaaagtcaagaatcagcttgtaattccggcgaatacatcggttttgataaaataa

SEQ ID NO: 13871 - protein, 526 aa, Bacillus sp
MKQLCKKGLAFILVLIFVNALILNPLNGAAAETVHKGKSPAADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKDTDLNEKGSWGQQVSHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKVKNQLVIPANTSVLIK

SEQ ID NO: 13872 - DNA, 1761 bp, Anoxybacillus flavithermus
  CDS (1)..(1761): transl_table=11
atgttaaaggaagctgtataccaccgtccaaccgatcagtttgcctatgcttatgacgacaaaacattgcacattcggttgcgaacgaagaaaagcgatgttcatgctgtgtcccttttgcatggtgatccgtattgttgggaagataggcaatggcagtttacaaaaacagagatgacaaaaagcggatcagatgccttgtttgactattggtgggtcgccatatcaccgccatatcgccgtctccgctacgggtttgagcttgtgtcaggaaacgagagatgcgtttatacggaaaaagggttttttcatgaagcacctattgatgatatcgcttattatttctgcttcccatttttaaatcgaatcgacgtatttcacgcgccaacatgggtgaaagataccgtttggtatcaaattttccctgagcggttcgcaaatggggatccgtccttgaacccgaaaggaacgatcccgtggggaagtgccgatccgactccgacgagcttttttggtggtgattttgctggcattatggagcggcttgattatttagtcgagctaggaattaacgggatttatttcactccgatttttaaagcatcgtccaatcataaatacgatacaattgattatttcgagattgatccacaatttggtgacaaaccaacatttaagcgacttgtcgagcgttgccaccaaaaaggcattcgcgttatgcttgatgcggtatttaatcatagtgggcattttttcgctccatttcaagatgtgctgaaacatggagaaaaatcaaaatataaagattggttccatattcacgagtttccattacaaaccgaaccgttaccgaactacgatacatttgccttcgtgccaactatgccaaaattaaatacggaaaatcaagaagtgaaacaatatctattagatgtagcaacatattggattcgcgaatttgatattgacggttggcgtttagatgtcgcaaatgaagtcgatcatcaattttggcgcgagtttcgtcaagcagtgaaagcggtgaaacaagacgtatatattcttggggaaatttggcacgatgcaatgccttggttacgcggcgatcagtttgatgcggtgatgaattatccatttacaaatggggtattgcgttattttgctaaaagcgaaatgaaagcaagcgaatttgctcattcgattacaaacgtgctccattcgtatccaaacaacgtaaatgaagtagcattccatttacttggcagccacgacactccgcgcattttaacggaatgtggggaaaataaggaaaaagtaaaactgatgtttactttccaattttcgttcacagggactccgtgcatttattacggcgatgaaattgggctaactggcggacaagacccgctttgccgcaaatgcatggtctgggaggaagaaaaacaagacctcgagttattcgcacacgtgcaaaaattaatttcattgcgccgcaagtaccgctctttgtctcgtggcgaactacactttctagaaacgaatgacgaaacaaaccatcttgtctatactaaaacatatgaacaagaaacggtaatattccttcttaacaatagcaaccgaaagcttgacatcacattgccgctttcggtaaaaagaaaaaagcttactgatttatggacaaataagcaatttgtgtcagaagaaaacgaatggaccgtaacgcttgcgccatacggatttcttatgttcttagttgaataa

SEQ ID NO: 13873 - protein, 586 aa, Anoxybacillus flavithermus
MLKEAVYHRPTDQFAYAYDDKTLHIRLRTKKSDVHAVSLLHGDPYCWEDRQWQFTKTEMTKSGSDALFDYWWVAISPPYRRLRYGFELVSGNERCVYTEKGFFHEAPIDDIAYYFCFPFLNRIDVFHAPTWVKDTVWYQIFPERFANGDPSLNPKGTIPWGSADPTPTSFFGGDFAGIMERLDYLVELGINGIYFTPIFKASSNHKYDTIDYFEIDPQFGDKPTFKRLVERCHQKGIRVMLDAVFNHSGHFFAPFQDVLKHGEKSKYKDWFHIHEFPLQTEPLPNYDTFAFVPTMPKLNTENQEVKQYLLDVATYWIREFDIDGWRLDVANEVDHQFWREFRQAVKAVKQDVYILGEIWHDAMPWLRGDQFDAVMNYPFTNGVLRYFAKSEMKASEFAHSITNVLHSYPNNVNEVAFHLLGSHDTPRILTECGENKEKVKLMFTFQFSFTGTPCIYYGDEIGLTGGQDPLCRKCMVWEEEKQDLELFAHVQKLISLRRKYRSLSRGELHFLETNDETNHLVYTKTYEQETVIFLLNNSNRKLDITLPLSVKRKKLTDLWTNKQFVSEENEWTVTLAPYGFLMFLVE

SEQ ID NO: 13874 - DNA, 1749 bp, Thermoactinomyces thalpophilus
  CDS (1)..(1749): transl_table=11
atgcttattgaagcactttttcacgaaacgagggttccctatgcctgtccggaaaatttgcattccctcagggtgcgactgcgtgccgggaaaggagaaatcgcccgctgtctcgtgctccacgcggatcgctatgaattactggattcctgttttcagcagacggaagcggaatggatggcctcggaccagcggtttgattattttgaagctttgctggagtgcactgcaaaacgcctgcaatatgtatttctcctggaaggaaaaaaaggagagcgggtttatttcggagaatcgggagtgtcaaaggaacggaaccgggcaggagttttccagtatgcctatatccatgaatcagccttgtttgtgaccccggagtgggccagggatgcggtggtttatcagatttttccggacaggtttgccaatggtgacaaggagaacgacccgccccggacggaagattggagcaaggatgcacggcccggaagggacagtttttacggcggtgacttggagggggtgatccattccctcccctatttgcgcaaactgggggttaatgcgctctatttcactcccatttttgcctccccatccaatcacaagtacgatacagcggattatctgagaattgatccccagtttggcaatctggacacgtttaagcgcctgatcagggaggctcaccggcacgggatgcgaatcattcttgatgcggtgttcaaccattcgggtgaccggttttttgcttttcgcgatgtactggaaaagggagcggactcgcaatacagagactggtttttcatcgagcagtttccggttgtgcaaacgccacagcccaactatgagacgtttgctgtcaatgttcctgtcatgccgaagctgcgcacggaaaacagggaggtaaaagaatatttgttccaggtcgtccgctactggacagaaatggggatcgacgggtggcggctggatgtggccaatgaggtggatcatgccttttggcgtgatttccgatcttttgtgaagatgctgaatccggaagccctcatcatcggcgaagtatggcataatgcggtaaaatggctggaaggggatcagtttgattcggtcatgaattatttgtttcgcgactgcgtttatcgtttttttgcagagcaaacatcagatgccagcgagtttgatgccgaattgaccacagcacgcatctcttatccggatcaggcgctgcaagtggcatggaatctgcttgattcccatgataccgagcgctttttgacctcttgcggtgaaaaggaagaacggttccgcctggccgtcttgtttcagatgacctatgtggggacgccgttgatttattacggggatgaaataggcatgaccggagagacagatcctgattgccgccggccgatgttgtgggataaagaggagcaaaatcaggcgcttttctcctattatcaacggctcatccggattcgccggagttgtgctccgttgcggagggggagtttccggacatggttggctgatccaggttcccctgtctatgcctttgtgcgctcatggcaaggggaaaatgcaggaattgtcctgaataacagcgacagctggcaaaatgtttccttgccgctggatacatgggcaaaaaggaattggaccgatttgttgacgggggaaaaaggccaggcatcaggaaaccggatggagttgattctttccccttatcagggaatagtgctggtttga

SEQ ID NO: 13875 - protein, 582 aa, Thermoactinomyces thalpophilus
MLIEALFHETRVPYACPENLHSLRVRLRAGKGEIARCLVLHADRYELLDSCFQQTEAEWMASDQRFDYFEALLECTAKRLQYVFLLEGKKGERVYFGESGVSKERNRAGVFQYAYIHESALFVTPEWARDAVVYQIFPDRFANGDKENDPPRTEDWSKDARPGRDSFYGGDLEGVIHSLPYLRKLGVNALYFTPIFASPSNHKYDTADYLRIDPQFGNLDTFKRLIREAHRHGMRIILDAVFNHSGDRFFAFRDVLEKGADSQYRDWFFIEQFPVVQTPQPNYETFAVNVPVMPKLRTENREVKEYLFQVVRYWTEMGIDGWRLDVANEVDHAFWRDFRSFVKMLNPEALIIGEVWHNAVKWLEGDQFDSVMNYLFRDCVYRFFAEQTSDASEFDAELTTARISYPDQALQVAWNLLDSHDTERFLTSCGEKEERFRLAVLFQMTYVGTPLIYYGDEIGMTGETDPDCRRPMLWDKEEQNQALFSYYQRLIRIRRSCAPLRRGSFRTWLADPGSPVYAFVRSWQGENAGIVLNNSDSWQNVSLPLDTWAKRNWTDLLTGEKGQASGNRMELILSPYQGIVLV

SEQ ID NO: 13876 - DNA, 1332 bp, Anaerobranca gottschalkii
  CDS (1)..(1332): transl_table=11
atgcaacaagagattttatattttattatggtagatcgttttttccaagggataaaagataaggagtttgatgatatagataaaagtcatcccagaaaattccatggaggagatatcaaagggataatagaaaaattagactatatacaagagttaggagcaacagccctctggattactccgatttttaagaatgatcccgatggttatcatgggtattgggcacaagacttttttagtgtagatccccattttggaattctagaggattttaaagagttggtacaaaaagcccatagaaaagggttaaaggtgattttagatatagtagtaaatcatacaggaaaaacccatcctcttttaaaggaaaagccccattggtttcatcctttagtacctattaaagattgggataaccaaaaggaagtagaggaaaagtgtttagggatgttaccagatttgaaccaggatttaccggaagtcagtagttatctaattaatatgtgtaaatggtggattgttcaaacaggtttagatggctttagaatagatacagtaaaacatgttcctagggaattttggagaaagttttgccaggaaatgaaaggggtaaaggaagatatcattcttttaggagaagtatggcatccagatccctgttacttagctccttatcaaaaggatggaattaactctttagtggattttcctctatattatgctattactaaagtatttgctaaagatgaacctatggataaaatttcatcaatattattgcaagatcacctttatcaaaacccttatcttctaggtacatttattgacaatcacgatgtaccaaggtttttaagtgtcgtaaaggatcggggaaaagaacgtttaaaattagcccttgattttctattctcagtaaggggagtaccgataatatattatgggacagaaactggtatggatggaggggatgatccccataatcgaaaggatatggattttgaaggggatcttgaattaagaaaatatgttaaagacctaattaccctaagaaaaaaatatttatctttatctttaggttctctgaaagttttaaaggtaaccgatgatggtatggtctttattcgggaatgtggagaagagcaagttgttatctttattaataacagttttgatagtcaaacttttgtagtaagacttcccgatgaattacaaaggaaaagctggaagttagtatggggtaaagggacctaccaatattcctatgaaatagcatcttgtataataccacctaaatcttctgcctattttcaattatttgcccctgaaaaataa

SEQ ID NO: 13877 - protein, 443 aa, Anaerobranca gottschalkii
MQQEILYFIMVDRFFQGIKDKEFDDIDKSHPRKFHGGDIKGIIEKLDYIQELGATALWITPIFKNDPDGYHGYWAQDFFSVDPHFGILEDFKELVQKAHRKGLKVILDIVVNHTGKTHPLLKEKPHWFHPLVPIKDWDNQKEVEEKCLGMLPDLNQDLPEVSSYLINMCKWWIVQTGLDGFRIDTVKHVPREFWRKFCQEMKGVKEDIILLGEVWHPDPCYLAPYQKDGINSLVDFPLYYAITKVFAKDEPMDKISSILLQDHLYQNPYLLGTFIDNHDVPRFLSVVKDRGKERLKLALDFLFSVRGVPIIYYGTETGMDGGDDPHNRKDMDFEGDLELRKYVKDLITLRKKYLSLSLGSLKVLKVTDDGMVFIRECGEEQVVIFINNSFDSQTFVVRLPDELQRKSWKLVWGKGTYQYSYEIASCIIPPKSSAYFQLFAPEK

SEQ ID NO: 13878 - DNA, 1740 bp, Aedes albopictus
  CDS (1)..(1740)
atgaagatcttcatacctctattaaccaccctcctagtagggctgaccactgctctagactggtgggagcacggaaacttctaccaggtctacccacgatccttcaaggattccgatggtgacggaattggtgatctggatggaatcaccgaaaagctgcaatatctaaaggacatcggcatggacggagtttggttgtcaccgatcttctcttcaccgatggctgattttggctacgacatttcaaacttccgtcagattcagaccgaatacggagatctggatgctttccagcgcttgtccgacaagtgtaaggaactgggcttgcatctgatcttggatttcgtcccgaaccatactagcgatcagcacgaatacttcattaagtctgtggaaaaagacgagacctacaaggatttctacgtctggcacccaggtgtagatggaccaaacaacaccaaggttccgccatcgaactggatcagcgtgttccgtggatcttcctgggaatggaatgagcagcgcggggagttttacctgcatcaatttttgaaggagcaaccggatcttaactatcgcaatcctgccgtagttgaagagatgaagaacgtgctgcggtattggttggatcgtggagtttctgggttcagaattgatgccgtgccgtatctgtttgaaagtggcgagtccgacggacgttatcgcaatgaaccagagagtcgagccaccgacgatcccgagaatccagcttacctgacccatacgcaaaccatggatcagccggaaacctacgacatgatctatcaatggcgcgcagttttggacgaatattcccagaaagacaacagaactcgtatcatgatgaccgagggctacacgagccttccgaagatcatcgagttcttcggtaacgctaccgcaaacggggcacagattccgttcaacttcgaagtgatcagtaacatcaagaagaccagcactggcgctgactttgccaaatacgtcaaaaactggctggatgccaaaccagcgaacagacgttccaactgggtgcttggaaatcacgacaaccctcgtattggatctcgtcttggtgagaacaagatcgacttgtacaacattgctctgcaaacgttgccggatattgccgtcacgtactacggcgaggaaatcggaatgctcgatcagtggattccttggaatgagaccgttgatccggctgcctgtagatcggacgaagccacctataccgcttactctcgagatccagttcgtaccccaatgcagtgggacaatgaaaagaacgccggtttctctacagcagctaaaacatggcttcaggttgcggataactataagaccctcaacgtcaaggttcaggaccgcgcccgcaagagtcatctgaagatattcaagaagctgaccaaataccgaaagcgccaaattctgaccgaaggagacctggacatccaggtgtccggggagaatctactcgtgtacaaacggaaggtcgacaaggtgggctacgtggttgtggcgctaaactttggcacggaaccggttgcgctgggtctgaccagtttgtacgatggagttgataaacgaatgcaagtggtggtatcttctaacagagtgaccactgctgataacgcctgggtggatgcggacaaataccgattgattggagagagcggtatcgttcttcaatacctttggggtaagaatccaattgtttcctaa

SEQ ID NO: 13879 - protein, 579 aa, Aedes albopictus
MKIFIPLLTTLLVGLTTALDWWEHGNFYQVYPRSFKDSDGDGIGDLDGITEKLQYLKDIGMDGVWLSPIFSSPMADFGYDISNFRQIQTEYGDLDAFQRLSDKCKELGLHLILDFVPNHTSDQHEYFIKSVEKDETYKDFYVWHPGVDGPNNTKVPPSNWISVFRGSSWEWNEQRGEFYLHQFLKEQPDLNYRNPAVVEEMKNVLRYWLDRGVSGFRIDAVPYLFESGESDGRYRNEPESRATDDPENPAYLTHTQTMDQPETYDMIYQWRAVLDEYSQKDNRTRIMMTEGYTSLPKIIEFFGNATANGAQIPFNFEVISNIKKTSTGADFAKYVKNWLDAKPANRRSNWVLGNHDNPRIGSRLGENKIDLYNIALQTLPDIAVTYYGEEIGMLDQWIPWNETVDPAACRSDEATYTAYSRDPVRTPMQWDNEKNAGFSTAAKTWLQVADNYKTLNVKVQDRARKSHLKIFKKLTKYRKRQILTEGDLDIQVSGENLLVYKRKVDKVGYVVVALNFGTEPVALGLTSLYDGVDKRMQVVVSSNRVTTADNAWVDADKYRLIGESGIVLQYLWGKNPIVS

SEQ ID NO: 13880 - DNA, 1170 bp, Aeromonas hydrophila
  CDS (1)..(1170): n means a or g or c or t/u, s means g or c
atgcgcatctgggcaccaacgcccaattcggccgagctgacgcgcaacctgcaccagcgcggcatgaagatcatcctggatgcggtggtcaaccacacctccaccgaacacccctggttctgcccgccgctgggggcccagcgcaacccggactcgccgtggcgcagcttctacacctttgacaacgaaggggattacgtcagctggaagggcatccgcagcctgcccaagctcgacttctccagcgaacaggtgcaggacgccgtctatcgcgccgatgacgccatcctgcgctactggatgcgcgccccctaccagatcgacggctggcgcttcgacgtcatccacatgctgggggagcgcggcaccgccgagggcaaccgcggccacgtgcgcgccattcgcggcgcggtgaagcaggagaacccggacgcctatgtactgggcgagcacttcttcgaggcgagccagtggttgcagggggatcaggaggatggcgccatgaactactacggcttcgcccacccgatccgcgccttcctggcgggccaggacatcgcctaccaccccatcaagatcagcgccgaggagctggatcgctggctcaagctggcgcgggcccacatcccgttcaagaatcagctggcacagttcaacctgctggacagccacgacaccgcccgcttcctccatctgctgggggaggacaagcagcggatgcggctcgccgccaccctgctgctcacctacatcggcgtaccctccatctactacggcgatgaagtggggctctctggcggcaacgatccggactgccgccgctgcttcccgtgggagaccaccgcctgggatcacgttctgcacgnccactaccgccggttgatccagatccgccggcaacgtccggctctgcgccgcggcgacatccagaccctctatgccggcccgcacagctatgtgttcgcccgcaccctgcaaagcgatcaggtggtggtagcctgcaaccgtcaccccagcgagccgcgcaccatcagtctgcccctgtggcagaccgccagtcccgccagccgcttcacagacgccttgaacggcgacaagttcgaagtagtgcagggcgagatacagctcaccatccccgccaactcggccagagtgctgctctccagctag

SEQ ID NO: 13881 - protein, 389 aa, Aeromonas hydrophila
  Xaa in position 289 is unknown
MRIWAPTPNSAELTRNLHQRGMKIILDAVVNHTSTEHPWFCPPLGAQRNPDSPWRSFYTFDNEGDYVSWKGIRSLPKLDFSSEQVQDAVYRADDAILRYWMRAPYQIDGWRFDVIHMLGERGTAEGNRGHVRAIRGAVKQENPDAYVLGEHFFEASQWLQGDQEDGAMNYYGFAHPIRAFLAGQDIAYHPIKISAEELDRWLKLARAHIPFKNQLAQFNLLDSHDTARFLHLLGEDKQRMRLAATLLLTYIGVPSIYYGDEVGLSGGNDPDCRRCFPWETTAWDHVLHXHYRRLIQIRRQRPALRRGDIQTLYAGPHSYVFARTLQSDQVVVACNRHPSEPRTISLPLWQTASPASRFTDALNGDKFEVVQGEIQLTIPANSARVLLSS

SEQ ID NO: 13882 - DNA, 1449 bp, Thermoactinomyces vulgaris
  CDS (1)..(1449): transl_table=11
atgaaaaagggagctttgctcagtgggttggtgtgtttattgtcggctgtgctgatgtttgcttctaccgcacccacagccgtggcgctttctcctgcggattggcaagagaaaagcatctattttattatgaccgaccggtttgacaatggtgaccccagcaatgacaattatggcggttttaacgctgacaaaagcgatccgcgcaagtatcatggtggggattttcaagggattatcaatcgcttggactacatcaagaatatggggttcacggccatttggattactcccgtcacgatgcaaaagagcgctaatgcatatcatggttattggacctatgatttttacagcgtagacggtcatctgggctccatggctaagctgcaagaattggtgcgggcggcgcatgcgaaagggatatcggtgatgctggatgtagtcgccaatcatacaggggatttccaaccttcgagcttcgccaaagctccgtttgacaaggcagattggtaccatcattatggcgacactcaagactggaacgatcaatggtgggtggagaatggagatattgccggcttggatgatttaaaccaagataatccggcagtggcaacggaattgaagaattggatcgcatggcttgtgcaaacgaccggagtggatgggttgcgcgttgatacggtgaaacacgttccaaagtggttctggcgcgaatttgacggggcagccaatacctttacccttggcgaagtgtttcatggggaccccgcatatgtaggcgattacaccaattatttggatgcggtgctcgatttcccgatgtactacaccatcaaaaatgtgtttggccaagaccagtcgatgagaacgattgcggatcgttacgcgcaagactatcgatataaaaatccgatgactaacggcttgtttatagacaaccatgacgtgccgcgctttttgaatgaagcttcaggcaagcctggcgcttcctgggacaagtggccgcaattaaaagcagcattgggcttcatgtttactacccgtgggatcccgattctgtatcaaggcacagagcagggatttagcgggggcgctgatccttacaaccgggatgatatggtctttaacgacaagcatgagctctacggttatatcgccaagctaaattatattcgtaacactcatgttgctttgcgcaaaggaacacaggctgaaaagtgggtggatgacacattttacgcttttcagcgttcgtataacggcgatgaggtggtggtgatgatcaataattcttggaacagccagacgcgcacagtgcccaacatcgatcgagtcgccaatgggcaaaccctgtacaatcggatggggacggacaaagtaacagtgaacaatggttcgattactgccacactcggccccaaagaagtaaagatatttaccaaatga

SEQ ID NO: 13883 - protein, 482 aa, Thermoactinomyces vulgaris
MKKGALLSGLVCLLSAVLMFASTAPTAVALSPADWQEKSIYFIMTDRFDNGDPSNDNYGGFNADKSDPRKYHGGDFQGIINRLDYIKNMGFTAIWITPVTMQKSANAYHGYWTYDFYSVDGHLGSMAKLQELVRAAHAKGISVMLDVVANHTGDFQPSSFAKAPFDKADWYHHYGDTQDWNDQWWVENGDIAGLDDLNQDNPAVATELKNWIAWLVQTTGVDGLRVDTVKHVPKWFWREFDGAANTFTLGEVFHGDPAYVGDYTNYLDAVLDFPMYYTIKNVFGQDQSMRTIADRYAQDYRYKNPMTNGLFIDNHDVPRFLNEASGKPGASWDKWPQLKAALGFMFTTRGIPILYQGTEQGFSGGADPYNRDDMVFNDKHELYGYIAKLNYIRNTHVALRKGTQAEKWVDDTFYAFQRSYNGDEVVVMINNSWNSQTRTVPNIDRVANGQTLYNRMGTDKVTVNNGSITATLGPKEVKIFTK

SEQ ID NO: 13884 - DNA, 1581 bp, Xanthomonas campestris
  CDS (1)..(1581): transl_table=11
atgtcttcgtcctgccgtttccgcccgttgtcgttcctgctcgccgccgcgctcggcgcatccgcggcgttcgcgccgtccgtgcatgccgccgatgccgcgcctgccactccgcggtccgaaggctccggcgtgtggtacgagatcttcgtgcgcgcctggtacgacaccgacggtgacggcatcggcgatctcaacggcgtcaccgccaagctcgactacctgcaatcgctcggcgtcagcggcatctggctgatgccgatcaatccgtcgcccagctaccacggctacgacatcaccgactacgaggggatcaacccgcagtacggcacgatggccgacttcgagaagctggtgagcgaagcgcacaagcgcggcatcgaggtgatcctcgacctggtgatcaaccacaccagcgaccagcatccatggttcaaggcggcgctggatccgaaggacgcgcatcgttcctggtacacctgggcaggcccgggtacgaacctgaaggcggtcagcgcggtgggcggcccggcgtggcatgccaacggcaagcagcactacctgggcgatttcaccggcgccatgccggacctcaactacgacgagccagcggtgcgccgcgagatgatcgcggtcggcaagttctggctggacaagggcgccgatggcttccgcctggatgccgcgcgccacatctatgacgatctggaaagcgacaacggccagcccgccgtgatcgccaggaatgcccagtggtggaacgagttccgccagggtttgcggcaggtccgtccggacgtctatctggtcggcgaggtctcggccaagcagccgggcgagctggcgccgtatctgccggcactgggctcggtgttcgactttccgctggccgagcagctgatcgccagcgccgggcaggaaaaggccggcaagctgccggcgctgctcaccgaaacgtacgcggccttccgtgccgccgcgggcgacgactacgccgacgcgccgttcctttccaaccacgatcaggagcgtgtgctcagccagctcggcggcgatctgcgccacatgcgcacggcggcggcgatgctgctgaccttgcccggccggccgtacctctactacggcgaagagatcggcatgctcggccgcaagccggacgagaacctgcgcgaacccatgcgctggcagcgccaggccggcgcgccgggcgacagccgctggaagccgtacagcgtgaagcagggcggcgaagtgtcggtgcaggccgagcaggatcggcccgattcgctcctgagcttctaccggacgctgatccattggcgcgtggaggtgccggcgctgcgcgacggcgcgctgcgcgtggtcgataccggcgccccggcgctggtggcctacgagcgcgtcacggcggacagccgcgcgctggtggtgcacaacctctcgggcaagccggcgagcatgaagctcggcgccgaccgcgccaaggccttcgccgccatccgcctgcacagtgcgcctggcgcgacgctgacggagggccggctcaccgtgccggcgtacgccaccgtggtgttgcagtga

SEQ ID NO: 13885 - protein, 526 aa, Xanthomonas campestris
MSSSCRFRPLSFLLAAALGASAAFAPSVHAADAAPATPRSEGSGVWYEIFVRAWYDTDGDGIGDLNGVTAKLDYLQSLGVSGIWLMPINPSPSYHGYDITDYEGINPQYGTMADFEKLVSEAHKRGIEVILDLVINHTSDQHPWFKAALDPKDAHRSWYTWAGPGTNLKAVSAVGGPAWHANGKQHYLGDFTGAMPDLNYDEPAVRREMIAVGKFWLDKGADGFRLDAARHIYDDLESDNGQPAVIARNAQWWNEFRQGLRQVRPDVYLVGEVSAKQPGELAPYLPALGSVFDFPLAEQLIASAGQEKAGKLPALLTETYAAFRAAAGDDYADAPFLSNHDQERVLSQLGGDLRHMRTAAAMLLTLPGRPYLYYGEEIGMLGRKPDENLREPMRWQRQAGAPGDSRWKPYSVKQGGEVSVQAEQDRPDSLLSFYRTLIHWRVEVPALRDGALRVVDTGAPALVAYERVTADSRALVVHNLSGKPASMKLGADRAKAFAAIRLHSAPGATLTEGRLTVPAYATVVLQ

SEQ ID NO: 13886 - DNA, 3309 bp, Rhodobacter sphaeroides f
  CDS (1)..(3309): transl_table=11
atgaatcagaatgtctctccctccaccgttgccgtccgccgcacggacggcatcgatcgcagccagaccgactggtacaaggatgcgatcatctaccagttgcacatcaaggcgttccaggacgccaatggcgacgggatcggtgacttcgcgggcctgatgcagcggctggattatgtgcaggcgctgggcgtgaccgcgatctggctgctgccgttctacccttcgccgctccgcgacgacggctacgacatctcggattaccgctcgatcaacccgtcctacggcgcgatgcgcgacttcaagctgttcgtgcaggaagcgcacaagcgcgggctgcgcgtcatcaccgagcttgtcatcaaccatacctccgaccagcacccctggttccagcgggcccggcgggcgaagaagggctcggccgcccgcgactggtatgtctggagcgacaccgaccagaaattccccgaaacgcggatcatctttctcgatacggaaaagtcgaactggacctgggatccggtggcgggcgcctattactggcaccgcttctattcgcaccagcccgacctgaacttcgacaatccccgcgtgctcgaggaagtcctcaagatcatgcgcatgtggctcgagatgggcgtcgacgggctcaggctcgacgcgatcccctatctggtcgagcgcgagggcaccaacaacgagaacctccccgagacgcatgacgtgctcaagaagatccgggccaatctcgaccagcatttccccgacaggatgctgcttgccgaggcgaaccaatggccggaggacacgcgcccctatttcggcgagggcgacgaatgccacatgggctttcatttcccgctgatgccgcggatgtacatggcgctcgcgcaggccgaccggcatccgatcaccgacatcatccgccagacgcccgagatcccggaaggctgccaatggggcatcttcctgcggaaccacgacgagctgacgctcgagatggtgacggccgaggagcgcgactacatgtggcgcttctatgccgaggattcgcgggcgcggatcaatctcggcatccggcgcaggctggcgccgctgatgaagaacgaccggcgcaagatcgagcttctgaaccagatgctgatgtcgatgccgggcacgcccatcgtctattacggcgacgagatcggcatgggcgacaattactatctcggcgaccgcgacggggtgcgcacgcccatgcaatggtcggccgaccgcaacggcggcttctcgcgctgcaatccgcagcagctttacctgccgaccatcctcgacccggtctacggccatcaggcgatcaacgtcgaggcgcaggcggcagacccgtcctcgctcctgaactggacgcggcggctgatcgcggtgcgcaagcagcatccggccttcgggcgcggctcgatgagcctgctctatccgcgcaaccgcaaggtgctggcctatgtgcgcagccatgagggcacggacatcctctgcgtggcgaacctctcggacacggcgcaggcggtcgagctcgatctcgcgcggttccgcggcgcggtgccggtcgagctcacgggccggtcggagtttccgccggtgggcgatctgccctacatgctgacgctgccgccctacggcttctactggttcatcctgtccgaccagcaggcgctgccgagctggcaccagccgatgcccgagacgctgccggatttcatcacgctcacgacgcgcgacgggcgggcggaaacggcgctcaccgggcgcgagacgcgccagttcgaggccgatgtgctgccgaactggctgccgctgcaacgctggttcggggccaaggaagagaagatcagcgcggtgaagctggccgttctgggctcgctctccgccgatcatgccctcgtccggctcgatgccgatgtgggcggcgaggcgcagcagtatttcctgcccgcctccgcgctctggggcgaggagcagctccgggccggggcgcccaagctgagcttcaccctggccaaggtccggcgcggcccgcaggtgggcgcgctcatcgacggggcctatgacgagcagatggcgcaggcgatgctcgaggcgctgcgtgagggccgcaggctctctggtgccgggggcgaggtggtgttcgagccgggctcgggactggccgagatcgccgacccgggcgagccgcgctatctcggggccgagcagtcgaacatttccatcgccttcggcgaccgcctgatcctgaagctctaccgacgcctgcgggccggcgagcagccggacgtcgaggtggcgcgcttcctgacggaagtggcgggctacacccatacgccccgctatctcggcgtcgtgagcctgcgcccggcggagggcgaggcgaccgtcctcgccgcggccttcgccttcgtggccaacatgggcgacgcctggcgcggcctcttcgacgcgctggtgcgggatctgggcgagttcggcggctggagcacggccgaggcgccggaagtggagaaggaaggcttctccttcccgctcaccatcccgggccttctcggccagcgcacggccgagctgcatcaggctttcgccaccgagaccgacgaggcggccttccgcatggagccgctgagggccgagcatctgacgggctgggccgagggggcgcggcgcgaggccgagaccatgctgtcggtgctcgaacggcagcggacgcatctgcccgaggaggtgctgcctctggccgaggcgctgctggcgcggcgcgacgacctgctggcgcggctcgaccgcgttaccggcttcgaaccctcgggcgcgctgacccgcattcatggcgactaccatctgggtcaggtgctgcttgcgcaggacgatgtcgccatcatcgactttgagggcgagccgcgccgcacgctcgaggaacggcgcgagaaatcctcgccgctccgcgatgtggcggggatgctgcgctcgttcgactatgccgccgccgcagccctcgcccgtcacgaggaaagcttcggcccggccagcgagcgggcggtggagcgggccgaagcctggcggcagcaggcggtggccgacttcctctctgcctacgagggcgcgtccgccggaaccgcgagcctgccctcggacccggcgctgaaggaggcgctgctcgatctcttcctcgtgcagaaggcggtctacgagacctcctacgaattgggcagccgtcccgcctgggtcggcatcccgctgcgcggccttctggaactgttggacaggacacctgcatga

SEQ ID NO: 13887 - protein, 1102 aa, Rhodobacter sphaeroides f
MNQNVSPSTVAVRRTDGIDRSQTDWYKDAIIYQLHIKAFQDANGDGIGDFAGLMQRLDYVQALGVTAIWLLPFYPSPLRDDGYDISDYRSINPSYGAMRDFKLFVQEAHKRGLRVITELVINHTSDQHPWFQRARRAKKGSAARDWYVWSDTDQKFPETRIIFLDTEKSNWTWDPVAGAYYWHRFYSHQPDLNFDNPRVLEEVLKIMRMWLEMGVDGLRLDAIPYLVEREGTNNENLPETHDVLKKIRANLDQHFPDRMLLAEANQWPEDTRPYFGEGDECHMGFHFPLMPRMYMALAQADRHPITDIIRQTPEIPEGCQWGIFLRNHDELTLEMVTAEERDYMWRFYAEDSRARINLGIRRRLAPLMKNDRRKIELLNQMLMSMPGTPIVYYGDEIGMGDNYYLGDRDGVRTPMQWSADRNGGFSRCNPQQLYLPTILDPVYGHQAINVEAQAADPSSLLNWTRRLIAVRKQHPAFGRGSMSLLYPRNRKVLAYVRSHEGTDILCVANLSDTAQAVELDLARFRGAVPVELTGRSEFPPVGDLPYMLTLPPYGFYWFILSDQQALPSWHQPMPETLPDFITLTTRDGRAETALTGRETRQFEADVLPNWLPLQRWFGAKEEKISAVKLAVLGSLSADHALVRLDADVGGEAQQYFLPASALWGEEQLRAGAPKLSFTLAKVRRGPQVGALIDGAYDEQMAQAMLEALREGRRLSGAGGEVVFEPGSGLAEIADPGEPRYLGAEQSNISIAFGDRLILKLYRRLRAGEQPDVEVARFLTEVAGYTHTPRYLGVVSLRPAEGEATVLAAAFAFVANMGDAWRGLFDALVRDLGEFGGWSTAEAPEVEKEGFSFPLTIPGLLGQRTAELHQAFATETDEAAFRMEPLRAEHLTGWAEGARREAETMLSVLERQRTHLPEEVLPLAEALLARRDDLLARLDRVTGFEPSGALTRIHGDYHLGQVLLAQDDVAIIDFEGEPRRTLEERREKSSPLRDVAGMLRSFDYAAAAALARHEESFGPASERAVERAEAWRQQAVADFLSAYEGASAGTASLPSDPALKEALLDLFLVQKAVYETSYELGSRPAWVGIPLRGLLELLDRTPA

SEQ ID NO: 13888 - DNA, 1548 bp, Ostreococcus tauri
  CDS (1)..(1548)
atggaagctgcgctcgcgtctcgcgaacgcgcgcgcgcgaagatcgtgcggaagaatcaaaacgacgagtcttccatgaaaagggcacagggtgatgcggtctctacgctagcaaagtcgaggctgcccttggatgagaggaacaccgtcgccgccccaaagctgaaaaagattaccgagatggccccgcaaacaccctttgcatcgcctctgagccgcccgctaccgtctacgccgtgcggaaatggtcgtgaattaattcttcaaggatttaattgggagtcgtgccaacacgcagaaaaaatgggcgcgtcttggtacgcgcacctgactgagatgacccctcaaatcgccgaagccggtttcacatccgtgtggttgccgccgccgacgaaatctgtgagtaaacaaggatatctaccgacggatttgtacaatctgaactcattctatgggtctgaagatgagctgaggtcttgtgtcgcgcgcctgcgtgagtacaacatcaccccagtggcggacattgtcatcaatcatagatgcgccgaggcaaaggatgacgccggtcggtggaacaagtacaccgggaagctagattgggatgagcgcgcgatcacgtgtgagaaccccgcctttggcggccgcggggcacataagactggcgaggattatctccccgcgccgaatatcgatcacacgcaagagtttgttcgacgcgatttgacccagtggctcgaatggttgcgtagcgacgtcggtttccgcggttggaggtttgacttcgtcaagggttacagtggcgccttcacgggagagtacgtcgaagctacgcgaccgtttttggcctttggcgagttctgggacgagtgtggatacagggatggagtcttggattataaccaagacgctcaccgccagcgcacgtgcaactgggtcgactccacgaccggtaacaccgccgcgttcgacttcacgacgaagggaattttgcaagaagccgtctcacgcaccgagtactggcgattgatcgacaacaaaggtcgtccaccgggattcttaggcatctggccttctcgcgccgtgaccttcatagaaaatcacgacactgggtctacgctccagcactggcctttcccatgggacaaggtcctgcaaggttactgctacatcttgacgcatcctggaacgcctacggtgttctttgatcactgggtcgatccagttttcaagccatccattgacgcgatgcttgaagttcgtaagcgcaaccgtctctcgtccaaggacgcggcgattcacattgagcgcgccaccgcgggagtctacgccgcacacgtaggccacgcgaaggaggcatacaccgaagggctgtgtaccgatgtcgacgtcacgcagccatcgatttgcatgaagatcgggcatgaagcctggtcgccgaacgcgcaaaaagttggaaacctatcttggcagtgcaccgctagcggcgacggctgggcggtctgggaagataaggcccatctcgtcgatgccgagaagatgaccagatag

SEQ ID NO: 13889 - protein, 515 aa, Ostreococcus tauri
MEAALASRERARAKIVRKNQNDESSMKRAQGDAVSTLAKSRLPLDERNTVAAPKLKKITEMAPQTPFASPLSRPLPSTPCGNGRELILQGFNWESCQHAEKMGASWYAHLTEMTPQIAEAGFTSVWLPPPTKSVSKQGYLPTDLYNLNSFYGSEDELRSCVARLREYNITPVADIVINHRCAEAKDDAGRWNKYTGKLDWDERAITCENPAFGGRGAHKTGEDYLPAPNIDHTQEFVRRDLTQWLEWLRSDVGFRGWRFDFVKGYSGAFTGEYVEATRPFLAFGEFWDECGYRDGVLDYNQDAHRQRTCNWVDSTTGNTAAFDFTTKGILQEAVSRTEYWRLIDNKGRPPGFLGIWPSRAVTFIENHDTGSTLQHWPFPWDKVLQGYCYILTHPGTPTVFFDHWVDPVFKPSIDAMLEVRKRNRLSSKDAAIHIERATAGVYAAHVGHAKEAYTEGLCTDVDVTQPSICMKIGHEAWSPNAQKVGNLSWQCTASGDGWAVWEDKAHLVDAEKMTR

SEQ ID NO: 13890 - DNA, 1554 bp, uncultured bacterium
  CDS (1)..(1554)
atgaaaaaatccatcctaactacctccatttttgcacttgtcgctttttcttcctgcgaaaaaaagcctgctccggaagtcaaaaactattggcctcaagcaggagtgacctatgagatttttgttcaatctttttatgattctaacggagacagtattggggattttaatggggtcactcaaaaactggactatgtgaaggagttgggggccaatgccatttggtttatgccgattatgccttcgccaacttaccataagtacgatgtgacggactacaaggcggttcatccagattacggtacgctggatgatttcaaaaagcttttggacgaagctcacaagcgggacatcaagattgtgatcgatttgatcatcaatcacaccagcaacgaacatccgtggtttttggaagcaaaatccggtagggataatccctatcgcgattactacgtgtgggcgcaaaaggacaccattgctgattttttgaacaaaaagaccatcacgtttgatttggataatatccgtcaatggcatgacccgggacagggagaagatttttactacgggtttttctggggtggaatgcctgatctgaactttgacaatcctaaggtaagagaggaaatctatgaaatcggacgattctggttggaagaagtgggtgtggacggatttcggttggacgctgccaagcatatttttcccgatgaccgacctttggataatcatgccttttggaaagaattccgggcaaaaatggaagtcataaagccggatgtttacttggtaggagaggtgtatgacaaaaaagaagtcgtggctccttatcttcctgggttgccagccttgttcaactttgattttcattacactctgcttgagaccatgaataccggggacgggatgcttttggccaagaagcagaaggagattttggacttttatcagggaatcacatcaagctttatcgatgcgaccatttcttctaaccatgatcagccccgtctgctgaatgaattgggatctgatccggccaaatacaagcaggccatcgcagtgatgctcagcatgccgggagcgccatatttgtattatggggaagagatcgggatgctgggtctcaagccggacgagcatatccgggagcctttcctttgggatgaaaaaagcaaggatacaggtcgcaccaagtggatcaaacccaaatacagcaaagactcaacagtaacctcattggaggtccaaaagaaagattccaacagctatttcaatcattacaaaaacttaattgctcttcgtaattcttatcctgctttggctattggttctttggaacttccagctgaggaattacctaaaagtgtaatggcatatttcagaaagtctggagatcaggaaatctttgtggttcacaatgtggacaaggaggaagttgacattcagcttccagagggatttgaagaagttattttctatttgggtgaggggaaaaacagttcaggaaaacttcagctaaaaggcaactcgagtatggtttttttgaaggattag

SEQ ID NO: 13891 - protein, 517 aa, uncultured bacterium
MKKSILTTSIFALVAFSSCEKKPAPEVKNYWPQAGVTYEIFVQSFYDSNGDSIGDFNGVTQKLDYVKELGANAIWFMPIMPSPTYHKYDVTDYKAVHPDYGTLDDFKKLLDEAHKRDIKIVIDLIINHTSNEHPWFLEAKSGRDNPYRDYYVWAQKDTIADFLNKKTITFDLDNIRQWHDPGQGEDFYYGFFWGGMPDLNFDNPKVREEIYEIGRFWLEEVGVDGFRLDAAKHIFPDDRPLDNHAFWKEFRAKMEVIKPDVYLVGEVYDKKEVVAPYLPGLPALFNFDFHYTLLETMNTGDGMLLAKKQKEILDFYQGITSSFIDATISSNHDQPRLLNELGSDPAKYKQAIAVMLSMPGAPYLYYGEEIGMLGLKPDEHIREPFLWDEKSKDTGRTKWIKPKYSKDSTVTSLEVQKKDSNSYFNHYKNLIALRNSYPALAIGSLELPAEELPKSVMAYFRKSGDQEIFVVHNVDKEEVDIQLPEGFEEVIFYLGEGKNSSGKLQLKGNSSMVFLKD

SEQ ID NO: 13892 - DNA, 2628 bp, Chlamydomonas reinhardtii
  CDS (1)..(2628)
atgcttctgcaagcccctggcctcgcgccgggctcggctcgtcgccaggcagcctgcagcgtggctcgcgaggcaaccaacgtgcgcattgtgacagcacctgctttgacacccgggcgcgctggagtttctggccggcgtatcctcccgccctcgcgcgtcgtgtccgtggagctggaggccccgacgctgtcgtcgagccctgcgactgtcagcaccaagaagttgttctgcgagccgagcgggcagcccgcatctactgcctatgggcccgccctgaccgggcgcccagctcctttgggcgccagcatcgacgctgacacgggcgccatcaacttctcagtgttcagctcctccgccgagtccgtgagcctggtgctgttcacggaggctgacctcaacgcaggccgggccactttcgagattcctctggacccgtatgtgaaccgcacgggcgacgtgtggcacatcatgctgcccgacctgcgggacgacctgctgtacggctaccgtgtggagggcgtgcaccaggaggaggacaaggactacccgggcatgaggcacgacaagcggcgtgtggttctggacccgtacgcggtggctgtgctcaaccggcggcgctggggccagatggggcccaacctgccgtacggcgaggagggcgtgctgggcgtcatgcccacgtggccgcaggccgccgccgcgctgcccgccgcccgcggctccgccttcgactgggagggcgacacgccgctcaacctgcccatggagagcctggtcatctacgaggcgcacgtgaggggcttcacggcgcacgccagcagcggggtggcggcgccgggcacgtacgcgggcatggtggagcggctggactacctcaagtcgctgggtgtgaacgccattgagctgctgcccgtgttcgagttcaacgagctcgagtactacagccagatccccggaagcgaccagtacaggttcaacttctggggctactccacggtcaactacttcagccccatgggccgcttcagcgctgcggtgggccagggcgcgccggcccgcgcctcctgcgacgagttcaagcagctggtcaaggagtgccacaggcgcggcatcgaggtgatcctggacgtggtgttcaaccatacggccgagggcaacgagcgcggccccaccatctccttccgcggcctggacaaccgcgtctactacatgctggcgccgggaggcgagtactacaactacagcggctgcggcaacacgctcaactgcaaccagcctgtggtgcggcagttcatcctggattgcctcaagcactgggtcaccgagtaccacgtggacgggttcaggttcgacctggcctccatcctgacccgcgcccactcggcctggcacccgcagcagtacgaccaggagacggggcagcgcgtggccatgagcagcggcggagccatcgtcacagcggagggcatcatgactgacggtgcgggtgtgcccaccggctacccgctggccgacccgcctctggtggagtccatcagcgaggaccccgtgctgcggaacaccaagatgatcgcggaggcctgggactgcgacggactcaaccaggtcggcgccttcccgcactacggcggccgctggagcgagtggaacggcaagttccgcgacgtggttcgcaacttcatcaagggcacggacggcccctgggcgggcgacttcgcctccgccatctgcggctcgcccaacatctacgccaacaacacgccgcacgagaccgactggtgggccaacaacggcgggcggcagtggaagggcggccgcggcccgcacgcctccatcaacttcgtggcggcgcatgacggcttcacgctggcagacatggtggcctacaacaacaagcacaacgaggccaacggagagaacaaccgggacggcgagcaacacaacaacagctggaactgcggcgaggaggggcccaccaccaagtgggaggtcaaccggctgcgtcagcgccagatgcgcaacctgaccggcgcgctgctgctgtcgtgcggcgtgcccatgatcaacatgggcgacgagtacgggcacagcaagaacggcaacaacaacacctactgccacgacagcgagctaaactacctgcggtgggaccagctggccgaggacccgcacggcttcaaccgcttcgtgcgcctgctgatccacttccgccgcgccacgcccgcgctgcagcgcaccacctttgtcaacgacaaggacatccagtggcacggcgagctgcccaacacgcccgactggaccgacaccagccgcctggtggccttcacgctgcacgacggcaagggcggcggcctgtacgtggccttcaacaccagccacctgcccaagctgctgcagctgcccaagtggggcggccgcgtgtggcagccgctggtggacaccagcaaggtggccccctacgacttcctggcggtggacggcgttctgagcgccgaggacgtggcggcggcgcggcggcagatggccatgtggaccgccgaccacacctaccccgtgctgccctggagctgcatcgtgctgcagagcgcgcccgaggacccggccgccacaagcatgatcaagtga

SEQ ID NO: 13893 - protein, 875 aa, Chlamydomonas reinhardtii
MLLQAPGLAPGSARRQAACSVAREATNVRIVTAPALTPGRAGVSGRRILPPSRVVSVELEAPTLSSSPATVSTKKLFCEPSGQPASTAYGPALTGRPAPLGASIDADTGAINFSVFSSSAESVSLVLFTEADLNAGRATFEIPLDPYVNRTGDVWHIMLPDLRDDLLYGYRVEGVHQEEDKDYPGMRHDKRRVVLDPYAVAVLNRRRWGQMGPNLPYGEEGVLGVMPTWPQAAAALPAARGSAFDWEGDTPLNLPMESLVIYEAHVRGFTAHASSGVAAPGTYAGMVERLDYLKSLGVNAIELLPVFEFNELEYYSQIPGSDQYRFNFWGYSTVNYFSPMGRFSAAVGQGAPARASCDEFKQLVKECHRRGIEVILDVVFNHTAEGNERGPTISFRGLDNRVYYMLAPGGEYYNYSGCGNTLNCNQPVVRQFILDCLKHWVTEYHVDGFRFDLASILTRAHSAWHPQQYDQETGQRVAMSSGGAIVTAEGIMTDGAGVPTGYPLADPPLVESISEDPVLRNTKMIAEAWDCDGLNQVGAFPHYGGRWSEWNGKFRDVVRNFIKGTDGPWAGDFASAICGSPNIYANNTPHETDWWANNGGRQWKGGRGPHASINFVAAHDGFTLADMVAYNNKHNEANGENNRDGEQHNNSWNCGEEGPTTKWEVNRLRQRQMRNLTGALLLSCGVPMINMGDEYGHSKNGNNNTYCHDSELNYLRWDQLAEDPHGFNRFVRLLIHFRRATPALQRTTFVNDKDIQWHGELPNTPDWTDTSRLVAFTLHDGKGGGLYVAFNTSHLPKLLQLPKWGGRVWQPLVDTSKVAPYDFLAVDGVLSAEDVAAARRQMAMWTADHTYPVLPWSCIVLQSAPEDPAATSMIK

SEQ ID NO: 13894 - DNA, 1962 bp, Paenibacillus sp
  CDS (1)..(1962): transl_table=11
atgtttctggaagctgtgtatcaccgtccgcgcaaaaactggtcctatgcgtacaacggcaccaccgttcatcttcggatccgcaccaagaaagacgacatgaccgccgtctatgctctcgccggtgacaagtacatgtgggaccacacgatggagtatgtcccgatgaccaagctggcgacagacgagctgttcgactactgggaatgcgaggtgaccccgccgtaccgaagagtgaaatacgggtttctgctgcagcagggtcatgagaagcgctggatgaccgagtatgattttctgaccgagccgccggccaatcccgaccgactgtttgagtacccgttcatcaaccctgtcgatgtgttccagccgccggcatgggtgaaggatgccatcttctatcaaattttccctgaacggtttgccaacggggatacccgcaatgatcccgaaggcacgctgccatgggggagtgccgatccgacgccaagctgcttctttggcggtgatctgcaaggcgtcatcgaccacctcgatcatctgagcaagctgggcgtgaacgccgtatacttcaccccgctctttaaggcgaccaccaaccataagtacgatacggaggattattttcagattgacccgcagttcggggacaaggatacgctgaagaagctcgtcgatctgtgccatgagcgcggaattcgcgtcctgctggacgccgtgttcaaccattccggccgaaccttccctcccttcgttgatgtcctcaagaacggggagaagtccaaatacaaggactggttccatatccgctccctgccgcttgaggtggtggacggcattccgacgtatgatacctttgcctttgaaccgctgatgcccaagctcaataccgagcatccggaagtgaaggaatacttgctgaaggccgcggaatactggattcgcgaaacggggatcgacggctggcggctcgatgttgccaatgaggtgagccaccagttctggcgcgagtttcgccgggtggtgaagcaagcgaaccccgatgcctatattctgggcgatgtatggcatgaatcgtccatctggctcgagggcgaccagttcgatgcggtgatgaactatccgttcaccaacgccgtccttgatttcttcattcatcaaatcgccgatgccgagaagttctccttcatgctcggcaagcagcttgccgggtatccgcgccaggccagcgaagtcatgttcaacctgctggacagccatgacaccgccagattgctgacccaagcggatggcgacaagcggaagatgaagctggcggtgctgttccagttcacctacttcggcaccccgtgcatctattatggggacgaggtcggccttgatggcgggcatgacccgggatgccgcaaatgtatggaatgggacgagacgaagcatgacaaggatctgttcgcgttctaccagacggtcatccggctccgccaagctcatgctgctctgcgcaccggcaccttcaagttcctcacggccgagaagaacagccggcagattgcttacctgcgtgaggacgaccaagatacgatcttggtcgtcatgaacaacgacaaggcgggccacacgcttacgctgcctgtccggcatgcacagtggacccatctgtggaacgacgatgtcctgaccgctgctcacggacagttgaccgtgaagctcccggcttacggctttgccgtgctgaaggcctcatccgattggtcatcatgggggcgccctccgttcactggcgaacacgccagcccgagcaagcggggcgcctctttttgtcgctccccctcctttcccttgacatcatcacattggcttgacccggtatcaacgttatcatgctcatgggttcagttatttagtaaattagtaaattataaatttagtgaacaattgagctgcatgtcattgaaatcatga

SEQ ID NO: 13895 - protein, 653 aa, Paenibacillus sp
MFLEAVYHRPRKNWSYAYNGTTVHLRIRTKKDDMTAVYALAGDKYMWDHTMEYVPMTKLATDELFDYWECEVTPPYRRVKYGFLLQQGHEKRWMTEYDFLTEPPANPDRLFEYPFINPVDVFQPPAWVKDAIFYQIFPERFANGDTRNDPEGTLPWGSADPTPSCFFGGDLQGVIDHLDHLSKLGVNAVYFTPLFKATTNHKYDTEDYFQIDPQFGDKDTLKKLVDLCHERGIRVLLDAVFNHSGRTFPPFVDVLKNGEKSKYKDWFHIRSLPLEVVDGIPTYDTFAFEPLMPKLNTEHPEVKEYLLKAAEYWIRETGIDGWRLDVANEVSHQFWREFRRVVKQANPDAYILGDVWHESSIWLEGDQFDAVMNYPFTNAVLDFFIHQIADAEKFSFMLGKQLAGYPRQASEVMFNLLDSHDTARLLTQADGDKRKMKLAVLFQFTYFGTPCIYYGDEVGLDGGHDPGCRKCMEWDETKHDKDLFAFYQTVIRLRQAHAALRTGTFKFLTAEKNSRQIAYLREDDQDTILVVMNNDKAGHTLTLPVRHAQWTHLWNDDVLTAAHGQLTVKLPAYGFAVLKASSDWSSWGRPPFTGEHASPSKRGASFCRSPSFPLTSSHWLDPVSTLSCSWVQLFSKLVNYKFSEQLSCMSLKS

SEQ ID NO: 13896 - DNA, 1548 bp, Halothermothrix orenii
  CDS (1)..(1548): transl_table=11
gtgaagctaaaacgcttgtctttcttcatgtttgttaccttactggtatttatatctgtttttcctgtttatgcaaacgatttcgaaaaacatggtacatattatgaaatttttgtcaggtctttttatgactctgatggtgacggaataggggatttgaaaggtataatagaaaaactggattatcttaatgatggagaccctgaaaccattgctgatctgggggttaatggtatctggttaatgcctatctttaaatctccctcctatcatggctatgatgtaaccgattattataagattaatcctgactacgggactctggaagacttccataagcttgttgaggctgcccatcaaaggggaatcaaggttataattgatttacccatcaatcataccagtgaaagacatccctggtttctcaaggcttcccgggataagaatagtgaatacagggattattatgtctgggctggccccgataccgataccaaagaaaccaagttagatggaggccgggtctggcattattccccgaccggcatgtattatgggtatttctggagtggcatgcctgatttaaactataataaccctgaagttcaggaaaaggttattgggatagcaaaatactggttaaaacagggggttgatggtttcaggcttgatggagccatgcatatcttcccaccggcccagtatgataaaaactttacctggtgggagaagttccgtcaggaaattgaagaggtaaaacccgtttacctggtgggtgaggtctgggatatttcggaaacggtagctccttacttcaaatatggttttgattctacctttaactttaaactggcagaggcagttatcgctacggctaaagctggatttccctttggttttaataaaaaggcaaaacatatttacggggtatatgacagggaggttggatttgggaattatatcgatgctcccttcctgaccaaccatgatcagaaccggattttggaccagcttgggcaggatcgtaataaggccagggttgctgccagtatttatttgaccttgcctggtaatccctttatttactatggtgaagaaatcggtatgagggggcaggggccccatgaagttatcagggagcccttccagtggtataatggatccggggagggagaaacatactgggagccagccatgtataatgatggctttacttctgttgaacaggaagaaaagaatctcgattccctcttaaatcactacaggaggttaatccatttccggaacgaaaatcctgtcttttataccggtaagattgagattataaatggaggattaaatgtagttgcatttagaagatataatgataagagggatttatatgtctaccataacctggtaaacagaccggttaaaataaaagtggctagtggtaactggaccttattgtttaattcaggtgataaggaaattacccctgttgaagataataataaacttatgtatactatccctgcttatactaccattgttctggaaaaggagtaa

SEQ ID NO: 13897 - protein, 515 aa, Halothermothrix orenii
MKLKRLSFFMFVTLLVFISVFPVYANDFEKHGTYYEIFVRSFYDSDGDGIGDLKGIIEKLDYLNDGDPETIADLGVNGIWLMPIFKSPSYHGYDVTDYYKINPDYGTLEDFHKLVEAAHQRGIKVIIDLPINHTSERHPWFLKASRDKNSEYRDYYVWAGPDTDTKETKLDGGRVWHYSPTGMYYGYFWSGMPDLNYNNPEVQEKVIGIAKYWLKQGVDGFRLDGAMHIFPPAQYDKNFTWWEKFRQEIEEVKPVYLVGEVWDISETVAPYFKYGFDSTFNFKLAEAVIATAKAGFPFGFNKKAKHIYGVYDREVGFGNYIDAPFLTNHDQNRILDQLGQDRNKARVAASIYLTLPGNPFIYYGEEIGMRGQGPHEVIREPFQWYNGSGEGETYWEPAMYNDGFTSVEQEEKNLDSLLNHYRRLIHFRNENPVFYTGKIEIINGGLNVVAFRRYNDKRDLYVYHNLVNRPVKIKVASGNWTLLFNSGDKEITPVEDNNKLMYTIPAYTTIVLEKE

SEQ ID NO: 13898 - DNA, 1533 bp, Paenibacillus sp
  CDS (1)..(1533): transl_table=11
atgctcacgatgttcgcctcaggtgcaatggctgagcaagaaatgaatgggcataagcctccaaattctgttggaagcggcgtgttttacgaaatttatattaattctttttatgattcgaatggggacggacacggtgatttgaaagggattacacaaaagcttgattacttaaacgacggcaacccccgttcgggcaaggatttgcaggttagtggcctctggctcatgcccatgaatccatctccaagctaccataaatatgatgttaccgactattatcaggtggacccccagtatgggaatctgaatgatttccgcaccttgacgaaagaagccaaacggaagggtgtcaaggtgatcatagaccttgttatcaaccattcgagcagtgagcacccttggttcaaggaggccagcaccaatccacaaagcaaataccatgactattacgtatgggcaaatgagaagacaaatctggatgaaaagggatcatggggccagcaggtatggcataagaatccgaatggcgaagggtatttctatggtaccttctggtcggggatgccagatctgaactttgacaatccagaagtccgtaaggaaatgattaaagtcggtaagtattggctgcagcagggtgcagatggtttccggcttgatgcggcgatgcatatctttaaagggcaaacgaaggatggtgccgataaaaacattgcgtggtggaatgagttccgttccgagatggaaaagattaatccaaatgtatatctggcaggagaggtatgggataagccggagaccatagctccttattacgaatcactccactctttgtttaattttgacctgggcggaaagatattgaactctgtgaaaaacggccgggatcagggtatcgcaacattcgctgagaaaacactgaagctgtacaaatcacacaataaagcggcacttgatgccccgttcctaagcaatcatgaccagacccgtgttatgagcgaactgggtggggatgtgcgaaaagccaagctgcctgcatccattcttttgacgctgccaggtcagccgtttctctattacggtgaagagatcggcatgaaaggggagaagcctgatgagtatcttcgagagcctatgcgctggtacaaaggagaaggccgcggtcaaacgacgtgggaagtacccaaatacaaccgaggcgaagtatcggtagaagcgcagatgcgggacaatgattccctgctacaaagctaccgcacgctcatccgtttgagggaagaacatgaagctcttcgtagccataatctagaaccaatccaagcaggttctgccaacgtggcggcataccaacgttcttctggcaaagaaacattgtatgtatatcacaacctgtcagggaagccggttacgctccagatgaaagatgcggataagcagaagaggaaagtggtcttttccagctccaagggtgtaaaaataaagaaaaatgcggtgacgattcccgcatacagctctctaatcaccaaatag

SEQ ID NO: 13899 - protein, 510 aa, Paenibacillus sp
MLTMFASGAMAEQEMNGHKPPNSVGSGVFYEIYINSFYDSNGDGHGDLKGITQKLDYLNDGNPRSGKDLQVSGLWLMPMNPSPSYHKYDVTDYYQVDPQYGNLNDFRTLTKEAKRKGVKVIIDLVINHSSSEHPWFKEASTNPQSKYHDYYVWANEKTNLDEKGSWGQQVWHKNPNGEGYFYGTFWSGMPDLNFDNPEVRKEMIKVGKYWLQQGADGFRLDAAMHIFKGQTKDGADKNIAWWNEFRSEMEKINPNVYLAGEVWDKPETIAPYYESLHSLFNFDLGGKILNSVKNGRDQGIATFAEKTLKLYKSHNKAALDAPFLSNHDQTRVMSELGGDVRKAKLPASILLTLPGQPFLYYGEEIGMKGEKPDEYLREPMRWYKGEGRGQTTWEVPKYNRGEVSVEAQMRDNDSLLQSYRTLIRLREEHEALRSHNLEPIQAGSANVAAYQRSSGKETLYVYHNLSGKPVTLQMKDADKQKRKVVFSSSKGVKIKKNAVTIPAYSSLITK

SEQ ID NO: 13900 - DNA, 1767 bp, Bacillus stearothermophilus
  CDS (1)..(1767): transl_table=11
atgaggaaagaagccatccaccaccgctcaaccgaccatttcgcttatgcttatgacagcgagacgctccatctccggcttcaaacaaagaaacatgatgtcgaccacgtcgagctgctttttggcgacccgtacgaatggcacgatggcgcctggcagtttcaaacgatgccgatgcggaaaacgggaagcgacgggttgtttgactattggctcgccgaagtcaaaccgccatatcgacggctgcgctatgggtttgtgcttcgagctggggacgagaaactggtctatacggaaaaaggattttaccatgaagctccgagcgacgacaccgcttactacttttgcttcccctttcttcatcgggtcgacctattccaagcgccggactgggtaaaagacacagtatggtatcaaattttccccgagcggttcgccaacggcaacccggccatcagtccgaaaggggcgcggccgtggggaagcgaggacccgacgccgacgagctttttcggcggcgacttgcaaggaatcatcgatcaccttgactatttggctgatctcggcatcaccggcatttacttgacgccgattttccgcgcgccgtcgaatcataaatacgacaccgctgattattttgaaatcgacccgcactttggggacaaagagacgttgaaaacacttgtcaagcgctgccatgaaaaagggatccgcgtcatgctcgatgcagtcttcaatcattgcggctatgagtttgccccgtttcaagatgtgttaaaaaacggtgcagcgtctaggtataaagattggttccatattcgcgagtttccgctccaaacggagccgcgcccgaattacgacacatttgcgttcgtgccgcaaatgcccaaactcaataccgcccatccggaagtgaagcgctacttgcttgatgtcgcgacgtactggattcgcgagtttgatattgacggctggcggctcgatgtggcaaacgaaatcgatcaccaattttggcgcgaattccgtcaggcggtgaaggcgctaaagcccgatgtgtacattctcggcgagatttggcatgatgccatgccgtggctgcgcggcgaccaatttgacgccgtcatgaactacccgttcacggacggagcgcttcgctttttcgcgaaagaggaaatcagcgcccgccagtttgccgatatcatggtccggttgcttcattcgtatccgaaacatgtgaacgaagcggcgtttaacttgcttggcagccatgatacaccaaggctgctcactgtttgcggcggcgacgtccgcaaagcgaagttgttgtttttgttccagctcacgttcactggttcgccgtgtatttactatggcgatgagatcggcatgacgggtggaaacgatccggaatgccggaaatgtatggtgtgggatacagagaagcaaaacaaagaactgtatgaacatgtcaagcaactgatcgctcttcgcaggcaatatcgggcgcttcgacgcggcgatgtcgcttttctcgccgccgatgatgaagcgaaccatcttgtttatgaaaaaacggatggcaatgaaacggtcatgatcatcatcaaccggagcaacgaagcagcagaaattcccatgccgatcgatgcgcgtggaaaatggctggtcaaccttctgacaggggagcggttcgctgcagaggcggaaacactttgcgtctccttgccgccgtacgggtttgtgctttacgcggtcgaaagctggtaa

SEQ ID NO: 13901 - protein, 588 aa, Bacillus stearothermophilus
MRKEAIHHRSTDHFAYAYDSETLHLRLQTKKHDVDHVELLFGDPYEWHDGAWQFQTMPMRKTGSDGLFDYWLAEVKPPYRRLRYGFVLRAGDEKLVYTEKGFYHEAPSDDTAYYFCFPFLHRVDLFQAPDWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFAPFQDVLKNGAASRYKDWFHIREFPLQTEPRPNYDTFAFVPQMPKLNTAHPEVKRYLLDVATYWIREFDIDGWRLDVANEIDHQFWREFRQAVKALKPDVYILGEIWHDAMPWLRGDQFDAVMNYPFTDGALRFFAKEEISARQFADIMVRLLHSYPKHVNEAAFNLLGSHDTPRLLTVCGGDVRKAKLLFLFQLTFTGSPCIYYGDEIGMTGGNDPECRKCMVWDTEKQNKELYEHVKQLIALRRQYRALRRGDVAFLAADDEANHLVYEKTDGNETVMIIINRSNEAAEIPMPIDARGKWLVNLLTGERFAAEAETLCVSLPPYGFVLYAVESW

SEQ ID NO: 13902 - DNA, 6057 bp, Bacillus stearothermophilus
  CDS (1)..(6057): transl_table=11
atggtgaagggaagatggagaaagtatgtcgcttatttctcaatctttttgctttttgcccagttgttttcatttagcgcaatcgttcgcgcaaatgaatcggtgcaaagccctgttgtgaacggaaacgatgtgacgtttcgctacgttggaacaggggaagagcagtctgttttgctcgctggatcgtttaatgactggcaaacagatggtgagaaaaagattgaattaacgaaagaaagcgatcatatttggtcagtaacaaaaacgcttccagatggaacgtacatgtacaaattcgttgtagacggaaattggatgacagatccattaaataacaacaaagcagatgatggatatggcggaaaaaatagcgtcgttgtagtcggtcaacctgctcagcagcaggagcgcgttgtgacgctcgtcggcaatttacaaaatgagcttgggcatgaaaaagagtgggatccggcagcgacagctaccgtcatgaagcatgaaggaaacggcttgtacacgttcacaggtgtactcccggcaggtacgtatgagtacaaaatcgcgataaatggaagctgggatgaaaactatggtgcgggtggccggaacggtggaaacatttctttcacgctcgaaaaagaaacggaagtaacgttttattaccacgatagtactcatgcgatcgctgattcaacgtggtatacgccgattccaaaagaaaaacagccgcgattagtcggaacgattttgcctgcgatcggctatgaaaaagaagttgatggttggacgccagagacgtcgagtgcatttttagtcgataataacttcgacttcatttacacatttactgctcgtgtaccaaaaggaaactatgaatttaaagtgacgttagggaatagttgggatgaaaattatcctcaagataatgctaagttaaacgtattagaagaaacgacaattacgttcttctttaacgcaaaaacaaaggagctatatacagactacagtccaacaggttcggatggcaacgttcaaaaagatcgtttaaagcataatacgtgggactctttatatcgtcagccgtttggagcagtgaaagcaggaacggaagtgacgttacgtttagctgcgaaaaaaggcgatgtaacgaaagcgaacgtgtatgtgaagaatacaacgacaggaacggcgaagttgtacgcgatgagcaaagtaggagtgatcggagacgatgagtattgggaagcgacattcactcctgaagaaaaagggttatatggctataaatttatcgcgatggacggtgcagctaaagcagagtatggtgaggatacacaagaaggtcaatggggacgagcggcagataagaacgtagaattattccaattgactgtatacgatccaaactataaaacgccagattggatgaaacaggcggttgtataccaaattttccctgatcgtttctttaatggaaatccaaataacgacaaagtgaaaaaatatgcgcgtggaaatgaaccgattgaacatcgggagtggtcggaacttccagataatccacgtatgaaagctactcctggatatgacggtgacggtatttggtccaacgacttttttggtggagacattgctggtattgaacaaaagctagattacttgcagtctttaggtgtaaatacgatttacttaaacccgattgcgcatgcgccatcaaaccataagtatgatgcgcacgattataaagcaatcgatccgatgtttggcacgcctgaagaatttgaatcattcgtgcaagcggttgcatcgcgcggtatgcaccttattttagatggggtatttaaccacgtatcggatgactccatttattttgatcgttacggaaaatatccgactgttggggcatatgaatattggtcggctgtatacgatttaatgaacgataaagggttgtcggaagaggaagcgcgtgttcaagtagaacaaaagtttaaagatgagggacaacagttcagtccgtacggattccatttatggtttaatatcgagaatgaaaaagtaaacggtgcatataaatatcaagcatggtggggatttgatagtttaccagaatttaagtctatttctggaacgaaagtaccgtatgcgagcgaattaaacaatgagcaactcgcaaactacattttttacgagcaagattccgtcgcaaaaagttggattacgcgcggggcatccggttggcgtttagatgtagccaatgaggtggatacggagttttggcgcgagtttcgtaaagagttgttgcaaggtgactatgaccgtgggccaacgctcaaaagcggacaacaaccgttaattctcggtgaaatttgggatgatgcatcaaaatacttccttggtgatcaatacgattcagttatgaactaccgtttccgcggcgctgtattagactttttacgaaacggtaaagcagaggaaatcgatgcgcgattaacagctattcgtgaagattatccggaagaagctttttatgcgctaatgaaccttatcggctcgcatgatacggcgcgtgcagtgtttttacttgggaacggaacagattcgtatgagcgtgctgaacttgatccgaactataatgaacaactcggcaaaaagcgattgaaactcgcggcgattttgcaaatgggttatccaggagcaccaacgatttactacggcgatgaggcaggtgtaacaggttcaaaagatccagatgatcgtcgtacgtatccgtggggaagcgaagatacggagcttattgcacattatcaaaaagtaggtactgttcggacagaacatcaagatgtgttagcgaaagggacaattgagacagtatatgcgaaaggtgatgtgtacgtctttgcccgtcagtacggaaaagatgttgcgcttatcgcgataaaccgtgggaatagtgcacaaacggtacagttggatgtttcttcaatcattccgaatggaacaagctttgttgatgaactacatggcgaatatgaagtgacagtatcgaacggaaaggtacagctaaacattcctgcatttgatggacgcatgttgtttggaaaagtaactgttaatatgccgaatgaagtgacgaacgttcaagcaacagcaggcgttggacaagtgacattaacgtgggaaggtgatgcaccgacttatcgtatttatcaatccacgttaaaaggtgcaggttatacgctcgtgaaagagacgaatgagaaagaggctgtcattggtggtctgaaaaatggaacagcgtattattttgctgttacagctgttgatgaaaacggaaatgagtcggctaaagtagaaacgaatcgcgtcgtaccacattatcctttagatgagcagcatattgtacatgtggacatcgtaagcgatgacgttttggacttggcaaaagcgatcgttgttgaggcgaaagtgcgcattgatgatgtaacaaagcacggcttagcggacggtttacaagccgtattacaagtgaaaagaccgaatcatgaaaagtgggaaaacgtgcaagcggcatacgaacgtcaagacggtgaagataacgtattccgagcatcgtttattccgttagcttcaggaacatacacgtatcgttacggctttacaacaaatctcggtgacagttgggtgtatacagaagaaaaaacgtttacactcgctgcaaatgaggcagatcaacaagcaccagcaaagggcattcagctcgtgcaaccagatgtcgaatctggtcaagtaaatttatcatggtcgtttgttgaaagagacgatcatgatgcttatatggtagtcattgagcgcgacggtcaagtgatttatacgacaacaacgattagtacatcatttacagattatgatgtagaaaacggaaaaacgtacacatatgtcgtaaaattgtacgaccgagcaggaaatgttgtcgaatccaatgcggtggaagtaacaccgaacatcgttatggttcaagtgacgtttaaagtgagagcgcctagttacacgccgttagatacgcgcattactattccaaacagcttgaacggttggaacacaggagcttgggaaatgacgcgtggtggagcggtaacatcggattgggagtttacaacggaactgcaagaaggtgagacgatcatctacaaatatgtaaaaggagcgtcttgggatcaggaaggattagctgatcatacacgtgatgatcaaacagatgatgacgttagctattatggctatggcgcaatcggaacggatttaaaaattacggtacaaaatcaaggcaataacaaaatgatcattcaagattacattttgcgttggatcgatatgcctgtcgttattgaagaagtgaaaaaagatggcgatcgcgtcacgataaaaggaaacgccatcaaaggcggtgtgcttacgatcaataaagaacgtgtaacgattcacgatgatatgtcatttacgtacacgttcacaccgaatgcaaaccaaaaagaagtagctatccatattgagccttctgaagaaagtaaggcgaatattttcaaaaatgacggtggagccattgcgaaaaatacgaaaaattatgtgttaaacattgaaacgaagcaattacgtgaaggggtgttaactgagcagccagatagcggcacgacaccaggaagcggcacgacaccaggaagcggcacaacaccaggaagcggcacaacaccaggaagcggcacaacaccgggcagtggtacaacaccaggaagcggcacgacaccaggcagtggtacaacaccaggcagtggtacaacgccagaaaaaggtgcagttgtcgttgagccgaaagtggaagtgaaagagagagatggaaaagttgttgaaaaagttgctgccgtttcgtcgaacgatatcgcaacgattgtcaacgaactttcgaatgaaaagaaacaagtcgtcatttccacaggttcgctcgttaaagatgtagcaacaaaagtagacgtacctgcgtcgttgtttgttcaagcagcgaataagcaatccgatgcgacgattgttagtgcgagtgaacaagcggtgtataaattgccagcaaaagaagtgaagcaagcagtagatcaagtggctaaacagctcggaacgacggtagatcaagtaagcatttccatcgagatgaaagtaaaagatgcgccacaattaccggttaaaacgttgtctgatgcggtacagttccacgttgtcgcaaaagcaaatggaaaggaacaagccattgatcgctttactcaatatgtcgagcgagagattgcgctcaaacaacctgttcagccaaatcgcgcggtagttgtgcgcgtaaacgatgatgggtcattgactccagtaccgacaacgttcgtcgatcaaaaagcggtagcgaagtcgttaacgaactcgacgtatgttgttgtcgaaggaacaacgacgtttgcggatatcgttcaacattgggcgaagccgtatattgattcgttggcagcaaaacagctcgttcgcggggtaacagagacggcgtaccgaccaaatgagccgatgacgcgtgcacaatttgccgtattgcttgtgcgtgccctcgcgttgcctagtgaaacatatgatgggcgatttgccgatgtgaaaggaacagaatggtttaaccaacatggtgaacttgctgcggcggtgaagtatggtgtgattcaaggaaagacgccaagcacgtttgcaccaaatgagccgattacacgcgcgcaagcagctgtcatgatcgagcgtgctcttaacctttcgtttgtcaactttgacaaggcggcaaaagatcaaacgaagaaactagcggatttccgtgatgcgaatcaattgccagcatggtcaaaacaagctattgaagcaatatatcaagcagggatcgtacaaggtcacccagacggtacatttgccccagcaggtcgaatgacacgtgcagaaatggcaaaggtgttagcagaatttttagcaaaggcgaagttgatgtaa

SEQ ID NO: 13903 - protein, 2018 aa, Bacillus stearothermophilus
MVKGRWRKYVAYFSIFLLFAQLFSFSAIVRANESVQSPVVNGNDVTFRYVGTGEEQSVLLAGSFNDWQTDGEKKIELTKESDHIWSVTKTLPDGTYMYKFVVDGNWMTDPLNNNKADDGYGGKNSVVVVGQPAQQQERVVTLVGNLQNELGHEKEWDPAATATVMKHEGNGLYTFTGVLPAGTYEYKIAINGSWDENYGAGGRNGGNISFTLEKETEVTFYYHDSTHAIADSTWYTPIPKEKQPRLVGTILPAIGYEKEVDGWTPETSSAFLVDNNFDFIYTFTARVPKGNYEFKVTLGNSWDENYPQDNAKLNVLEETTITFFFNAKTKELYTDYSPTGSDGNVQKDRLKHNTWDSLYRQPFGAVKAGTEVTLRLAAKKGDVTKANVYVKNTTTGTAKLYAMSKVGVIGDDEYWEATFTPEEKGLYGYKFIAMDGAAKAEYGEDTQEGQWGRAADKNVELFQLTVYDPNYKTPDWMKQAVVYQIFPDRFFNGNPNNDKVKKYARGNEPIEHREWSELPDNPRMKATPGYDGDGIWSNDFFGGDIAGIEQKLDYLQSLGVNTIYLNPIAHAPSNHKYDAHDYKAIDPMFGTPEEFESFVQAVASRGMHLILDGVFNHVSDDSIYFDRYGKYPTVGAYEYWSAVYDLMNDKGLSEEEARVQVEQKFKDEGQQFSPYGFHLWFNIENEKVNGAYKYQAWWGFDSLPEFKSISGTKVPYASELNNEQLANYIFYEQDSVAKSWITRGASGWRLDVANEVDTEFWREFRKELLQGDYDRGPTLKSGQQPLILGEIWDDASKYFLGDQYDSVMNYRFRGAVLDFLRNGKAEEIDARLTAIREDYPEEAFYALMNLIGSHDTARAVFLLGNGTDSYERAELDPNYNEQLGKKRLKLAAILQMGYPGAPTIYYGDEAGVTGSKDPDDRRTYPWGSEDTELIAHYQKVGTVRTEHQDVLAKGTIETVYAKGDVYVFARQYGKDVALIAINRGNSAQTVQLDVSSIIPNGTSFVDELHGEYEVTVSNGKVQLNIPAFDGRMLFGKVTVNMPNEVTNVQATAGVGQVTLTWEGDAPTYRIYQSTLKGAGYTLVKETNEKEAVIGGLKNGTAYYFAVTAVDENGNESAKVETNRVVPHYPLDEQHIVHVDIVSDDVLDLAKAIVVEAKVRIDDVTKHGLADGLQAVLQVKRPNHEKWENVQAAYERQDGEDNVFRASFIPLASGTYTYRYGFTTNLGDSWVYTEEKTFTLAANEADQQAPAKGIQLVQPDVESGQVNLSWSFVERDDHDAYMVVIERDGQVIYTTTTISTSFTDYDVENGKTYTYVVKLYDRAGNVVESNAVEVTPNIVMVQVTFKVRAPSYTPLDTRITIPNSLNGWNTGAWEMTRGGAVTSDWEFTTELQEGETIIYKYVKGASWDQEGLADHTRDDQTDDDVSYYGYGAIGTDLKITVQNQGNNKMIIQDYILRWIDMPVVIEEVKKDGDRVTIKGNAIKGGVLTINKERVTIHDDMSFTYTFTPNANQKEVAIHIEPSEESKANIFKNDGGAIAKNTKNYVLNIETKQLREGVLTEQPDSGTTPGSGTTPGSGTTPGSGTTPGSGTTPGSGTTPGSGTTPGSGTTPGSGTTPEKGAVVVEPKVEVKERDGKVVEKVAAVSSNDIATIVNELSNEKKQVVISTGSLVKDVATKVDVPASLFVQAANKQSDATIVSASEQAVYKLPAKEVKQAVDQVAKQLGTTVDQVSISIEMKVKDAPQLPVKTLSDAVQFHVVAKANGKEQAIDRFTQYVEREIALKQPVQPNRAVVVRVNDDGSLTPVPTTFVDQKAVAKSLTNSTYVVVEGTTTFADIVQHWAKPYIDSLAAKQLVRGVTETAYRPNEPMTRAQFAVLLVRALALPSETYDGRFADVKGTEWFNQHGELAAAVKYGVIQGKTPSTFAPNEPITRAQAAVMIERALNLSFVNFDKAAKDQTKKLADFRDANQLPAWSKQAIEAIYQAGIVQGHPDGTFAPAGRMTRAEMAKVLAEFLAKAKLM

SEQ ID NO: 13904 - DNA, 1983 bp, Thermococcus sp
  CDS (1)..(1983): transl_table=11
atgtataaaattttcggatttaaagacaatgactaccttggaaaggttggaatcacagagttttctatacctaagagcggttcctatgcctaccttttaggaaattttaatgcattcaatgaaggaagctttagaatgagggaaaagggagatagatggtatataaaggtagagcttcctgagggaatctggtactatacattttcggttgatggaaatttaatattagattttgaaaataatgaaaaaactgtgtatagaaggctttcatataaatttgaaaaaactgttaatgttgctaaaatcttctcgggagagaaattttaccattatccctctttggtctatgcttattctttgggagactcaacatacattcgctttagagccatgaagggagtggctaaaagagtgtttttaatttcagaccaaaaatatgaaatgagaaaaaaagcacaagatgaactctttgagtattttgaagcagttctacccagaaaagaaggacttgagtattattttgagattcatgaagcagatgaaattattgattatggagactttaaggtagattttaacgagcagaaggaaaggtttaagccacctgcatgggtctttgagagagtcttttatcaaataatgcccgatcgctttgctaatgggaatccagagaatgacccgcataattgtatagaatttaaaactatcactcaccacggcggtgatcttgagggtattatagagaaacttgactacattgaggaactcggtgttaatgcactttacctaaccccgatcttcgagtcaatgacatatcacgggtatgacatagtggactactatcatgttgctcggaaattcgggggagatgaagcttttgaaaaattaatgcaaaagctgaagaaacgggatataaagcttattttagatggagtttttcatcataccagcttttttcatccctactttcaagatgtagtgaaaaatgggaaaaacagtaagtacaaagatttttatcgtataatcagttttccagttgttccagaggagtttttcgagattttaaactcgaagctcccatgggatgaaaaatataggcggcttaaatcccttaaatggaactacgagagcttttattctgtatggctaatgcctcgtttaaaccacgacagcaaaggagtaagagaattcattaggaatataatggagtactggattaaaaaaggcgccgatggctggaggttggatgttgctcatggagttccacctgaagtatgggaagaaattagagaaaagttgcccagtaatgtgtatctagttggagaagtgatggacgatgctaggttgtggatattcaacaagttccatggaaccatgaactatccattgtatgaggcaattttgagattttttgtaacaagagaaattaacgcagagcaattcttgaactggcttgaacttttgagcttctactacggccctgctgagtacgtgatgtataatttcttagataaccatgatgtggatagaatgcttagcctgcttggagacaagagaaaatatctctgcgccttggtttttcttttcacgtacaagggagttccgtctatttactatggtaatgaaattgggatgaaaaatatagaggctccttttatggagcgttcaagggcacctatggaatggaataagaagaaatgggataaagaaatccttaaaactacaaaagagttgataaagttgagaaggagaagcaaagctttgcaaaaaggtatttttaaaccagttaaattcaaagacaaattattggtctataaaagagtgttaaataacgaaaacatcttagtagcaatcaactattcaaagaaagaaaagcatctagatttaccaccttcctttgaaatactctttcaaagtggatcattcgacagagtgaatatccgattaaaaccattttccagtattattgctaaaaagttgtag

SEQ ID NO: 13905 - protein, 660 aa, Thermococcus sp
MYKIFGFKDNDYLGKVGITEFSIPKSGSYAYLLGNFNAFNEGSFRMREKGDRWYIKVELPEGIWYYTFSVDGNLILDFENNEKTVYRRLSYKFEKTVNVAKIFSGEKFYHYPSLVYAYSLGDSTYIRFRAMKGVAKRVFLISDQKYEMRKKAQDELFEYFEAVLPRKEGLEYYFEIHEADEIIDYGDFKVDFNEQKERFKPPAWVFERVFYQIMPDRFANGNPENDPHNCIEFKTITHHGGDLEGIIEKLDYIEELGVNALYLTPIFESMTYHGYDIVDYYHVARKFGGDEAFEKLMQKLKKRDIKLILDGVFHHTSFFHPYFQDVVKNGKNSKYKDFYRIISFPVVPEEFFEILNSKLPWDEKYRRLKSLKWNYESFYSVWLMPRLNHDSKGVREFIRNIMEYWIKKGADGWRLDVAHGVPPEVWEEIREKLPSNVYLVGEVMDDARLWIFNKFHGTMNYPLYEAILRFFVTREINAEQFLNWLELLSFYYGPAEYVMYNFLDNHDVDRMLSLLGDKRKYLCALVFLFTYKGVPSIYYGNEIGMKNIEAPFMERSRAPMEWNKKKWDKEILKTTKELIKLRRRSKALQKGIFKPVKFKDKLLVYKRVLNNENILVAINYSKKEKHLDLPPSFEILFQSGSFDRVNIRLKPFSSIIAKKL

SEQ ID NO: 13906 - DNA, 2181 bp, Thermococcus sp
  CDS (1)..(2181)
atgagacggcgctttggggctcttcttttgctaatgttcatgttaaatataatagcatcaggatgccttcaatcacccacaacccaagagctaaaacttccctcaggaaactatccccccatctacataaacgaaaaaagccaaaatatgtgtccaccaggtaaagtgcccgtcacgttcagataccaaccagaagaaaacgttacttctgtgagtctgcgaggaagctttaacgactggggagaactgcccatgaaaaatgagaatggaacatgggtaaggacagtatgcttaaatcccggcagatacgaatacaaattctttgtagatggcgaatggataaaagatatgtcagcagttgatcccacagcagatgcttacgtagatgacggatttggcggaaaaaacgccgttaaaatcgtaaaaggggaacaaggcctgataatagaacacgaccctaagaaccccgcttatctatcgattgccgataatagaacggtaattaggttcaaggtacaacccaaccagatacaatcggcatttctcgtggcttccaatggagaatacaaaatggagcgtcagctatggtgggggtctggagaagtctggagagtggagattcaagaggtaagccccatagaatactacttcaaactcacaacaaacaatggagaggttctcgtccttaatacctccaaaaatccattcttcacctttgatgggataaacaggttcccccaagtggagtgggtgagcaaaggaataggctaccagatatttccggatcgctttaataacggtgatccaagcaatgatgcattagctctccaaaccgatgagttttggtttaatgagcttataaatgaaaggcccattctatcaaattggagcgacccaataagcccacttcactgctgtcaccagtactttggaggagatataaaagggatactcgaaaagctggattaccttcaagaacttggggttactgttatctacctaaacccgatatttctagctggaagcgctcacggttacgatgtatacgaccattaccgcctcgatccacagtttggaagcgaagaagacctaaagattctcattgaagaagctcataagagaggtataagaattatctttgactttgtccccaaccacagcggaattggacattgggcgtttctggatgtggcatcaagaggaaagaaaagcccttactggaactggtactttgtgcagagatggccatttaagttgggagatggaaaagcatatcttgggtggtggggactcggaagtttgcccaagctcaacacagccaatccagaggtcaaggaatatttaataggtgccgcactgcactggcttgactttggctttgacggcattaggatagatgcgccacaagagctcataaacgccgaggaatttttctccgagctaaggaaagccatcaaggaaaagcaccccgatgcatacatagtgggcgaaatatgggagctttctccgagatgggtgcagggaaacatgttcgactccctcatgaactacgctctcggaagagatatactccttgcttacgcaaggggagactggaatggagaaagaacgctggagcttttgggcagatactacgcaagctacggagaaaacgtcattgccatgggttttaatctggtaagctcccatgacacttcaagagtccttacagatttaggaggtggcaatttaggagacacaccaaagccagaagcaattcagagactaaaacttctttcaacgctcttatacactcttccaggcatgcccgtaactttccaaggagatgaaagaggcctcctaggggacaaagaacactttgactcccatagatacccaatacaatgggataccgtgaatgaagatgtgttaaaccattacaagagcctcgcagatttaagaaaaagcgttccggcgttaacaagcagcaaaataaagttctacacctcaaaagaaggcgtcctagcatttttcaggggacatgatgacgaggttcttgtaattgcaaacaacgtccccaaagacacatctattccccttcctccaggcaaatggaagcagatatggccagaaggagagaaaatatttgagaaagagataacagttccagggctggaagttctggtactcgtaaagacatag

SEQ ID NO: 13907 - protein, 726 aa, Thermococcus sp
MRRRFGALLLLMFMLNIIASGCLQSPTTQELKLPSGNYPPIYINEKSQNMCPPGKVPVTFRYQPEENVTSVSLRGSFNDWGELPMKNENGTWVRTVCLNPGRYEYKFFVDGEWIKDMSAVDPTADAYVDDGFGGKNAVKIVKGEQGLIIEHDPKNPAYLSIADNRTVIRFKVQPNQIQSAFLVASNGEYKMERQLWWGSGEVWRVEIQEVSPIEYYFKLTTNNGEVLVLNTSKNPFFTFDGINRFPQVEWVSKGIGYQIFPDRFNNGDPSNDALALQTDEFWFNELINERPILSNWSDPISPLHCCHQYFGGDIKGILEKLDYLQELGVTVIYLNPIFLAGSAHGYDVYDHYRLDPQFGSEEDLKILIEEAHKRGIRIIFDFVPNHSGIGHWAFLDVASRGKKSPYWNWYFVQRWPFKLGDGKAYLGWWGLGSLPKLNTANPEVKEYLIGAALHWLDFGFDGIRIDAPQELINAEEFFSELRKAIKEKHPDAYIVGEIWELSPRWVQGNMFDSLMNYALGRDILLAYARGDWNGERTLELLGRYYASYGENVIAMGFNLVSSHDTSRVLTDLGGGNLGDTPKPEAIQRLKLLSTLLYTLPGMPVTFQGDERGLLGDKEHFDSHRYPIQWDTVNEDVLNHYKSLADLRKSVPALTSSKIKFYTSKEGVLAFFRGHDDEVLVIANNVPKDTSIPLPPGKWKQIWPEGEKIFEKEITVPGLEVLVLVKT

SEQ ID NO: 13908 - DNA, 2220 bp, Thermococcus sp
  CDS (1)..(2220): transl_table=11
atgagaagcagaaagatttatatgcttgttgtattgcttctttttttaggatttagtgaacaaatttcaacagtagctgcaggggtcagtccctcatatccagcaggggatccccagacatgggttatctaccaaatagtcattgatagattttacgatgggaacacctcaaacaatgatccattaaaaagtccaggattatatgatccaaacaaagagaactggaagctttattggggcggtgatttagagggcatcatagcaaagctgccctacttatatgaacttggagtgagtgccatatggatttctccagtgtttgataatatagatgttcctatcaatggaagcaatggtctagaggcggggtatcatgggtattggccaaaggactttaaggttatagaagagcactttgggacatgggaaatattccgcagacttagtcaagaagcagccaagtacaatatcacgattataattgacttcgttccaaaccacagcaatcccaatgatgcgggcgagtatggagctctatatgataatggcacgtttgttattgattatccaacggatgcaaattatgcgactgttcacccaataacaaagagtttatcgtacatatacaatcacaatggaggaataacaaattggaatgatagatgggaagtcagatataaaaatctctttaatctggctgatcttaatcagttgaatccatgggtggacaattatcttaaagaatcgacagtatcttacttagaagctggaattggaggaataagaatagatgcagttaaacacttagagcctggatggctcaaaacttatgcagactatgtatatgcaagaaagaacgtatttatgtttggagaatggtaccagggctttaacgatgagatgtactgggatatggttaagtttgcaaactatacggggataggccttattaacatcccactccaacaagttctcgttgatgtttttgcttatgatacaaagactatgtgggacttggaaagcgctgttaataaatataccattgactttatgtggcaaaataaactaactatattcgtagacagccacgatgttccaagatttctgtccttgagaaatgacttaataagatttcaccaagctcttgcttttgttctaaccgctcctggaattccaataatctattacggtgatgaacaatatcttcacaatgatactgtaaatgactttggtcaagttggaggtgacccatataatagacctatgatgaaaacttggaacacatcaacaaccgcttttaaactaataaagactctcgcaagtctgagacgctataatcctgctttagcttatggattgatcgcgacaaggtatgtaagcgatgacatttacatctttgaaagaaagttctttgataacgttgttctcgtagcaataaatcgcaatttaaattctccatatgtggtctctaacgtttacacctccctaccagatggaagttacaatgactaccttggaggacttttgaacggagttggaataacggtttcatctggtacattctctgtagagttacctgcaggttcagtatcagtatggcagtacaaagcaacgccgactgatccatgggtaggagcaattgatccagttatgggaagagctggaaacattgtcacagttagtggagaagggtttggggatgttccgggaagagtcttaataacaaatggacaagattactggactgcagaagttacatattggagcgataaaagcgtagagttcatagttccttcaggaataactacccaactaaacgaaaatcatgttgaagtcagaattgaaagggctgatggggctacatcaaatggaatagcctttgaatatctaacgaacaaacaaattccagctatttttgaagttaggaacactcaaggtacaaatttagaaacccaagttggagaatttttatggctaacaggtagtgttccagagttgagctattggagtccagaaacaataaaagctgttggaccaatgttgtgtccaggatggcctgattggtttgttgtagcaagtgtcccggcggatacctatatagagttcaagttcttaaaggcaccgcttggaggcactggaatctgggaagtaggaagcaatcacgcatacctaacaccttcaagcggaataggggaagtttcagttgaagccaaccgttga

SEQ ID NO: 13909 - protein, 739 aa, Thermococcus sp
MRSRKIYMLVVLLLFLGFSEQISTVAAGVSPSYPAGDPQTWVIYQIVIDRFYDGNTSNNDPLKSPGLYDPNKENWKLYWGGDLEGIIAKLPYLYELGVSAIWISPVFDNIDVPINGSNGLEAGYHGYWPKDFKVIEEHFGTWEIFRRLSQEAAKYNITIIIDFVPNHSNPNDAGEYGALYDNGTFVIDYPTDANYATVHPITKSLSYIYNHNGGITNWNDRWEVRYKNLFNLADLNQLNPWVDNYLKESTVSYLEAGIGGIRIDAVKHLEPGWLKTYADYVYARKNVFMFGEWYQGFNDEMYWDMVKFANYTGIGLINIPLQQVLVDVFAYDTKTMWDLESAVNKYTIDFMWQNKLTIFVDSHDVPRFLSLRNDLIRFHQALAFVLTAPGIPIIYYGDEQYLHNDTVNDFGQVGGDPYNRPMMKTWNTSTTAFKLIKTLASLRRYNPALAYGLIATRYVSDDIYIFERKFFDNVVLVAINRNLNSPYVVSNVYTSLPDGSYNDYLGGLLNGVGITVSSGTFSVELPAGSVSVWQYKATPTDPWVGAIDPVMGRAGNIVTVSGEGFGDVPGRVLITNGQDYWTAEVTYWSDKSVEFIVPSGITTQLNENHVEVRIERADGATSNGIAFEYLTNKQIPAIFEVRNTQGTNLETQVGEFLWLTGSVPELSYWSPETIKAVGPMLCPGWPDWFVVASVPADTYIEFKFLKAPLGGTGIWEVGSNHAYLTPSSGIGEVSVEANR

SEQ ID NO: 13910 - DNA, 1737 bp, Alicyclobacillus acidocaldarius
  CDS (1)..(1737): transl_table=11
atggaacttgtgtggcagcatcgttgggcggcagacgcttacccgcttgacttgtcaaccatggttcttgtgttgcgcgttgcgcgatgcacacccgcacagcgggtgcgggtgcactttggagatcggtacgaacctgactttcagaattcaagtgaggctcgaagatacggatcggacggaacatttgactggtttacgtgtcgagttgccgcaccgacgcgaagactgaagtatgcatttgaagtgttatcctcaactggacgggctgtgtacctgggtgagggcgggctcgcggatacattggatgctgtccagccctttcaatatccgtacattcatccatctcgggttctcgctgtcccagattgggtggggcatgcggtggcttatcaaatatttcctgatcggtttgctgtgggtgaacaacagttggtacgtccgacggatccatgggacgcgcgtccaacccctgatagtgtatttggtgggaacctgcgagggattgtggacaaactcccgtatctgagcgatctcggcgtgaacctgatgtacctcacgcctatcttccaggctccatcgaaccacaaatacgacacgcaggactattttgccgtagaccccgcattcggtaccttgggcgatctgcaattgctcgtacgagaagctcatcgcctcgggattcgcgtggttctcgacgcagtgttcaaccattcggggtttcaatttgccccctttcaggacgtcattgcgcgcggtacggcgtctccctattggtcttggttcttcgtgcaaggggaccgcgttgacgtcgaatccgtcaattatgagactttcgcaacgcgcctcagacatatgccaaaactgaacttggcagagcctgctgccgaagaatactttctgcaagtggccaaacactatgttctcgagtgcgatatcgacggatggcgttttgacgtcgccaacgaaatcgatccccacttttggtcacggttgcgatcagaactgcgcgccttgaaacctgatatcttgttgataggagaaatatggcatgacagcctcccttggctgatgggcgatgccttcgatggcgtgatgaattatccgcttcgagagcttgtcatgcgctatgccatggacgaatccatagatgaacctgctttcgcagaagcgtgggtacgcctctatctgcagtacccgcgtccggcatggcgcgcgatgtggaatctgttgggcagtcatgatactgaacgcgcgcttacgcgcgcacgcggtcatgttccctctgttgtgttggcgtttgcaatgcttttcacgctacccggaattcccatggtgtattatggggacgagatcggcatggaaggtggaaccgatccggattgccgtcggggcatgatctgggacgcgaacttatggcagcttgatcttcgcgaagccgtgcggcaactcgcatggctcaagcgaacccatcccgcgcttgcaggagatacaatggagattcgcgatgcgaactctggcgtgctgcattatgtacggctaaacggcacaggtccgcatcttcacattgctgtttgcaaacgtcgagacttcggcgcggaagtggactccccactattcgcgtgggatgtgccatctcggacatcgggcgaggaacgaaagatcctgatatgggaatgcgattcaactgaggggtgtgggcatgattcacgagcagacggatttcacaaccagtga

SEQ ID NO: 13911 - protein, 578 aa, Alicyclobacillus acidocaldarius
MELVWQHRWAADAYPLDLSTMVLVLRVARCTPAQRVRVHFGDRYEPDFQNSSEARRYGSDGTFDWFTCRVAAPTRRLKYAFEVLSSTGRAVYLGEGGLADTLDAVQPFQYPYIHPSRVLAVPDWVGHAVAYQIFPDRFAVGEQQLVRPTDPWDARPTPDSVFGGNLRGIVDKLPYLSDLGVNLMYLTPIFQAPSNHKYDTQDYFAVDPAFGTLGDLQLLVREAHRLGIRVVLDAVFNHSGFQFAPFQDVIARGTASPYWSWFFVQGDRVDVESVNYETFATRLRHMPKLNLAEPAAEEYFLQVAKHYVLECDIDGWRFDVANEIDPHFWSRLRSELRALKPDILLIGEIWHDSLPWLMGDAFDGVMNYPLRELVMRYAMDESIDEPAFAEAWVRLYLQYPRPAWRAMWNLLGSHDTERALTRARGHVPSVVLAFAMLFTLPGIPMVYYGDEIGMEGGTDPDCRRGMIWDANLWQLDLREAVRQLAWLKRTHPALAGDTMEIRDANSGVLHYVRLNGTGPHLHIAVCKRRDFGAEVDSPLFAWDVPSRTSGEERKILIWECDSTEGCGHDSRADGFHNQ

SEQ ID NO: 13912 - DNA, 1548 bp, Paenibacillus polymyxa
  CDS (1)..(1548): transl_table=11
atgctcacgatgttcgcctcaagtgcaatggccgagcaggatatgaacgggcataagcctccgaattctgctggaagcggcgtgttttacgaaatttatatcaattctttttatgattcgaacggggacggacatggtgatttaaaaggtattacgcaaaagcttgattacttaaacgacggcaatccccgttcgggtaaggatttgcaggtcagcggcctctggctcatgccactgaatccgtctccaagctaccataaatatgatgtaactgactactatcaagtggacccgcagtacgggaatctgaatgatttccgcaccttgacgaaagaagcaaaaagaaaaggtgtcaaggtgatcattgaccttgttatcaatcattcaagtagcgagcacccttggttcaaggaggctagtgccaacccgcaaagcaaataccatgactattacgtatgggctgatgagaatacaaacctggatgaaaagggatcatggggccagcaggtatggcataagaatccgaatggcgaagggtatttttacggtaccttctggtccgggatgccggatctgaattttgataatcccaaagtccgcaaggaaatgatcaaagtcggtaagtattggctacagcaaggtgcagacggcttccggcttgatgcggcgatgcatatttttaaagggcaaacgaaggacggtgccgataaaaacattacgtggtggaatgaattccgttccgagatggaaaagataaatccaaacgtatatctggcaggagaggtatgggataaaccggagacaatagctccttattacgaatcgctccactctctgtttaattttgacctgggcggaacgatattgaactctgtgaaaaacggtcgagatcaaggtattgctacattctccgagaaaacgctgaagctgtacaaatcatacaataaggcggcactcgatgctccatttttaagcaatcatgaccaaacccgagttatgagcgagctgggcggggatgtacgaaaagccaagctggctgcatccattcttttgacgttgccgggtcagccgtttctctattatggggaagagatcggcatgaagggagagaagcccgatgagtatcttcgagagcctatgcgctggtacaagggagaaggcctcggtcaaacaaagtgggaggaacccaaatacaacaaaggcgaagtatcggtggaagcgcagttgcgggacaatgattctctgctggaaagctaccgcacgcttatccgtctgagggaagaacatgaggctcttcgcagcgacagtctagagccgatccaagcaggttctgccagcgtgacggcatacgaacgttcttcaggcaaagaaacattgtatgtatatcataatctgtcaggagagccggttaccatccagatgaaagatcgagataaggaaaagcggaaagtggttttctctacctcaaaggatgctaaagtaaggaaagaaacggtgacgattcccgcttacagttctttaattacccaagaagatagaaagagctga

SEQ ID NO: 13913 - protein, 515 aa, Paenibacillus polymyxa
MLTMFASSAMAEQDMNGHKPPNSAGSGVFYEIYINSFYDSNGDGHGDLKGITQKLDYLNDGNPRSGKDLQVSGLWLMPLNPSPSYHKYDVTDYYQVDPQYGNLNDFRTLTKEAKRKGVKVIIDLVINHSSSEHPWFKEASANPQSKYHDYYVWADENTNLDEKGSWGQQVWHKNPNGEGYFYGTFWSGMPDLNFDNPKVRKEMIKVGKYWLQQGADGFRLDAAMHIFKGQTKDGADKNITWWNEFRSEMEKINPNVYLAGEVWDKPETIAPYYESLHSLFNFDLGGTILNSVKNGRDQGIATFSEKTLKLYKSYNKAALDAPFLSNHDQTRVMSELGGDVRKAKLAASILLTLPGQPFLYYGEEIGMKGEKPDEYLREPMRWYKGEGLGQTKWEEPKYNKGEVSVEAQLRDNDSLLESYRTLIRLREEHEALRSDSLEPIQAGSASVTAYERSSGKETLYVYHNLSGEPVTIQMKDRDKEKRKVVFSTSKDAKVRKETVTIPAYSSLITQEDRKS

SEQ ID NO: 13914 - DNA, 1689 bp, Dictyoglomus thermophilum
  CDS (1)..(1689): transl_table=11
atgatatacgatgacaaaatattcggagatttatgccacaaagagtttttagtagaaagagaagttaaaaaacttgaagaaatatatttagaagaggttttaccagaagatcctaagcctgaagatgaaatagaatttacttttaactgtccattaaagtttcacattacttcaggaaaaattgtcaaagataacagagaaatatatacctttaatatacaggaaagaaaaactcaatggaatgatagcatatttaactttagcgaaattatcaaaataaaaatacctcctttaaaggaaaatggtctatatcaaatccacctttatgagatgaatgaaaaaatctatgagcaatatctctcaatagacagttttgaagcacccttatggagtgaggagagtataatttatcacatatttattgatagatttgctaaagatgaaaaagaagtagaatattctgaaaacctcaaagagaaattaggaggaaacctgaaggggatactaagccgtttggattatatagaaaaccttgggataaataccatatggatatctcccatttttaaaagcacatcatatcatggttatgatattgaggattactttgaaattgatcctatttggggaacaaaagaagatttaaaaaaacttgtaagggaagccttcaatagaggcataagaataatcttagactttgtaccaaatcatatgtcatataaaaatcctatatttcagaaagctttaaaagacaaaaacagtaatctaagaagttggtttatatttaaaggagaagattatgaaacctttttcggtgtaaagtcaatgcccaaaataaaccttaaaaataaggaagcgatagattatataataaatgctgccaaatactggataagagaatttggaatttctggatatagaatggatcatgctacaggtcctgacattaatttttggagtattttttattataatttgaaatctgaatttccagaaactttctattttggagagatagtagagactccgaaagaaacaaaaaaatatgtaggcaaatttgacggaactttagatttttatctttttaaaataattagagacttttttataggtaaaagatggtctaccaaagagtttgtaaaaatgatcgatttggaagaaaaattctatggaaataaattcaagagaatttcttttctcgaaaatcacgattcaaatagatttctatgggttgctaaagataagaaattacttagattagcttcaattttccaattctcgattaatgcaatacctataatctacaatggacaagaaatgggatgtagtcagtacagagatatacttgagggaaatagaactctacacgaacatgcaagacttcctataccctggagtgatgacaaacaagacaaagaacttatagatttttacaggcaattagttaaaatcagaaaaagtcatccagcgctttacaaaggtacgtttattcctatattttcagatatgatatcttttatcaaagaaacccaagaagaatccatacttgtacttataaatatagaggataaagaagaaatctttaatctgaacggtacgtacagagatctatttagcggaaatatttacactaattctttaaagctaggcccgatgagtgctcacttattacttcgtatagatcactga

SEQ ID NO: 13915 - protein, 562 aa, Dictyoglomus thermophilum
MIYDDKIFGDLCHKEFLVEREVKKLEEIYLEEVLPEDPKPEDEIEFTFNCPLKFHITSGKIVKDNREIYTFNIQERKTQWNDSIFNFSEIIKIKIPPLKENGLYQIHLYEMNEKIYEQYLSIDSFEAPLWSEESIIYHIFIDRFAKDEKEVEYSENLKEKLGGNLKGILSRLDYIENLGINTIWISPIFKSTSYHGYDIEDYFEIDPIWGTKEDLKKLVREAFNRGIRIILDFVPNHMSYKNPIFQKALKDKNSNLRSWFIFKGEDYETFFGVKSMPKINLKNKEAIDYIINAAKYWIREFGISGYRMDHATGPDINFWSIFYYNLKSEFPETFYFGEIVETPKETKKYVGKFDGTLDFYLFKIIRDFFIGKRWSTKEFVKMIDLEEKFYGNKFKRISFLENHDSNRFLWVAKDKKLLRLASIFQFSINAIPIIYNGQEMGCSQYRDILEGNRTLHEHARLPIPWSDDKQDKELIDFYRQLVKIRKSHPALYKGTFIPIFSDMISFIKETQEESILVLINIEDKEEIFNLNGTYRDLFSGNIYTNSLKLGPMSAHLLLRIDH

SEQ ID NO: 13916 - DNA, 1497 bp, Dictyoglomus thermophilum
  CDS (1)..(1497): transl_table=11
atgaagataaagttttttatcaaaagaactcttattttcatattcatcttagttacttttctaacttatattcatggatataatgagccatggtataaaaacgcgattttttatgaagtctttgtaagatcttttgcagatagcgacggggatagagtaggagatttaaatggacttatagacaaattagattactttaaaaatctaaatattactgctctatggctaatgcctatcttcccctcagtgagttatcatggatatgatgtcacagactattatgatatccatccaggttatggtaccatggaggactttgaaaacctaataagaaaagcccatgaaaaaaatattaaaataattcttgatttggtagtaaaccacacctcttcaaggcatccatggtttgtttcttctgcctcttcttacaattctccgtatcgcgattattatatatggagtactgaaaaacctgaaaaaaattctaatttatggtataaaaaacctacaggatactactatgcattattctggtcagaaatgcccgatctaaactttgataatccaaaagtaagagaagaggtcaaaaaaattgcaaaattttggatagaaaaaggtgttgacggatttagactcgacgcagcaaagcatatttatgatgatgactctaaaaacattcagtggtggaaagaattttactcatatttaaagagtataaaacccgatgtataccttgttggtgaagtttgggataacgagtataagatagcagaatactataaaggattaccctcaaactttaattttcctctttctgacaaaataatgaactccagtagcaaatcaaaaagacttaggaattatagaatttctcgattgaagagactttttggggaaaacaatacagactttgctgatgccatatttttaagaaaccacgatcaagtaagagttaggacattctttggtggaagcatagataaaagtattttggcaggatctatttacttaactttggccgggaataccttcatatactacggagaagaaataggaatggaaggatcaaaacctgacgaatatataagagaaccgtttaagtggactgacgatatgaaatctaaataccaaacctattggattattccacgatataacttaccaggaaatggtatagccctcgataccgaagaaaaagatccaaatagcatatacaatcactataaaaaactcttagaaataagagtcaaatgcagagctttatctaatggaaaaatagagagaataaagactcaagatagatctatacttgcctataagttagaattagaggatgaaaaaataatggtagtccacaatctaaataggattgaaaatacctttaactttaacaacgagataaaagaaaaagacatactatatattagaaacgctaaaactgaaaaaaataaaataatcttaggaccttatagcactgttatagtcaaaatcccataa

SEQ ID NO: 13917 - protein, 498 aa, Dictyoglomus thermophilum
MKIKFFIKRTLIFIFILVTFLTYIHGYNEPWYKNAIFYEVFVRSFADSDGDRVGDLNGLIDKLDYFKNLNITALWLMPIFPSVSYHGYDVTDYYDIHPGYGTMEDFENLIRKAHEKNIKIILDLVVNHTSSRHPWFVSSASSYNSPYRDYYIWSTEKPEKNSNLWYKKPTGYYYALFWSEMPDLNFDNPKVREEVKKIAKFWIEKGVDGFRLDAAKHIYDDDSKNIQWWKEFYSYLKSIKPDVYLVGEVWDNEYKIAEYYKGLPSNFNFPLSDKIMNSSSKSKRLRNYRISRLKRLFGENNTDFADAIFLRNHDQVRVRTFFGGSIDKSILAGSIYLTLAGNTFIYYGEEIGMEGSKPDEYIREPFKWTDDMKSKYQTYWIIPRYNLPGNGIALDTEEKDPNSIYNHYKKLLEIRVKCRALSNGKIERIKTQDRSILAYKLELEDEKIMVVHNLNRIENTFNFNNEIKEKDILYIRNAKTEKNKIILGPYSTVIVKIP

SEQ ID NO: 13918 - DNA, 1242 bp, Triticum aestivum
  CDS (1)..(1242)
atgggcaagcactctgctactctctgtggccttctggttgttgtgctttgtctcgcctccagcttagcacaggctcaaattcttttccaggggtttaattgggaatcgtggaagacacaaggcgggtggtacaagttcatgcaagggaaggtggaggagatcgccagcaccggcgccacccacgtctggctccccccgccgtcgcaatccgtgtcgccggagggctatctgccggggcagctctacaacctcaactccaagtacggcagcggggccgacctcaagtcgctgatccaggcgttccgcggcaagaacatctcgtgcgtcgccgacatcgtcatcaaccaccgctgcgccgacaagaaggacggccgcggcgtctactgcatcttcgagggcgggacgtccgacaaccgcctcgactggggccccgacgagatctgcagcgacgacaccaagtactccaacggccgcggccacagggacaccggcggtggcttcgacgccgcgcccgacatcgaccacctcaacccgcgggtccagagggagctctccgcctggctcaactggctcaaaaccgacctcggcttcgacggatggcgcctcgacttcgccaagggatactccgcggccatggccaagatctacgtcgacaacagcaagccggcgttcgtcgttggcgagctctacgaccgggaccgacagctgctcgcgaactgggtgcggggcgtcggcgggccggccacggcgtttgacttccccaccaagggcgttctccaggaggccgtccagggcgatctggggaggatgcgcggcagcgacggcaaggcgcccggtatgattgggtggatgccggagaagaccgtcacgttcatcgacaaccacgacactgggtcgacgcagaggctgtggccattcccctcggacaaggtcatgcagggctacgcctacatcctcacacacccgggcataccatgcatcttctacgaccatgtgttcgactggaaactgaagcaggagatcaccgcactggctacggtcaggtcaaggaacgggatccatccgggtagcacactggatatcctcaaagccgagggcgatctctatgttgccaagattgggggcaaggttataaccaagatcgggtcaagatacaatattggcgacaatgtgatcccctcgggtttcaagattgcagctaaaggcaacaactattgtgtctgggagaagagcggcctctga

SEQ ID NO: 13919 - protein, 413 aa, Triticum aestivum
MGKHSATLCGLLVVVLCLASSLAQAQILFQGFNWESWKTQGGWYKFMQGKVEEIASTGATHVWLPPPSQSVSPEGYLPGQLYNLNSKYGSGADLKSLIQAFRGKNISCVADIVINHRCADKKDGRGVYCIFEGGTSDNRLDWGPDEICSDDTKYSNGRGHRDTGGGFDAAPDIDHLNPRVQRELSAWLNWLKTDLGFDGWRLDFAKGYSAAMAKIYVDNSKPAFVVGELYDRDRQLLANWVRGVGGPATAFDFPTKGVLQEAVQGDLGRMRGSDGKAPGMIGWMPEKTVTFIDNHDTGSTQRLWPFPSDKVMQGYAYILTHPGIPCIFYDHVFDWKLKQEITALATVRSRNGIHPGSTLDILKAEGDLYVAKIGGKVITKIGSRYNIGDNVIPSGFKIAAKGNNYCVWEKSGL

SEQ ID NO: 13920 - DNA, 1761 bp, Bacillus acidopullulyticus
  CDS (1)..(1761): transl_table=11
atgtttagagaagcaatttatcaccgtcctaaagataattatgcatatgcttgcgcaaatggagaattacatatcagaatcagaacgaaaaaagacgatatgaaagaggtaacacttgtttacggagacacttatgaatttgatgacaataaatggacctattcaacagcccatatgaaaaaaaccggctccgaccaattgtttgattactggctcgcttctgtcactccgcgatataagagattgcgctatgggtttattgtaaatgaccgcaaagactcgacctgttttactgaaaaagggttttacccggagcccccagtaaatgacatttcctattatttcagctttccttatgtgaatcaggccgatattttccaggcacccgaatgggtaaaggacaccgtctggtatcaaattttccctgaacgctttgccaatggaaacaaagacaacgaccctgatggcacccttccatggggcagccgtgaaccggaaattgacaacttttttggcggagatttggaaggagtcattgaacatattgactatctcaaagaattgggcattggcggtatatactttacccctatatttaaggcacactccaaccataaatacgatacgattgattacatggaaatagatccgcaattcgggacaaaagaaacattaaaaaaattgattgatgtctgccataaaaatggaataaaagtgatgcttgatgctgtgtttaatcatagcggtgttttttttccaccatttcaggatgtagtggaaaaaggtaagaattccaagtaccaagactggttccacatccgggagtttccactcgtaatggagccaaggccaaattatgataccttcggctttacgtcttccatgccaaagttcaagacagaaaaccctgaagtgaaggaatatttactagaggttggccggtattgggtaagggaatttgatattgacggctggcgtttagatgtggcaaatgaagtgagccacgccttttggcgtgaattccgcagggaagtgaaagccatcaagcccgacttgtatatccttggggaaatttggcacgactccttgccttggctgcggggtgatcaatttgatgctgtgatgaattatcctttatccactaatattgtaaatctttttgccaatcaatccgtttcggtaaaagagtttgtagaaaatatgtcccatgttatccatatgtatcctgacactgttaacgaagctgcgttcaaccttgttggcagccacgatacaccgagaatattaacacagtgcggagaggatgtagaacgcttaaagcaagtgtttgtcttattgttaacattcataggcaccccctgcatttattacggggatgaaatcggcttaaccggcggacaggatcccggctgccggaaatgcatggagtggaatccagaccaacaaaaccgtgaacttcttcagcacgtcaggaaattaatacaattacgcagcgaaaatcctttgctcgccaatgagggagagctgacttttgtcccaccgaaaaatgaggaagatccgtgtcttgcttatacaaaatccaatgaggaaaaaacgattatgattattataaataaaagtaaaaactcagtggagtacccactttcatttgacgcagctgaacaaacagtaaaaaatctttggaatcaggaacagttgattttacaaaatggccaaacactggaactgaaggcaaatgactttaaaatattagaattttaa

SEQ ID NO: 13921 - protein, 586 aa, Bacillus acidopullulyticus
MFREAIYHRPKDNYAYACANGELHIRIRTKKDDMKEVTLVYGDTYEFDDNKWTYSTAHMKKTGSDQLFDYWLASVTPRYKRLRYGFIVNDRKDSTCFTEKGFYPEPPVNDISYYFSFPYVNQADIFQAPEWVKDTVWYQIFPERFANGNKDNDPDGTLPWGSREPEIDNFFGGDLEGVIEHIDYLKELGIGGIYFTPIFKAHSNHKYDTIDYMEIDPQFGTKETLKKLIDVCHKNGIKVMLDAVFNHSGVFFPPFQDVVEKGKNSKYQDWFHIREFPLVMEPRPNYDTFGFTSSMPKFKTENPEVKEYLLEVGRYWVREFDIDGWRLDVANEVSHAFWREFRREVKAIKPDLYILGEIWHDSLPWLRGDQFDAVMNYPLSTNIVNLFANQSVSVKEFVENMSHVIHMYPDTVNEAAFNLVGSHDTPRILTQCGEDVERLKQVFVLLLTFIGTPCIYYGDEIGLTGGQDPGCRKCMEWNPDQQNRELLQHVRKLIQLRSENPLLANEGELTFVPPKNEEDPCLAYTKSNEEKTIMIIINKSKNSVEYPLSFDAAEQTVKNLWNQEQLILQNGQTLELKANDFKILEF

SEQ ID NO: 13922 - DNA, 1563 bp, Bacillus megaterium
  CDS (1)..(1563): transl_table=11
atgaaagggaaaaaatggacagctttagctctaacactgccgctggctgctagcttatcaacaggtgttgacgccgaaaccgtacataaaggtaaagctccaacagcagataaaaacggtgtcttttatgaggtatatgtaaactctttttacgatgcaaataaagatggacatggtgatttaaaaggccttacacaaaagttggactatttaaatgacggaaattctcatacaaagaatgatcttcaagtaaacgggatttggatgatgccggtcaacccttctcctagctatcataaatatgatgtaacggactattataatattgatccgcagtatggaaatctgcaagattttcgcaaacttatgaaagaagcagataaacgagacgtaaaagtcattatggaccttgttgtgaatcatacgagcagtgaacacccttggtttcaagctgcgttgaaagataaaaacagcaagtacagagattactatatttgggctgataaaaatactgacttgaatgaaaaaggatcttggggacaacaagtatggcataaagctccaaacggagagtatttttacggaacgttctgggaaggaatgcctgacttaaattacgataaccctgaagtaagaaaagaaatgattaacgtcggaaagttttggctaaaacaaggcgttgacggcttccgcttagatgctgcccttcatatttttaaaggtcaaacgcctgaaggcgctaagaaaaacattctatggtggaatgagtttagagatgcgatgaaaaaagaaaacccgaacgtatatctaacgggtgaagtgtgggaccagccagaagtagtagccccttactatcaatcacttgattctctatttaattttgatttagcaggaaaaattgtcagctctgtaaaagcaggaaatgatcaaggaatcgccactgcagcagcggcaactgatgagctgttcaaatcatacaatccaaataaaattgacggcattttcttaaccaaccatgaccaaaatcgcgtcatgagtgagttaagcggcgatgtgaataaagcaaaatcagccgcctctatcttacttacgcttcctggaaatccgtatatttattacggtgaagaaattggcatgacaggtgaaaagcctgatgaattaatccgtgaaccgttccgctggtacgaaggcaacggaattggacaaactagctgggaaacacctgtatataacaaaggcggtaacggcgtgtctgtagaagcacaaacaaaacaaaaggattccttgttaaatcattaccgtgaaatgattcgtgtgcgccagcagcacgaagagttagtaaaaggaacgcttcaatccatttcagtagacagtaaagaagtcgttgcctatagccgcacgtacaaaggcaaatcgattagcgtgtatcataatatttcaaatcaacctgtaaaagtatctgtagcagcgaaaggtaacttgatttttgctagtgaaaaaggtgctaagaaagtcaaaaatcagcttgtgattccggcgaatcggacggttttaataaaataa

SEQ ID NO: 13923 - protein, 520 aa, Bacillus megaterium
MKGKKWTALALTLPLAASLSTGVDAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGIGQTSWETPVYNKGGNGVSVEAQTKQKDSLLNHYREMIRVRQQHEELVKGTLQSISVDSKEVVAYSRTYKGKSISVYHNISNQPVKVSVAAKGNLIFASEKGAKKVKNQLVIPANRTVLIK

SEQ ID NO: 13924 - DNA, 4428 bp, Thermoanaerobacter thermohydrosulfuricus
  CDS (1)..(4428): transl_table=11
gtgtttaaaaggagagctttaggatttttgctggcttttcttttagtttttacagcagtatttggctcaatgcctatggaatttgcaaaggctgagacagatacagcgccagcgatagccaatgttgttggcaattttcaatccaaacttggagattctgactggaatataaacagtgacaaaacgataatgacatataaaggtaatggcttttatgaatttactaccccagttgcgttacctgcaggtgattatgagtataaagttgctcttaatcattcatgggaaggtggaggagttccttcacaaggtaatttaagctttcatcttgattcagattctgtagtgactttttattacaattacaacacttcaagtattaccgattccacaaaatatacaccaattcccgaagacaagcttccaagacttgtagggactatacagcctgcaataggagcaggtgatgattggaaacctgaaacatcgactgctataatgagagactataagtttaataatgtttacgaatacactgcaaatgttccaaaagggaattatgagtttaaagtgactttagggccctcatgggatataaattatggcttaaatggtgaacaaaatgggccaaatattcctttgaatgtagcctatgatactaagattacattttactatgattcggtttcacataatatatggacagattataatccacctcttacaggacctgataataacatatattatgacgatttaagacatgacacccatgacccattcttccgctcgcctttcggtgcaataaaaacgggagatactgtgacattaagaatacaagcaaaaaatcatgacattgagtcagctaaaatttcttattgggatgatattaaaaaaacaagaatagaagtccctatgtacagaattggtcaaagtcctgacgggaaatatgaatactgggaagttaagttaagctttgaccatcccacaagaatttggtattactttatacttaaagacgggaccaaaactgcttattacggagataacgatgaacaattaggtggcgtaggtaaagccacagatacagaaaataaggacttcgaacttactgtctacgataaaaacttagacacccctgattggatgaaagggtcagtaatgtatcaaatattccctgataggttctttaatggggattcttcaaatgaccatctaaagaaatacagcagaggttttgatcctgttgaatatcatagcaactggtacgagcttccagataatccgaatgataaaaataaactaggatatacaggggatggcatatggtcaaatgacttctttggcggtgatttaaaaggtatagatgataaattggattatttaaaaagccttggaatatcagtcatttatctcaatccaatttttcaatcaccttctaatcacaggtacgatacaaccgattacacaaaaatagacgaactattaggagatttatctacctttaagaagctcatggaggatgcccatgcaaaagggattaaggtaatacttgatggcgtcttcaatcatacaagtgatgacagcatttattttgatagatatggtaaatacttaaacacgggagttttaggtgcttatcaagcatggaaacagggagatcagtcaaagtctccatatggtgactggtatgagataaagcctgacggtacctatgaaggatggtggggatttgacagtttacctgtgataaggcagataaacggcagtgaatataatgtcaaaagttgggcggattttattataaataatcctaatgcaatatctaagtattggttaaatcctgatggggacaaaaatgtaggtgcagatggttggagattagatgttgcgaatgaagttgctcacgatttttgggttcattttagaggtgcaattaatactgtgaaaccgaatgctccgatggttgcagaaaactggaatgacgcttcactggatctgcttggagattcttttaactctgttatgaattatctctttagaaatgcagtaattgactttatattggataaatcatttgatgacggaaatgtggttcacaatcctatagatgcagcaaaactcgaccaaaggcttatgagcatatatgagagatatcctcttccagtgttttattctactatgaatcttttaggttctcatgacaccatgaggatattgacagtatttggatacaactctgcggatgaaaatcaaaattctcaagcagcaaaagaccttgcggttaaaagacttaaacttgctgcaatactgcaaatgggttatccaggcatgccttctatttattacggagatgaagcaggacaatctggcggaaaagacccggacaacagaaggacattcccttggggaagagaagatactgatttgcaaacttttttcaagaaagttgtaaatataagaaatgagaatcaagttttgaaaacaggagaccttgagacactttatgcaaatggcgatgtttatgcctttggaagaagaatcataaatggaaaagatacttttgggaaatcgtatcctgacagtgtagctattgtcgtaataaataaaggtgacgcaaaacaggtttctatagataccactaaatttataagagatggagttgcttttacagatgccttaagtggcaagacatacacggttcaggatggtaaaattgttgtagaagttggatcaatggatggagctatacttatatcagatacaggacaaaatttgacagcacctcagccaataacagaccttaaagcagtctcagggaatggcaaagtagacctttcctggagtgtagtagataaagcagtaagctataatatttaccgttctacagttaaaggtgggttatatgaaaaaatagcttcaaatgttacgcaaattacctatactgatacagaggttaccaatggtctaaagtatgtgtatgctgtaaccgctgtagataatgatggaaatgagagtgctttaagcaatgaagttgaggcatatccagcatttcctattggctgggcgggaaatatgaatcaagtaaatacacatgtaataggtgtaaataatccagttgaagtgtatgctgaagtgtgggctcaagggcttacagataaacctggccaaggagaaaatatgattgcccagttaggatataggtatattggagatactgtaggagatgcagtttacaatgccgtgtacaataaggtagaaggtgttgaaataagtaaggactggacatgggttgatgcacaatatgtaggtgattctggaaataatgataaatacatggctaaatttgtacctgatatggtaggcacatgggaatacattatgagattttcttctaaccaaggccatgattggacgtatacaaaaggaccagatgggaaaacagatgaagcaaaacagtttactgtcgtgccatcaaatgatgtagaaacacctacagctccagtcttacaacaaccaggaattgaatcctcaagagttacacttaactggagtccgtcagctgatgatgttgctattttcggctacgaaatctataagtcttcaagtgagacaggaccatttataaagattgcaactgtgtctgacagtgtgtataactacgtagatacagatgtagtaaatggcaatgtgtattattataaagttgtggcagttgatacctcctataataggacagcatcaaatacagtaaaagcgacacctgatataatacctataaaagtgacatttaatgtcacaataccagattatactcctgatgatggtgtaaatattgctggaaacttcccggatgctttctggaatccaaatgctaatcaaatgacaaaagctggttctaacacctatagtattacacttactttaaatgagggtacacaaattgaatataaatatgcaagggggagctgggataaagtagaaaaaggtgaatacggcaatgagattgacaacagaaaaataactgttgtcaatcagggttcaaatacaatggttgtaaatgatacagtgcaaagatggagagatgtgccaatatatatctattctccaaaagacaagactattgttgatgcaaatacgagtgaaatagagattaaaggcaatacttacaaaggtgcgaaagtaactataaatgatgaatcttttgtgcaacaagaaaatggagtatttacaaaagtagttcccttggaatatggtgtaaatactatcaaaatacatgtagagccaagtggtgacaagaataatgaacttacaaaagatataacaataactgttacaagagagaagccggccaggagacagaacctactcctactccaccaacagaaacaacaaaaccatctcaagaagtatcacaaggcaaaatag

SEQ ID NO: 13925 - protein, 1475 aa, Thermoanaerobacter thermohydrosulfuricus
MFKRRALGFLLAFLLVFTAVFGSMPMEFAKAETDTAPAIANVVGNFQSKLGDSDWNINSDKTIMTYKGNGFYEFTTPVALPAGDYEYKVALNHSWEGGGVPSQGNLSFHLDSDSVVTFYYNYNTSSITDSTKYTPIPEDKLPRLVGTIQPAIGAGDDWKPETSTAIMRDYKFNNVYEYTANVPKGNYEFKVTLGPSWDINYGLNGEQNGPNIPLNVAYDTKITFYYDSVSHNIWTDYNPPLTGPDNNIYYDDLRHDTHDPFFRSPFGAIKTGDTVTLRIQAKNHDIESAKISYWDDIKKTRIEVPMYRIGQSPDGKYEYWEVKLSFDHPTRIWYYFILKDGTKTAYYGDNDEQLGGVGKATDTENKDFELTVYDKNLDTPDWMKGSVMYQIFPDRFFNGDSSNDHLKKYSRGFDPVEYHSNWYELPDNPNDKNKLGYTGDGIWSNDFFGGDLKGIDDKLDYLKSLGISVIYLNPIFQSPSNHRYDTTDYTKIDELLGDLSTFKKLMEDAHAKGIKVILDGVFNHTSDDSIYFDRYGKYLNTGVLGAYQAWKQGDQSKSPYGDWYEIKPDGTYEGWWGFDSLPVIRQINGSEYNVKSWADFIINNPNAISKYWLNPDGDKNVGADGWRLDVANEVAHDFWVHFRGAINTVKPNAPMVAENWNDASLDLLGDSFNSVMNYLFRNAVIDFILDKSFDDGNVVHNPIDAAKLDQRLMSIYERYPLPVFYSTMNLLGSHDTMRILTVFGYNSADENQNSQAAKDLAVKRLKLAAILQMGYPGMPSIYYGDEAGQSGGKDPDNRRTFPWGREDTDLQTFFKKVVNIRNENQVLKTGDLETLYANGDVYAFGRRIINGKDTFGKSYPDSVAIVVINKGDAKQVSIDTTKFIRDGVAFTDALSGKTYTVQDGKIVVEVGSMDGAILISDTGQNLTAPQPITDLKAVSGNGKVDLSWSVVDKAVSYNIYRSTVKGGLYEKIASNVTQITYTDTEVTNGLKYVYAVTAVDNDGNESALSNEVEAYPAFPIGWAGNMNQVNTHVIGVNNPVEVYAEVWAQGLTDKPGQGENMIAQLGYRYIGDTVGDAVYNAVYNKVEGVEISKDWTWVDAQYVGDSGNNDKYMAKFVPDMVGTWEYIMRFSSNQGHDWTYTKGPDGKTDEAKQFTVVPSNDVETPTAPVLQQPGIESSRVTLNWSPSADDVAIFGYEIYKSSSETGPFIKIATVSDSVYNYVDTDVVNGNVYYYKVVAVDTSYNRTASNTVKATPDIIPIKVTFNVTIPDYTPDDGVNIAGNFPDAFWNPNANQMTKAGSNTYSITLTLNEGTQIEYKYARGSWDKVEKGEYGNEIDNRKITVVNQGSNTMVVNDTVQRWRDVPIYIYSPKDKTIVDANTSEIEIKGNTYKGAKVTINDESFVQQENGVFTKVVPLEYGVNTIKIHVEPSGDKNNELTKDITITVTREKPARRQNLLLLHQQKQQNHLKKYHKAK

SEQ ID NO: 13926 - DNA, 1776 bp, Bacillus sphaericus
  CDS (1)..(1776): transl_table=11
atgattatgctggaagccgtttaccaccggatgggacaaaactggtcctatgcctacaatgattcgaccttgcatatccgcatccgcaccaagcgggacaatgtcccgcgcatcgacctgcactgcggcgagaagtacgatccggagaagtacaaggaaaccattcccatggagcgtatggcttctgacggactgtttgattattggcaagccgccgtgcagcccagataccgtagattagtttattacttcgcgctgcattccgacaacggcgatgccgtttactttatggagaagggattctttgatcagccgcccaaggtgatgtatgaaggattgttcgacttcccttatctgaatcggcaggatgtgcacacgcctccggcatgggttaaggaagcgatattctatcagattttccccgagcgcttcgcgaacggcgatccgtccaacgatcccgaaggcgtgcaggaatggggaggtacgcccagcgccggcaatttcttcggcggggatttgcaaggcgtgatcgatcatctggactatctaagcgatctgggcgttaatgctttgtatttcaaccccctattcgcggccaccaccaaccataaatacgatacggcggactatatgaagatcgacccccaattcggcacgaacgaaaagctcaaggagctggtcgatgcctgccatgcccggggcatgcgcgtgctgctggacgccgtgttcaaccactgcggccatacgtttccgccgttcgtggacgtgttgaacaacggtctgaattcgcgttacgcggattggttccatgttcgggaatggcctctgcgggtcgttgacgggattccgacctacgatacgttcgcattcgaaccaatcatgcccaagctcaataccggcaatgaagaagtgaaggcttacctgttgaatgtcggccgttactggctggaggagatggggctggacggctggcggctggatgtcgccaatgaggtggaccatcaattctggcgggaattccggagcgagatcaaacggatcaatccttcggcctatatcttaggcgagattatgcatgattccatgccgtggctgcaaggcgaccaattcgacgcggtcatgaattatcccttcacgaacatcctgctgaacttcttcgcccgcaggctgacgaacgcggccgaattcgcccaggcgatcggcacgcagctcgccggttatccgcagcaggttacggaagtgtcattcaatctgctcggcagccatgacacgacgaggctattgacgttgtgcagcggcaatgtggagcgcatgaagctggcgaccttattccagctgacctatcaggggacgccatgcatctattacggcgacgagatcggcatggacggcgagtatgaccccctcaaccgcaagtgcatggaatgggacaagagcaagcagaatacggagctgcttgcgttcttccggagcatgatcagcctgcgcaaggctcaccctgcgctgcgcggaagcggactgcgcttcctgccggtgctggagcacccgcagttgctggtctatgagcgctgggacgataatgagcgattcctcatcatgctgaataatgaggatgctcccgtgaacgttgttatcccggcagctcagcccggcgcttcttggcgcaccgtgaacggcgagccatgcgcagtagtcgaggaaagttcgatacaggcggctctccctccttacggttatgccatactgcatgcgcctatagcaggaacggctgagtaa

SEQ ID NO: 13927 - protein, 591 aa, Bacillus sphaericus
MIMLEAVYHRMGQNWSYAYNDSTLHIRIRTKRDNVPRIDLHCGEKYDPEKYKETIPMERMASDGLFDYWQAAVQPRYRRLVYYFALHSDNGDAVYFMEKGFFDQPPKVMYEGLFDFPYLNRQDVHTPPAWVKEAIFYQIFPERFANGDPSNDPEGVQEWGGTPSAGNFFGGDLQGVIDHLDYLSDLGVNALYFNPLFAATTNHKYDTADYMKIDPQFGTNEKLKELVDACHARGMRVLLDAVFNHCGHTFPPFVDVLNNGLNSRYADWFHVREWPLRVVDGIPTYDTFAFEPIMPKLNTGNEEVKAYLLNVGRYWLEEMGLDGWRLDVANEVDHQFWREFRSEIKRINPSAYILGEIMHDSMPWLQGDQFDAVMNYPFTNILLNFFARRLTNAAEFAQAIGTQLAGYPQQVTEVSFNLLGSHDTTRLLTLCSGNVERMKLATLFQLTYQGTPCIYYGDEIGMDGEYDPLNRKCMEWDKSKQNTELLAFFRSMISLRKAHPALRGSGLRFLPVLEHPQLLVYERWDDNERFLIMLNNEDAPVNVVIPAAQPGASWRTVNGEPCAVVEESSIQAALPPYGYAILHAPIAGTAE

SEQ ID NO: 13928 - DNA, 1725 bp, Thermoanaerobacter ethanolicus
  CDS (1)..(1725): transl_table=11
atgataaaagaagctatattccataaaagcgatgtgccttacgcatatccactgaatgaaaatcaattaaagatagtactaaggactgctgtatttgatgtagatagggtgtatgttttatacaaagacagatacgattggctgggaaaattcaaaataaaaccaatggtattaactcataccaacgagttatttgattattatgagactactttagagcttaataaaaaatttgtgtattttttctatttggtatctgatgggggcgagaagttatattatacagaagcaggattttacaaaaaaaggccagaaaatcatttttggggatttttccattacccgtatataggagaaaaggatgtcttttttgctccagagtggacaagcgattgcatggtgtatcagatatttcctgaaaggtttaataacggtgataaatcaaatgaccctgaaaatgtaaagccctggggtgaaaaacctactgcagattctttctttggaggagatttgcaaggaataatagataaaatagattatttaaaggatttgggtataaatgccatttatttaacccccatatttttatcgcattccacccacaaatatgatactactgattattatacaattgacccccactttggtgatacgcaaaaagcgagagaacttgtgcaaaaatgtcatgacaatggcataaaagttatatttgatgccgtttttaatcactgcggatatgacttttttgcatttcaggatgttattaaaaatggtaaaaaatcaaaatactgggattggtttaatatatacgaatggccaattaaaactcatggaaaaccttcctatgaagcttttgcagatactgtatggagaatgccaaaacttatgacaaaaaatccagaagtacagaagtatttattggaagtagcggaatattggattaaagaagtggacatagacggctggaggctggatgttgctaatgagatagaccaccatttttggagaaagtttagagaagttgtaaaggcagctaaaccggaggccataattgtaggagaggtttggcatgatgcttctccttggcttagaggggatcagtttgacagtgtaatgaactatccttttagaaatgcggttgtggacttttttgcaaaaaggaaaataagtgcttctcgctttaatacaatgattacagagcaacttatgaggcatatggatagtgtaaatagggttatgtttaatttaataggaagtcatgatactgagaggtttttgactttagctaatggcatggttgcgagaatgaagttagcattagtgtttcaatttacctttgttggaatcccatatatttactatggggacgaggtaggaatggtgggagattatgaccctgattgcagaagatgcatgatatgggaggaggaaaagcaaaataaaagtatttttaatttctataaaaagttgatttctataaggagagaaaatgaggagctcaaatacggaagtttctgtactttatatgctataggaagagtgtttgcttttaagagggaatacaaaggtaaatcaataattgttgtactaaataacagtagcaagcaggaagtgatatttttgaatgaagtagaaggaaaagaagatattttaaagatgaaggaattaaaaagaagtggaaatctcctttacttgcaacctaactctgcctatattttaaagtaa

SEQ ID NO: 13929 - protein, 574 aa, Thermoanaerobacter ethanolicus
MIKEAIFHKSDVPYAYPLNENQLKIVLRTAVFDVDRVYVLYKDRYDWLGKFKIKPMVLTHTNELFDYYETTLELNKKFVYFFYLVSDGGEKLYYTEAGFYKKRPENHFWGFFHYPYIGEKDVFFAPEWTSDCMVYQIFPERFNNGDKSNDPENVKPWGEKPTADSFFGGDLQGIIDKIDYLKDLGINAIYLTPIFLSHSTHKYDTTDYYTIDPHFGDTQKARELVQKCHDNGIKVIFDAVFNHCGYDFFAFQDVIKNGKKSKYWDWFNIYEWPIKTHGKPSYEAFADTVWRMPKLMTKNPEVQKYLLEVAEYWIKEVDIDGWRLDVANEIDHHFWRKFREVVKAAKPEAIIVGEVWHDASPWLRGDQFDSVMNYPFRNAVVDFFAKRKISASRFNTMITEQLMRHMDSVNRVMFNLIGSHDTERFLTLANGMVARMKLALVFQFTFVGIPYIYYGDEVGMVGDYDPDCRRCMIWEEEKQNKSIFNFYKKLISIRRENEELKYGSFCTLYAIGRVFAFKREYKGKSIIVVLNNSSKQEVIFLNEVEGKEDILKMKELKRSGNLLYLQPNSAYILK

SEQ ID NO: 13930 - DNA, 1761 bp, Drosophila virilis
  CDS (1)..(1761)
atgagtttgaagtggagcttagttttgggcctaagttggctcctttttgtggcttcgtcagaattaaaaaagcataagccaaacgagttggacgacaatattaattggtggcgacacgaggtcttttatcagatttatcctaggtcctttaaggacagcgatggcgatggcattggtgatcttaagggcatcacctccaagctgcagtactttgtggacactggcatcacggccatctggctaagtcccatttacaagtcacccatggttgactttgggtacgatatatccgactacagggacatccagccggagtatggcaccctggaggactttgatgcgctgatcgccaaggccaatcaactgggcatcaaggtcattttggactttgtgcccaatcacagctcggacgaacacgaatggtttaagaagtccgctgctagagagcctggctatgaggatttctatgtgtgggaggacggcatacctggggataatgaaactcgcttaccgccaaacaactgggtatctgtattctccggctccgcttggcagtggcacgaggagcggcaacaattctatttgcgtcagtttaccaagggacagcccgatttgaactatcgtaatcctgctgtggtgcaggccatggatgaagttttgttgtactggctgcaaaagggcgtggctggcttccgcatcgatgccgttatctatatatatgaggacgaacagttgcgcgacgagcccttgagcggttccaccagtgatccgaactcagttgattatctggagcacatctacacaaggaacctgccggaatgctatggcctcattcagcattggcgtcagctgttggacaactacacggccgataatccgggaccagtgcgcattatgatgaccgagggctatgcggatctatcgctgctaatgaactactatgaagatgaggacggcgtgcagggcgcccactttccctttaattttgattttattaccgagctgaatgcaaactcagcggctccggactttgtatacttcattcaaagatggctgacctatatgccgcctggacactcagccaactgggtgatgggcaatcatgataatccgcgcgttgcatctcggtatggcgttggcactgtggatgccatgaacatgctgatgatgactttgccgggcatcggcattacctactatggcgaggaactcggcatggtagactatcgtgacattagctggaacgatacagtggatcagcccgcctgtgatgctggtcttgacaattacaagtgggtctctcgcgaccccgaacgcacgccaatgcagtggagtgatgagaagaatgctggtttctccacgggagattccacctggttgccagtgcacccgaattatcaggagcttaatctgctcacccagcaagaagccacttacagccattataaggtctatcagtcgctgatcaagctgagacaatcgcgagtcttgcgggatggctcatttacagcccaggcccttaatcgtaatgtttttgctattaagcgcgaattgagaggtcagcccaccctgctaactgtcattaatgtgagcaatcgcacccagcaagtcgatgtcagtaactttatcgatttgcccaatcgtcttacattgttggttgtgggcgtttgctcccagcatagggtgagcgagcgccttaagcccgccgaggtcaaactgtcgccccatgagggtctagttatacagctcaaagctcgctag

SEQ ID NO: 13931 - protein, 586 aa, Drosophila virilis
MSLKWSLVLGLSWLLFVASSELKKHKPNELDDNINWWRHEVFYQIYPRSFKDSDGDGIGDLKGITSKLQYFVDTGITAIWLSPIYKSPMVDFGYDISDYRDIQPEYGTLEDFDALIAKANQLGIKVILDFVPNHSSDEHEWFKKSAAREPGYEDFYVWEDGIPGDNETRLPPNNWVSVFSGSAWQWHEERQQFYLRQFTKGQPDLNYRNPAVVQAMDEVLLYWLQKGVAGFRIDAVIYIYEDEQLRDEPLSGSTSDPNSVDYLEHIYTRNLPECYGLIQHWRQLLDNYTADNPGPVRIMMTEGYADLSLLMNYYEDEDGVQGAHFPFNFDFITELNANSAAPDFVYFIQRWLTYMPPGHSANWVMGNHDNPRVASRYGVGTVDAMNMLMMTLPGIGITYYGEELGMVDYRDISWNDTVDQPACDAGLDNYKWVSRDPERTPMQWSDEKNAGFSTGDSTWLPVHPNYQELNLLTQQEATYSHYKVYQSLIKLRQSRVLRDGSFTAQALNRNVFAIKRELRGQPTLLTVINVSNRTQQVDVSNFIDLPNRLTLLVVGVCSQHRVSERLKPAEVKLSPHEGLVIQLKAR

SEQ ID NO: 13932 - DNA, 1329 bp, Thermotoga neapolitana
  CDS (1)..(1329): transl_table=11
atgataggctaccagatctacgtgagatcattcagggatggaaacttcgatggtgtgggggatttcaaaggattgaaaggtgcgatttcctacctgaaagaactgggtgttgattttgtctggctcatgcccgtcttttcctccatttccttccacgggtatgacgtggtggatttttattctttcaaagccgagtacggagacgagaaagactttagagagatgatcgaggcgttccacgacaacggtataaaagtcgttctcgatcttcccatccatcatactggtttcctccacacgtggtttcagaaagccctgaaaggagatccacactacagggattattacgtatgggcgagtgaaaaaacggatctggacgaaagaagagagtgggacaacgaaaggatctggcatcctctggaggacggaaggttctacagaggacttttcggtcccctctcacccgatctgaactacgataacccgcaggtttttgaagagatgaagaaggtggtttatcaccttcttgaaatgggagtggacggattcagattcgacgcagcaaagcacatgagagatactctggaacagaacgttcgcttttggaggtatttcctctccgatattgagggaatattccttgcggaaatctgggcagaatccaaagttgtggatgaacacggcaggatattcggctacatgctaaatttcgatacctcacactgtattaaggaagcggtgtggaaggaaaacttcaaagtgttgatcgagtcgatcgaaagggccctggttggaaaagattatctgccggtgaacttcacatcgaaccatgatatgtcaaggcttgcgagtttcgaaggagggttgagtgaagagaaggtgaaactctcactttccattctgttcacgcttcccggggttcctctcatattctacggagacgaactgggaatgaaaggaatctatcgaaaaccgaacacggaagtggttctggatccgttcccctggagtgaaaacatctctcttgaggggcagacgttctggaaatggccggcctacaacagtccattctctggtgtttctgttgagtatcaaaagaaaaaacgtgattcgatcctcttacacattatgaagtggacaggattcagaaaggaaaatcactggctggacagggcaaacatcgaatttctgtgcaaagaagaaaaactgctgcacgtgtacagactggtcgatgaagggcgttctctgaaagtgatacacaacctgtcgaatggtgaaatggtgtttgagggagtgcgcgtacaaccctacagcacggaggtgatttga

SEQ ID NO: 13933 - protein, 442 aa, Thermotoga neapolitana
MIGYQIYVRSFRDGNFDGVGDFKGLKGAISYLKELGVDFVWLMPVFSSISFHGYDVVDFYSFKAEYGDEKDFREMIEAFHDNGIKVVLDLPIHHTGFLHTWFQKALKGDPHYRDYYVWASEKTDLDERREWDNERIWHPLEDGRFYRGLFGPLSPDLNYDNPQVFEEMKKVVYHLLEMGVDGFRFDAAKHMRDTLEQNVRFWRYFLSDIEGIFLAEIWAESKVVDEHGRIFGYMLNFDTSHCIKEAVWKENFKVLIESIERALVGKDYLPVNFTSNHDMSRLASFEGGLSEEKVKLSLSILFTLPGVPLIFYGDELGMKGIYRKPNTEVVLDPFPWSENISLEGQTFWKWPAYNSPFSGVSVEYQKKKRDSILLHIMKWTGFRKENHWLDRANIEFLCKEEKLLHVYRLVDEGRSLKVIHNLSNGEMVFEGVRVQPYSTEVI

SEQ ID NO: 13934 - DNA, 2001 bp, Thermoactinomyces vulgaris
  CDS (1)..(2001): transl_table=11
atgatcaaattattaaagccgatgtctttgtccatcctccttgtcttcattctctcattttcttttccatttcccacggcaaaggcggccgccaatgacaacaatgtggagtggaatggattgtttcatgatcaaggcccgctttttgacaacgcgccggagcccacttcaacccagagtgtcacgcttaaactgcgaaccttcaaaggagatattaccagcgccaatatcaagtattgggatactgccgacaatgcctttcactgggtgcccatggtttgggattccaatgacccgacaggcacgtttgattactggaaagggacgatcccggcaagcccatcgatcaagtattaccgtttccaaattaacgatggcacaagcacggcctggtacaacggcaatggcccttcttccaccgaaccgaatgccgatgatttttatattattcccaatttcaaaacgccggactggctgaaaaacggcgtaatgtaccagatctttccggatcgtttctacaatggcgattcttcaaatgatgtccagacaggctcctatacctataacggcaccccaacggagaaaaaagcatggggcagcagcgtttacgctgatccggggtacgacaatagtttggtcttttttggcggagacctggcgggaatcgatcaaaaactgggctatatcaaaaagactctcggcgcgaacatcctctatctgaatcccatcttcaaggcgccaaccaaccacaaatacgacacccaggactacatggcggttgatcccgcgtttggcgacaattccaccttgcaaacgctgatcaacgacatacacagcaccgcgaacggccctaaagggtaccttattttggacggggtgttcaaccacacgggagacagccatccgtggtttgacaaatacaataatttttcgtctcagggagcatacgagtcacaatccagcccatggtacaactactatactttctacacatggcccgattcatacgcttcttttctcggattcaacagtttgcccaaactaaactacggcaacagcggttcagccgtacggggcgtaatctacaacaacagcaattcggtggctaaaacctatttaaacccgccttattctgtcgatggttggcggctcgatgcagcacaatatgttgacgcaaatggcaacaatggaagtgacgtgaccaaccaccagatttggagcgaatttcggaatgccgtcaagggagtgaattcaaacgccgcaatcatcggggagtattggggcaacgccaatccatggacggcccagggaaaccagtgggacgcagccaccaactttgatggcttcacccagcctgtttctgaatggattaccggcaaagactaccaaaacaattcggcttcgatcagcaccacacagtttgacagttggcttagggggacacgggccaactaccctaccaatgtccaacagtccatgatgaacttcctttccaatcatgacatcacccgctttgccacacgttccggcggagatctttggaaaacctacttggccctgatctttcagatgacttatgtgggcactccgaccatttactatggggacgaatacggcatgcagggaggcgcggaccccgacaaccgccggtcctttgattggtcacaagccactccctccaatagcgcggtggccctgacccaaaagctgatcaccattcgcaaccaataccctgctttaagaaccggttcctttatgacattaatcacggacgacaccaacaaaatttattcttatgggcgttttgacaacgtcaaccgaatcgccgtcgtgctaaacaatgactccgtcagccatacggtcaacgtgccggtttggcaactcagcatgccaaatggcagcactgtcacggacaaaattaccggccatagttacaccgtacaaaacggcatggttaccgttgccgttgacgggcactacggcgctgtcttggcacaataa

SEQ ID NO: 13935 - protein, 666 aa, Thermoactinomyces vulgaris
MIKLLKPMSLSILLVFILSFSFPFPTAKAAANDNNVEWNGLFHDQGPLFDNAPEPTSTQSVTLKLRTFKGDITSANIKYWDTADNAFHWVPMVWDSNDPTGTFDYWKGTIPASPSIKYYRFQINDGTSTAWYNGNGPSSTEPNADDFYIIPNFKTPDWLKNGVMYQIFPDRFYNGDSSNDVQTGSYTYNGTPTEKKAWGSSVYADPGYDNSLVFFGGDLAGIDQKLGYIKKTLGANILYLNPIFKAPTNHKYDTQDYMAVDPAFGDNSTLQTLINDIHSTANGPKGYLILDGVFNHTGDSHPWFDKYNNFSSQGAYESQSSPWYNYYTFYTWPDSYASFLGFNSLPKLNYGNSGSAVRGVIYNNSNSVAKTYLNPPYSVDGWRLDAAQYVDANGNNGSDVTNHQIWSEFRNAVKGVNSNAAIIGEYWGNANPWTAQGNQWDAATNFDGFTQPVSEWITGKDYQNNSASISTTQFDSWLRGTRANYPTNVQQSMMNFLSNHDITRFATRSGGDLWKTYLALIFQMTYVGTPTIYYGDEYGMQGGADPDNRRSFDWSQATPSNSAVALTQKLITIRNQYPALRTGSFMTLITDDTNKIYSYGRFDNVNRIAVVLNNDSVSHTVNVPVWQLSMPNGSTVTDKITGHSYTVQNGMVTVAVDGHYGAVLAQ

SEQ ID NO: 13936 - DNA, 1758 bp, Thermoactinomyces vulgaris
  CDS (1)..(1758): transl_table=11
atgctgttggaagcgatttttcatgaagcgaaaggaagctatgcttacccgatttcggaaacgcaactgcgggtgagattgcgggcgaaaaaaggggacgtggtgagatgcgaggtgctctatgcggaccgctatgcttcgccggaggaagaactggcacatgcacttgcgggcaaagcagggtccgatgagcgatttgattattttgaggctttactggaatgttccaccaaacgggtgaaatacgtgtttttgttgacaggcccacaaggggaggctgtttattttggcgagaccggtttttccgccgaacggtctaaagcgggggtgttccaatatgcttacatccaccggagcgaagtgtttacgacaccggaatgggcaaaggaggcggtgatctaccagatctttcccgaacgttttgccaatggggatcccagcaatgatccgccgggaacggaacaatgggccaaagacgccagacctcggcacgacagtttttacggcggagatttaaagggggtgatcgaccgtttgccatatttggaggagttgggagtgacggcgctttattttactcccatttttgcttcgccgtcccatcacaaatatgatacagctgattatttggcgattgatccgcaatttggggatttgcccacctttcggcgtttggtggatgaagctcaccggcgcgggatcaaaatcattttggatgccgtgtttaaccatgccggagatcagttttttgcgtttcgggatgttctgcaaaagggagaacagtcgcgatataaggattggtttttcatcgaggattttcccgtttccaagacgtcaagaaccaattatgaaacctttgccgtccaagtgccggccatgcccaaattgcggacggaaaatccggaagtgaaggaatatttgtttgatgtcgcgcgattttggatggagcaggggatcgacggatggagactggatgtggccaatgaggtggatcacgccttttggcgcgagtttcgccgccttgtcaaatccctcaatcccgacgccttgattgtcggagagatttggcatgacgcttccggctggctgatgggagaccaatttgattcggtgatgaattatttgtttcgcgagagtgtgatccgtttttttgccacgggggagatccatgccgaaagatttgacgccgaacttacccgggccaggatgctttatccggaacaggcggcacaagggttatggaacctcctcgactcacacgatacggaacgttttttgacatcgtgtggggggaatgaggcgaaattccgcctggctgttttgtttcagatgacatacctggggacgccgctgatttattacggtgatgagatcgggatggccggagcgacggacccggattgccggcgcccgatgatatgggaggaaaaagagcagaaccgcggcttgtttgagttttataaggaattgattcgcttgcgccatcggctggcatcgctcaccaggggaaatgtccggtcttggcatgccgacaaacaagccaatctttatgcttttgtgcgcacggttcaagaccaacatgtcggtgtggttctcaataatcgtggcgagaagcaaaccgttttgctacaggtgccggaatcgggcggaaaaacttggctggattgtttgaccggagaagaagtgcatggcaaacaagggcaactgaagctgacacttcgcccttaccagggaatgattctctggaatggccggtag

SEQ ID NO: 13937 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 13938 - DNA, 24 bp, Primer
atgatgttaaatgcatggcacctg

SEQ ID NO: 13939 - DNA, 24 bp, Primer
ttagttcatccataccgtagccga

SEQ ID NO: 13940 - protein, 917 aa, consensus
  MISC_FEATURE (1)..(917): consensus for the disclosure of Xaa see table VIII
PXWWKXAVIYQIFPXXFXDSNXDGXXXXXXXXXXXXXXXXXXXXXXXXXXXXXXXXXXXXXXXXXXXXXXXXXXXXXXXXXXXXXGDLXGIIXKLDYLXDXXXXXXXXLGVXAIWLXPIFXSPXXXXXXXXXXXXXXXXXXXXXXXXXXXXXHGYDIXDYXXIDPXFGTLXDFXXLVXXAHXRGIXXXXKVILDXVXNHTSDXHXWFXDAXXXXXXXXXXXXXXXXXXXXXXXXXXXXXXXXXXXXXXXXXXXXXXSXYRDWYVWXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYYXXXFXXXXPDLNFDNPXVXXXLLXXXXXXXVMRFWLXXGXXXXXXIDGFRLDXVXXLXXXXXXXXXXXXXXXXXXXXXXXXXXXXXXXXXXRXXVXXXXPDXYLLGEXXXXXXXXXXXXXXXXXXXXXXXXXXGDXXXXXXXYXXXXXILXXXXXXXXXXXXXXXXXXXXXXXXXXXXXXXXXXXXXXXXXXXXXXVXXXXXXXXXXXXXXXXXXLXNHDXXRXLTXLXXXXXXXXXXXXXXXXXXXXXXXXXXXXXXXXXXXXXXXXXXXRIKLXXXLLLTLPGTPXIYYGDEIGMXXXXXXXXXXXXXXXXXXXXXXXXXXXXXXXXXXXXXXXXXXXXDXXRXPMXWXXXXNXXXXXXXXXXXXXXXXXXXXXXXXXXXXXXXXXXXXXXXXXXXXXXSLLXFXRXLIXLRKXXXALXXGXXXXXXXXXXXXXXXXXXXXXVLAYXRXXXXEXILVVXNXXXXXXXXXXXXXXXXXXXXXXXXXXXXLXXXXXXXXXXXXXXXXXXXXXXLXXXXXXV

SEQ ID NO: 13941 - protein, 8 aa, consensus
  MISC_FEATURE (1)..(8): consensus for the disclosure of Xaa see table VIII
YXXXXXXF

SEQ ID NO: 13942 - protein, 72 aa, consensus
  MISC_FEATURE (1)..(72): consensus for the disclosure of Xaa see table VIII
GXXXXXXXXXXXGXXXXXXXPXXXXXXXXXXYXXXXXXXXXXXXGXXXXXXXXXXXXXXXXXXXXXXXXXXH

SEQ ID NO: 13943 - protein, 14 aa, consensus
  MISC_FEATURE (1)..(14): consensus for the disclosure of Xaa see table VIII
WXXXXXXXDXXRXD

SEQ ID NO: 13944 - protein, 12 aa, consensus
  MISC_FEATURE (1)..(12): consensus for the disclosure of Xaa see table VIII
GXXXXYXGXEXG

SEQ ID NO: 13945 - DNA, 1203 bp, Escherichia coli
  CDS (1)..(1203)
atgacacaattcgcttctcctgttctgcactcgttgctggatacagatgcttataagttgcatatgcagcaagccgtgtttcatcactattacgatgtgcatgtcgcggcggagtttcgttgccgaggtgacgatctgctgggtatttatgccgatgctattcgtgaacaggttcaggcgatgcagcacctgcgcctgcaggatgatgaatatcagtggctttctgccctgcctttctttaaggccgactatcttaactggttacgcgagttccgctttaacccggaacaagtcaccgtgtccaacgataatggcaagctggatattcgtttaagcggcccgtggcgtgaagtcatcctctgggaagttcctttgctggcggttatcagtgaaatggtacatcgctatcgctcaccgcaggccgacgttgcgcaagccctcgacacgctggaaagcaaattagtcgacttctcggcgttaaccgccggtcttgatatgtcgcgcttccatctgatggattttggcacccgtcgccgtttttctcgcgaagtacaagaaaccatcgttaagcgtctgcaacaggaatcctggtttgtgggcaccagcaactacgatctggcgcgtcggctttccctcacgccgatgggaacacaggcacacgaatggttccaggcacatcagcaaatcagcccggatctagccaacagccagcgagctgcacttgctgcctggctggaagagtatcccgaccaacttggcattgcattaaccgactgcatcactatggatgctttcctgcgtgatttcggtgtcgagttcgctagtcggtatcagggcctgcgtcatgactctggcgacccggttgaatggggtgaaaaagccattgcacattatgaaaagctgggaattgatccacagagtaaaacgctggttttctctgacaatctggatttacgcaaagcggttgagctataccgccacttctcttcccgcgtgcaattaagttttggtattgggactcgcctgacctgcgatatcccccaggtaaaacccctgaatattgtcattaagttggtagagtgtaacggtaaaccggtggcgaaactttctgacagccctggcaaaactatctgccatgataaagcgtttgttcgggcgctgcgcaaagcgttcgaccttccgcatattaaaaaagccagttaa

SEQ ID NO: 13946 - protein, 400 aa, Escherichia coli
MTQFASPVLHSLLDTDAYKLHMQQAVFHHYYDVHVAAEFRCRGDDLLGIYADAIREQVQAMQHLRLQDDEYQWLSALPFFKADYLNWLREFRFNPEQVTVSNDNGKLDIRLSGPWREVILWEVPLLAVISEMVHRYRSPQADVAQALDTLESKLVDFSALTAGLDMSRFHLMDFGTRRRFSREVQETIVKRLQQESWFVGTSNYDLARRLSLTPMGTQAHEWFQAHQQISPDLANSQRAALAAWLEEYPDQLGIALTDCITMDAFLRDFGVEFASRYQGLRHDSGDPVEWGEKAIAHYEKLGIDPQSKTLVFSDNLDLRKAVELYRHFSSRVQLSFGIGTRLTCDIPQVKPLNIVIKLVECNGKPVAKLSDSPGKTICHDKAFVRALRKAFDLPHIKKAS

SEQ ID NO: 13947 - DNA, 1281 bp, Aquifex aeolicus VF5
  CDS (1)..(1281): transl_table=11
atgaaatatttaggactttgcacagacctctacgaactcaccatggcacagagttacctctacgaaggcaaaaccggaaccgctgtattctccctttttgtaaggaaactccccgaaaagaggaacttcctgatatccgcagggctcgaaaccttggtggagaggataaagaacttcaagttcggagatgaggagataaagtatttaaagagcctgggaatttttaaagacgattttctggactacctcaaggactttgaattttctggaaatgtttacgcaattcccgagggaaggatagtattccaaaacgaacctctcgttcaggtagaagctccgattcccgaagcccaactccttgagacgttggtaataaatactatacagtttgagacaatgatagcttcaaaggcggtgaggagttatctcgtggctaaagggaagaagctcgttgatttcggtttcaggcgggcccacggcttagaagcgggaatccttgcagcgagggcttcctacatcgccggttttgacgggacttcaaacgtcgaggcgggaagggagttcggtattcccgttgtgggaactatggcacactcctacgtgatgatttttgacaaggaagaagacgccttcagggcttttgccaaactctaccccaagaacgctatattcctgatagacacctacgataccattgaggcggcaaaaaaggtcgtagacctcgcaaaggaaggcgtacccgttgtgggagtcagaattgacagcggtgatatagtgaagctttccaaggaagtgaggaaaattctggacgaaaacggactgaaaaatgtaaggattatagtgagcggtggcgttgacgagtacaaaatcaaggaatggtttgacagaggcgctcccatagacgccttcggcgtaggaacgaagttcataacttccgcagatgccccatactttgacatagcctataagctcgttgagtacgaaggaaaaccaaagtacaaactcagccccggtaaaaaaacattcccatacaagaggcaggtctacaggtattacgaaaacggaaagatgaagtacgacgagaccgccaagtgggagagcaaaagggaaggagaacctctggtagaactcgttatgaaaaacggaaagctaataaaggaattgcctagcctgaaggaaataagggaagttgtgatgtcggaactagaaaaactccccgaaaattacaaggacataacgaaacactacgagtacgaagtaaagatcttagactgggagtaa

SEQ ID NO: 13948 - protein, 426 aa, Aquifex aeolicus VF5
MKYLGLCTDLYELTMAQSYLYEGKTGTAVFSLFVRKLPEKRNFLISAGLETLVERIKNFKFGDEEIKYLKSLGIFKDDFLDYLKDFEFSGNVYAIPEGRIVFQNEPLVQVEAPIPEAQLLETLVINTIQFETMIASKAVRSYLVAKGKKLVDFGFRRAHGLEAGILAARASYIAGFDGTSNVEAGREFGIPVVGTMAHSYVMIFDKEEDAFRAFAKLYPKNAIFLIDTYDTIEAAKKVVDLAKEGVPVVGVRIDSGDIVKLSKEVRKILDENGLKNVRIIVSGGVDEYKIKEWFDRGAPIDAFGVGTKFITSADAPYFDIAYKLVEYEGKPKYKLSPGKKTFPYKRQVYRYYENGKMKYDETAKWESKREGEPLVELVMKNGKLIKELPSLKEIREVVMSELEKLPENYKDITKHYEYEVKILDWE

SEQ ID NO: 13949 - DNA, 1260 bp, Neisseria meningitidis Z2491
  CDS (1)..(1260): transl_table=11
atgtgttctaatacgccccaagccgccaccaaaaatcgggagacacgccatatgaccggcatcatacattcgttgcttgacaccgacctctacaaattcactatgctgcaagtagtcctgcaccagtttccgcagacgcacagcctttacgaattccgatgccgcaacgcctcgaccgtctatccgcttgccgacatcaaagaagacttggaagtcgaactcgacgcgctctgccaactacgcttcacccacgacgaactcgactatctgcgcagcctgcgtttcatcaaaagcgactttgtcgattatctcgaactcttccagctccaacgccgctttgtcgaagtcggcacagacgataaaggccgtctgaacatccgcatcgaaggtccgatgatacaggcgatgttttttgaaatcttcatcctcgccattgtcaacgaactttacttccgccggctggaaacccctgccgttatcgaagaaggtgaacgccggcttcaagccaaagccgcgcgcctgaaagaaatcgccgccgcacaaaaccccgacgaaccgcccttcctgatttccgacttcggcacgcgccgccgctacaagctcgcgtggcaggaacacgtcatccgcaccctgctcgaagccgccccaagcatcgtgcgcggcaccagcaatgtctttctcgccaaaaaactcggcatcacgcccatcggcaccatggcgcacgaattcctccaagccttccaagccctcgacgtgcgcctgcgtaatttccaaaaggccgcgctcgaaagttgggtacacgaataccggggcgatttgggcgttgccctgaccgacgtggtcggtatggatgccttcctgcgcgatttcgacctctatttcgccaaactctttgacgggctgcgccacgacagcggcgacccttacatttggggcgacaaagcctacgcccactatcaaaagctcaaaatcgacagccgcaccaaaatgctgaccttctccgacgggctggacatcgaacgctcttgggcattacaccaatatttcaaagaccgcttcaaaaccggcttcggcatcggcaccaacctcaccaacgatatggggcatacacccttaaatattgtgttgaaactggtcgaatgcaacgggcagtccgtcgccaagctgtccgactctccgggcaaaaccatgaccaacaacagcaccttcctcgcctacctgcgccaagtgttcgacgtacccgaacccgaaacgccgtaa

SEQ ID NO: 13950 - protein, 419 aa, Neisseria meningitidis Z2491
MCSNTPQAATKNRETRHMTGIIHSLLDTDLYKFTMLQVVLHQFPQTHSLYEFRCRNASTVYPLADIKEDLEVELDALCQLRFTHDELDYLRSLRFIKSDFVDYLELFQLQRRFVEVGTDDKGRLNIRIEGPMIQAMFFEIFILAIVNELYFRRLETPAVIEEGERRLQAKAARLKEIAAAQNPDEPPFLISDFGTRRRYKLAWQEHVIRTLLEAAPSIVRGTSNVFLAKKLGITPIGTMAHEFLQAFQALDVRLRNFQKAALESWVHEYRGDLGVALTDVVGMDAFLRDFDLYFAKLFDGLRHDSGDPYIWGDKAYAHYQKLKIDSRTKMLTFSDGLDIERSWALHQYFKDRFKTGFGIGTNLTNDMGHTPLNIVLKLVECNGQSVAKLSDSPGKTMTNNSTFLAYLRQVFDVPEPETP

SEQ ID NO: 13951 - DNA, 1425 bp, Deinococcus radiodurans R1
  CDS (1)..(1425): transl_table=11
atgactgacctctccccccttctgaccgacctctaccagctcaccatgatgcagggctattttctcagcgacctgcaccggcagcaggcgacgtttgacctgtatttccgccgcctgcccttcgagggcggctacgcggtgtgggccgggctggagccgatgctcgactggcttcagggcttgcacttcgccgaggccgacctcgactacctcgcctcgctggggcagttccggcccgagtttctggcggcgctgcgcgagtggcgcttttcctgcgaggtgacggcgtttcccgaaggcagcgtggtctttccgcacgagccgctgctgacggtgcgcgggccgctgtgggaagcgcaactggtggaaacggcgctgctcaacaccctgaattttcagacgctggtggcgaccaaggcggcgcgctgcgtgctggcggcgcaggcgggcggcggcacggtcctcgaattcggggcgcggcgggcgcaggggccgaacggggccgtcagcgcggcgcgggcggccttcgtgggcggcgcagtgggcacgagcaatctggaagcggggcggcagttcgggattccagtgtcggggacgcacgcgcacgcctgggtggagagttttccgactgaactcgacgcctttcgcgcctacgccgagttttaccccgactccaccacgctgctgctcgacacggtggacaccctcggcagcggcctgcccaacgcgctgacggtggccgccgaactgcgggcgaagggccatgaactgggcggcgtgcgcgtggactcaggcgacctcgcctacctctcgcgggtcatccgggagcggctggacgcggcgggctttcccgacgtgaaaatcgtggtgagcaacgacctgtccgaatcggtcatctccggcgtgattgccgaggggggccgggtggacgtgtacggcgtggggacgcaactcgccacggcggggggccccggcggcggagcgctcggcggcgtgtacaagctggccgaactgaatgggcggccccgcatgaagctgaccggcgaccccgccaagtcgagcctgcccggcaccaaagccgtgtggcgcgggttagatcatgatcacttcgcctgggacgtgctgacgctgggagacgctccacatgagggcctgcgcgtcagcgaccccaccaacccgctgcgctcggcccggctcacctcgcgcctgcactggcgtccggcccgcgacctcgtgatgagcggcggccagcgcacccgccctgctgaggcgctgcccgcgctgcaagcccgcgcccgcgaggaacttgcgcgcctcgcccccgaaacgcgccgtctgcttaacccgcacgtctaccgcgtgagccttgcccccgaagtctcggaattgcgcgaccggctggcgcaggaactgcggggccactga

SEQ ID NO: 13952 - protein, 474 aa, Deinococcus radiodurans R1
MTDLSPLLTDLYQLTMMQGYFLSDLHRQQATFDLYFRRLPFEGGYAVWAGLEPMLDWLQGLHFAEADLDYLASLGQFRPEFLAALREWRFSCEVTAFPEGSVVFPHEPLLTVRGPLWEAQLVETALLNTLNFQTLVATKAARCVLAAQAGGGTVLEFGARRAQGPNGAVSAARAAFVGGAVGTSNLEAGRQFGIPVSGTHAHAWVESFPTELDAFRAYAEFYPDSTTLLLDTVDTLGSGLPNALTVAAELRAKGHELGGVRVDSGDLAYLSRVIRERLDAAGFPDVKIVVSNDLSESVISGVIAEGGRVDVYGVGTQLATAGGPGGGALGGVYKLAELNGRPRMKLTGDPAKSSLPGTKAVWRGLDHDHFAWDVLTLGDAPHEGLRVSDPTNPLRSARLTSRLHWRPARDLVMSGGQRTRPAEALPALQARAREELARLAPETRRLLNPHVYRVSLAPEVSELRDRLAQELRGH

SEQ ID NO: 13953 - DNA, 1392 bp, Mycobacterium tuberculosis CDC1551
  CDS (1)..(1392): transl_table=11
atggcgatccgccaacacgtcggcgcgctgttcaccgacctgtacgaggtgacgatggcccaggcctactgggccgaaagaatgtcgggcacagcggttttcgagatattcttccgcaagcttccgcctggcaggtcctacatcatggccgccgggctggccgatgtggtcgagttcctcgaagcgtttcgattcgacgagcaggatctgcgttacctgcgtggcctgggccagttttccgacgagttcctgaggtggctggccggagtgcgtttcaccggagatgtctgggccgcgccggaaggaaccgtgatttttccgaacgaacccgcggtccagctgatcgcgccaatcatcgaggcccagcttgtcgagacgtttgtgctgaaccagattcatctgcaaagcgtgctcgcgagcaaggccgcgcgggtggtcgccgccgcgcgcggacgaccggtggtggatttcggcgcgcggcgcgctcacggcaccgacgcggcctgcaaggtcgcgcgcaccagttatctcgcgggcgctgcgggcacgtcgaatctgctcgcggcccgccaatatgggatcccgacgttcggcaccatggcgcacagctttgttcaagccttcgacagtgaggtggccgcgttcgaggcgttcgcccggctctacccagccaccatgctgctcgtggacacctacgacacgctacgcggcgtcgatcacgtcatcgagttggccaagcggctgggcaatcgcttcgatgtgcgcgcggtccggctggattccggcgacctcgatgagctgtccaaggcgacccgtgcacggctcgacaccgccggtctcgagcaggtcgagatcttcgcgtcgtcgggcctcgacgaaaaccgcatcgccgcgcttttggctgcccgctgtccgatcgacggcttcggcgtgggcacccagctcgtcgtggctcaagacgcgcccgcgctggacatggcctacaagctggtggcatacgacggcagcgggcgcaccaagttctccagcggcaaggtgatctacccgggacgcaagcaggtgttccgtaagctcgagcacggagtcttttgcggcgacacgctcggcgagcacggtgaaaaccttcccggggacccgttgctggtgcccatcatgaccaacggccgacgcatccggcagcatgcacccacattggacggcgcgcgggactgggcccgccagcagatcgacgcgctcccgccggagctgcgctcgctcgaggacaccggctactcgtatccggtggcggtcagcgacaggatcgtgggcgaactcgcccggctgcggcacgccgacacggccgaagcccaccccgggtccaacgtcgtcggggcgaaggccaaacgaccctag

SEQ ID NO: 13954 - protein, 463 aa, Mycobacterium tuberculosis CDC1551
MAIRQHVGALFTDLYEVTMAQAYWAERMSGTAVFEIFFRKLPPGRSYIMAAGLADVVEFLEAFRFDEQDLRYLRGLGQFSDEFLRWLAGVRFTGDVWAAPEGTVIFPNEPAVQLIAPIIEAQLVETFVLNQIHLQSVLASKAARVVAAARGRPVVDFGARRAHGTDAACKVARTSYLAGAAGTSNLLAARQYGIPTFGTMAHSFVQAFDSEVAAFEAFARLYPATMLLVDTYDTLRGVDHVIELAKRLGNRFDVRAVRLDSGDLDELSKATRARLDTAGLEQVEIFASSGLDENRIAALLAARCPIDGFGVGTQLVVAQDAPALDMAYKLVAYDGSGRTKFSSGKVIYPGRKQVFRKLEHGVFCGDTLGEHGENLPGDPLLVPIMTNGRRIRQHAPTLDGARDWARQQIDALPPELRSLEDTGYSYPVAVSDRIVGELARLRHADTAEAHPGSNVVGAKAKRP

SEQ ID NO: 13955 - DNA, 1203 bp, Salmonella typhimurium LT2
  CDS (1)..(1203): transl_table=11
atgacacaattcgcttctcctgttctgcactcgttgctggatacagatgcttataagttgcatatgcagcaagccgtttttcaccactactatgatgtgcaggtagcggctgagtttcgttgccgtggcgacgacctgctgggtatttatgccgatgctattcgcgagcaggtggacgcgatgcagcacctgcgcctcctggaggacgagttccagtggctctccggcctgcccttttttaaaccggattatctgaactggttacgcgagtttcgctataacccagctcaagtctgtgtcaccaacgataacggcaagctgaatattcgcttaaccggcccgtggcgtgaagtcattatgtgggaagtgccgctgctggccgtgatcagtgagctggttcatcactaccgctcgccaaacgcgggtgttgatcaggcgctcgacgcgctggaaagtaagctggttgatttcactgcgttaaccgccaatctcgatatgtcccgcttccacctgatggacttcggcacccgccgccgtttctctcgtgaagtgcagcaggcgatagttaaacgtctccagcaggagtcatggttcgtcggcaccagcaactatgatctcgcgcgtcgcctggcgctgacgccgatgggcactcaggcgcacgaatggttccaggcgcatcaacaaatcagtccggacctggcgaccagccagcgtgccgcgttggccgcctggcttaacgaatatccggaccagcttggtatcgccttgacagattgcattacaatggatgcgtttttacgcgatttcggcattgaattcgccagccgttatcaggggttacgccacgactcaggagaccctgtcgcatggggcgaaaaggcgattgcccattatgaaaagctggggattgatccgctgacaaaaacgctggtcttttcagataaccttgatctgccaaaggcggtcgagctctatcgccatttcgcctctcgcgtgcagttaagcttcggcatcggtacccgcctgacctgcgatatccctcaggtaaaaccgctcaatatcgtgattaagctcgtggaatgtaacggaaagccggtggctaaactttccgacagccccggtaaaacgatctgtcatgataaagcgtttgtgcgcgcgctgcgtaaagcgttcgatctcccgcaggtgcgtaaagcaagttaa

SEQ ID NO: 13956 - protein, 400 aa, Salmonella typhimurium LT2
MTQFASPVLHSLLDTDAYKLHMQQAVFHHYYDVQVAAEFRCRGDDLLGIYADAIREQVDAMQHLRLLEDEFQWLSGLPFFKPDYLNWLREFRYNPAQVCVTNDNGKLNIRLTGPWREVIMWEVPLLAVISELVHHYRSPNAGVDQALDALESKLVDFTALTANLDMSRFHLMDFGTRRRFSREVQQAIVKRLQQESWFVGTSNYDLARRLALTPMGTQAHEWFQAHQQISPDLATSQRAALAAWLNEYPDQLGIALTDCITMDAFLRDFGIEFASRYQGLRHDSGDPVAWGEKAIAHYEKLGIDPLTKTLVFSDNLDLPKAVELYRHFASRVQLSFGIGTRLTCDIPQVKPLNIVIKLVECNGKPVAKLSDSPGKTICHDKAFVRALRKAFDLPQVRKAS

SEQ ID NO: 13957 - DNA, 1320 bp, Agrobacterium tumefaciens str. C58
  CDS (1)..(1320): transl_table=11
ttggggaatgcaagtatgacgaagaccgatatagccacccgtgtccacaatcatacttggaagctagacccgatcgtccgcagcctgattgatacagatttctacaagctgttgatgttgcagatgatctggaaactctatccggaagtcgacgcgacgttttccctgatcaaccgcaccaagactgtgcggctggcggaagagatcgacgagatggaactgcgcgagcagctcgatcatgcgcgcaccctgcgtctctccaaaaaggaaaatatctggcttgcgggtaatacgttttacggccgctcgcagattttcgagccggaatttctctcctggctttccagctatcaattgccggaatacgagcttttcaagcgcgacgggcaatatgagctgaatttccatggccgctggatggacacgacactctgggaaatcccggcgctgtctatcatcaacgagctgcgctcgcgcagcgccatgcgttcgctcggttatttcacgctggacgtgctttatgcccgcgccaaggccaagatgtgggaaaaggtcgagcggttgcgtgaactgccggggctgcgcatttccgatttcggcacccgccgccgccatagcttcctgtggcagcgctggtgcgtcgaggcgctgaaggaaggcatcggccctgcctttaccggcacgagcaatgtcctgctcgccatggattccgacctcgaagccgtcggcaccaacgcgcatgagttaccgatggtggttgccgcactggcgcagacgaacgaggaactggccgccgccccctatcaggttctaaaggactggaaccggctttatggcggtaacctgctgatcgtgctgccggacgcctttggcacggcggcgtttcttcgcaatgcgccggaatgggtggctgactggacgggctttcgccccgacagcgcgccgcccattgaaggcggtgaaaagattatcgagtggtggcggaagatgggccgcgacccgcgcacgaagatgctgatcttctcagatggtctcgatgtcgatgccatcgtcgatacctacaggcattttgaaggccgcgtccgtatgagcttcggctggggcaccaacctcaccaatgattttgccggctgcgcgccgaagaccattgccagcctcaagccgatttccatcgtctgcaaggtgagcgatgccaatggccgcccagcggtgaagctctcggacaatccgcaaaaagccactggcgatccggccgaagtggaacggtatctgaagttcttcggcgaggaagaccacaaggaacagaaggttctggtgtaa

SEQ ID NO: 13958 - protein, 439 aa, Agrobacterium tumefaciens str. C58
MGNASMTKTDIATRVHNHTWKLDPIVRSLIDTDFYKLLMLQMIWKLYPEVDATFSLINRTKTVRLAEEIDEMELREQLDHARTLRLSKKENIWLAGNTFYGRSQIFEPEFLSWLSSYQLPEYELFKRDGQYELNFHGRWMDTTLWEIPALSIINELRSRSAMRSLGYFTLDVLYARAKAKMWEKVERLRELPGLRISDFGTRRRHSFLWQRWCVEALKEGIGPAFTGTSNVLLAMDSDLEAVGTNAHELPMVVAALAQTNEELAAAPYQVLKDWNRLYGGNLLIVLPDAFGTAAFLRNAPEWVADWTGFRPDSAPPIEGGEKIIEWWRKMGRDPRTKMLIFSDGLDVDAIVDTYRHFEGRVRMSFGWGTNLTNDFAGCAPKTIASLKPISIVCKVSDANGRPAVKLSDNPQKATGDPAEVERYLKFFGEEDHKEQKVLV

SEQ ID NO: 13959 - DNA, 1251 bp, Yersinia pestis KIM
  CDS (1)..(1251): transl_table=11
ttgccgactgtggaaaatgctcctacgaggatgctgtatagcgccatgactcaagacgcctcaccgattttgacttcattgcttgatacggacgcatataagcttcatatgcaacaagccgtatttcatcattatcgtcacattactgttgccgccgaattccgctgccgtagtgatgagctgctgggggtgtatgctgatgaaatccgccaccaggtaaccctgatgggtcaattagcactgacatctgatgagtttatttacctctccagtctccccttcttccaggatgattatctgcattggttgcgcgattttcgttttaaaccagagcaagtctccgtcgctgttcatgacggtaaattagatattcgcattgccggtttatggtgtgaggtgatcatgtgggaagtgcctttgctggcagtgatcagcgaaatcgttcaccgccgccgctctacccaagtgacaacggatcaagcggttcaacaactgcgcacaaaacttgagcaattcaatgccctcagtgcggatatcgatattactcactttaaattgatggatttcggtacccgccgccgattctctcgcgagatacagcacaccgttgtcagcacgttaaaagatgagttcccttatctggtcggcaccagcaactacgacttagcccgcacattagccttagcgcccgtcgggactcaagcccatgagtggtttcaggctcaccaacaaattagcccaacattggcaaacagccagcgtgtagcactgcaagtctggctggatgaataccccaatcaactgggcatcgcactaactgattgcattactatggatgctttcctacgcgattttgatctggctttcgccaaccgctatcaaggcctacgccatgactctggtgacccgatcgagtggggggagaaggctatcgcgcattatgaaaaattgggtattgacccaatgaaaaaggtattggtgttttcagataatctagatctggagaaagcattattcctctaccgtcacttttatcagcgcattaagttggtgtttggtatcggtacccgtttgacctgcgatataccagatgttaagccattgaatattgttattaaactggttgaatgtaacgataaaccggtggctaagctctcagatagcccgggtaagactatttgtcaggaccccgcattcgttgatcaattacgtaaagcctttgcgctaccgttagtcaagaaagccagttaa

SEQ ID NO: 13960 - protein, 416 aa, Yersinia pestis KIM
MPTVENAPTRMLYSAMTQDASPILTSLLDTDAYKLHMQQAVFHHYRHITVAAEFRCRSDELLGVYADEIRHQVTLMGQLALTSDEFIYLSSLPFFQDDYLHWLRDFRFKPEQVSVAVHDGKLDIRIAGLWCEVIMWEVPLLAVISEIVHRRRSTQVTTDQAVQQLRTKLEQFNALSADIDITHFKLMDFGTRRRFSREIQHTVVSTLKDEFPYLVGTSNYDLARTLALAPVGTQAHEWFQAHQQISPTLANSQRVALQVWLDEYPNQLGIALTDCITMDAFLRDFDLAFANRYQGLRHDSGDPIEWGEKAIAHYEKLGIDPMKKVLVFSDNLDLEKALFLYRHFYQRIKLVFGIGTRLTCDIPDVKPLNIVIKLVECNDKPVAKLSDSPGKTICQDPAFVDQLRKAFALPLVKKAS

SEQ ID NO: 13961 - DNA, 1314 bp, Thermosynechococcus elongatus BP-1
  CDS (1)..(1314): transl_table=11
atgagcggtttgaccttggctgccaccgattacagcttgctgacggatctctacgaactgacgatggtgtccacctacgccggcgaagatttggcttggacaccggccagttttgaactcagtgtgcggcgtctgccccgaggctatacgtatctggtggcaatggggttggctcaggtgctggagtatttgcaacagctacggttgacacctcagcaaattgattacctcagaggtctggcggtttttgaacgggcaccggcagcattttgggagctattgagccagggtgagttccgcggcgatgtctgggcggttccggaaggaacagtggtctttgcccaggaacccctgctgcgcattgatgcccccctttggcaaggccagtggatagaaacttgtctgctcaatatcgtcaactaccaaacccttgtggccacccgtgcttcccggctgcgacagttggtgggggaagaggtggatctcctggaatttggcacgcggcgcgccttcagtccccaagcctccctgtgggcagcccgctccgccctagcggcaggatttacagccacttccaatgtcctcgctgcacagcagttgggggtggttcccgtaggcaccatggcccattccctagtcatggcgatcgcgaccctcaagggaaccgaacaggacgcctttacggttttcttgcgctcctatcccgaaggggcactcttggtggatacctatgacagccttgccgccattgccaccctcgccgatcgccaagccgctggggagattttggtcaaggcagtgcgcattgattcaggggatctcttgagcctctcccagaaaatccgtcaactgttgccccaagcaaaaatcattgccagtggcgatctcgatgagggggaaattcgccgcctgcaggcagcgggtgccgcaattgatgcctatggcatcggtacgaagctggttacgggagaaccggtcaacggtgtctataaactggtggagatcaatggtcagggggtgatgaagatcgccagtggcaaaatgaccctacccggacgcaagcaaatttaccgccgccccagtggggattgccttgcccttgccagcgaggaacaggtttggggcaaaccgctccttgaactggttatgaaggaagggtgccccctttatccgccggagtcattgacaaccattcgcgatcgccaccgcgccagccttgcggaattgccagagactctcttggatgtgacccagcccgtggtttattcccctgcccttgacgccttgatccaacagttacgacagcacccatga

SEQ ID NO: 13962 - protein, 437 aa, Thermosynechococcus elongatus BP-1
MSGLTLAATDYSLLTDLYELTMVSTYAGEDLAWTPASFELSVRRLPRGYTYLVAMGLAQVLEYLQQLRLTPQQIDYLRGLAVFERAPAAFWELLSQGEFRGDVWAVPEGTVVFAQEPLLRIDAPLWQGQWIETCLLNIVNYQTLVATRASRLRQLVGEEVDLLEFGTRRAFSPQASLWAARSALAAGFTATSNVLAAQQLGVVPVGTMAHSLVMAIATLKGTEQDAFTVFLRSYPEGALLVDTYDSLAAIATLADRQAAGEILVKAVRIDSGDLLSLSQKIRQLLPQAKIIASGDLDEGEIRRLQAAGAAIDAYGIGTKLVTGEPVNGVYKLVEINGQGVMKIASGKMTLPGRKQIYRRPSGDCLALASEEQVWGKPLLELVMKEGCPLYPPESLTTIRDRHRASLAELPETLLDVTQPVVYSPALDALIQQLRQHP

SEQ ID NO: 13963 - DNA, 1464 bp, Oceanobacillus iheyensis HTE831
  CDS (1)..(1464): transl_table=11
atgaattacattgatgacagcttggcattacatacggatttatatcaaattaatatggcagaaacatattggaatgacgatgttcataataggaaagcagtgtttgatctatatttccgcagccttccatttggaaacggatatggagtgtatgctggtttagaacggataatcgagtatatgaataattttcgatttacagatgcagatctaacttatttaaaagagattggttatcaagatgactttatcgaatatttaaaaagtatacgcttcactggtacgattaagtcaatgaaagaaggggaaatcgtatttgccaatgagccgattcttcgtgtagaggctagtcttgctgaggcgcaattattagaaacagctttattaaatattgttaattaccaaacgcttattgctaccaaagcatcgcgtattcgccagcttgtaggagatcagcttgtaatggaatttggaacgagaagagcgcaggaaatggatgcagcagtttggggtactcgcgctgcatttattggaggctttagtgcaacgagtaatgtccgtgcaggcaaattatttggtattcctgtctcaggaacccatgcgcactcgatgattcaggcgtatcgagatgaatataaagcgtttatgaagtacgccgaacgacacaaagactgtgtgtttcttgttgatacatacgatacattacgttcaggagttccgaacgctattaaagctgcaaaagagctaggggatagtattaatttccaaggaatacgattagacagcggagatttagcttatttatcaaaagaagcaagaagaatgcttgatgaagctggttttccagatgcaaaaatttatgcatcgaatgatttagatgaatatacgattgcaagtcttctcgcacagggagcgaagattgatgtgtggggaattggaacaaagctgattactgcgtatgatcaacctgcactaggtgcagtatataaacttgtgtctattgaagatgaaaatggggatatgaaagataccattaaattatcaggaaatccagaaaaaatgacaacacctgctatgaaaaaggtttaccgaattataaataaggaaaatcaacatagtgaaggagattatctcacgctggaaaatgagtatccaaatgaacaagaagaagtgatgttattccatccggtgcatacttactataaaaagtttgtttctaattttgaagctgtaaatctccatcatgatattttcattgatggacaacttgtttatgaatgtcctgatttggcagagattcaattatttactgaaaatcaacttaatttattctgggacgagtataaaagaacaaactatccggctgagtatccggtcgatttaagtgaagcattatggaataataagatgaatcatattgaacgagtgaaacaagcagtaaaagataaaattaataaacgataa

SEQ ID NO: 13964 - protein, 487 aa, Oceanobacillus iheyensis HTE831
MNYIDDSLALHTDLYQINMAETYWNDDVHNRKAVFDLYFRSLPFGNGYGVYAGLERIIEYMNNFRFTDADLTYLKEIGYQDDFIEYLKSIRFTGTIKSMKEGEIVFANEPILRVEASLAEAQLLETALLNIVNYQTLIATKASRIRQLVGDQLVMEFGTRRAQEMDAAVWGTRAAFIGGFSATSNVRAGKLFGIPVSGTHAHSMIQAYRDEYKAFMKYAERHKDCVFLVDTYDTLRSGVPNAIKAAKELGDSINFQGIRLDSGDLAYLSKEARRMLDEAGFPDAKIYASNDLDEYTIASLLAQGAKIDVWGIGTKLITAYDQPALGAVYKLVSIEDENGDMKDTIKLSGNPEKMTTPAMKKVYRIINKENQHSEGDYLTLENEYPNEQEEVMLFHPVHTYYKKFVSNFEAVNLHHDIFIDGQLVYECPDLAEIQLFTENQLNLFWDEYKRTNYPAEYPVDLSEALWNNKMNHIERVKQAVKDKINKR

SEQ ID NO: 13965 - DNA, 1209 bp, Pseudomonas putida KT2440
  CDS (1)..(1209): transl_table=11
ttgatgagcgaaagcgcattcgccgagcgcatcgtgcacaacctgctcgacaccgacttctacaaactcaccatgatgcagggtgtgctgcacaactacccggacgccgacgtcgaatgggaattccgctgccgcaacggtgaggacctgcgcccctacctcggcgaaattcgcaatcagctcgaacggcttgccgacctcaccctggacgatggccagctggccttcctcgaacgcatcagcttcctcaagcccgactttttacgctttctgcgcctgttccgcttcaatctgcgttacgtgcacgtcggcatcgaaaatgatcagctgttcctgcgcctgaaaggtccgtggctgcatgtgatcctgttcgaagtgccgctgctggccatcatcagcgaagtacgcaaccgcaatctgcacccgcacatgcgcctggccgaggcgcgggaccagttgtaccgcaagttcgactggctgcgtgcgcatgccagcgacgacgagctggccgaactgcaggtggccgacttcggcacccgccggcgcttttccagccgcgtgcaggaggaagtggcaagggtgctgcgcgacgacttccccggccgttttgtcggcaccagcaacgtcgacctggcatggaaactggatatcaagccgctgggcaccatggcccacgagtggatcatggcccaccagcagctcggcccacggctgatcgacagccagatcgctgcgctggactgctgggtacgcgagtaccgcggcctgctcggcatcgccctgaccgactgcatcaccatggatgccttcctcggcgatttcgacctgtacttcgccaagctgttcgacggcctgcgccatgattcgggcgagccggtagcctgggcggagaaggccattgcccattaccagaaactgggtatcgacccgatgaccaagacgctggtgttttccgacggcctcaacctgacccgctcgctggaaattttccgcgccctgcgcggacgcatcaacgtcagctttggcatcggcaccaacctgacctgcgacatcccaggtgtggcccccatgaacatcgtgcttaaaatgaccgactgcaacggcgcgccggtggccaagatctctgacgaagccgccaagacccagtgccgcgacgagaacttcgtcgcctacatgcgtcacgtattcaaagtccccagcaaggagtaa

SEQ ID NO: 13966 - protein, 402 aa, Pseudomonas putida KT2440
MMSESAFAERIVHNLLDTDFYKLTMMQGVLHNYPDADVEWEFRCRNGEDLRPYLGEIRNQLERLADLTLDDGQLAFLERISFLKPDFLRFLRLFRFNLRYVHVGIENDQLFLRLKGPWLHVILFEVPLLAIISEVRNRNLHPHMRLAEARDQLYRKFDWLRAHASDDELAELQVADFGTRRRFSSRVQEEVARVLRDDFPGRFVGTSNVDLAWKLDIKPLGTMAHEWIMAHQQLGPRLIDSQIAALDCWVREYRGLLGIALTDCITMDAFLGDFDLYFAKLFDGLRHDSGEPVAWAEKAIAHYQKLGIDPMTKTLVFSDGLNLTRSLEIFRALRGRINVSFGIGTNLTCDIPGVAPMNIVLKMTDCNGAPVAKISDEAAKTQCRDENFVAYMRHVFKVPSKE

SEQ ID NO: 13967 - DNA, 1305 bp, Bradyrhizobium japonicum USDA 110
  CDS (1)..(1305)
atgacagtgaccgatattgcgagccggacctacaatcacagctggcggctggatcccatcatccgcagcctgctcgataccgacttttataagctattgatgttacagatgattcgggaagattactcgaatcagcaggtgaccttctcggtcatcaaccgctcgcgccatgtgcggctcgccgagatcatcgacgagggcgagctgcgcgcccagctcgaccacgcccgcaccatccgcttcaccaagaaggagctgatctggctcgccggtaacaccttctacggcaagacccacatgttctcggcggatttcatccgctggctggccgaattccgcctgcccgaatacgagctgcgcaaggtcgaggggcagtacgaattgcacttccacgggccgtggacccacaccacgatgtgggagattccggcgctcgcgattctcaacgagctgcgctcgcgcgcggcgatcaagggccgcggccgcttcgagctcgacgtgctctacgcccgcgccaaggccaagctgtggaccaaggtcgagcggctgcgcaagctcgagaacctgaggctctccgacttcggcacccgccggcgtcacggctttctctggcagcgctggtgcgtcgaggcggtgaaggaaggcctcggcccctccttcatcggcacctccaacgtgctgctcgcgatggacaacgacctcgaggccatcggcaccaacgcgcacgagctgccgatggtcgcggccgggctcgccaaggacgacgaggagttgcgctgggcgccctatcgcattctcgaccagtggcgtcagacctacggcggcaacctcctgatcgcactgcccgacgccttcggtacgaaagcgttcctacgcgatgcgccggaatgggtcgccgactggaccggcttccgccccgacagcgcgccgccaatccaggccggcgaggagatcatcgcctggtgggagaagaagggccgcaacccgagggacaagctgctcgtcttttccgacgcgatggacgtcggctcgatcgaggagacctatcaccacttcaccggccgcgtgcggctctctttcggctggggcaccaacctcaccaacgacttcgtcggctgcgccccggacggctcgttcaatctcgatccgatctcgctggtctgcaaggtgtcgtcggtcgacggccatccggcggtcaagctctccgacaatccggagaaggcaaccggcctcccctcggagatcgagcgttacctgcgcgtgttcggcgacgtcggccgcgtgcgcaagccggtgctggtctag

SEQ ID NO: 13968 - protein, 434 aa, Bradyrhizobium japonicum USDA 110
MTVTDIASRTYNHSWRLDPIIRSLLDTDFYKLLMLQMIREDYSNQQVTFSVINRSRHVRLAEIIDEGELRAQLDHARTIRFTKKELIWLAGNTFYGKTHMFSADFIRWLAEFRLPEYELRKVEGQYELHFHGPWTHTTMWEIPALAILNELRSRAAIKGRGRFELDVLYARAKAKLWTKVERLRKLENLRLSDFGTRRRHGFLWQRWCVEAVKEGLGPSFIGTSNVLLAMDNDLEAIGTNAHELPMVAAGLAKDDEELRWAPYRILDQWRQTYGGNLLIALPDAFGTKAFLRDAPEWVADWTGFRPDSAPPIQAGEEIIAWWEKKGRNPRDKLLVFSDAMDVGSIEETYHHFTGRVRLSFGWGTNLTNDFVGCAPDGSFNLDPISLVCKVSSVDGHPAVKLSDNPEKATGLPSEIERYLRVFGDVGRVRKPVLV

SEQ ID NO: 13969 - DNA, 1434 bp, Lactobacillus plantarum WCFS1
  CDS (1)..(1434): transl_table=11
atgcgcaatttatctttattaaccgacttatacgaactctcaatggcaaatggatttcatcacgacttacctcagaccaacgccaccttcgaccttttttatcgccgggttcctgacaatggtagctttgtcattgcggccggcctccagcaagttgtcgaagctttacaagattttcattttaccaacagtgacctcgactacttccgtcaacttaacctatgggatgaatccttcttagccatgctggcaaattttaagttaacttgtcaaattaaggcactaccagaaggaaccccggtctttcctcgtgaaccactattgacaatcactgggccacttgagcaagcgcaattacttgaaacactcgccttaaatatcgtcaatcaccaatcactgattgccactaaagctcgtcgactgagttatgctgcggcaggacgtccaattatggaattcggtgcgcgccgtgcgcaaggcccggacagcgcgctttacggcacccgggcagccattattggtggcgccaatagtacttcaaacgttctcgctgcgaagctgtttgatattcccgttgctggtaccatggcccacagttggattgaggccttcccggatgaactaacggcgtttcgcaagtgggccgaacaatatcctgacaatagtgcgctactagtcgatacttatgatgtgcttaactctgggattcctaacgcggtgacggtctttaaggagctacgagcagctgggcatgaacccgtcggtattcgaatcgattcgggggacgtcacgactttatcacaagctgcccggacacaattggacgcggctggctttcccaatgccaaaatcactatttctaacgcattggatgaacacatcattacttcgctgttgcacgaaggcgcaccgatcgataattttggtatcggtgaaaagctcatcactagcgcgtccgcaccggttctaagtggcgtctacaagcttgcggcaactgagagcaatggtcagagcacccccaagatcaaggtcagtgccagtcgcgaaaaactaacgattcctggtgataagcaagtctatcgtctgtacgaaccaggaactcagcgggcctttgctgacttgattgcactagctaccgagacgatcgtcgatgcgaccagcctaaccgtcgtcaacagtgacccactcagtgtcgaccgccaacagcgactcacccgttttgaagcccggcccttactcgcgccggtagatttgtccaacaccacgtcaattccggttacaaccattcaggcaacgacccaggctaaacttgccgagctcccacgaacaacccagcggctcgtcaacccagatctttacccggtctacatgacaaccacactcagccagttacaaactagtttgttgaataaaatgacgatactagcagattaa

SEQ ID NO: 13970 - protein, 477 aa, Lactobacillus plantarum WCFS1
MRNLSLLTDLYELSMANGFHHDLPQTNATFDLFYRRVPDNGSFVIAAGLQQVVEALQDFHFTNSDLDYFRQLNLWDESFLAMLANFKLTCQIKALPEGTPVFPREPLLTITGPLEQAQLLETLALNIVNHQSLIATKARRLSYAAAGRPIMEFGARRAQGPDSALYGTRAAIIGGANSTSNVLAAKLFDIPVAGTMAHSWIEAFPDELTAFRKWAEQYPDNSALLVDTYDVLNSGIPNAVTVFKELRAAGHEPVGIRIDSGDVTTLSQAARTQLDAAGFPNAKITISNALDEHIITSLLHEGAPIDNFGIGEKLITSASAPVLSGVYKLAATESNGQSTPKIKVSASREKLTIPGDKQVYRLYEPGTQRAFADLIALATETIVDATSLTVVNSDPLSVDRQQRLTRFEARPLLAPVDLSNTTSIPVTTIQATTQAKLAELPRTTQRLVNPDLYPVYMTTTLSQLQTSLLNKMTILAD

SEQ ID NO: 13971 - DNA, 1203 bp, Salmonella enterica subsp. enterica serovar Typhi Ty2
  CDS (1)..(1203): transl_table=11
atgacacaattcgcttctcctgttctgcactcgttgctggatacagatgcttataagttgcatatgcagcaagccgtttttcaccactactatgatgtgcaggtagcggctgagtttcgttgccgtggcgacgacctgctgggtatttatgccgatgctattcgcgagcaggtggacgcgatgcagcacctgcgcctccaggaggacgagttccagtggctctccggcctgcccttttttaaaccggattatctgaactggttacgcgagtttcgctataacccagctcaagtctgtgtcaccaacgataacggcaagctgaatattcgcttaaccggctcgtggcgtgaagtcattatgtgggaagtgccgctgctggccgtgatcagtgagctggttcatcactaccgctcgccaaacgcgggcgttgatcaggcgctcgacgcgctggaaagtaagctggttgatttcactgcgttaaccgccaatctcgatatgtcccgcttccacctgatggacttcggcacccgccgccgtttctctcgtgaagtgcagcaggcgatagttaaacgtctccagcaggagtcatggttcgtcggcaccagcaactatgatctcgcgcgtcgcctggcgctgacgccgatgggcactcaggcgcacgaatggttccaggcgcatcaacaaatcaatccggacctggcgaccagtcagcgtgccgcgttggccgcctggcttaacgaatatccggaccagcttggtatcgcattgacagattgcattacaatggatgcgtttttacgcgatttcggcattgaattcgccagccgttatcaggggttacgccacgactcaggagaccctgtcgcatggggcgaaaaggcgattgcccattatgaaaagctggggattgatccgctgacaaaaacgctggtcttttcagataaccttgatctgccaaaggcggtcgagctctatcgccatttcgcctctcgcgtgcagttaagcttcggcatcggtacccgactgacctgcgatatccctcaggtaaaaccgctcaatatcgtgattaagctcgtggaatgtaacggaaagccggtggctaaactttccgacagccccggtaaaacgatctgtcatgataaagcgtttgtgcgcgcgctgcgtaaagcgttcgatctcccgcaggtgcgtaaagcaagttaa

SEQ ID NO: 13972 - protein, 400 aa, Salmonella enterica subsp. enterica serovar Typhi Ty2
MTQFASPVLHSLLDTDAYKLHMQQAVFHHYYDVQVAAEFRCRGDDLLGIYADAIREQVDAMQHLRLQEDEFQWLSGLPFFKPDYLNWLREFRYNPAQVCVTNDNGKLNIRLTGSWREVIMWEVPLLAVISELVHHYRSPNAGVDQALDALESKLVDFTALTANLDMSRFHLMDFGTRRRFSREVQQAIVKRLQQESWFVGTSNYDLARRLALTPMGTQAHEWFQAHQQINPDLATSQRAALAAWLNEYPDQLGIALTDCITMDAFLRDFGIEFASRYQGLRHDSGDPVAWGEKAIAHYEKLGIDPLTKTLVFSDNLDLPKAVELYRHFASRVQLSFGIGTRLTCDIPQVKPLNIVIKLVECNGKPVAKLSDSPGKTICHDKAFVRALRKAFDLPQVRKAS

SEQ ID NO: 13973 - DNA, 1170 bp, Bacteroides thetaiotaomicron VPI-5482
  CDS (1)..(1170): transl_table=11
atgattgtaagaacactactggatacagacctctataagtttaccacctcgtacgcttatatcaaattattcccttacgcaatgggcactttcagtttcaacgacagaaacgaaactgaatataccgaagagtttctggaagcgctcaaaagcgaattcaacaaactcagccggttgagacttacggaagaggaactggaatacatgacacgcaattgccggtttcttcctagagtctattgggaatggctgtcttctttccgttttgatccggacaagatcgatattcatctggacacaacgggccggctgcatattgaagtcagcgattttctttataaagtcacactgtatgaagtaccgctgctcgccatcgtatccgaaatcaaaaacaagtttttcggcaatgtacccgatatgagcgagatactctgcaaattgtcggagaaagtggaattgtccaatcagcaccagctccgcttctcggagttcggcacgcggagaagattctcaatcgacgtgcaggagacggtgatcaaacggctgaatgatacggccaaatactgtaccggaacttccaactgctattttgccatgaagtacggcatgaaaatgatgggaactcatccgcatgagtggttcatgtttcatggggcacagttcggatataagcacgccaactatatggcgctcgaaaactgggtgaatgtatatgacggagatttgggcattgcgctgtccgacacttatacttcaggaatattcctgagcaatctcagccgcaagcaggccaagctattcgacggagtgcgctgcgattccggcaatgagtttgattttatcgataagctggtagcccgctataaagaactgggcattgatgccactaccaaaacaatcgtcttcagcaacgctctcgacttcacgaaggcactggaaattcaggaatactgcaaggacaagattcgctgttccttcggaatcggtaccaatcttacgaatgatacaggatttgccccttccaacattgtcatgaaactcacgcaatgcaaaatgaatgtcaatcaggaatggagagaatgcatcaaactatcggatgacgagggaaaacatacaggcagtccggaggaagtacaggcttgtctatacgaactgaggctggcgaaataa

SEQ ID NO: 13974 - protein, 389 aa, Bacteroides thetaiotaomicron VPI-5482
MIVRTLLDTDLYKFTTSYAYIKLFPYAMGTFSFNDRNETEYTEEFLEALKSEFNKLSRLRLTEEELEYMTRNCRFLPRVYWEWLSSFRFDPDKIDIHLDTTGRLHIEVSDFLYKVTLYEVPLLAIVSEIKNKFFGNVPDMSEILCKLSEKVELSNQHQLRFSEFGTRRRFSIDVQETVIKRLNDTAKYCTGTSNCYFAMKYGMKMMGTHPHEWFMFHGAQFGYKHANYMALENWVNVYDGDLGIALSDTYTSGIFLSNLSRKQAKLFDGVRCDSGNEFDFIDKLVARYKELGIDATTKTIVFSNALDFTKALEIQEYCKDKIRCSFGIGTNLTNDTGFAPSNIVMKLTQCKMNVNQEWRECIKLSDDEGKHTGSPEEVQACLYELRLAK

SEQ ID NO: 13975 - DNA, 1407 bp, Coxiella burnetii RSA 493
  CDS (1)..(1407): transl_table=11
atgtttcacttaacaggcacttacactgatcaataccaactggcgatgggacaagtttatttcctgaaggggaaaaaaaatcacccagctgtcttcgattatttctttcgaaaattgccgtttggagggggctacgctattttcgcgggcttggaggatctacttgctatccttgaaaatcttcgttttaatgaaaaagatattgaatttcttcaccgtcaaggcttccatccggaatttctcaattatcttagggattttcgcttcaccggcaccctttatgcctcccgcgaaggcgatgtggtgtttccaacgcgacccatcttgagtgtagaagctcctttgattgaagctcagattgtggaaacgttgctattaaatatcttgaatttccaaacgctaatcgccaccaaagccagccgaatgcgccaggttgccgaagagcgcgccttagttgattttggatttcgtagagccgcggggcttgcaagctactatgccagccgcgctgctgttattggcggtttcgatgcgacaagccatgtagccgcaggaagagactacgacattcccgtcgtagggacaatggcgcactcgtttgtccaaagttatgatgatgaattatccgctttccgcgattttgccgaggggcggcccgatgattgcgttttgctggtggacacctacgatacgctgaaaagtggtatgccaaacgcgatcaagatcgccaaagcgatggaagcgcgcggccaaagactcaagggggtacggctggacagcggcgatttagcttatctggctaagaaaagccgccaaatgttagatgacgcaggattatcttacgtaaaaattgctgcttctaaccagttagacgaatacgttattaaaagtttgttagaacaaaaagcgcccatcgacatatttggcgtaggaaccaaactcgctatcggagcgcctgacgctgcgctagatggggtctataaattagcgatgagcaatctcaagcctcgcataaagctttcagaaagcattgcgaaaataacacttccttacaaaaaacaagtttatcgtgtcatcgatcagaagggcgattttttcggcgctgatgtggtggctttacgcgaagaagaagaaataaatattatgcaccactcttttgaactttctaaatctttcgtcattaaaaagaataagaaagaaccattgctgaataaagtaatggaaaaaggcaaacgcctttttgaggcgaaaaagccgttggaaataatgaaatttagccagcagcgtttgggtttcttgcctttagaatacaaacgttttaataatcctcatatttataaaatcggtttaagcgatggactgaataacaaacgaaaccaattaatagaagcttataaaaaaacatga

SEQ ID NO: 13976 - protein, 468 aa, Coxiella burnetii RSA 493
MFHLTGTYTDQYQLAMGQVYFLKGKKNHPAVFDYFFRKLPFGGGYAIFAGLEDLLAILENLRFNEKDIEFLHRQGFHPEFLNYLRDFRFTGTLYASREGDVVFPTRPILSVEAPLIEAQIVETLLLNILNFQTLIATKASRMRQVAEERALVDFGFRRAAGLASYYASRAAVIGGFDATSHVAAGRDYDIPVVGTMAHSFVQSYDDELSAFRDFAEGRPDDCVLLVDTYDTLKSGMPNAIKIAKAMEARGQRLKGVRLDSGDLAYLAKKSRQMLDDAGLSYVKIAASNQLDEYVIKSLLEQKAPIDIFGVGTKLAIGAPDAALDGVYKLAMSNLKPRIKLSESIAKITLPYKKQVYRVIDQKGDFFGADVVALREEEEINIMHHSFELSKSFVIKKNKKEPLLNKVMEKGKRLFEAKKPLEIMKFSQQRLGFLPLEYKRFNNPHIYKIGLSDGLNNKRNQLIEAYKKT

SEQ ID NO: 13977 - DNA, 1185 bp, Porphyromonas gingivalis W83
  CDS (1)..(1185): transl_table=11
atgggtattatccggagcatattagacaccgatctatataaattcaccaccggctatgcctatgccaagctattccccagagcttatggcgaatttcgcttcatagaccgtaatcggcagggctttacggaagaatttgcggagctggtgcgaggtgaaatacgagcgatggctgctctgtctttgactcgtgatgaaaaagagtttctccaacgagagcttccttatcttccaccgatatatatcgattttctcgatggcttccgtttcgatccggaagaagttacagtatcgatagacgcacaaggccacttggatatacgagcgcaaggccttctctaccgagtgacactttgggagacgcctatccttgccgtcatcagcgagctgtactatcgttttattggagccgagccggattggaaacaagtagaagaggtaactcgatctaaaggggagctgatgcgagagcatcgagctacgttctcgatattcggtatgcggcggcgtttctcccttgaagtggaagaccgtgtgacggatattctcaagcagtatgcaggtgagagtctctttggtacgagcaacgtacaccttgcccataagcatgggctacgtgtttccggcacacatccacacgaatggatacaattccatggagctatttacggctataagatggccaattatgtagccatggaggattggatcaatgtctatgacggtgatcttggcactgtgctgaccgatacgtacacgactgatgtcttcatgcgcaatttcagtaagaagcatgccatgctctttaccagtctgagacatgacagtggtgatcccgagatattcatagaaaaagcagtgcgacgatacgaagagctgcgagtggatcccaaaatcaagtacattatattctctgacagcctcactcctcagcgagctatagagattcaaaagttgtgcgccggcaggattaaggccagctttggaatcggtaccaatctgaccaatgatgtgggggggggcgtagagccgttgaatatcgtaatgaagctctggaagtgcaagatgacggcgaaagacgactggcactactgtgtaaagctgagcgacgtcgatggtaagcatacgggagagccggaagaaatccttttggcgatgaatacactgggtatcaaaccgaaataa

SEQ ID NO: 13978 - protein, 394 aa, Porphyromonas gingivalis W83
MGIIRSILDTDLYKFTTGYAYAKLFPRAYGEFRFIDRNRQGFTEEFAELVRGEIRAMAALSLTRDEKEFLQRELPYLPPIYIDFLDGFRFDPEEVTVSIDAQGHLDIRAQGLLYRVTLWETPILAVISELYYRFIGAEPDWKQVEEVTRSKGELMREHRATFSIFGMRRRFSLEVEDRVTDILKQYAGESLFGTSNVHLAHKHGLRVSGTHPHEWIQFHGAIYGYKMANYVAMEDWINVYDGDLGTVLTDTYTTDVFMRNFSKKHAMLFTSLRHDSGDPEIFIEKAVRRYEELRVDPKIKYIIFSDSLTPQRAIEIQKLCAGRIKASFGIGTNLTNDVGGGVEPLNIVMKLWKCKMTAKDDWHYCVKLSDVDGKHTGEPEEILLAMNTLGIKPK

SEQ ID NO: 13979 - DNA, 1608 bp, Oryza sativa (japonica cultivar-group)
  CDS (1)..(1608)
atggcggcggtggcgggtagcgcgagcgcaggcgccaacggttcggcggcggcgcatcgggtgggggcgccgacgaaccccatggcgacggcgctgctcaccgatcagtaccagttctccatggcctacgcctactggaaggccggcaagcacgccgaccgagccgtgtttgatctgtacttcaggaaaaatccatttggtggagaattcactgtttttgctggtcttgaagaatgcattaagttcattgcaaattttaagttcacagaagatgacattttgttcctgcaatcagtcatgccaatgtgtgaggatgcgttctttgattatctcaggaaaaccgactgctctgatgtggaagtgtactccattcctgagggttcagtggtttttccaaaagttcctttgatgcgagttgagggtccagttgctgtggtccaactacttgagacaccgtttgtaaatcttatcaattatgcctctttggtaacaacaaatgctgcgagacaccgccatgttgctggaaaatcaaaagttttactggaatttggtttgagacgagcacaggggcctgacggtgcaataagtgcttcaaagtattgtttcatgggaggttttgatgcaaccagtaatgttttggctggaaatctgtttggcataccacttcgcggaacacattctcatgcttatgttagctcatatatgttagcagaatcgttatgtggggtatttggtgagacaaatcaaagtgagctggcagcatttgcatcctatgcattgggttttccgacccattttttagctcttgtggacacatatgatgttatgcgaagtggaattccaaacttttgtgcagtagcgctagcactccatgacttagggtacaaggcatctggtattagattagattctggtgatctggcctatttgtctattgaggcccgtaaagtgttccgtacactagaaaaggagtttaatgtgcccgcttttgggaagatgataattactgctagcaatgacctgaatgaggaaacaattgatgccctgaacaagcagggccatgaagttgattcctttggtattggaacttatctagtaacatgttattcccaggctgctcttggctgtgtctttaagctagttgagataaacagtagacctcgtatcaaactttctgaggatgtggctaaatgtcatgatgggttccaggtatccattccatgcaaaaagcgatgtttcagattgtatggaaaagaaggctaccccttagtagatatcatgatgcgtgaaagtgaaccatcaccgaaggctggagaacgaatcctttgtcgtcatccattccttgaatccaagagagcatatgttgtcccccagcatgttgaggagctcctacaatgctactggcctggtacatcaaataaacctagggtagagttaccctctctagaggagatcagagggcgctgcatgcaacagcttgaaaaacttcgaccagatcacatcaggcggttaaatccaacaccttacaaggtgagtgtgagtgcaaagctgtatgagtttatccattccctatggttgaatgaggccccagtaggagagttacaatag

SEQ ID NO: 13980 - protein, 535 aa, Oryza sativa (japonica cultivar-group)
MAAVAGSASAGANGSAAAHRVGAPTNPMATALLTDQYQFSMAYAYWKAGKHADRAVFDLYFRKNPFGGEFTVFAGLEECIKFIANFKFTEDDILFLQSVMPMCEDAFFDYLRKTDCSDVEVYSIPEGSVVFPKVPLMRVEGPVAVVQLLETPFVNLINYASLVTTNAARHRHVAGKSKVLLEFGLRRAQGPDGAISASKYCFMGGFDATSNVLAGNLFGIPLRGTHSHAYVSSYMLAESLCGVFGETNQSELAAFASYALGFPTHFLALVDTYDVMRSGIPNFCAVALALHDLGYKASGIRLDSGDLAYLSIEARKVFRTLEKEFNVPAFGKMIITASNDLNEETIDALNKQGHEVDSFGIGTYLVTCYSQAALGCVFKLVEINSRPRIKLSEDVAKCHDGFQVSIPCKKRCFRLYGKEGYPLVDIMMRESEPSPKAGERILCRHPFLESKRAYVVPQHVEELLQCYWPGTSNKPRVELPSLEEIRGRCMQQLEKLRPDHIRRLNPTPYKVSVSAKLYEFIHSLWLNEAPVGELQ

SEQ ID NO: 13981 - DNA, 1446 bp, Geobacter sulfurreducens PCA
  CDS (1)..(1446): transl_table=11
atgcgctactccccccttctcaccgacctctatcagctgaccatgctcgccggctacctggacgaaggcatggcggagactccggcagtctttgatctcttttttcgccacaaccctttccagggtggctatgcagtcttcgccggactcgacacggccctcgactttctcgaacacctcgagttcagcgaagacgagatcgagtatctccaggggctcggtctcttccggccggcgttcatcgattttctccgttcgttccgtttcaggggaagggtaacggcccctcccgaaggaacggtggtcttcgccaatgagccgctggtcacggtggatgcgcccctggcccaggcccaactggtggaaaccgcgctcctcaatatcatcaacttccagacgctcgtggccacgaaggccgcccggatcgttcacgcggcagcggacggaaccgttctcgagttcggccttcgacgcgcccagggccccgacggcggcctgagcgaagccagggctgcctacgtgggaggggtacgcagcaccagcaacgtcctggcgggcaagaccttcggcatcccggtgcgcggcactcacgcccacagctggatcatggccttttccgacgaattgacggcgttcaggaaatacgctgaggtcttccccgactcctgcattctcctggtggatacctatgacactctcaggagcggcctgcccaacgcaatcaccgttgcgcgggagttgcgggccaagggacacgaattggtcggggtacggatcgactcgggcgatctggcctacctctcgcgccaggcacggcggctgttcgacgaagcggggttccccaatgtccggatcgtcgcctccaatgagctggacgaattcgtcatcgagtcgatccgggccgaagggggatgtgtcgacatctacggcgtgggaacccggctcgccacctgtgccggggagggaggaggcgccctgggaggtgtctacaaactggtccggatcggcgatcgaccgcggctcaaggtgacgagtgacctggcaaaggcgaccctgcctgaccggaagcggctcctgcgggccgtggcggccgacggcaccttcatccaggacgtgatctgcctggatggcgaagaggtgcttcccggccatacggtctttgatccggccaatcctctgcagcatgtgaccatcccgatgaaggcccgccttgaagacgtccgttccgttgccatggagaacggcaggcggaccgcctcacgatccgtttcactcgaccggatggccgatcggtcacggaatcaactcgccctcctcccgcagggatgccttcggttcatcaacccgcaccgctacaaggtttccatcagccaagggctcaatgacctgcgacttcgcctcatggaggaggtgcggcacgggtatcacgacattgccaatccgtaa

SEQ ID NO: 13982 - protein, 481 aa, Geobacter sulfurreducens PCA
MRYSPLLTDLYQLTMLAGYLDEGMAETPAVFDLFFRHNPFQGGYAVFAGLDTALDFLEHLEFSEDEIEYLQGLGLFRPAFIDFLRSFRFRGRVTAPPEGTVVFANEPLVTVDAPLAQAQLVETALLNIINFQTLVATKAARIVHAAADGTVLEFGLRRAQGPDGGLSEARAAYVGGVRSTSNVLAGKTFGIPVRGTHAHSWIMAFSDELTAFRKYAEVFPDSCILLVDTYDTLRSGLPNAITVARELRAKGHELVGVRIDSGDLAYLSRQARRLFDEAGFPNVRIVASNELDEFVIESIRAEGGCVDIYGVGTRLATCAGEGGGALGGVYKLVRIGDRPRLKVTSDLAKATLPDRKRLLRAVAADGTFIQDVICLDGEEVLPGHTVFDPANPLQHVTIPMKARLEDVRSVAMENGRRTASRSVSLDRMADRSRNQLALLPQGCLRFINPHRYKVSISQGLNDLRLRLMEEVRHGYHDIANP

SEQ ID NO: 13983 - DNA, 1437 bp, Treponema denticola ATCC 35405
  CDS (1)..(1437): transl_table=11
atgattgataatgctttattttcagacttttatgaattgacaatggctcaaggtttttggaaaaaaggaaacaatacaaaaaccgtttttgaaatgttttttagatcaaatccttttaaggggggctattccgtctttgcaggccttgaacccctcttaaaaaccattcaaaattttcactttgaaaaaagcgatatcgactggcttaagtctttaggaatatttgaaaaagattttttggaatatattgccggttttaaattctcgggcaatatttgggcaatgaaagaaggcagtctcgttttcccgaatgaacccttaatccgtatcgaagctgatacggttgaagccttgctcttggaaggcctaattttaaacatgataaatttccaaacccttatagcaaccaaaacagcccgaatttggctggcctcaaaaaagggatctataatggaattcggtctccgcagagctcaaggcaatgacggtgctatgagtgcaacaagagctgcctacataggcggagctttcggcacaagcaattcccttgctgccaaggaactcggcatacccgccctcggaacaatggctcactcatggataatgtcttttaaaagcgaagaagatgcctttcaggcctatgctgacatgtatcccgacaattcaatattcttaatagatacttatgatacgctccgttcgggtattgtaaatgctatcaaggtaggaaagcggctgcaagaaaaggggaaaaacttcggagtacgcctcgattcgggagatatttattatttgagtaaggatgtgcggaagcggcttgatgaagcaggttgtactaaagcaaagatttccgtttcaaacgaactgacggaagaaattgtagaatccctagttcaaaacaatgcacctatagattcttggggagtaggtactcacatggttacgggcggaaatgaagcatctcttacaggcgtatacaaaatggccgcccgcaagagtttaggagaagcggaatggactccggttatgaaattttctgataatccagcaaagatgactaaccctgcatgtaagcaggtttggcgcctatacaatcccgacggaacatttaaggccgatgtgttgacccttgaagacgaaaaaattgaagagggtgtggagcagactttttatcaccctgcaaacgattatcagaattttacctttacaccgacaaagattgaagctcttttagaaaaacgtattgaaaacggcaaggctgtcggcaaggctccaagtcttaaagaaatcaaagcctatgctgaaaaacagctcgacagtttggactacacttcaaagcgccttttaaaccctcacatatacaaggtttctttaagcgaaaagatgagggatttaaaacagcagctgataaaaaataaaccggtttttaaaaactga

SEQ ID NO: 13984 - protein, 478 aa, Treponema denticola ATCC 35405
MIDNALFSDFYELTMAQGFWKKGNNTKTVFEMFFRSNPFKGGYSVFAGLEPLLKTIQNFHFEKSDIDWLKSLGIFEKDFLEYIAGFKFSGNIWAMKEGSLVFPNEPLIRIEADTVEALLLEGLILNMINFQTLIATKTARIWLASKKGSIMEFGLRRAQGNDGAMSATRAAYIGGAFGTSNSLAAKELGIPALGTMAHSWIMSFKSEEDAFQAYADMYPDNSIFLIDTYDTLRSGIVNAIKVGKRLQEKGKNFGVRLDSGDIYYLSKDVRKRLDEAGCTKAKISVSNELTEEIVESLVQNNAPIDSWGVGTHMVTGGNEASLTGVYKMAARKSLGEAEWTPVMKFSDNPAKMTNPACKQVWRLYNPDGTFKADVLTLEDEKIEEGVEQTFYHPANDYQNFTFTPTKIEALLEKRIENGKAVGKAPSLKEIKAYAEKQLDSLDYTSKRLLNPHIYKVSLSEKMRDLKQQLIKNKPVFKN

SEQ ID NO: 13985 - DNA, 1293 bp, Eremothecium gossypii
  CDS (1)..(1293)
atgacgagcgaggaagctgcgattaagtcgctgttggacacagacatgtacaaactgacaatgcatgcggcggtttacgtgaatttcccagacaccgaggtcgtctacaagtacaccaatagatccgccggcctgagcttcaacaaggctgctattgtgtggctcgaggaccaggtgagcaagctggcaacactgcgcttcacggcggaggaggtggcataccttaaagagaccttgcctttcctgcctgcgcagtacatcgattacatctcgtcgccagagtgccgcatggaccctgccactcaggtgcagctcctgcacgagcagcgagagggcgaggagcgctatgacctgaacatcaccgtcaccggtctctggaaagacacgatcctctacgagatacacatgctggcgctcatctcggaggcgtacttcaagtttgtcgacacagactgggtgctcgacggccaggtcgagcaggcgtatcgcaaaacgcggctgctgttggacaacggcctggtcttctcggagttcggcacgcgccggcgccgctcgctgctcgtccaggacctcgtgctccagggcatcgccgaggccgtggcagatagcggtaccggcgacacgcagttcatcggcacctccaacgtctacttcgccaaaaagtacggcgtcaagcccgtcggcaccgtcgcgcacgagtggtacatgggcattgccgccctgacagacgactaccgcaacgccaacaaaaacgccatggacttctggctcaacaccttcggctccgaacaggcgggcctggtcctcaccgacaccttcggcaccgataccttcctgcccatgttccgcccgccctactccgacgtctacgacggcgtgcgccaggactctggcgacccggccgttttcaccgagaaggtcgcccaccactacctcaacgtcctgcactatccccgcttttcgaaggtcatctgctactcggactccctaaacccggagaaggccctgcagtacgccgaggtcgcacgcgcacacggcatgagagcctcctttggaatcggcacaaactttacaaacgacttccgcagacattctgcgcccgacgccaagagcgagccactaaatatcgtcttcaagctgcttactgtcaacggacgccccgccatcaagatctctgatgatcttgggaagaccatgggcgacccggaaaaggtcgaagaggtaaaaagagagctaggctatatagaaagaacgtgggagggcagcgatgaggcgcataggtggaaagactag

SEQ ID NO: 13986 - protein, 430 aa, Eremothecium gossypii
MTSEEAAIKSLLDTDMYKLTMHAAVYVNFPDTEVVYKYTNRSAGLSFNKAAIVWLEDQVSKLATLRFTAEEVAYLKETLPFLPAQYIDYISSPECRMDPATQVQLLHEQREGEERYDLNITVTGLWKDTILYEIHMLALISEAYFKFVDTDWVLDGQVEQAYRKTRLLLDNGLVFSEFGTRRRRSLLVQDLVLQGIAEAVADSGTGDTQFIGTSNVYFAKKYGVKPVGTVAHEWYMGIAALTDDYRNANKNAMDFWLNTFGSEQAGLVLTDTFGTDTFLPMFRPPYSDVYDGVRQDSGDPAVFTEKVAHHYLNVLHYPRFSKVICYSDSLNPEKALQYAEVARAHGMRASFGIGTNFTNDFRRHSAPDAKSEPLNIVFKLLTVNGRPAIKISDDLGKTMGDPEKVEEVKRELGYIERTWEGSDEAHRWKD

SEQ ID NO: 13987 - DNA, 1434 bp, Neurospora crassa
  CDS (1)..(1434)
atggacttcaacagctctttgcctcacccagcgggtgttatctcgttcctcgacaccgatctgtacaagttgacgatgcaatgcgccgttctcaaatacttcaaagacgtacccgtcacctactcgttcacaaaccgcactcccgagaagaagttgtcgcgcgaagccttcgtctggctcgaagaacaggttatgaagctcgggaatatcagcctatcccccgaggagctccagttcctcaagactcactgcccttacctaaccgaagagtatcttgattacctttccgagttccgccttcggccgcgagagcaggtcgccgtttccttccgccctgatggtgactcagatctcggtgatatccactatgatattaagggcaattgggccgagactattctctacgaaattccgcttctcgcactcacttcggaagcctacttcaagttcatggacacggactgggattatgatggccaggaagagaaggcctatgagaagggcatgcgcctgctcgaggctggttgcgtgttctcggaattcggaacccgccggcgccgcgactaccacacgcaagctttggtgtttaggggtctcaccaaggcggccaaggaagccgagaagagaggcctaaccggcaagctctccggcactagcaatgttcaccttgccatgcgcttcaacatcccacccgttggcaccgttgcgcacgagtggtttatgggtaacgccgccatccttggagattacaagtccgctacagaggaagccctttcccgctgggttggatgctacggccctggcgtcctcggcattgcgctcacagatacctttggaacccctgaattccttagggcgtttagcaagccaatgtcggcatctggagagcccgtaccacagccaagggatcgcaagatcagcacggccgatgccttcatctcggcagcgaaagatttcatcaaggacctccatcccgacaagacctatgcccaagttttcacgggtgtccgccaggattcgggagaccccaaggagtttgtcaagctcatgcgcaagttctatgatgaacagggcatcaaggacaaaaaggttattgtcttttccgactcgctggatattgacaggtgcttggagtacaaggaggttgctgaagcggccggcttccagccaacttttggtgtcggtacctactttaccaatgactttgtccacaaggctactggcaagaaatccacgcctctgaatattgtcatcaagctgagctcggctgccggaaatccagcagtcaagatcagtgacaacgtgggaaagaacacaggcgataaggcgacggtcgagaaggtcaagcgagagctcggatacgtcgaaaaggattggagcgagggtgatgagtcggcaagatggggtcacgatggtgatgctgccacggcatga

SEQ ID NO: 13988 - protein, 477 aa, Neurospora crassa
MDFNSSLPHPAGVISFLDTDLYKLTMQCAVLKYFKDVPVTYSFTNRTPEKKLSREAFVWLEEQVMKLGNISLSPEELQFLKTHCPYLTEEYLDYLSEFRLRPREQVAVSFRPDGDSDLGDIHYDIKGNWAETILYEIPLLALTSEAYFKFMDTDWDYDGQEEKAYEKGMRLLEAGCVFSEFGTRRRRDYHTQALVFRGLTKAAKEAEKRGLTGKLSGTSNVHLAMRFNIPPVGTVAHEWFMGNAAILGDYKSATEEALSRWVGCYGPGVLGIALTDTFGTPEFLRAFSKPMSASGEPVPQPRDRKISTADAFISAAKDFIKDLHPDKTYAQVFTGVRQDSGDPKEFVKLMRKFYDEQGIKDKKVIVFSDSLDIDRCLEYKEVAEAAGFQPTFGVGTYFTNDFVHKATGKKSTPLNIVIKLSSAAGNPAVKISDNVGKNTGDKATVEKVKRELGYVEKDWSEGDESARWGHDGDAATA

SEQ ID NO: 13989 - DNA, 5916 bp, Magnaporthe grisea 70-15
  CDS (1)..(5916)
atggacttcaatagcgactctccgtttccggagggagtcatctcctttttggatacggatttgtataaactcactatgcagtgtgcggtcctcaaatactacagcaacacttctgtcacatattcttttaccaaccggaccccggagaaaaggttgtctagaaaggcttaccagtggttgcaggatcagattaggaatgaggagtaccgcttcttgaaggacaactgcccatacctcggtactcagtatctagagttcctccaaaatttccggctcaatccgagggatcaagtcattgtgagttttgcgcccgtgggcaagcatgaaggggccgattcggatgtgggagacatcgacatccaaatcagtggaaaatgggtagataccatcctttacgagatcccaattctcgccctgacgtctgaggcctacttccgcttcatggataccgactgggactaccagggtcaagaggagctcgcctacgaaaagggcaaacgcatcctcgaggccggctgcatattgtcggaatttggcaccaggcgccggagggactaccacacccaagccttggtattccgcgggctggtgaaggcaagcaaggaagcccagaagcgcggtctctccggaaagctctccggcaccagcaatgtgcacctggcgatgcgcttcaacatggcccctgtcggcactgtcgcgcatgagtggtttatgggcatcgccgctattatcggcgactaccgcagcgcatcggaggaggcgctggcccgatgggtcggcgctttcggccccggcgtgctggctatcgcgttgaccgacacgttcggcacccccgagtttctcaagtcgttcagccggccggtgcgatggctggaggaggcgcactcggcggcagcgggcaacgaatcaaagacgtacgcgcaggtgtttgcgggggtgaggcaggactccggagacccgacgacgtttgtcaagcggatgcgggagttctacgaccaacagagaatcaaggagaagaagaccattgttttctcggactctcttgacatcgaccggtgcctggtatacaagcaggtgtcagaggctgcgggcttccagccgacttttggagtgggaaccttcttgacaaacgattttgttggcaagtcgactgggaagaagtcgacgccgctaaacattgtcatcaagctgagctctgcggatggcaagcctgcggtgaaattgagcgacaacattggaaagaacacgggcgatgcaaacaccgtcgagaaagtcaagcgtgaaattgggtacgaggagaaggactgggagggcggtgacgagacatcgagactaaatgggaatcgatacgatagaggtgcacatgccttgatggacctgagcgatcctgccgccaccagtcgcagtcgcagtgtcgtctacttcttcaagagtggaaccaccctctccgagatcccggaaagcccgcctgggcgctcagggcctatgaattctcaacggtcccacggcggcggtgcctttgaccgcgagcgcgatccccgcgaacgtgacctcgacgagcaccgacaccgtccacttacacaagaggaagccgccaatcgtgaccgtgagcgagacatcgatcgtgaacgcgagcgggaacacgccgaccggcagcagccacgcgaggcctacccgcccggagcacctcttcacagcaccgccggctcgataccgatccaccagcccgtagcctcgcgaatagcgggcgtcatccacagccctggtggtctcttgggtgcccacaacggcgcgcccggcggcctgcccttgggcgccccgacgacgcagttagctggtttcggcgggccgatccacagcgatcccgcaaggcagatgccgcctcaacccccgaaccagaacagcacgggtggccaacagcaccagatgtttgcgccgatccctcagcaagcgggagggcccaacggctccctgggacctgggggtagccctggatccgtctttggcggcccgctacagacagaaaatggtcgggcacctgttcagcaggcccctccgcccgctgttgttcctccagcacaaacaagctctgctgctgggctctcgcagcagggctcacagcctattttgaatgatgcgctcagctacctcgatcaagtcaaggctcaatttcatgaacaacccgatgtttataaccgattcctcgatatcatgaaagatttcaagagtcaaacaatcgacactcctggggtgatcaaccgagtttccgatctttttgctggacatccgaatctcatacagggttttaacacgttcttgccacccggttaccggatcgagtgcgggctggacaacaaccccaacagcataagggttactacaccttcaggttcgaccgtccattcaattggtgctggaagaggcgcactgccgcccgtggacggatctgcaggaccccctggtcagaacgctcagtatctcggtcccaacagccggccagggaactggcagcagtcagtacagcatagtattgagagtcctgaagcccagttcagcgcacctgcgcagccgggacctggtccatttggccctgtcggagctccaggggcccagttcgatggccacagccctgcgcatcaacagcgtgtcgtgagttcaggacagcagcctgcaggtcctggctctgggcttgtagcgggccctggctcggcgatgcctggccctatggccagaaatgtacaaaccccaacgccaggtgcgcagccggcttcgttgaatggaagttcttcgcagcaaggcggtcagcggggaccagtcgagttcaaccatgctataagttacgtcaacaagatcaagaaccgattccaggacaagcccgaaatctacaaacaatttcttgagatactgcagacgtaccagcgggaacagaagccgatccaggaggtgtatgctcaggttaccaccttgttccatacagccccagacctgctggaggacttcaaacagtttctccccgagtctgctgctcagacccgcacgtttggccaacgacccgccgaggatggcggccttttgaaccacatcaaccagatgccgcaagctacaaaccccgctagggaaggccccaaaatgcctcctgttggcaattttgccgttccggtcagtgccagcaaggacaacaagaagcgaccgcgcatagaaaagccacccgctgcaacgcctcaggctcaacagtcgccggctgttgggtccgcctctatcaacagcgcgaacaaacggacaaagaccacgcataagccttctggcgatggtccttctattgagccgtcgttgacgcccattgtgcctgaaccaatgagcccgtctgcgtcgacaagtgtctcccaggagaaggctctcaactaccttgagcgcatcaagaagcacattggaaacaggacaactctgcacgaatttttcaagcttatcaatctttacacccagggcctgatcgataagaacgtgctcgtccaaaaggctcaaatgataataggcgctaatgtcgaacttatgacatggttcaagaactttgttcggtacactggggatgatgagttggttgagaacaagcctgaaccacctactggccgtgtgtcactcagcaactgccgcggatacggcccaagttaccgactgctacgtaagcgagaacgactaaagccatgtagcggacgcgacgagctgtgtaattcagttctgaatgacgaatgggcttctcacccgacatgggcctcggaagatagtggattcgtggcccatcgaaagaacgcctttgaagaaggccttcatcggattgaagaagagcgtcacgactatgactttttcatcgaagccaatcagaagtgcatccagttgctagagccaattgcccagcagatgctgaccttgaatcctgccgacaggcagaacttcaggatgcccagtgggctgggaggccagagcacttcgatctacaagcgagtacttaagaaggtgtacggtgcagacaagggtgctgaagtagtcaatgacatgttccagcatcccttcaccgtggtacctatagtaatggctcgcctcaagcagaaagacgaggaatggaggtttagccagcgtgagtgggaaaaggtatggcaaagtcaaacaaaagccatgcatctgaagagtctggaccaccaaggaatccaggtcaagggtaacgacaagcggactctgtctgccaagcacctggttgatttgatcaagaccaagcacgaagagcaaaagcgacaacgggtcaacaaaggcaaagcgccaagggtccagcacctttggtcatttacggaccagggcgttctgctggatttgctccggttcatggttttgtacgcaatgaacagcgggcagcatgggtcttctgaaaaggacaggattctagagttcttcgagaactcggtgccacagttcttcggaatacttcctgagcaggtccgtcagcatctcggcgatatcgaccgcgatgctggcgaggaggaggctgatgacaacacgcctgctgaattgactaacggccgaagccgccggaatggcaagaaatcagacctccttcgtgggctcttggacccaggtcgcaacggcagcaagactaggagtcagcccgaggaaagcaacacatcggccagcaaggaaaccacgcctgatcagggctcgactaatgaggaggagatggccgatgcaccggatgatggttctgctaccgcagagaacgccaacaacgaaaggtggctgcaaaatcctccaaaggcaaccgtactgtctggttacaatcctctgagcgacggagacagcgaactcaaggccgacggactcttcccgcggccctggtacaatttcttctgcaatcagacgatatttgtcttcttcagcgtcttccagacattatacaagcgcttgaagacagtcaaggaaagcagggagagcgtgttggaggagatcaggcgagagagggcagacaagcctgccaagcagttgggcctggttcatgacgagatgaactactttgatggcgatcccgagacattctggccaaggacggttgagctgatcgaagatttcatcacgggtgaaatagacgagagcaggtgtcaggacgtcctacgccattactatctacagtgtggctggactttgtacaccattcaggacttgctcaaaaccttgtgccggcaagctctcgtttgcaacaactctgacaacaaggagaagacaccagatcttgtgcaacaattcctgactgccaagagtcaggaggagactagttatcaggttgagatcagtgcccgcaagtttgcggaaaagtgcatcaaggatggcgagatgtttatgattacttgggccccaagcagcaatgaggcaacagtacgctggttaccaaaggaggacacgaccttccatgcggaagaaatggaaccgacggatcgctggaagtactacatcgcctcctacatgcgagtcgacccgactgagggggtgcctaagctgcgtctccaaaagacggtgttagcacgcaacctgccatcctcagactcggactcggacgacggtgctgtccctaagccgctttcatacagtgaaggtcttggcctgcgaatctgcgtcaactcgtccaagatagtatacgagaaggagacgtccgagtacacaatctacaacatgacgtcgctctcagaggagaggcgtgcttttgatagggaccggcgagctcaactattccgcgaaaagctgattatgaacaacgcctggatgaaggatctgagccaagtcgaggtgcaaggaatgaacgaggatttccagcggtgggcaaaggacggcattgtaccaggcacctcatcaaccggcggtgctgggtcttctgcataa

SEQ ID NO: 13990 - protein, 1971 aa, Magnaporthe grisea 70-15
MDFNSDSPFPEGVISFLDTDLYKLTMQCAVLKYYSNTSVTYSFTNRTPEKRLSRKAYQWLQDQIRNEEYRFLKDNCPYLGTQYLEFLQNFRLNPRDQVIVSFAPVGKHEGADSDVGDIDIQISGKWVDTILYEIPILALTSEAYFRFMDTDWDYQGQEELAYEKGKRILEAGCILSEFGTRRRRDYHTQALVFRGLVKASKEAQKRGLSGKLSGTSNVHLAMRFNMAPVGTVAHEWFMGIAAIIGDYRSASEEALARWVGAFGPGVLAIALTDTFGTPEFLKSFSRPVRWLEEAHSAAAGNESKTYAQVFAGVRQDSGDPTTFVKRMREFYDQQRIKEKKTIVFSDSLDIDRCLVYKQVSEAAGFQPTFGVGTFLTNDFVGKSTGKKSTPLNIVIKLSSADGKPAVKLSDNIGKNTGDANTVEKVKREIGYEEKDWEGGDETSRLNGNRYDRGAHALMDLSDPAATSRSRSVVYFFKSGTTLSEIPESPPGRSGPMNSQRSHGGGAFDRERDPRERDLDEHRHRPLTQEEAANRDRERDIDREREREHADRQQPREAYPPGAPLHSTAGSIPIHQPVASRIAGVIHSPGGLLGAHNGAPGGLPLGAPTTQLAGFGGPIHSDPARQMPPQPPNQNSTGGQQHQMFAPIPQQAGGPNGSLGPGGSPGSVFGGPLQTENGRAPVQQAPPPAVVPPAQTSSAAGLSQQGSQPILNDALSYLDQVKAQFHEQPDVYNRFLDIMKDFKSQTIDTPGVINRVSDLFAGHPNLIQGFNTFLPPGYRIECGLDNNPNSIRVTTPSGSTVHSIGAGRGALPPVDGSAGPPGQNAQYLGPNSRPGNWQQSVQHSIESPEAQFSAPAQPGPGPFGPVGAPGAQFDGHSPAHQQRVVSSGQQPAGPGSGLVAGPGSAMPGPMARNVQTPTPGAQPASLNGSSSQQGGQRGPVEFNHAISYVNKIKNRFQDKPEIYKQFLEILQTYQREQKPIQEVYAQVTTLFHTAPDLLEDFKQFLPESAAQTRTFGQRPAEDGGLLNHINQMPQATNPAREGPKMPPVGNFAVPVSASKDNKKRPRIEKPPAATPQAQQSPAVGSASINSANKRTKTTHKPSGDGPSIEPSLTPIVPEPMSPSASTSVSQEKALNYLERIKKHIGNRTTLHEFFKLINLYTQGLIDKNVLVQKAQMIIGANVELMTWFKNFVRYTGDDELVENKPEPPTGRVSLSNCRGYGPSYRLLRKRERLKPCSGRDELCNSVLNDEWASHPTWASEDSGFVAHRKNAFEEGLHRIEEERHDYDFFIEANQKCIQLLEPIAQQMLTLNPADRQNFRMPSGLGGQSTSIYKRVLKKVYGADKGAEVVNDMFQHPFTVVPIVMARLKQKDEEWRFSQREWEKVWQSQTKAMHLKSLDHQGIQVKGNDKRTLSAKHLVDLIKTKHEEQKRQRVNKGKAPRVQHLWSFTDQGVLLDLLRFMVLYAMNSGQHGSSEKDRILEFFENSVPQFFGILPEQVRQHLGDIDRDAGEEEADDNTPAELTNGRSRRNGKKSDLLRGLLDPGRNGSKTRSQPEESNTSASKETTPDQGSTNEEEMADAPDDGSATAENANNERWLQNPPKATVLSGYNPLSDGDSELKADGLFPRPWYNFFCNQTIFVFFSVFQTLYKRLKTVKESRESVLEEIRRERADKPAKQLGLVHDEMNYFDGDPETFWPRTVELIEDFITGEIDESRCQDVLRHYYLQCGWTLYTIQDLLKTLCRQALVCNNSDNKEKTPDLVQQFLTAKSQEETSYQVEISARKFAEKCIKDGEMFMITWAPSSNEATVRWLPKEDTTFHAEEMEPTDRWKYYIASYMRVDPTEGVPKLRLQKTVLARNLPSSDSDSDDGAVPKPLSYSEGLGLRICVNSSKIVYEKETSEYTIYNMTSLSEERRAFDRDRRAQLFREKLIMNNAWMKDLSQVEVQGMNEDFQRWAKDGIVPGTSSTGGAGSSA

SEQ ID NO: 13991 - DNA, 1380 bp, Gibberella zeae PH-1
  CDS (1)..(1380)
atggttttcaacagctcttcgccctaccccgagggcgtcatctccttcctcgacaccgacctttacaagttgacgatgcaatgcgcggtcttcaagttcttcaaggatgtaccagtaacatatgcctacacgaaccgaacccccgacaagaagctgtcccgaactgctttcaagtggcttgaggagcagattggaaagctcggaaatatctcactctctaccgacgaatacctcttcctaaagaagcactgcgattacctctccgaagactacctcaacttcctcaaggagttccgcttgagcccccgagagcaagttgttgcgaccttcactcccgttggcgaggacactggagacgactcaattgttggagatgttgacattcagattaagggaacttgggtcgacacgattctctacgaaattcccatgcttgcgttgacctcggaggcatacttcaagtttatggacactgattggaactatgagggccaagagaagcaggcgttcgacaagggactccaattgctcgaggcaggatgcgtcacatccgagtttggcacacgacgacgtcgcgattaccacacccaggctcttgtcttcagaggtctggtccaggcttccaaggaagctgagaagaagggattccctggcaagctttctggaaccagtaacgtccatcttgctatgcgcttcaacattcctcctgtcggaacagtcgctcacgagtggttcatgggcgttgctgctattcttggtgactacaagcaagctactgaagtcgcactacgacactgggtggcttgctttggtaataagcttggtatcgctttaaccgacacttttggcactcaggagttcctccgcgcctttacacagactgtgcaaaccattgagggtggattcccagcagagacctttaagagggctgatggaagcatgaagacttatgccgaagcttttgctggcattcgacaagattctggtgaccctgctgagtacaccaagtggatgcgagagttttacgacaagcagggcattacggacaagaagttgattgtcttttccgactctctcaacatcgaaagatgcttggagtacaagaaggtcgctgatgacctcggtttccaacccacgttcggtgttggcacataccttactaacgactttactaacaccaagactggcaagaagtcagtacccttgaacattgtaatcaagatcagctcagcggcgggcaatccagctgttaagatcagtgacaacgctggaaagaacactggtgataaagaaaccgtcgagaaggtcaagagagagcttggatatgttgagcgtgagtggaaagagggcgacgaaacctcccgatggggtaaggcgtaa

SEQ ID NO: 13992 - protein, 459 aa, Gibberella zeae PH-1
MVFNSSSPYPEGVISFLDTDLYKLTMQCAVFKFFKDVPVTYAYTNRTPDKKLSRTAFKWLEEQIGKLGNISLSTDEYLFLKKHCDYLSEDYLNFLKEFRLSPREQVVATFTPVGEDTGDDSIVGDVDIQIKGTWVDTILYEIPMLALTSEAYFKFMDTDWNYEGQEKQAFDKGLQLLEAGCVTSEFGTRRRRDYHTQALVFRGLVQASKEAEKKGFPGKLSGTSNVHLAMRFNIPPVGTVAHEWFMGVAAILGDYKQATEVALRHWVACFGNKLGIALTDTFGTQEFLRAFTQTVQTIEGGFPAETFKRADGSMKTYAEAFAGIRQDSGDPAEYTKWMREFYDKQGITDKKLIVFSDSLNIERCLEYKKVADDLGFQPTFGVGTYLTNDFTNTKTGKKSVPLNIVIKISSAAGNPAVKISDNAGKNTGDKETVEKVKRELGYVEREWKEGDETSRWGKA

SEQ ID NO: 13993 - DNA, 1839 bp, Ustilago maydis 521
  CDS (1)..(1839)
atgtgtgccgcgccatccacaagtgcgcctgtcgccaaacatgcgtcggacgcatcgccgattcgaagcatcctcgataccgacttgtacaagctcacaatgcaacaagcggtgcttcgtcactacccacacactcgtgtcgcatacaagttcaccaaccgctctgcagccacgatgaagttcacacgtcaagccatggatcgcatccgtaatcacattgacaaccttgtccatctttcgctcagcgctcaagaacgcgcttggctcgagcgaagctgtccttaccttggaaaggactacctcgattacctcgaggcgtttcgcttccagccaaagcagcaggtgcagctccgctttcttcccacgggtgaggatgggtggggccatctcgatctaaacgtttcgggtgtgtggtcagacgtcatcttttacgaggtacccttgatggcgattgtatcagaggtgtatttcagcacgatcgacacagactggtcgttgcaagaccagtatcaacaggcatttgacaaggcttgcaggctgacgtcgaatggcattcgatattccgaattcgggacgaggagaagacgatcctatcaaacacaccgtattgtcctgcaagggctcatggcgggcgacttgtctgcaagctcgggatgctcctctgggaaacttctggggacatccaacgtgcactttgcgcaacaatttgatctggtccccattggcacagtggcgcacgaatggaccatggctattgccgcgctgcaagggtatgcgcattcaaatctgaaagcgctgcagctgtgggacgctgtctattctgcaccggactttgtcgccaacagtgctacgcacgacctcaccattgcgctcaccgatacattttccaccaacgtcttctggaacgatctgctggataatccatctggcatcgaaatcgcgcgtcgatggcgcggcctccgtcaggattccggtgacagtaaagcgtttgcgcaaaaggcacttgacgcatatcgctcgatcggcgtcgatccgaaatccaaagtggtcatctactcggacggcctagacgtcgaccgatgcctcgagctcgccgcttactcgaaccacatcggcatcggcgccgccttcggtatcggcacgtccttcaccaacgacttcatccagctctccaccgcccaaaagagcaaaccactcaatatcgtcatcaagctcgattcggtcgagcacagacgcgtcgtcaagatcagtgatgacctcaccaaaaacacgggcgatcccacagaggtgctcgccgtcaagaggaggtttggcattccaacaccgtcgagtgccacgccagctgatgcatctgtgatcaaccatctcgatccaggagcgccaccgaatccgtcctcgcatgcgcatcttggcacagacgatgctaccatgacccaagtatcgccgcttgatcaacgcaatgtggcagcaggcgtcgaactgaccccaccgaacgagccgcgaagactcttgagtgctcggtccacttcgaagctctcgtcacctaagaatgtggcctcgtcctgcgcctggtccaactgtgcactcgcatcgaagctcgtctcgtcgataccggctgcgctcatcgctggcgtgatcgagcgtgctcgcgaaggcgactgcgactgcgaaccggacgcgcctcgtgaaatgtgtcttgccctaaacgctgccaacggcgacgatgcaggtgcgactgctccgatagctgggttgaactcggagatcggcgtgcctggcgtacccggcgtacctggcgaaccgatccggttgttgctttgtgcaaatccactattgtag

SEQ ID NO: 13994 - protein, 612 aa, Ustilago maydis 521
MCAAPSTSAPVAKHASDASPIRSILDTDLYKLTMQQAVLRHYPHTRVAYKFTNRSAATMKFTRQAMDRIRNHIDNLVHLSLSAQERAWLERSCPYLGKDYLDYLEAFRFQPKQQVQLRFLPTGEDGWGHLDLNVSGVWSDVIFYEVPLMAIVSEVYFSTIDTDWSLQDQYQQAFDKACRLTSNGIRYSEFGTRRRRSYQTHRIVLQGLMAGDLSASSGCSSGKLLGTSNVHFAQQFDLVPIGTVAHEWTMAIAALQGYAHSNLKALQLWDAVYSAPDFVANSATHDLTIALTDTFSTNVFWNDLLDNPSGIEIARRWRGLRQDSGDSKAFAQKALDAYRSIGVDPKSKVVIYSDGLDVDRCLELAAYSNHIGIGAAFGIGTSFTNDFIQLSTAQKSKPLNIVIKLDSVEHRRVVKISDDLTKNTGDPTEVLAVKRRFGIPTPSSATPADASVINHLDPGAPPNPSSHAHLGTDDATMTQVSPLDQRNVAAGVELTPPNEPRRLLSARSTSKLSSPKNVASSCAWSNCALASKLVSSIPAALIAGVIERAREGDCDCEPDAPREMCLALNAANGDDAGATAPIAGLNSEIGVPGVPGVPGEPIRLLLCANPLL

SEQ ID NO: 13995 - DNA, 1464 bp, Aspergillus nidulans FGSC A4
  CDS (1)..(1464)
atgggcgagcactccctgcttccggacggggtcttctctctgcttgatacagatttgtacaagctgacgatgcaatgcgcgatcctcaaatactttccggacgtccaggttacctatggcttcacgaaccgaaccccgcatatgaagttgacgcgaggtgcatacaaatggatgctggctcaaatggataagctcgcaaatatccgcgttacagaagacgaaattgcgttcctcaaaaggcgctgcccttactttaacaccgcctacctggacttcctgacgaatttccgcctcaagccctccgagcagattgatataaactttacacccgtaaatgatacaggaagcgacagtgacttcggcgacattgattatatagtcaagggtgcctgggtggatacgatcctatatgagatccccttactggccctgactagccaggcatacttcatgttcagcgataaggactggaactacgagtgccaggaagggaaggcataccggaagggatatgttctgctagagaatggctgcaccttttcagagtttgggaccaggcggcgccgcagctaccacacccaggaccttgttatgcaggggctctgtcgggctgctagggagggaaaggccaagggtttaccaggtgtctttaccggcagtagcaatgtccactttgcgatgaagtatgatgttgatccggtcgggacagtagcgcacgagtggtacatgaccattgcagcgatcacggacgactacgagaatgcaaacgagatggccctgaagtactggcttggttgctttggtgaaggtgtcctcgggatcgcactaacagacacctttggcacccctgccttcctcgacgctttccgcaaacctatccccgattatacctccgccggcactggcgccgtctcaacaacagcttcagggcccagcacgactgccgaatccaatattcagagcgaagccgaaaccaaagcccccatcacagcgccgctttccccagaccaccctccacccgccgttaaaacgtatgcccaggtctacgcaggcgtacgtcaggactcaggcgacccatcttatttcgtaaagatggcccgcgatttctacgaccgtgagggcattacagggacaaagacagtggtattctcggactcgttggacatcgagcactgtcttgagtataaagttctagcagaggaggctgggttcaagcctgtttttggcgttgggacattcttcacgaatgacttcatcaatacaaccacgaacgaaaaatcgcaaccgctcaacattgtcataaaaatttcctctgctaatggccgggccgctgtcaagctaagcgacaatatgggcaagaatacgggcgacaaggatacagtccaggctgtcaagaagaggctggggtacgtcgagcatgaatgggaagaaggtgatgagcggaatcggtgggctcggaagtga

SEQ ID NO: 13996 - protein, 487 aa, Aspergillus nidulans FGSC A4
MGEHSLLPDGVFSLLDTDLYKLTMQCAILKYFPDVQVTYGFTNRTPHMKLTRGAYKWMLAQMDKLANIRVTEDEIAFLKRRCPYFNTAYLDFLTNFRLKPSEQIDINFTPVNDTGSDSDFGDIDYIVKGAWVDTILYEIPLLALTSQAYFMFSDKDWNYECQEGKAYRKGYVLLENGCTFSEFGTRRRRSYHTQDLVMQGLCRAAREGKAKGLPGVFTGSSNVHFAMKYDVDPVGTVAHEWYMTIAAITDDYENANEMALKYWLGCFGEGVLGIALTDTFGTPAFLDAFRKPIPDYTSAGTGAVSTTASGPSTTAESNIQSEAETKAPITAPLSPDHPPPAVKTYAQVYAGVRQDSGDPSYFVKMARDFYDREGITGTKTVVFSDSLDIEHCLEYKVLAEEAGFKPVFGVGTFFTNDFINTTTNEKSQPLNIVIKISSANGRAAVKLSDNMGKNTGDKDTVQAVKKRLGYVEHEWEEGDERNRWARK

SEQ ID NO: 13997 - DNA, 1296 bp, Candida glabrata CBS138
  CDS (1)..(1296)
atgtcaagcatgactcctgccattacgtccttattggacaccgacatgtacaagattaccatgcatgctgcagttttcactaacttcccagatgctagagtagtctacaagttcaccaataggactgcacaatttcatttcaacaagagagcagtcgattggatcaaagagcagtttaggctactaggcgacctcacgtttacacacgatgatgttgagtatttagctcgtgagattccctttttgcctgcaaaatatcttcattacattgagaatgggttcactttgaagcctgatgaacaaatagaactagactgccaggagataaaaggtaaagaagaccaatatgaccttcatatcctagtgaaaggtctgtggattgacactatcctttacgagattccaatactggctttattgtctgaggcttacttcaaatttgttgacactgactgggattatgagaaccaactatctaacgccaaagaaaaggccctaagattattcgaaaacaacctatcctttagcgaatttggaactagacgtcgtaggtctttcaagactcaagatttggtcatggaaggtatcatgcaagctgtgaaggaaaatcctgagaaatacaggccgttgcttttgggtacctctaacattttattcgctaagaagtacggagtcaaaccaattggtacagtcgcccatgaatggatcatgggtatagcatccatcactggcgattatccagagactaacagaattgccatggattactggattaagacatttggcaaagagcatgcaggccttgccttgactgatacctttggtaccgacgacttcttaaaaagcttcaagcctccatattccgattattacattggtgttagacaagattctggagatccaataaaatacacagaaaagattgcacaccatttccatgatgtactgaaactaccaaaattctctaaattcatatgttactcagactcgcttaatattgacaaagctatcgaatatggaaaggttgcagaggctcatggcataaagtccacctttggcataggtacaaattttacgaatgatttccacaaaaagtccgatccttctgtcaaaagtgcaccattaaatattgttattaaactactagaagtgaatggtaaccactcaattaagatttcagataatgcaggtaaaaatatgggtgacccagatactgtaaaaaaagtaaaggaacaactgggatatgttgaacgtcaatgggctggaggtaatgaagcccatcgttctgctgcatga

SEQ ID NO: 13998 - protein, 431 aa, Candida glabrata CBS138
MSSMTPAITSLLDTDMYKITMHAAVFTNFPDARVVYKFTNRTAQFHFNKRAVDWIKEQFRLLGDLTFTHDDVEYLAREIPFLPAKYLHYIENGFTLKPDEQIELDCQEIKGKEDQYDLHILVKGLWIDTILYEIPILALLSEAYFKFVDTDWDYENQLSNAKEKALRLFENNLSFSEFGTRRRRSFKTQDLVMEGIMQAVKENPEKYRPLLLGTSNILFAKKYGVKPIGTVAHEWIMGIASITGDYPETNRIAMDYWIKTFGKEHAGLALTDTFGTDDFLKSFKPPYSDYYIGVRQDSGDPIKYTEKIAHHFHDVLKLPKFSKFICYSDSLNIDKAIEYGKVAEAHGIKSTFGIGTNFTNDFHKKSDPSVKSAPLNIVIKLLEVNGNHSIKISDNAGKNMGDPDTVKKVKEQLGYVERQWAGGNEAHRSAA

SEQ ID NO: 13999 - DNA, 1284 bp, Kluyveromyces lactis NRRL Y-1140
  CDS (1)..(1284)
atggaaccggttataacttcattcctcgacacggacatgtacaaattgacgatgcatgccgctgtctatacacattttaaggatgtcaaagtcaagtacaagtataccaaccgatcgcctcagatgacgttcaataaggaagctgtggaatggttgaagggtcaattcctattattggctaatataagacttactactgaggaactgaaatacatcaaggaggctattccgtacctgccagcggaatatttggaatttatatctaacggtgggttcgaagtaaatccaaaggatgaaattaaatttgaggccagggaaattgagggtgaacctggtcattacgagttggatatctccattgagggattatggatcaagactatatggtacgagatcccagtgcttgcgttggtgtcagaagcgtacttcaaattcgtggatacggattggacttacgatggtcaggtcgagaaagcttatgccaaggccaaaaagcttttggatcacgatatcgtattcagtgagtttggtactagacgtcgtagatctttcaagactcaagatcttgtcatgcaaggtatcataaatgccgctaaggattgtgataagtctaaatacgtattgggtacctcgaacgtgttattcgctaagaaatataacgtaaaccctatcggtacagtagcgcatgagtggatgatgggtattgcatccattacaaatgactatctgaatgcaaataagaacgcaatggattactggattgagacgtttggtatggaaaatgcgggtcttgcactaacagatacttttggtaccgattcgttcttgaaatcgttctacccaccttattcagatgcatacattggggtgagacaggactctggagacccaattttgtacactgagaaaatcgctcatcattacaatgacgtattgaagctcccaaagttctcaaagataatctgctattcagactctcttaacccagatcgagcaatagaatatgcccaagtggctcataaacatggtctaaaggcaactttcggtatcggtacgaatttcaccaacgatttccaaagaaaatctgatgtctcagtgaaaagtgaaccgctgaatattgtcataaaactactggaggttaatgggaaccatgccatcaagatttccgataatttaggtaaaaatatgggtgacccagagacagttcgtagagtgaaggaagaattgggctatgttgagagaaagtatgcaggtgataatgaagctcatagatgggctgcttaa

SEQ ID NO: 14000 - protein, 427 aa, Kluyveromyces lactis NRRL Y-1140
MEPVITSFLDTDMYKLTMHAAVYTHFKDVKVKYKYTNRSPQMTFNKEAVEWLKGQFLLLANIRLTTEELKYIKEAIPYLPAEYLEFISNGGFEVNPKDEIKFEAREIEGEPGHYELDISIEGLWIKTIWYEIPVLALVSEAYFKFVDTDWTYDGQVEKAYAKAKKLLDHDIVFSEFGTRRRRSFKTQDLVMQGIINAAKDCDKSKYVLGTSNVLFAKKYNVNPIGTVAHEWMMGIASITNDYLNANKNAMDYWIETFGMENAGLALTDTFGTDSFLKSFYPPYSDAYIGVRQDSGDPILYTEKIAHHYNDVLKLPKFSKIICYSDSLNPDRAIEYAQVAHKHGLKATFGIGTNFTNDFQRKSDVSVKSEPLNIVIKLLEVNGNHAIKISDNLGKNMGDPETVRRVKEELGYVERKYAGDNEAHRWAA

SEQ ID NO: 14001 - DNA, 1269 bp, Debaryomyces hansenii CBS767
  CDS (1)..(1269)
atgacgacagacattccaattattacatccatattggatactgacttgtacaagttgacgatgcatgctgcagttgtcaagcatttcccgaacatacccgttgtatatagatatacaaataggacaccatcgatggtattaaacaaagaagcaatcgattggttaaagtatcaaatttccaagctaagtgacttaagggtcagttcagaagaacttgaatatttgcggaaagcattgccacaaatgccggaggtttacttgaaatatttggaaactttccagctctttcccgacaaacaaatcaaatacttcaatgacgagagcaattttgaagaatttgaaattgaaatgaaaggcaaatgggatgaaaccatgttatatgaaatccctttgttggcgttaatatcagaagcttattttaaatttgttgatactgattggaactacgatggtcaagcagaacgtgccgaagacaaatgtgcacaattatttaagaacgaatgcacttttagtgaatttggaactagacggaggagatcattcaagacgcaagatctagtagtgaagaatttatgtgattttgctggaaagaatccagataagaagcactttttaggaacatcaaatgtattattggcaaaaaaatacaatacaacacctataggaacagttgcacacgaatggtttatgggtattgcctcgattacgcaggactatacaaatgctaataaacttgccatggactactggttagatacatttggtcctgaacatgctggtttggctttaacagatacatttggaacagatgcgtacttaaaagtatttaccaagccttacactgattattatactggcgtaagacaagattcaggcgatcctgaactgttcgctgaaaaattagcagatcattacaagaagcaagggtatccggattttagtaaaataatatgctttagcgattccttaaacgttgagaagtgtttaaaatataaacaaaaagttaatagtttgggattgatcgcttcttttggtattggaacgtttttcacaaatgactttgcgtctgtgtctgatccctctactaagtctgttccgcttaatattgtcattaaattgaaagaagccaacggtaacccttcgatcaaaattagcgataatcttggtaaaaatatgggtgatccggcagtagtctcgagagtgaaaaaagaactcaattatgaagaacattcttgggctgagggagatgaagagaagagatgggattag

SEQ ID NO: 14002 - protein, 422 aa, Debaryomyces hansenii CBS767
MTTDIPIITSILDTDLYKLTMHAAVVKHFPNIPVVYRYTNRTPSMVLNKEAIDWLKYQISKLSDLRVSSEELEYLRKALPQMPEVYLKYLETFQLFPDKQIKYFNDESNFEEFEIEMKGKWDETMLYEIPLLALISEAYFKFVDTDWNYDGQAERAEDKCAQLFKNECTFSEFGTRRRRSFKTQDLVVKNLCDFAGKNPDKKHFLGTSNVLLAKKYNTTPIGTVAHEWFMGIASITQDYTNANKLAMDYWLDTFGPEHAGLALTDTFGTDAYLKVFTKPYTDYYTGVRQDSGDPELFAEKLADHYKKQGYPDFSKIICFSDSLNVEKCLKYKQKVNSLGLIASFGIGTFFTNDFASVSDPSTKSVPLNIVIKLKEANGNPSIKISDNLGKNMGDPAVVSRVKKELNYEEHSWAEGDEEKRWD

SEQ ID NO: 14003 - DNA, 1245 bp, Yarrowia lipolytica CLIB99
  CDS (1)..(1245)
atgtccacaatcacctcgcttctcgacaccgatctgtacaagctgacgatgcaggcagctgttttgcagcactttcccgcggcacaggcgacttttctgttcaagaatcgaacaccatccaaacagctcaacgacgacgcgattgagtggctcaagagcgagattgcggcgctgggcgagcttcgatttactgaggacgagattgtgtttctccagaagcatgtcggcttcctgccagccgagtactttgagtatctcaagacgtgccaactcgatccggcagcccaggtcaaggtgaccgtcaacacagaaggacacctggaaatcgaggtcaatggcccctggaaagacacaattttgtacgagattccgctgctggcgctggtttcggaagcgtacttcaagtttgtcgacaaggactggagctacgacggacagagtgaactggcggccaccaaggcccaggagctcattgcccagggctgtgcgttttccgagtttggcacccgacgccgacgttccctcaagacccacgatatcgtcattgccggtattctggagggtctcaaatccgcccaaggcaacggtatcttcacaggaacctccaacgtctacctggccaagaagtacaatctcaagccgattggaacggtggcacacgaatggatgatgggcgtggctgcagctacgggcgactactctacagccaacctgcgggccatggagttgtggatccagacggttggagacgccaacgcaggggtggctctcacagacacgtttggaacggaatcatttctcctggacttcaacaagccgctcacagacatttacaacggcgtgcggcaggactctggcgatcccctggagtacacgaagctattgggcgaccactacaagcagttgggatatgagcccatgtccaaggtgattgtgtactcggattcgttggacgtggaaaagtgtggcaaatacaaggctgccgctgccgagaacgggctcaaggctgcctttggagtgggcactttcttcaccaacgatttcaagcggctcagcgatggacagaagagcactcctctgaacattgtcatcaagatccaacagctcaacgggcagtcgtgtatcaagctatccgacaatctgtccaagaacatgggtgatcccgagaccgttgagagggttaagcgggagcttgggtatgttgagaagggggatgtgattgacgagtccaagcggtggaattga

SEQ ID NO: 14004 - protein, 414 aa, Yarrowia lipolytica CLIB99
MSTITSLLDTDLYKLTMQAAVLQHFPAAQATFLFKNRTPSKQLNDDAIEWLKSEIAALGELRFTEDEIVFLQKHVGFLPAEYFEYLKTCQLDPAAQVKVTVNTEGHLEIEVNGPWKDTILYEIPLLALVSEAYFKFVDKDWSYDGQSELAATKAQELIAQGCAFSEFGTRRRRSLKTHDIVIAGILEGLKSAQGNGIFTGTSNVYLAKKYNLKPIGTVAHEWMMGVAAATGDYSTANLRAMELWIQTVGDANAGVALTDTFGTESFLLDFNKPLTDIYNGVRQDSGDPLEYTKLLGDHYKQLGYEPMSKVIVYSDSLDVEKCGKYKAAAAENGLKAAFGVGTFFTNDFKRLSDGQKSTPLNIVIKIQQLNGQSCIKLSDNLSKNMGDPETVERVKRELGYVEKGDVIDESKRWN

SEQ ID NO: 14005 - DNA, 1362 bp, Cryptococcus neoformans var. neoformans JEC21
  CDS (1)..(1362)
atgccggacaagctacacctacccatagatgatgtccagatccccttcagtatcctcgatactgacctttacaagcttacaatgcaaaacgccgtcctccaccactttagtgacgcgcatgtggtcatcaagtttaccaataggagtcctcaaatgctcttctcgaaggaatgttttgactgggtacaacagcgagtgaatgacctttcgaagctcaagttgacttcagaagaacgtaaagagctttctaaggcttgtccttatttctcggaatcatacctagattatctctccaatatgcaactcgaccctgtcaagcaagtaaagctcactttcattccccagggctccaacgagaaaggagaaaagatgggtgagattggatgtgtcatcgaagggccttggaaggatactatgttatacgaagttcccgttatggctatcttgagtgaaggatacttcaagtttgtggacaccgactgggattacgacgggcagtttgaactggccaagaagaaggctttagatctcttgaatcctcctgctcccacgacgtcattatcgttctctgaattcggcactcgccgtcgacggagtttcaaggcccaggatatcatcatgcggggccttattgctggccatgaagagtacaaatccaaaggagggagtcaggggattttgagcgggacaagtaatgtctatttggctttgaaatacggcctcaatcctgtcggcacgattgcccatgaatggatcatggccgtcggtgcgacttatggatacagaggggctaatggaagagctatggatatgtgggaagaggtctaccctcccggtaccaagttttcctctccactcaccatgctcacggacacctacactgccgcgatcttctttaaagactttatctccgatcccgctcgtgctcttcgctgggccgttctcaggcaagattctggagacgccttcaagtttgtcgaggacgcaaaggaggcgtggaggactatcgaggataaggctggtatcaagcgagacgttgggccgaatggcgaggaagaagttgcaaaaggaaagaaggttattttcagtgacggcttagatgtggagaaggccatcaagttgcaacaagggtgtgacaaggctggcatggcggcatcattcggtatcggtacggacttgaccaatgattttcgtaaggcctcagatcccagtcaaaagtccaaagctttgaatatggtcatcaaactcaacaagatcaatggaaaggattgtatcaagttgtcagatgacaaggggaagcatactggttctcttgaagaggttaggaaagctcaacaggaactgggcattaacaagaactag

SEQ ID NO: 14006 - protein, 453 aa, Cryptococcus neoformans var. neoformans JEC21
MPDKLHLPIDDVQIPFSILDTDLYKLTMQNAVLHHFSDAHVVIKFTNRSPQMLFSKECFDWVQQRVNDLSKLKLTSEERKELSKACPYFSESYLDYLSNMQLDPVKQVKLTFIPQGSNEKGEKMGEIGCVIEGPWKDTMLYEVPVMAILSEGYFKFVDTDWDYDGQFELAKKKALDLLNPPAPTTSLSFSEFGTRRRRSFKAQDIIMRGLIAGHEEYKSKGGSQGILSGTSNVYLALKYGLNPVGTIAHEWIMAVGATYGYRGANGRAMDMWEEVYPPGTKFSSPLTMLTDTYTAAIFFKDFISDPARALRWAVLRQDSGDAFKFVEDAKEAWRTIEDKAGIKRDVGPNGEEEVAKGKKVIFSDGLDVEKAIKLQQGCDKAGMAASFGIGTDLTNDFRKASDPSQKSKALNMVIKLNKINGKDCIKLSDDKGKHTGSLEEVRKAQQELGINKN

SEQ ID NO: 14007 - DNA, 1173 bp, Entamoeba histolytica HM-1:IMSS
  CDS (1)..(1173)
atgccaattattacaagtatacttgataatgatttgtataaatttactgtaagtaatggttatttttgtttgtatccttatgcctctggtgttttttcttttagagaccgtaatttaatgaattttcctgatggctttgctgaggtgttacagaaagagataaatgaaatggcatctataagtacaacaacagaagaagttgaataccttaaaacccttaaatatttacctccaacatatattgaatttattaagaattttcattatgacccaaaagaagttaagattgaagttattaacaataaattgcatatagactgtactgggtatttgtacagaatgactttatgggaagttcctttattggctattgtaagtgaattatatcaaaaaatgactcatcatactgctgatatggattatgtcatcaaaactactgaattgaaagcaaaaaaacttactgaagcaggatgtaaatatagtgattttggaacaagaagaagattttctaaagaagttcacgacgttgttgtgaaaacattaaaagaaaattcaggtaacaactttattggatcatctaacgtttatttagcaatgaaatataaccttaaacctattggaactcatccacatgaatggatgatgttccatgctgctgcttatggatataaaggggctaatgctttaggacttactcgatggagagatttgtacagagggtatttgtgttgtgctttaactgatacattcacaactgatgtattctttagagaatttgacagaccacttgccatgagttttgatggtattagacatgacagtgaatctccatttgtttttgctgacaaagctattgctttttataagaagatgggtattgacccaatgaccaaaaacattgttttcagtgatagtctgacttatgaaaaagctattgaattacaaaattattgtaaaggaaaaatcaattgcagctttggtattggaactcattttacttgtgacactggtaataataataaacctttaaacattgttatgaaacttttgaaagcaaaagaatatgatgaaaatgagtttgtaggttgtgttaaactttctgatgcagttggaaaacatcttggagaagaaaaagatatattaacttgcaaactatctcttgggcttaattaa

SEQ ID NO: 14008 - protein, 390 aa, Entamoeba histolytica HM-1:IMSS
MPIITSILDNDLYKFTVSNGYFCLYPYASGVFSFRDRNLMNFPDGFAEVLQKEINEMASISTTTEEVEYLKTLKYLPPTYIEFIKNFHYDPKEVKIEVINNKLHIDCTGYLYRMTLWEVPLLAIVSELYQKMTHHTADMDYVIKTTELKAKKLTEAGCKYSDFGTRRRFSKEVHDVVVKTLKENSGNNFIGSSNVYLAMKYNLKPIGTHPHEWMMFHAAAYGYKGANALGLTRWRDLYRGYLCCALTDTFTTDVFFREFDRPLAMSFDGIRHDSESPFVFADKAIAFYKKMGIDPMTKNIVFSDSLTYEKAIELQNYCKGKINCSFGIGTHFTCDTGNNNKPLNIVMKLLKAKEYDENEFVGCVKLSDAVGKHLGEEKDILTCKLSLGLN

SEQ ID NO: 14009 - DNA, 1266 bp, Candida albicans SC5314
  CDS (1)..(1266): transl_table=12
atgaatggaactgaagataaaccagtcatcaaatccttcttggataccgatttatacaaattgtttatgcatgcagcggtcaacaaacagtttcctgatgtcccagtgaaatacaggtataccaatagaactcctcaattgaagttaaatagccaagccatatcgtggttgaaaaagcaaatcgagtatttgggtgatttaagattttctgcagaagagattttgtatttgcatagagtattgccgcaattgccatcagactatttagaatatttggcggacttcaaattagtcccatcgtcccagatcaaatatttggataatgatgaaggggacttcgaattggaaattgtcggtaagtggaatgacactatactttatgagattccgttattggcattagtgtctgaagcttattttaagtttgttgacaccgactggaattacgaaggtcagtacgctttagcacaaaaaaaggccaagcagttaattagcaatgaatgtaatttcagtgaatttggaactagaagaagaagatcatacgagtcacaagaaattgttatcaaggcaatcaaagacgtgcaaatagacactcaatcaaagtacattgctggtacgtcgaacgtttattttgccatgaaatatgatttgccacctataggcactgttgcacatgaatggtatatgggaattgcatcaatcacacaagattatgtgcatgcaaataaattggctatggattattggattgatacatttggagcaaaatatgcagggttggccttgacagatacttttggaacagacaactacttgacaatgtttgttgctccctatgtaaatgaatactctggagttaggcaagattcgggggatcctgaattgtatgctgagaaaattgcccgtcattatgaaaaaatgggtatagcgaaaaataccaagatcatttgtttcagtgactccttgaacgttgaaaaatgtttgaaatataaaaatacagcagataaattgggattaatcagtacttttggaattggtacgtttttcacaaatgatttcaataagttgtcaaatggcgaaaagtctcagccaatgaacattgtcattaaaattaaggaggcaaacggtaaaccagccattaagattagtgataatattggaaagaatatgggtgatcaggctactgttgatagagtcaaacaagaattaggatatacagaaagaacatggtctgaaggagacgaaactcatagatggtctaagtag

SEQ ID NO: 14010 - protein, 421 aa, Candida albicans SC5314
MNGTEDKPVIKSFLDTDLYKLFMHAAVNKQFPDVPVKYRYTNRTPQLKLNSQAISWLKKQIEYLGDLRFSAEEILYLHRVLPQLPSDYLEYLADFKLVPSSQIKYLDNDEGDFELEIVGKWNDTILYEIPLLALVSEAYFKFVDTDWNYEGQYALAQKKAKQLISNECNFSEFGTRRRRSYESQEIVIKAIKDVQIDTQSKYIAGTSNVYFAMKYDLPPIGTVAHEWYMGIASITQDYVHANKLAMDYWIDTFGAKYAGLALTDTFGTDNYLTMFVAPYVNEYSGVRQDSGDPELYAEKIARHYEKMGIAKNTKIICFSDSLNVEKCLKYKNTADKLGLISTFGIGTFFTNDFNKLSNGEKSQPMNIVIKIKEANGKPAIKISDNIGKNMGDQATVDRVKQELGYTERTWSEGDETHRWSK

SEQ ID NO: 14011 - DNA, 1305 bp, Bartonella quintana str. Toulouse
  CDS (1)..(1305): transl_table=11
atgaatcatccagatatcgctcaacgtgtttacaatcatacctggaaactcgatcctattattcgttcacttctcgatacggatttttataaacttcttatgttgcagatgatttggggactttatcccaatgtaaatgttactttcaccctcataaaccgcaccaaaacaatacgtcttgccgatgatattgatgagggtgaattgcgtgcccaacttgatcacgcgcttagtttacgctttactaaaaaagaaatgatctggctcgctggtaatacattttacggacgtaaacaaattttcaaaccagattttcttcattggcttaagaattttcaactgccagaatatgaacttacacgtaaagatggccaatatatccttcatttccatggtccgtggtcccatagctccatgtgggaaatccccgctcttgctattatcagtgaattacgttcacgtgccgccatgaaaaatctagatcgtttcgctcttgatgtactttatgcgcgtgctaaagcaaaaatgtggagtaaagtcgaacaactaaaaaaactacctgatattaaaatatccgactttggtacaagacgtcgtcattcttttttatggcaacgctggtgtgttgaagcattaaaagaagggattggcgattcttttacaggtacttctaatgtccttctcgccatggctacagatctagaagctcttggtaccaatgcacatgaattgcccatggtcatcgccgctctcaccaataatgataatgaattatgcaaggcaccttatcaagtcttgcaagattggaatcgttattatggtggaaatcttctcattgttttgcctgatacctttggtacagaaacatttttacgcaatgcaccagattgggtggctgattggacaggtttcagacctgatagtgctccccctattgagggcggtgaacgcattatccagtggtggaaagaaaaaggaaaagacccgcgtgaaaaattattgattttttctgatgcactcgatgtcaatacaattgaacagacctatcaccatttccatgggagagtgcgcatgagttttggatggggaacagatcttaccaatgatttcgtaggctgtgcgccccaaaaaattgcgacctttgatgctctttcccttgtctgtaaagtcacccacgccaatggtcgacctgccgtaaaactttcagataaccctgaaaaaaccatcggtgatccacgagaaatacaacgttatcttaattttttcggcaatgaaaactttatcaccaggcctataaacacttaa

SEQ ID NO: 14012 - protein, 434 aa, Bartonella quintana str. Toulouse
MNHPDIAQRVYNHTWKLDPIIRSLLDTDFYKLLMLQMIWGLYPNVNVTFTLINRTKTIRLADDIDEGELRAQLDHALSLRFTKKEMIWLAGNTFYGRKQIFKPDFLHWLKNFQLPEYELTRKDGQYILHFHGPWSHSSMWEIPALAIISELRSRAAMKNLDRFALDVLYARAKAKMWSKVEQLKKLPDIKISDFGTRRRHSFLWQRWCVEALKEGIGDSFTGTSNVLLAMATDLEALGTNAHELPMVIAALTNNDNELCKAPYQVLQDWNRYYGGNLLIVLPDTFGTETFLRNAPDWVADWTGFRPDSAPPIEGGERIIQWWKEKGKDPREKLLIFSDALDVNTIEQTYHHFHGRVRMSFGWGTDLTNDFVGCAPQKIATFDALSLVCKVTHANGRPAVKLSDNPEKTIGDPREIQRYLNFFGNENFITRPINT

SEQ ID NO: 14013 - DNA, 1305 bp, Bartonella henselae str. Houston-1
  CDS (1)..(1305): transl_table=11
atgaatcatccagacattgcgagacgcgtttacaatcatacctggaaacttgaccccattattcgttcactgctcgataccgatttttataaacttcttatggtacagatgatttgggggctttatcccaatgtaaacgttactttctccctcatcaaccgtagcaaaacaatacgtcttgctgatgatattgatgaaatggaattgcgtgcacaacttgatcacgcccttaatttacgctttaccaaaaaagaaatgatttggcttgctggtaatacattttatggacgtaaacaaattttcgaaccagattttcttcagtggcttgagaattttcaacttccagaatatgaactcacacgtaaagatggccaatatatccttcatttccatggtccgtggacccatagctccatgtgggaaatccctgccctttctattataagtgaattacgttcacgtgctgctatgaaaaaactagatcgcttcactcttgatgtactttatgcgcgtgctaaagcaaaaatgtggagtaaagtcgaaagactcaaaaaactgcctaatattaaaatatctgactttggtacaagacgtcgccattcttttttatggcaacgttggtgcgttgaagcattaaaagaaggaattggcaattcttttaccggaacgtctaatgtccttctcgccatggatacagatttagaagctcttggtaccaatgcacatgaattgcctatggtcatagccgctctcaccaataatgataatgaattgcgcaaagcaccttatcaagttttacaagattggaatcgttattatggtggaaatcttctcattgttttgccagataccttcggtacagaagcatttttacgcaatgcaccagattgggtggctgattggacaggtttcagacctgacagtgctcctcctctcgagggcggcgaacgcattattcaatggtggagagaaaaaggaaaagaccctcgtgaaaagttattgattttctccgatgcactagacatagatacaattgaaaaaacctatcatcattttcacggtaaagtgcgcatgagttttggatggggaacagaccttactaatgatttcgtcggctgttctccacaagaaactgcaacttttgatgctctttcccttgtttgtaaagttacccatgccaatggtcggccagccgtaaaactttcagataatcctgaaaaaaccatcggtaatccgcaagaaatacaacgttatctcaatttttttggtaatgaaaaccgtgttgctaaacctatcaaaacataa

SEQ ID NO: 14014 - protein, 434 aa, Bartonella henselae str. Houston-1
MNHPDIARRVYNHTWKLDPIIRSLLDTDFYKLLMVQMIWGLYPNVNVTFSLINRSKTIRLADDIDEMELRAQLDHALNLRFTKKEMIWLAGNTFYGRKQIFEPDFLQWLENFQLPEYELTRKDGQYILHFHGPWTHSSMWEIPALSIISELRSRAAMKKLDRFTLDVLYARAKAKMWSKVERLKKLPNIKISDFGTRRRHSFLWQRWCVEALKEGIGNSFTGTSNVLLAMDTDLEALGTNAHELPMVIAALTNNDNELRKAPYQVLQDWNRYYGGNLLIVLPDTFGTEAFLRNAPDWVADWTGFRPDSAPPLEGGERIIQWWREKGKDPREKLLIFSDALDIDTIEKTYHHFHGKVRMSFGWGTDLTNDFVGCSPQETATFDALSLVCKVTHANGRPAVKLSDNPEKTIGNPQEIQRYLNFFGNENRVAKPIKT

SEQ ID NO: 14015 - DNA, 1470 bp, Bacillus licheniformis ATCC 14580
  CDS (1)..(1470): transl_table=11
ttggaacaccgttttacagacgacagtctagcactacacacagacctatatcaaattaatatggcggaaacgtattggcgcgacggcattgatcaaaagaaagccgtatttgaactgtttttcagaaagctcccttttgacagcggttttgccgtttttgccggtcttgaaaaagcgattgaatttttgcgggatttcagatttactgaaagcgatttagtttatttaaaagaagagctgggctttaaagatgactttctcggctttttaaaagatatgagattcaccggttcgctttattctatgcaggaaggcgaaatcgtgtttggcaacgaaccgatcatgaggatcgaagcgcctttggctgaagcgcagctgattgagacggctctgctcaacattgtgaattaccaaacattgattgccacaaaagcggcgagaatcaaaagtgtgatcggagaagagacggcgcttgaatttggaacaaggcgcgcgcatgaaatggacgcggcgatgtggggagcaagagccgcgattatcggcggattcgacgcgacaagcaatgtccgcgccggcaagcggtttgacattccggtatcaggcacgcacgcccatgcgcttgtacaggcctatcgcgatgagtacacggcatttaaaaaatatgcggaaacccataaaaaatgtgtctttttggtcgatacatatgatacggtgcgttccggcattccaaatgcgatcaaagtagcaaaggaattcggcgatcaaattgaattttcgggaatccgcctggacagcggagacctcgcctatttgtcgaagaaagcgagagccatgctggatgaagccggatttacagatacaaaagttgttgcatcaagcgatcttgatgagtacacgattatgaaccttaaagcccagggtgcaaaaatcgacgtctggggcgtgggcacaaagctgattaccgcttacgaccagccggctctcggcgcggtttacaaacttgtttcgatcgaagaagacggaaagatggcagacacgattaaaatttcttcgaatccggaaaaagtgacgactccaggcttgaaaaaggtgtacagaatcatcaatcagctgaaccatcattcagaaggcgattatatcgctttggactatgaaaaggtcaatgaacaggagcggctgaagatgtttcaccccgttcatacgtttatcagcaagtttgtgacgaattttgatgcgaaagatcttcaccagccgatctttgaaaaaggcgagcttgtctatgagaatccgagcattcaggatattaagcggtatgttcaagaaaatctcagtttgctttgggaagagtataagcggatcagcaagcccgaagaatatcctgtcgatttaagcgaagcttgctggaacaacaagatgcagcaaattcacgaagcgaaaatcaaggcgaaaaaaggtctggatcaaggttga

SEQ ID NO: 14016 - protein, 489 aa, Bacillus licheniformis ATCC 14580
MEHRFTDDSLALHTDLYQINMAETYWRDGIDQKKAVFELFFRKLPFDSGFAVFAGLEKAIEFLRDFRFTESDLVYLKEELGFKDDFLGFLKDMRFTGSLYSMQEGEIVFGNEPIMRIEAPLAEAQLIETALLNIVNYQTLIATKAARIKSVIGEETALEFGTRRAHEMDAAMWGARAAIIGGFDATSNVRAGKRFDIPVSGTHAHALVQAYRDEYTAFKKYAETHKKCVFLVDTYDTVRSGIPNAIKVAKEFGDQIEFSGIRLDSGDLAYLSKKARAMLDEAGFTDTKVVASSDLDEYTIMNLKAQGAKIDVWGVGTKLITAYDQPALGAVYKLVSIEEDGKMADTIKISSNPEKVTTPGLKKVYRIINQLNHHSEGDYIALDYEKVNEQERLKMFHPVHTFISKFVTNFDAKDLHQPIFEKGELVYENPSIQDIKRYVQENLSLLWEEYKRISKPEEYPVDLSEACWNNKMQQIHEAKIKAKKGLDQG

SEQ ID NO: 14017 - DNA, 1167 bp, Bacteroides fragilis YCH46
  CDS (1)..(1167): transl_table=11
atgatcattcgtaccatactcgatacagacctttataaattcactacttcgtatgcttatatcaaactattcccgtacgcaataggcactttcaacttcaaagacagggacgggactgaatatagcgacgagtttgtggaaagattgagaacggaaatcagtcagctatcacacgtggcactgaccgaaaaagaactggaatatatgataaagaactgccgcttcctgcccagggtctattgggagtggctctcttctttccgtttccaacccgagaaaatagaaatccgtctggacgagaatcggcagcttcacatcgaagtgaacgactatctttacaaagcaacgctttatgaagtacctctactcgccatcgtttcggagataaagaaccaatcgtccggcaatgttgccaacctggaagacatcctgtacaaactgtccgaaaagacagaactgtccaataagcatcagctacttttctctgaattcggaacccgaaggcgcttttcgttcgatgtgcagaatcaagtcatcgggcacctgaaacagacagcccattactgtatcggcacttccaattgccatttcgccatgaaatacggcatgaagcccatgggtacgcatccccatgaatggttcatgtttcacggagcgcaattcggctataaacatgccaactatatggcccttgaaaattgggtaaatgtatacgatggcgaccttggcatcgccttgtccgacacttatacatctgccatctttctaagcaatctaagccgcaaacaggctaagttgtttgatggcgtgaggtgtgattccggtgatgaattccggttcatcgatcagctgaccgcacgttataaggagttgggcatcgacccgaccaccaagacaatcgtattcagtaacgcactcgactttgacaaagcactggatatccaggagtattgccagggaaagatccgttgctctttcggcatcgggacaaacctgaccaacgatacgggattcaagccatcaaacattgtcatgaagctatcgcaatgcaagatgaacatgaaccaggagtggcgcgaatgtgtgaaattatcagacgacatagggaaacatatcggcagcccggaagaggtgcgtgcctgtctatacgacttgcggttggagtaa

SEQ ID NO: 14018 - protein, 388 aa, Bacteroides fragilis YCH46
MIIRTILDTDLYKFTTSYAYIKLFPYAIGTFNFKDRDGTEYSDEFVERLRTEISQLSHVALTEKELEYMIKNCRFLPRVYWEWLSSFRFQPEKIEIRLDENRQLHIEVNDYLYKATLYEVPLLAIVSEIKNQSSGNVANLEDILYKLSEKTELSNKHQLLFSEFGTRRRFSFDVQNQVIGHLKQTAHYCIGTSNCHFAMKYGMKPMGTHPHEWFMFHGAQFGYKHANYMALENWVNVYDGDLGIALSDTYTSAIFLSNLSRKQAKLFDGVRCDSGDEFRFIDQLTARYKELGIDPTTKTIVFSNALDFDKALDIQEYCQGKIRCSFGIGTNLTNDTGFKPSNIVMKLSQCKMNMNQEWRECVKLSDDIGKHIGSPEEVRACLYDLRLE

SEQ ID NO: 14019 - DNA, 1350 bp, Methylococcus capsulatus str. Bath
  CDS (1)..(1350): transl_table=11
atgagcctgccgatcgacagcgtcctgctcaccgacctctatcagttgacgatgctgcagggctatcatgcccaacgcatgaacgggactgcggtgttcgaattcttcgtccgcaagcttcccggtggggacgagcccaaacgcaacttcctggtcgcggccgggctggaacaggccctggatttcctggaaggcatgcggttccggcccgacgagatcgagtggctgcgcgccagcggacggttcacgccggatttcgtcgacgccttggccgcgctgcgcttcagcggcgacgtcgatgccatgccggaaggcacggtgttctttcccggcgagccgatattgcgggtgacggcgccccttcccgaggcccagctggccgaaacccggctcatcaacctgctgcatttccagaccctcatcgcctccaaggcggcgcgcatgaccctggccgcgccgggcaaactgctggtggatttcggtctgcgccgcgcccacggcgccgaggcgggactcctggcggcccgcgccgcctgcctcgccggtttcgccggcacttccgacgtactcgccggccggctttgggacttcccgctgtacggcaccatggcccattccttcatccaggcccatgacgacgaactcgccgccttcgagcatttcgccctcgcccagccggacaacctggtgctgctgatcgacacctacgacaccgaagccgcggcggaaaagctcatccccctggccgaacgcctggctgccaaaggaatccgcatccagggcgtgcgcctggacagcggcgacctggccgagcacgcccgccgggtccggcgtatcctcgaccgcggcggcctcggccaggtcagcatcttcgccagcggcagcctcgacgaatacctcctggccgcgcacactgcggaagccgtgccgatcgacggctacggcatcggcacccgcatggatacctcgtccgacgcaccctatctcgactgcgcctacaagctccaggaatatgccggcatcccccggcgcaagcgttcggaaggcaaggcgacctggcctggccggaaacaggtttaccggtattacgacgccgaggggaaattgcagcgggacagcctgacgttggtcgacgacgcgcagcccggcgaaccgctgctgcgcccggtgatgcgcaacggccgccgactcgcagcaagcccgcctttgcagacccttcgatcccatgcgatggaacagctcggtcgcctgccggaagcgttacgccgcctgtcaccggcgccggctcatccggtagagatcgccgggcgattgaagtccctggttaaagcgatggatggccatagctga

SEQ ID NO: 14020 - protein, 449 aa, Methylococcus capsulatus str. Bath
MSLPIDSVLLTDLYQLTMLQGYHAQRMNGTAVFEFFVRKLPGGDEPKRNFLVAAGLEQALDFLEGMRFRPDEIEWLRASGRFTPDFVDALAALRFSGDVDAMPEGTVFFPGEPILRVTAPLPEAQLAETRLINLLHFQTLIASKAARMTLAAPGKLLVDFGLRRAHGAEAGLLAARAACLAGFAGTSDVLAGRLWDFPLYGTMAHSFIQAHDDELAAFEHFALAQPDNLVLLIDTYDTEAAAEKLIPLAERLAAKGIRIQGVRLDSGDLAEHARRVRRILDRGGLGQVSIFASGSLDEYLLAAHTAEAVPIDGYGIGTRMDTSSDAPYLDCAYKLQEYAGIPRRKRSEGKATWPGRKQVYRYYDAEGKLQRDSLTLVDDAQPGEPLLRPVMRNGRRLAASPPLQTLRSHAMEQLGRLPEALRRLSPAPAHPVEIAGRLKSLVKAMDGHS

SEQ ID NO: 14021 - DNA, 1317 bp, Nocardia farcinica IFM 10152
  CDS (1)..(1317): transl_table=11
gtggacatccgcgaccaggtcaccacgagcaccgcgctgctgaccgatcaatacgagctcaccatgctggccgccgcgctcgccgacggttcggccgcgcgcacctgcgcgttcgaggtgttcgcccggcgcttgccgcacgggcgccgctacggcgtggtcgccggtaccgggcggttgctcgaggcgctgcggcacttccgcttcggcgagcccgagctcgcggtggtggcggggttcctcgacgagcgcacgctgaactggttgcgcgagtaccgcttcaccggcgacatcgacggctacccggagggcgagctgtactttcccggctccccgatcctgtccgtgcgcggcagtttcgccgagtgcgtggtgctggagacgctgatcctgtcgatcttcaaccacgacagtgccatcgcctcggcggcggcccgcatggtctcggccgccgacggccgccggatgatcgagatgggctcgcgccgcacccacgaagcggccgcacccgccgcggcccgggccgcctacctcgccggtttcgacgccacctcgaatctggaggcggtgcgccgctacggcgtgcccggcgcgggcaccagcgcgcacgcgttcaccctcctgcacagcggccgcgacggcgcgcacgaggccgaggcgttccgcagccaggtcgccgcgctcggcgtcggcaccaccctgttggtcgacaccttcgacatcaccgagggggtggcgaccgcgatccgggtggccggaccggagctgggcggcgtgcgcatcgactccggcgacctgggtgtgctggcccggcaggtccgcgagcaactggacgccctcggcgcgacgaagacccgcatcgtggtctccggcgacctcgacgagtacgcgatcgccgcgttgcgcgccgaacccgtcgacgtctacggcgtgggcacctcgctggtcaccggttccggcgcgccgaccgcgggcatggtctacaagctggtggaggtcgagggtgtgccggtggtcaagcgcagcagccacaaggaatcgcgcggcggtgccaagcgggcactgcggctgaccaagagctcgggcacgatcgtggaggagatcgtctacccggccactgccgagccgccgcccaccgacggcttcgaggccaggcagctgctggtgccgctggtgcgcggcggtgcggtcgtcgacgacctgccgacgctcaccgacgcccgcgacctcgtcgcgcgcggcctggtgagcctgccgtgggagggcctcaagctctccgacggcgaacccgccgtgcccaccaccttcgtctcctga

SEQ ID NO: 14022 - protein, 438 aa, Nocardia farcinica IFM 10152
MDIRDQVTTSTALLTDQYELTMLAAALADGSAARTCAFEVFARRLPHGRRYGVVAGTGRLLEALRHFRFGEPELAVVAGFLDERTLNWLREYRFTGDIDGYPEGELYFPGSPILSVRGSFAECVVLETLILSIFNHDSAIASAAARMVSAADGRRMIEMGSRRTHEAAAPAAARAAYLAGFDATSNLEAVRRYGVPGAGTSAHAFTLLHSGRDGAHEAEAFRSQVAALGVGTTLLVDTFDITEGVATAIRVAGPELGGVRIDSGDLGVLARQVREQLDALGATKTRIVVSGDLDEYAIAALRAEPVDVYGVGTSLVTGSGAPTAGMVYKLVEVEGVPVVKRSSHKESRGGAKRALRLTKSSGTIVEEIVYPATAEPPPTDGFEARQLLVPLVRGGAVVDDLPTLTDARDLVARGLVSLPWEGLKLSDGEPAVPTTFVS

SEQ ID NO: 14023 - DNA, 1404 bp, Legionella pneumophila str. Paris
  CDS (1)..(1404): transl_table=11
atgataaacatcacaggaacctacacagatcaatatcaattggctatggctcaagtatgttttttaaaagggcagcatgagcgtatagcgacattcgattatttttttcgtgctcttccttttaaaggaggctatgcgatttttgctggtttggaggatttactggatgttctcgaacaacttcgctttgaacaacaagatatagagtttttacaacatcagaatatgcatcctgactttattcgctatttgcaacagtttaagttcaatggcacggtgtatacgtcgctcgagggagatgttgtatttcctacgcggccagtggttattatcgaagccaatttgattgaagcacaaatcatagaaacattattattaaatattattaattttcagacacttattgcgacaaaagccagacgcatcaggcaggttgcgggggaacggattttaattgattttggactaaggagagcacagggtgctggagggtattttgcaagccgtgcagccatagttggtggctttgattcgacaagcaatgtcagagcagggcgtgattattcaattcctgtatcgggtactatggctcattcctttatccaaagttacgatagcgagatacaagctttttctgattatgctgaagcttggccggagaattgcatcttgctagtagatacttataatacgttgcaaagtggtgttcctaatgcaatcaaaatagctaaggaaatggagaagagaggacatagactcaaaggcattcgcctggatagtggcgatttggcatggttagccaagagggctcgccacatgttagacgaggtcggtttaaactatgtggctattacagcttccaatcaactcgatgaatatgtcatcaagaatttgttagagcaggatgcgcctattgacgcttttggtgtggggaccaatctcgcgattggtgccccggatgcggctcttgatggggtttataaattagcgtttataaatggtcaacctaggattaaactatcggatacccctgcaaagatcactattccttatcaaaagcaagtctacagggtgttcgaaagagatgggacatatcgaggtgcggatgttgtctgtctcaaaacggaaaaaaaaattgatatgatgcatcatccttttgaaattctaaaatcgctttcgataaagcactataaaaaagaagcattactgcataaagtgatggaaaacggcaaacggttactacctaaaaaatcacttggagaaatagccaggtttagccagcaatgttttgatcgattgcctttggaatacaagcgttttattaatcctcatatctataaagtaggtttaagtaccgagctgaaaatgaaaagagatcaactgatagctgaacactcaagataa

SEQ ID NO: 14024 - protein, 467 aa, Legionella pneumophila str. Paris
MINITGTYTDQYQLAMAQVCFLKGQHERIATFDYFFRALPFKGGYAIFAGLEDLLDVLEQLRFEQQDIEFLQHQNMHPDFIRYLQQFKFNGTVYTSLEGDVVFPTRPVVIIEANLIEAQIIETLLLNIINFQTLIATKARRIRQVAGERILIDFGLRRAQGAGGYFASRAAIVGGFDSTSNVRAGRDYSIPVSGTMAHSFIQSYDSEIQAFSDYAEAWPENCILLVDTYNTLQSGVPNAIKIAKEMEKRGHRLKGIRLDSGDLAWLAKRARHMLDEVGLNYVAITASNQLDEYVIKNLLEQDAPIDAFGVGTNLAIGAPDAALDGVYKLAFINGQPRIKLSDTPAKITIPYQKQVYRVFERDGTYRGADVVCLKTEKKIDMMHHPFEILKSLSIKHYKKEALLHKVMENGKRLLPKKSLGEIARFSQQCFDRLPLEYKRFINPHIYKVGLSTELKMKRDQLIAEHSR

SEQ ID NO: 14025 - DNA, 1404 bp, Legionella pneumophila str. Lens
  CDS (1)..(1404): transl_table=11
atgataaacatcacaggaacctacactgatcaatatcaattggctatggctcaagtgtgttttttaaaagggcagcatgagcgcatagcgacattcgattatttttttcgagctcttccttttaaaggaggctatgcgatttttgcgggtttggaggatttactggatgttctcgaacaacttcactttgaacaacaagatatagagtttttacaacatcagaatatgcatcctgactttattcgctatttgcagcagtttaagttcaatggcacggtgtatacgtcgctcgagggagatgttgtatttcctacgcggccagtggttattatcgaagccaatttgattgaagcacaaatcatagaaacgttattattaaatattcttaattttcagacacttattgcgacaaaagccagacgcatcagacaggttgcgggagaacggattttaattgattttggcctaaggagagcacagggtgctggagggtattttgcaagccgtgcagccatagtcggtggctttgattcgacaagcaatgtcagagcagggcgtgattattcaattcctgtatcgggtactatggctcattcctttatccaaagttacgatagcgagatacaagctttttctgattatgccgaagcatggccggagaattgtgtcttgctagtagatacttataataccttgcaaagtggtgttcccaatgcaatcaaaatagctaaggaaatggagaagagaggacatagactcaaaggcattcgcctggatagcggcgatttggcatggttagccaagagggctcgccacctgttagacgaggccggtttaaactatgtggctattacagcttccaatcaactcgatgaatatgtcatcaagaatttgttagagcaggatgcgcctattgatgcttttggtgtggggaccaatctcgcgattggtgccccggatgcggctcttgatggggtttataaattagcgtttataaatggtcaacctaggattaaattatcagatacccctgcaaagatcactattccttatcaaaagcaagtctacagggtgttcgaaagagatgggacatatcggggtgcggatgttgtctgtctcaaaacggaaaaaaaaattgatatgatgcatcatccttttgaagttctaaaatcactttcgataaagcactataaaaaagaagcattactgcataaagtgatggaaaacggcaaacggttactacctaaaaaatcacttggagaaatagccaggtttagccagcaatgttttgatcgattgcctttggaatacaagcgttttattaatcctcatatctataaagtgggtttaagtaccgagcttaaaatgaagagagatcaactgataactgaacactcaagataa

SEQ ID NO: 14026 - protein, 467 aa, Legionella pneumophila str. Lens
MINITGTYTDQYQLAMAQVCFLKGQHERIATFDYFFRALPFKGGYAIFAGLEDLLDVLEQLHFEQQDIEFLQHQNMHPDFIRYLQQFKFNGTVYTSLEGDVVFPTRPVVIIEANLIEAQIIETLLLNILNFQTLIATKARRIRQVAGERILIDFGLRRAQGAGGYFASRAAIVGGFDSTSNVRAGRDYSIPVSGTMAHSFIQSYDSEIQAFSDYAEAWPENCVLLVDTYNTLQSGVPNAIKIAKEMEKRGHRLKGIRLDSGDLAWLAKRARHLLDEAGLNYVAITASNQLDEYVIKNLLEQDAPIDAFGVGTNLAIGAPDAALDGVYKLAFINGQPRIKLSDTPAKITIPYQKQVYRVFERDGTYRGADVVCLKTEKKIDMMHHPFEVLKSLSIKHYKKEALLHKVMENGKRLLPKKSLGEIARFSQQCFDRLPLEYKRFINPHIYKVGLSTELKMKRDQLITEHSR

SEQ ID NO: 14027 - DNA, 1473 bp, Geobacillus kaustophilus HTA426
  CDS (1)..(1473): transl_table=11
atgaacgaaaaatatgccgatgacagtttgatgcttcatacggacttatatcaaatcaatatggtcgagacgtattgggaagatcgtatgcatgagcgccgcgccgtgtttgaagtgtttttccgcaagctgccgtttggcaacggctatgcggtgttcgctgggttggagcgcgtcattcagtttttgcaacaattccgcttctccgacagcgacatcgactatttgcggcatgagcttggctaccgcgacgactttttagactatttgcggacgcttcgtttcactggcacggtccgttcgatgcgagaaggggaaatcgtgttcgccaacgagccgattatgcgcattgaggcgccgctcgcggaggcgcagctcatcgaaaccgccattttaaacatcatcaatttccagacgctcatcgccacgaaagcgtcacgcattaagcatattctcggggatgagccggccttggagttcggcagtcggcgggcgcaggagatggatgcggcgctatggggcgcgcgcgcagcgtatatcggtgggattgaggcgacatcgaacgtgcgcgctgggaagctgtttggcattccggtcgccggaacgcatgcccattcgatgattcaagcgtatcaggatgaatacatcgcatttttgaagtatgcacgccgccataaagactgcgtatttctcgtcgatacgtacgatacgttgaagtcgggggtgccaaacgccattcgcgtcgctaaggagctgggcgaccaaatcaactttatcggcatccgcatcgacagcggcgatctcgcctatttgtcgaaagaagcgcggaaaatgctcgatgaagccggatttccgaacgcgaaaattttcgcctcgaacgatttggacgaagatacgattttaaacttgaagtcgcaaggggcgaaaattgacgtctgggggatcggcacgaagctgatcacggcgtacgatcagccggcgctcggtgccgtgtacaaaatggtggcgattgaaaacgaacgcggtgagatggtcgatacgatcaaaatcagcggcaatccagagaaagtgacgacgccggggctgaagcgggtgtaccgcatcgtcaacaaaatcaaccataaagcggaaggcgactacatcgccttagagagcgaaaacccgcagcaagaagagcggctgaaaatgttccatccggtgtacacgttcatcagcaaattcgtcaccaattttgaagcgcgtgatttgcatgtgacgatcttcgacaacggccggcttgtgtatacgtcgcccccgctttcggacattcaagcgtatgcgaaagaaagcttgcgcttgttttgggaggaatacaaacggacgctcaaccctgagcaatatcccgtcgatttgagccaagcgtgctgggacaataagatggaaaacatccgcaaggtgaaagaaacgatcgcgcgcatgtcgacgaaagagtaa

SEQ ID NO: 14028 - protein, 490 aa, Geobacillus kaustophilus HTA426
MNEKYADDSLMLHTDLYQINMVETYWEDRMHERRAVFEVFFRKLPFGNGYAVFAGLERVIQFLQQFRFSDSDIDYLRHELGYRDDFLDYLRTLRFTGTVRSMREGEIVFANEPIMRIEAPLAEAQLIETAILNIINFQTLIATKASRIKHILGDEPALEFGSRRAQEMDAALWGARAAYIGGIEATSNVRAGKLFGIPVAGTHAHSMIQAYQDEYIAFLKYARRHKDCVFLVDTYDTLKSGVPNAIRVAKELGDQINFIGIRIDSGDLAYLSKEARKMLDEAGFPNAKIFASNDLDEDTILNLKSQGAKIDVWGIGTKLITAYDQPALGAVYKMVAIENERGEMVDTIKISGNPEKVTTPGLKRVYRIVNKINHKAEGDYIALESENPQQEERLKMFHPVYTFISKFVTNFEARDLHVTIFDNGRLVYTSPPLSDIQAYAKESLRLFWEEYKRTLNPEQYPVDLSQACWDNKMENIRKVKETIARMSTKE

SEQ ID NO: 14029 - DNA, 1347 bp, Idiomarina loihiensis L2TR
  CDS (1)..(1347): transl_table=11
atgacaggtactgagcgacaagatcttggactgttcacagatttgtatcagctcacaatgctcgatgcgtatttgcaggaaggcatgcaagacgacgccgtttttacgttgttcgtccggcggcttccgaatgagcggaaatttctgttggctgcggggttagatcccttgcttgaaaccattgaaaacctgtcgttcagcgatgacgatttgcgctacctaaaagagcaaaacttctctcaacagcttatcgattatcttcgtgattttgagtttaccgggcaggtcagagcgcttcctgaaggtacggtattctttgaaaatgaacccattgtcgagattaaagcgccgctgccacaggcacagcttattgaaactctggtgatgaatcagatacacctgcaaaccttattggcctcaaagggggcgcgagttgcccatgcggcagaaaagcggccggttctggattttggtgcacgcagggtgcatggcattgatgcgggcaaaaaaggcagccgggcactgtatttaagcggtattgctgccacttcaaatatgctggctgcgcgaacttacggtttacctgtagctggcactatggcgcacagctatattcaggctcacgattcggaatatcaggcgttaaagaattttacccaggtttttccggaaaccgtcctactggtagacaccatcgataccttaaaaggtgtagaaaaagtcattcagttggccaatgagctgggcgatgactttaaagtaaaaggcattcggcttgactccggtgatttaggtgatcttgctgttaaagccagaaagctgctggacgaacataaccttcaccatttagagattattgccagcggcggtctggacgaacataaaattgcgcagttaatagctgatagagcacctatcgatggttttggtgtcggcaccggcatgggggtctccgacgatgcagcggcacttgatatggcctacaaactggttgaatacgcgggcaaggggcgtttgaagctttccagtggcaagcctgttttgccgggcgaaaagcaagtttttcgcgagtctggagacaacttccgtcgcgacactattgctcgtgcagaagagcagttacccggcgaaccattgctgaaaaaagtgatgcaaagcggcaaaaggttgccttctcaccagcgcgacattgaagaaattcgacagtacgcgcagcaacagttaaataaattacccgagtacgtctcctcgataagcagcaaggagaagtcttatccgatcgagataagcgataaactagcgagctaccagaaagaaataaccgaacaccttaaacaagagggttag

SEQ ID NO: 14030 - protein, 448 aa, Idiomarina loihiensis L2TR
MTGTERQDLGLFTDLYQLTMLDAYLQEGMQDDAVFTLFVRRLPNERKFLLAAGLDPLLETIENLSFSDDDLRYLKEQNFSQQLIDYLRDFEFTGQVRALPEGTVFFENEPIVEIKAPLPQAQLIETLVMNQIHLQTLLASKGARVAHAAEKRPVLDFGARRVHGIDAGKKGSRALYLSGIAATSNMLAARTYGLPVAGTMAHSYIQAHDSEYQALKNFTQVFPETVLLVDTIDTLKGVEKVIQLANELGDDFKVKGIRLDSGDLGDLAVKARKLLDEHNLHHLEIIASGGLDEHKIAQLIADRAPIDGFGVGTGMGVSDDAAALDMAYKLVEYAGKGRLKLSSGKPVLPGEKQVFRESGDNFRRDTIARAEEQLPGEPLLKKVMQSGKRLPSHQRDIEEIRQYAQQQLNKLPEYVSSISSKEKSYPIEISDKLASYQKEITEHLKQEG

SEQ ID NO: 14031 - DNA, 1344 bp, Silicibacter pomeroyi DSS-3
  CDS (1)..(1344): transl_table=11
atggcggttcggctggcgtatccatgggtgatccattccgaacgagggccatccgtggacatcgcaacccgcgtctataatcacaagtggaagatcgacccgatcgtccggtcgctgattgataccgatttctacaagttgctgatgtgccaatcggtgttccgcaacaagcccgacactcaggtcaccttttccctgatcaaccgcacgatgcggatcccgttggcccgtatcattgacgagggcgagttgcgcgagcagctcgatcatatccgctcgctgcggctgagccggggcgagagcacctggttgcgtggcaataccttttacggcaagcggcagatgtttaggccggacttcatggaatggttcgaggggctgcagttgccgccctatcatctggaacgccgcgacgatcaatatgagctgaccttcgagggcaactggcccgaggtgatgctgtgggagataccggcgctggcagtgctgatggaactgcgctcgcgcgcggtgctgcatgacatgcgccggttcgagctgcaggtgctttatgcccgcgcgatgacccgggtctgggagaagatcgaacgcctgcgcgggatcgacgggctgaccatcgccgatttcggcacccggcggcggcactccttcctctggcaggactggtgcgtgcaggcgatgatcgaggggctgggcgcgaaattcaccggcacctccaactgtctgatcgcgatgcgtcgcgaggtcgaggcgatcggcaccaatgcgcatgaactaccgatggtctatagcgccctggccgagaccgacaccgaactggcgcgcgcgccctacgacgtgctgagcgattggcacgaggagcatgacggcaacctgcgcatcatcctgcccgatacctatggcaccaaggggttcctcgaccgggcgccggactggctggcaggctggacaggcatccggatcgacagtggcgatccggccgagggggcggaaaccgccatctcctggtggaaggatcgcggcgagaacccgaccgacaagcgtatcatcttctcggacgggctcgacgtggacaagatcgccgaactgcatgcccggttttccgggcgggccaagatttccttcggctggggcaccctgctgaccaatgatttcaggggcctcgtgccggacgatgggctggcgccgttctcgctggtgtgcaaggcggtctcggccaatgggcacccgacggtgaaactgagcgacaatccggaaaaggcgatgggtcccgccgacgaggtcgcgcgctacaagcgggtgttcggagtggggcggcaaaccagctatgcggtcgaggtgtaa

SEQ ID NO: 14032 - protein, 447 aa, Silicibacter pomeroyi DSS-3
MAVRLAYPWVIHSERGPSVDIATRVYNHKWKIDPIVRSLIDTDFYKLLMCQSVFRNKPDTQVTFSLINRTMRIPLARIIDEGELREQLDHIRSLRLSRGESTWLRGNTFYGKRQMFRPDFMEWFEGLQLPPYHLERRDDQYELTFEGNWPEVMLWEIPALAVLMELRSRAVLHDMRRFELQVLYARAMTRVWEKIERLRGIDGLTIADFGTRRRHSFLWQDWCVQAMIEGLGAKFTGTSNCLIAMRREVEAIGTNAHELPMVYSALAETDTELARAPYDVLSDWHEEHDGNLRIILPDTYGTKGFLDRAPDWLAGWTGIRIDSGDPAEGAETAISWWKDRGENPTDKRIIFSDGLDVDKIAELHARFSGRAKISFGWGTLLTNDFRGLVPDDGLAPFSLVCKAVSANGHPTVKLSDNPEKAMGPADEVARYKRVFGVGRQTSYAVEV

SEQ ID NO: 14033 - DNA, 1260 bp, Neisseria gonorrhoeae FA 1090
  CDS (1)..(1260): transl_table=11
atgtgttctaatacgccccaagccgccaccagaaatcgggagacacgccatatgaccggcatcatacattcgctgctcgacactgacctctacaaattcactatgctgcaagtagtcctgcaccagtttccgcagacgcacagcctttacgaattccgctgccgcaacgtctcgaccgtctatccgcttgccgacatcagggaagacttggaagccgaactcgacgcgctctgccggctgcgcttcacccacgacgaactcggctatctgcgctccctgcgtttcatcaaaagcgactttgtcgattatctcgaactcttccagctccaacgccgctttgtcgaagtcggcacagacgataaaggccgtctgaacatccgtatcgaaggcccgatgatacaggcgatgttttttgaaatcttcatcctcgccattgtcaacgaactttacttccgccggctggaaacccctgccgttatcgaagaaggcgaacgccggcttcaagccaaagccgcgcgcctgaaagaaatcgccgccgcacagaatccggacgaaccgcccttcctgatttccgacttcggcacgcgccgccgctacaagctcgcgtggcaggaacacgtcatccgcaccctgctcgaagccgccccaagcatcgtgcgcggcacaagcaacgtttacctcgccaaaaaactcggcatcacccccatcggcaccatggcgcacgaattcctccaagccttccaagccctcgacgtgcgcctgcggaatttccaaaaggccgcgctcgaaagctgggtgcacgaataccggggcgatttgggcgttgccctgaccgacgtggtcggtatggatgccttcctgcgcgatttcgacctctatttcgccaaactctttgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaaggccgcttcaaaaccggcttcggcatcggcaccaacctcaccaacgatatggggcatacgcccttgaatatcgtgttgaaactggtcgaatgcaacgggcagtccgtcgccaagctctccgactcgccgggcaaaaccatgaccaacaacagcaccttcctcgcctacctgcgccaagtgttcggcatacccgaacctagaacgccgtaa

SEQ ID NO: 14034 - protein, 419 aa, Neisseria gonorrhoeae FA 1090
MCSNTPQAATRNRETRHMTGIIHSLLDTDLYKFTMLQVVLHQFPQTHSLYEFRCRNVSTVYPLADIREDLEAELDALCRLRFTHDELGYLRSLRFIKSDFVDYLELFQLQRRFVEVGTDDKGRLNIRIEGPMIQAMFFEIFILAIVNELYFRRLETPAVIEEGERRLQAKAARLKEIAAAQNPDEPPFLISDFGTRRRYKLAWQEHVIRTLLEAAPSIVRGTSNVYLAKKLGITPIGTMAHEFLQAFQALDVRLRNFQKAALESWVHEYRGDLGVALTDVVGMDAFLRDFDLYFAKLFDGLRHDSGDPYVWGDKAYAHYQKLKIDSRTKMLTFSDGLDIERSWALHQYFKGRFKTGFGIGTNLTNDMGHTPLNIVLKLVECNGQSVAKLSDSPGKTMTNNSTFLAYLRQVFGIPEPRTP

SEQ ID NO: 14035 - DNA, 1167 bp, Bacteroides fragilis NCTC 9343
  CDS (1)..(1167): transl_table=11
atgatcattcgtaccatactcgatacagacctttataaattcactacttcgtatgcttatatcaaactattcccgtacgcaataggcactttcagcttcaaagacagggacgggactgaatatagcgacgagtttgtggaaagattgagaacggaaatcagtcagctatcacacgtggcactgaccgaaaaagaactggaatatatgataaagaactgccgcttcctgcccagggtctattgggagtggctctcttctttccgtttccaacccgagaaaatagaaatccgtctggacgagaatcggcagcttcacatcgaagtgaacgactatctttacaaagcaacgctttatgaagtacctctactcgccatcgtttcggagataaagaaccaatcgtccggcaatgttgccaacctggaagacatcctgtacaaactgtccgaaaagacagaactgtccaataagcatcagctacttttctctgaattcggaacccgaaggcgcttttcgttcgatgtgcagaatcaagtcatcgggcacctgaaacagacagcccattactgtatcggcacttccaattgccatttcgccatgaaatacggcatgaagcccatgggtacgcatccccatgaatggttcatgtttcacggagcgcaattcggctataaacatgccaactatatggcccttgaaaattgggtaaatgtatacgatggcgaccttggcatcgccttgtccgacacttatacatctgccatctttctaagcaatctaagccgcaaacaggctaagttgtttgatggcgtgaggtgtgattccggtgatgaattccggttcatcgatcagctgaccgcacgttataaagagttgggcatcgacccgaccaccaagacaatcgtattcagtaacgcactcgactttgacaaagcactggatatccaggagtattgccagggaaagatccgttgctctttcggcatcgggacaaacctgaccaacgatacgggattcaagccatcaaacattgtcatgaagctatcgcaatgcaagatgaacatgaaccaggaatggcgcgaatgtgtgaaattatcagacgacatagggaaacatatcggcagcccggaagaggtgcgtgcctgtctatacgacttgcggttggagtaa

SEQ ID NO: 14036 - protein, 388 aa, Bacteroides fragilis NCTC 9343
MIIRTILDTDLYKFTTSYAYIKLFPYAIGTFSFKDRDGTEYSDEFVERLRTEISQLSHVALTEKELEYMIKNCRFLPRVYWEWLSSFRFQPEKIEIRLDENRQLHIEVNDYLYKATLYEVPLLAIVSEIKNQSSGNVANLEDILYKLSEKTELSNKHQLLFSEFGTRRRFSFDVQNQVIGHLKQTAHYCIGTSNCHFAMKYGMKPMGTHPHEWFMFHGAQFGYKHANYMALENWVNVYDGDLGIALSDTYTSAIFLSNLSRKQAKLFDGVRCDSGDEFRFIDQLTARYKELGIDPTTKTIVFSNALDFDKALDIQEYCQGKIRCSFGIGTNLTNDTGFKPSNIVMKLSQCKMNMNQEWRECVKLSDDIGKHIGSPEEVRACLYDLRLE

SEQ ID NO: 14037 - DNA, 1251 bp, Salmonella enterica subsp. enterica serovar Choleraesuis str
  CDS (1)..(1251): transl_table=11
ttgtttattgtactaaacgctcccgtgagaggacgcaacagcgcacctatgacacaattcgcttctcctgttctgcactcgttgctggatacagatgcttataagttgcatatgcagcaagccgtttttcaccactactatgatgtgcaggtagcggctgagtttcgttgccgtgacgacgacctgctgggtatttatgccgatgctattcgcgagcaggtggacgcgatgcagcacctgcgcctccaggaggacgagttccagtggctctccggcctgcccttttttaaaccggattatctgaactggttacgcgagtttcgctataacccggctcaagtctgtgtcaccaacgataacggcaagctgaatattcgcttaaccggcccgtggcgtgaagtcattatgtgggaagtgccgctgctggccgtgatcagtgagctggttcatcactaccgctcgccaaacgcgggcgttgatcaggcgctcgacgcgctggaaagtaagctggttgatttcactgcgttaaccgccaatctcgatatgtcccgcttccacctgatggacttcggcacccgccgccgtttctctcgtgaagtgcagcaggcgatagttaaacgtctccagcaggagtcatggttcgtcggcaccagcaactatgatctcgcgcgtcgcctggcgctgacgccgatgggcactcaggcgcacgaatggttccaggcgcatcaacaaatcagtccggacctggcgaccagccagcgtgccgcgttggccgcctggcttaacgaatatccggaccagcttggtatcgcattgacagattgcattacaatggatgcgtttttacgcgatttcggcattgaattcgccagccgttatcaggggttacgccacgactcaggagaccctgtcgcatggggcgaaaaggcgattgcccattatgaaaagctggggattgatccgctgacaaaaacgctggtcttttcagataaccttgatctgccaaaggcagtcgagctctatcgccatttcgcctctcgcgtgcagttaagcttcggcatcggtacccgcctgacatgcgatatccctcaggtaaaaccgctcaatatcgtgattaagctcgtggaatgtaacggaaagccggtggctaaactttccgacagccccggtaaaacgatctgtcatgataaagcgtttgtgcgcgcgctgcgtaaagcgttcgatctcccgcaggtgcgtaaagcaagttaa

SEQ ID NO: 14038 - protein, 416 aa, Salmonella enterica subsp. enterica serovar Choleraesuis str
MFIVLNAPVRGRNSAPMTQFASPVLHSLLDTDAYKLHMQQAVFHHYYDVQVAAEFRCRDDDLLGIYADAIREQVDAMQHLRLQEDEFQWLSGLPFFKPDYLNWLREFRYNPAQVCVTNDNGKLNIRLTGPWREVIMWEVPLLAVISELVHHYRSPNAGVDQALDALESKLVDFTALTANLDMSRFHLMDFGTRRRFSREVQQAIVKRLQQESWFVGTSNYDLARRLALTPMGTQAHEWFQAHQQISPDLATSQRAALAAWLNEYPDQLGIALTDCITMDAFLRDFGIEFASRYQGLRHDSGDPVAWGEKAIAHYEKLGIDPLTKTLVFSDNLDLPKAVELYRHFASRVQLSFGIGTRLTCDIPQVKPLNIVIKLVECNGKPVAKLSDSPGKTICHDKAFVRALRKAFDLPQVRKAS

SEQ ID NO: 14039 - DNA, 1224 bp, Pseudomonas syringae pv. syringae B728a
  CDS (1)..(1224)
atgagcgagagcgccttttccaatcgcatcgtgcaaagcctgctcgataccgatttctacaagctgaccatgatgcaggccgtcctgcacaactacccgaacgtggacgtcgagtgggaattccgttgccgcaacggggaggaccttcgcccctatctggatgaaatcaagcaccagatcgagctgttgtgcgagctgtcgctaagccccgaacatctggcctttctggaacgcatcaccttcatcaaaccggattttctgcgctttctcgggctgttccgcttcaatacccgctacgtgaaaaccaccatcgagaatgacgaactgtgcattcgcctgcacgggccgtggctgcacgtcatcctgttcgaagtgccgctgctggccatcgtcagcgaagtgcgcaaccggcatcgctacccggacaccctgctcagccaggcgcgggatcgtctgtatgacaagttcgaatggttgaccacgcatgccacgacggatgagctggccgagctgaaagtggcggacttcggcacgcgccggcggttttcctaccgcgtgcaggaagaaatgctcggcgtcctgaaaaacgactttccaggccagttcgtcggcaccagcaatgtgcatctggcccgccagcttgacctcaagcccttgggcaccatggcccacgaatggatcatggcccatcagcagctgggaccgcgtctgatcgacagtcagattgccgcgctcgattgctgggtccgtgaatatcgcggcctgctggggatcgcgctgaccgactgcatcaccaccgatgccttcctgaacgacttcgatctgtacttcgccaagctgttcgacggtttgcgccatgattcgggcgacccggtgaagtgggccgaaaaatgcatctcgcattaccagaagctcggtatcgacccgatgagcaagaccctggtgttttccgatgggctgaacctgcccaaggcgctcgatatctttcgcgcgttgcgcggacgcatcaatgtcagcttcgggatcggcaccaacctgacggccgacatccccggcattgcgccgatgaacatggtattgaaaatgacggcttgcgccggtcaggccgtggcgaagatctctgacgagcccggcaagacgcagtgcaaggacccgaactttgtcgcttacctgcggcatgtgttcaaggtgccggatttgccgagcccggaaaaacccgcttga

SEQ ID NO: 14040 - protein, 407 aa, Pseudomonas syringae pv. syringae B728a
MSESAFSNRIVQSLLDTDFYKLTMMQAVLHNYPNVDVEWEFRCRNGEDLRPYLDEIKHQIELLCELSLSPEHLAFLERITFIKPDFLRFLGLFRFNTRYVKTTIENDELCIRLHGPWLHVILFEVPLLAIVSEVRNRHRYPDTLLSQARDRLYDKFEWLTTHATTDELAELKVADFGTRRRFSYRVQEEMLGVLKNDFPGQFVGTSNVHLARQLDLKPLGTMAHEWIMAHQQLGPRLIDSQIAALDCWVREYRGLLGIALTDCITTDAFLNDFDLYFAKLFDGLRHDSGDPVKWAEKCISHYQKLGIDPMSKTLVFSDGLNLPKALDIFRALRGRINVSFGIGTNLTADIPGIAPMNMVLKMTACAGQAVAKISDEPGKTQCKDPNFVAYLRHVFKVPDLPSPEKPA

SEQ ID NO: 14041 - DNA, 1326 bp, Corynebacterium jeikeium K411
  CDS (1)..(1326): transl_table=11
atggagcgggtgaacgaaaacaacacccgctcctccgcacttcttacggacaaatacgaactcaccatgctcgaggccgcgatcctcgacggcactgtcgaccgcgcctgcaccttcgaggtgttcacccgccgcctgcccaacgagcgccgctacggcgtgatcgccggcaccgcccgcgtactgcaggccgtgcgcgatttcgtatttaccgaccagcagctggatcgcatcgacttcctgcgggacgaaaccctggagtacctgcgcaacttccgcttctccgggcagatcgacggctaccgcgaaggcgagctgtacttcccccactcccccgtcctgacggtccggggcaccttcggcgagtgcgtaatcctggagacagtgatcctctccatcctgaacatggattccgccgtggctagtgccgccgcccgcatggtcaccgccgcaggtgaccgtcccatcatcgacatgggtgcacgccgcacccacgaatacgccgccgtcacctccgcccgggccgcctacctcgccgggttcgtcgccacctccaacatggaggccgcccagcgctacggcatcccggcctccggcaccgcagcccacgcctggaccctgctgcacacccgcccggacggcacccccgacgagctcgcagccttcaaggctcagatcgccgccctgggaacagacaccaccctgttggtggatacctacgacatcactcaaggcgtggaaaacgccgttgccgccggcggcacggaactgggagccgtgcgcatcgactccggcgatttgggcgtgctgacccgccgggtgcgcgaccagctggattccttgggggcaaagaacaccaagatcgtggtctcctccgacatggacgaattctccatcgccgccttgcgcagcgagccggtggattccttcggcgtgggcacctccgtcgttaccggctccggggcgcccaccgcggggctggtctacaagctcgtggaggtagacggcgtgcccgtcgccaagcgttcccgaggcaaggccagcctcggcggggcgaaggatgccgcccgctttagccgcccctccggcacggccgtcgaggaagtcaccttccccttgggtgcggaactgccccaggccgaagggctgaaaagcacccagctgaccatccccatggttcgcgacggcgagctcgtggacggcctgcccaccctcgaggaatcccgcgagcactgcgccaagcagctagtttgcctgccctgggaaggcctggctctcacccgcgacgagcccgccctgcaggtgcgccatatcagccgcatttaa

SEQ ID NO: 14042 - protein, 441 aa, Corynebacterium jeikeium K411
MERVNENNTRSSALLTDKYELTMLEAAILDGTVDRACTFEVFTRRLPNERRYGVIAGTARVLQAVRDFVFTDQQLDRIDFLRDETLEYLRNFRFSGQIDGYREGELYFPHSPVLTVRGTFGECVILETVILSILNMDSAVASAAARMVTAAGDRPIIDMGARRTHEYAAVTSARAAYLAGFVATSNMEAAQRYGIPASGTAAHAWTLLHTRPDGTPDELAAFKAQIAALGTDTTLLVDTYDITQGVENAVAAGGTELGAVRIDSGDLGVLTRRVRDQLDSLGAKNTKIVVSSDMDEFSIAALRSEPVDSFGVGTSVVTGSGAPTAGLVYKLVEVDGVPVAKRSRGKASLGGAKDAARFSRPSGTAVEEVTFPLGAELPQAEGLKSTQLTIPMVRDGELVDGLPTLEESREHCAKQLVCLPWEGLALTRDEPALQVRHISRI

SEQ ID NO: 14043 - DNA, 1293 bp, Rhodobacter sphaeroides 2.4.1
  CDS (1)..(1293)
atggtcgatatcgccacccgcgtctacaatcacaaatggaagatcgatccgatcgtccgctcgctgatcgacaccgacttctacaagctcctgatgtgccagtcggtgttccgcaacaggccggacacggtggtgcgcttcagcctcatcaaccgcacctcctcggtgcggctggccgagctgatcgacgagggcgagctgcgcgaacagctcgaccatatccgcacgctgagcctgtcgcgcggcgagagcaccttcctgcgcggcaacaccttctacggcaagcgccagatgttccgccccgacttcatggagtggttcgaaaacctgcggatgcccccctaccatctggagaagcgcgacgggcaatacgagctgaccttcgagggcaagtggcccgaggtcatgctgtgggagatcccggcattggccgtgctgatggagctgcgctcgcgcgcggtgctggccacgatggggcggttcgagctgcaggtgctctatgcccgcgccatgaccaagctctgggagaagatcgagcggctgaagcggatcgagcggctgaagatcgcggatttcggcacccggcggcggcattccttcctctggcaggactggtgcgtgcaggcgatgatcgaggggctgggcgatgccttcaccggcacctcgaactgcctgatcgccatgcggcgcgaggtcgaggccatcggcaccaatgcccacgagctgccgatggtctattccgccctggccacgacggacgaagacctcgcccgcgcgccctatcaggtgctggccgactggcacgaggagcatgacggcaacctccgcatcatcctgcccgacacctacggcaccgaaggcttcctcgcccgcgcgccggactggctctcgacctggacgggcatccgcatcgactcgggcgacccggcccagggcgccgagaccgcgatccgctggtggcagagccggggcgaggatccgcgccgcaagctcgtgatcttctcggacgggctcgatgtcgagaagatcgaggagctgcaccgccagttccacggccaggtgaaggtcagcttcggctgggggacgatgttcaccaacgatttccgcggcctcgtgaaggacgatgcgctggcccccttcagcctcgtctgcaaggcggtggcggcggacggacggcccacggtgaagctctcggacaatccgctgaaggcgatgggtcccgccgacgagatcgcgcgctacaagcgcgtcttcggcgtgggcgatcaggtggcctacgaagtgcaggtctga

SEQ ID NO: 14044 - protein, 430 aa, Rhodobacter sphaeroides 2.4.1
MVDIATRVYNHKWKIDPIVRSLIDTDFYKLLMCQSVFRNRPDTVVRFSLINRTSSVRLAELIDEGELREQLDHIRTLSLSRGESTFLRGNTFYGKRQMFRPDFMEWFENLRMPPYHLEKRDGQYELTFEGKWPEVMLWEIPALAVLMELRSRAVLATMGRFELQVLYARAMTKLWEKIERLKRIERLKIADFGTRRRHSFLWQDWCVQAMIEGLGDAFTGTSNCLIAMRREVEAIGTNAHELPMVYSALATTDEDLARAPYQVLADWHEEHDGNLRIILPDTYGTEGFLARAPDWLSTWTGIRIDSGDPAQGAETAIRWWQSRGEDPRRKLVIFSDGLDVEKIEELHRQFHGQVKVSFGWGTMFTNDFRGLVKDDALAPFSLVCKAVAADGRPTVKLSDNPLKAMGPADEIARYKRVFGVGDQVAYEVQV

SEQ ID NO: 14045 - DNA, 1134 bp, Xylella fastidiosa Ann-1
  CDS (1)..(1134)
atgatgcaggctgtgttgcatcaataccctggggcacaggtggagtacaggtttaaatgccgtacgcctggtgtggatctggcgcgtttcatcaacgaaatctctcatgagattgatgggctatgtgggctgtgtttttctaaggaggaactggattatttgcgcggcttgcgcttcatgaagccagatttcgttgatttccttggactgtttcatttagaccgtaaatacctgcaattgcgtgcctcgtcccaggtgccgggcgagattgaattggatattcgtggcccatggttacatacgattctgttcgaggtgccgttgttggcgattatcaatgaggtttggttccgcaatacaagcgtgttgaatcttgatgtgggtcgtgaccgattggatgccaaggtacgtttacttaaagacgagagtggttatgaggagtgcagcattgctgactatggcacccgccgccgttactcgcggcagtggcatgccgaattattgccgttgttggcgcaaggtttagggtcgaacttcgttggtaccagtaacgtttatttcgccaagcagtatggctataccccattggggacgatggcacacgagtatctacaggcatttcaggcattgggaccgcgcctgcgtgattcccaggtggcagggttggaagcctgggcgcgtgagtaccgcggcgatttaggaattgcgttgtctgatgttgttgggttggatgcgtttttgggtgactttgacttgtatttttgcaagttgtttgacggaatgcgccacgactccggagatccatttaaatggggggagcgcatcattatgcatctggagtcgcatcgtatcgatccacgtaccaaggtgctggtattcagtgatggacttgatatgaataaggtcatgcggttgtaccagcacttccgtggccgttgtcgcttggcgtttggcgtagggacgagtttgacgaatgatctcgggccgacgccattgcagatcgtgattaaaatggtccgttgcaatggtcagccagtggcgaagctcagtgattctccgggtaaaagcatgtgcgatgatccagggtacctgcattacttgcgtcaggtgtttggggtatctgccgatgtttga

SEQ ID NO: 14046 - protein, 377 aa, Xylella fastidiosa Ann-1
MMQAVLHQYPGAQVEYRFKCRTPGVDLARFINEISHEIDGLCGLCFSKEELDYLRGLRFMKPDFVDFLGLFHLDRKYLQLRASSQVPGEIELDIRGPWLHTILFEVPLLAIINEVWFRNTSVLNLDVGRDRLDAKVRLLKDESGYEECSIADYGTRRRYSRQWHAELLPLLAQGLGSNFVGTSNVYFAKQYGYTPLGTMAHEYLQAFQALGPRLRDSQVAGLEAWAREYRGDLGIALSDVVGLDAFLGDFDLYFCKLFDGMRHDSGDPFKWGERIIMHLESHRIDPRTKVLVFSDGLDMNKVMRLYQHFRGRCRLAFGVGTSLTNDLGPTPLQIVIKMVRCNGQPVAKLSDSPGKSMCDDPGYLHYLRQVFGVSADV

SEQ ID NO: 14047 - DNA, 1464 bp, Leuconostoc mesenteroides subsp. mesenteroides ATCC 8293
  CDS (1)..(1464)
atggaaggaaaggacttgaacatgtattctgatgactcactggtgctccatacggatgcgtaccaaattaatatgatttatacttactggaaacaaggtattgatcaaaaacccgttgtttttgaggcttatttccgtaaaatgcctttcaataatggctatgttattttcagtggtttagaacgaattgtcaaaatattaaatcaactgaaatttactgatgacgatattgattatttacaatcattagacctatacgacactgaatttttaacgtaccttaaaaactggcatttgactgcaacaatacgttcggcttatgagggtgaagtgatgttcaacaatgaaccgcttttgcaagttgaaggacctctggtcgatgctcaattattggaaactttactgctcaatattatcaactttcagacattgattgctactaaagcggctcgtattgctagtgtaacaaatggtgaccccctattagagtttggtacacgtcgtgctcaggaattggacgctgcgctttggggtacccgtgctgcttttattggtggctttgatgctacatctaatgttcgtgcaggaaaactattcaatattcctatttctggcacacatgctcatgcgcttgttcaagcttaccacaacgattatgatgcttttcatgcctacgcagcaacacataaaaatgttgtttttctagtagatacatttgacacactaaaatctggtgttccaaacgctatcaaagtagcccgtgagtttggagataagattaattttcaaggggttcgaattgattcaggtgacatggcatacctttctaaaaaagttcgtatcatgttagatgaagcaggattcacgaatgccaaaatttatgcatcaaatgatttagacgaaaacaccattttaaatcttaaaattcagggtgcaaaaattgatgtctggggaattggcacaaaattaatcacagcatatgatcaacctgccttaggtgcggtatacaagatggttagtatcgacggcgatgacacaattaaattgtcaaacaacgttgaaaaaatctcaacccctggaaaaaagcaagtttggcgaataacagatagtaaagatggcaaatctgaaggtgattatttgactttcgatgatgaaaatcctagccaattggaaactttgcacatgtttgatcccaatcatcctgttatttctaaaaacattaaaaatttcgatgcacaaccgatgctacatgatatttttgttgagggtgacctaatttatgatttgcctgatattactacaattaaaagctacgccaaacattcgttaaacgatctatgggatgaatacaaacgtatactgaatcctgaaacctatcctgttgacttatctcaaaagctatatgatgctaaaatgaatttaattcatgacattcgaaacaatatacaggagatgaccaaatga

SEQ ID NO: 14048 - protein, 487 aa, Leuconostoc mesenteroides subsp. mesenteroides ATCC 8293
MEGKDLNMYSDDSLVLHTDAYQINMIYTYWKQGIDQKPVVFEAYFRKMPFNNGYVIFSGLERIVKILNQLKFTDDDIDYLQSLDLYDTEFLTYLKNWHLTATIRSAYEGEVMFNNEPLLQVEGPLVDAQLLETLLLNIINFQTLIATKAARIASVTNGDPLLEFGTRRAQELDAALWGTRAAFIGGFDATSNVRAGKLFNIPISGTHAHALVQAYHNDYDAFHAYAATHKNVVFLVDTFDTLKSGVPNAIKVAREFGDKINFQGVRIDSGDMAYLSKKVRIMLDEAGFTNAKIYASNDLDENTILNLKIQGAKIDVWGIGTKLITAYDQPALGAVYKMVSIDGDDTIKLSNNVEKISTPGKKQVWRITDSKDGKSEGDYLTFDDENPSQLETLHMFDPNHPVISKNIKNFDAQPMLHDIFVEGDLIYDLPDITTIKSYAKHSLNDLWDEYKRILNPETYPVDLSQKLYDAKMNLIHDIRNNIQEMTK

SEQ ID NO: 14049 - DNA, 1242 bp, Psychrobacter sp. 273-4
  CDS (1)..(1242)
atgaccgttacccatacttctacaacttttgagcccattattacctcgttacttgataacgatttgtacaaatttaccatgctgcaagccatgctacatcagtttccgcagactcatggtgtctaccgctttcgctgccgtaataataaagatgccgcttatccacttgctgatatcaaagacgcattagaaaaacaactagacagcttatgtgaactgcgatttttagaagatgaactagaatacttgcgtggtttacgctttatgcgttcagacttcgttgattacttggagttgtttaagttaaaacgtcgttttatcacggtgactaccgatgataaaggtcgcctatttatcgatatcgaaggtccgatgattcaggcgatgttcttcgaagtgttcgtgctagccattgttaatgagctatatttcaaggcgttaaccgacgctagcgtacttgaagaagggcagcgccgcctagatgaaaaagttgaattattgcatcgttatgctgccgaacaagcaggcaacagccgtgatattccgccttttatcgtcgctgattttggtacacgtagacggtttaataaagactggcaagcccatgtggttgaaactttgcacaaggctgaaccaaaaatagtgggcggcacctccaacgtttatttggcaaaaaagcttggcatgacgccaattggtacgatggcacatgagtttatgcaggcatttcaggcattggatgtgcgcctacgtgattcacaaaaagcagcgcttgaggcttgggtacacgaatatcgcggtgatttgggtattgcgctgaccgatgtcgttggcatggatgcgttcttacgtgattttgatttgtattttgccaagctttttgatggtctgcgccatgatagtggcgacccgtatctttggggtgataaggcgattgcccattataaaaagctaaaaatagacccaagaactaaggtgttaacctttagtgatggcttggatctgaataaggcgtgggatttacatcaatattttaaaggtcaaattaaaaccagctttggtattggcaccaatctcaccaatgatatgggcatcacaccgttaaatatcgttctaaaattggttgaatgtaatggacagccagtcgctaagctgtctgatagcccaggcaagacaatgatcaataatgatacctatcttgcctatctgcgccaagtgtttgacgtcgatgagccagaatag

SEQ ID NO: 14050 - protein, 413 aa, Psychrobacter sp. 273-4
MTVTHTSTTFEPIITSLLDNDLYKFTMLQAMLHQFPQTHGVYRFRCRNNKDAAYPLADIKDALEKQLDSLCELRFLEDELEYLRGLRFMRSDFVDYLELFKLKRRFITVTTDDKGRLFIDIEGPMIQAMFFEVFVLAIVNELYFKALTDASVLEEGQRRLDEKVELLHRYAAEQAGNSRDIPPFIVADFGTRRRFNKDWQAHVVETLHKAEPKIVGGTSNVYLAKKLGMTPIGTMAHEFMQAFQALDVRLRDSQKAALEAWVHEYRGDLGIALTDVVGMDAFLRDFDLYFAKLFDGLRHDSGDPYLWGDKAIAHYKKLKIDPRTKVLTFSDGLDLNKAWDLHQYFKGQIKTSFGIGTNLTNDMGITPLNIVLKLVECNGQPVAKLSDSPGKTMINNDTYLAYLRQVFDVDEPE

SEQ ID NO: 14051 - DNA, 1179 bp, Ralstonia eutropha JMP134
  CDS (1)..(1179)
atgatcatccaatccctgctcgacaccgacctgtacaagttcacgatgatgcaggtggtgctgcaccatttcccgcaggcccaggtcgagtaccgcttcaagtgccggaacgcggatgttgacctgactccgtatgtcgacgagatccgcgcggaagtggcccacctgtgcagccttcgcttctcggatgacgaacttgcctacctgcgtagcatgcgcttcatcaagagcgatttcgtcgatttcctcgcgctgttccacctgaacgagaaatacgtgtcgatcgagccggcgccgcagggcaatggtgaaatcgagattgcgatccgcggctcgtggctgcacacgatcctgttcgaggtgccgctgctggccatcgtcaacgaggtttatttccgggccacccagccgcagccggacttcgccgaggggcgtcgccggctggaacagaagctgacgctgctgcgggcgccgaagtaccgcgactgcgtgattgccgactatggcacgcgccggcgcttctcgcgcgactggcaggaggaaatcctgctggcgacacgcaagacgctgggggcgcaactggccggcaccagcaacgtgctttttgcataccggcacaatatggtgccgctggggaccatggcccatgagtacctgcaggcgtgccaggcactgggtccgcgcctgcgcgactcacaggtattcgcgctggagaactgggcgcgcgaataccgtggcgacctgggcatcgcgctgtcggacacctacggcttcgacgcgttcctgcgggacttcgatctgtttttctgcaagctgttcgatggcgttcggcatgattccggtgacccgttcctgtggggcgagaagatgctcgcgcactacgcggccaatcgtgtcgatccgctcggcaagacgctgatcttcagcgacagcctcgatatcccgcgcgtgatcgagctgtacgagcggttccatggccgctgcaagctggcattcggcgtcggcaccaacctgaccaacgacctcggctacacgccgttgcagatcgtcatcaagatggtccgctgcaacggccagccggtggccaagctgtcggataccccggaaaagaccatgtgcgacgaccccggctacctggcctacctgcgtcaggtattcgacgttaaggcgtccgcgtag

SEQ ID NO: 14052 - protein, 392 aa, Ralstonia eutropha JMP134
MIIQSLLDTDLYKFTMMQVVLHHFPQAQVEYRFKCRNADVDLTPYVDEIRAEVAHLCSLRFSDDELAYLRSMRFIKSDFVDFLALFHLNEKYVSIEPAPQGNGEIEIAIRGSWLHTILFEVPLLAIVNEVYFRATQPQPDFAEGRRRLEQKLTLLRAPKYRDCVIADYGTRRRFSRDWQEEILLATRKTLGAQLAGTSNVLFAYRHNMVPLGTMAHEYLQACQALGPRLRDSQVFALENWAREYRGDLGIALSDTYGFDAFLRDFDLFFCKLFDGVRHDSGDPFLWGEKMLAHYAANRVDPLGKTLIFSDSLDIPRVIELYERFHGRCKLAFGVGTNLTNDLGYTPLQIVIKMVRCNGQPVAKLSDTPEKTMCDDPGYLAYLRQVFDVKASA

SEQ ID NO: 14053 - DNA, 1200 bp, Burkholderia cepacia R18194
  CDS (1)..(1200)
atgatcatcacttcgctgctcgacacggatctctacaagttcacgatgatgcaggtcgtcctgcatcacttccccgctgcaagcgtcgaataccgtttccgctgccgcacgcccggcgtcgatctcgtgccgtacatcgacgagatccgcgacgaggtgcgcggcctgtgcgcgctgcgtttttccgacgtcgaactcgactacctgcggcggatgcgcttcatcaaaagcgatttcgtcgatttcctcgcgctgttccacctgaacgagaagtacatctcgatcacgccgtcgccgaagggcaacggcgaaatcgacatcgagatcatcgggccgtggctgcacacgatcctgttcgagatcccggtgctcgcgatcgtcaacgaagtgtatttccgcaacacgcagcgcgagcccgactatcgcgaaggccgcgaacggctgtgcgagaaaatcaagctgctcggtgcgaagcccgagttcgccgactgcaagatcgccgactacggcacgcgccggcgcttctcgaaggtctggcacgaggaagtcgcgctcaccctgcgcgacggcctcggcccgcagttcgcgggcacgagcaacgtgctttatgcgatgaagcacggcatcacgccgctcggcacgatggcgcacgagtacctgcaggcgtgccaggcgctcggcccgcggctgcgcgattcgcagatctacggcttcgagatgtgggcgaaggaataccgcggcgacctcgggatcgcgctatcggacgtctacgggatggatgcattcctgaacgacttcgacatgtacttctgcaagctgttcgacggcgcgcgccacgattcgggcgatccgttcgaatggggcgagcggatgctgcgccattacgagtcgaaccgttgcgacccgcggaccaaggtgctcgtgttctcggacgcgctcgacatcccgaaggtcatgcagttgtacgaacggttccgcggccgctgcaagctcgcgttcggtgtcggcacgaacctcaccaacgatctcggctacgtgccgctgcagatcgtgatcaagatggtccgctgcaacggccagccggtcgcgaaactgtcggattcgccgggcaagagcatgtgcgacgacaaggcgtatctcgcatacctgcgccaggtgttcggcatcgcgcagccggtcgaggaagacgcgtcgaagtaa

SEQ ID NO: 14054 - protein, 399 aa, Burkholderia cepacia R18194
MIITSLLDTDLYKFTMMQVVLHHFPAASVEYRFRCRTPGVDLVPYIDEIRDEVRGLCALRFSDVELDYLRRMRFIKSDFVDFLALFHLNEKYISITPSPKGNGEIDIEIIGPWLHTILFEIPVLAIVNEVYFRNTQREPDYREGRERLCEKIKLLGAKPEFADCKIADYGTRRRFSKVWHEEVALTLRDGLGPQFAGTSNVLYAMKHGITPLGTMAHEYLQACQALGPRLRDSQIYGFEMWAKEYRGDLGIALSDVYGMDAFLNDFDMYFCKLFDGARHDSGDPFEWGERMLRHYESNRCDPRTKVLVFSDALDIPKVMQLYERFRGRCKLAFGVGTNLTNDLGYVPLQIVIKMVRCNGQPVAKLSDSPGKSMCDDKAYLAYLRQVFGIAQPVEEDASK

SEQ ID NO: 14055 - DNA, 1224 bp, Pseudomonas fluorescens PfO-1
  CDS (1)..(1224)
atgagcgagagtgtgtttgccgatcgcatcgtgcagaacctgctcgacaccgacttctacaaactgacgatgatgcaggcggtgctgcacaactaccccaacgtcgaagtcgaatgggagtttcgttgccgtaacagtgaagatctgcgcccgtatctggcggagatccgcttccaggtcgagcgtctggccgagttgagcctgagcgccgatcagttgagtttcctggagcgcatcagcttcctcaaacctgacttcctgcgtttcctcggcctgttccgcttcaacctgcgctacctgcacaccggtatcgagaacggcgagttgttcatccgcctgcgcgggccgtggctgcatgtgattctgttcgaagtgccgctgctggcgatcgtcagcgaagtgcgcaaccgctatcgctaccgtgaaacggtgctggaacaggcccgcgaacagctgtatcgcaagttcgactggttgaccgccaatgcctcggccgaagagttgtcgcagttgcaggtcgccgatttcggcacacgccggcggttttcctaccgcgtgcaggaagaagtggtgaacgtgctcaagcacgatttccccggacgcttcgtcggcaccagcaacgtgcacctgtcccgcgaactggacatgaaaccgctgggcaccatggcccacgagtggatcatggcccaccagcaactcggcccgcgactgatcgacagccagatcgccgccctcgattgctgggttcgcgagtaccgcggcctgctggggatcgccctcacagactgcatcactaccgatgccttcctcggcgatttcgatctgttcttcgccaagctgttcgacggtctgcgccacgattccggggacccggtgctgtggggcgaaaaatgcatcgcccactatcacaagctcggcatcgacccgatgagcaagaccctggtgttctccgacagcctgaccctgcccaagtcgctggagatcttccgtgcgttgcgcggccggatcaatgtcagcttcggcatcggcaccaacctgacctgtgacattccgggtgtcgaaccgatgagcatcgtgcttaaaatgaccgcctgcaacggccaaccggtggcgaagatctccgacgagccgggcaagacccactgcaaagacccgaatttcgtcgcctatttgcgacacgttttccaggttcctgccgtttccagcctttccagcaaggagtga

SEQ ID NO: 14056 - protein, 407 aa, Pseudomonas fluorescens PfO-1
MSESVFADRIVQNLLDTDFYKLTMMQAVLHNYPNVEVEWEFRCRNSEDLRPYLAEIRFQVERLAELSLSADQLSFLERISFLKPDFLRFLGLFRFNLRYLHTGIENGELFIRLRGPWLHVILFEVPLLAIVSEVRNRYRYRETVLEQAREQLYRKFDWLTANASAEELSQLQVADFGTRRRFSYRVQEEVVNVLKHDFPGRFVGTSNVHLSRELDMKPLGTMAHEWIMAHQQLGPRLIDSQIAALDCWVREYRGLLGIALTDCITTDAFLGDFDLFFAKLFDGLRHDSGDPVLWGEKCIAHYHKLGIDPMSKTLVFSDSLTLPKSLEIFRALRGRINVSFGIGTNLTCDIPGVEPMSIVLKMTACNGQPVAKISDEPGKTHCKDPNFVAYLRHVFQVPAVSSLSSKE

SEQ ID NO: 14057 - DNA, 1197 bp, Burkholderia fungorum LB400
  CDS (1)..(1197)
atgattattacttcgctgctcgacaccgatctgtacaagttcacgatgatgcaagtggtcttgcatcactttcccgcagcgaacgtcgaatatcgcttccgttgccgcacgccgaacgtcgatctcgtgccgtatatcggcgagattcgcgacgaagtgcgcaagctctgccaactccgcttcaccgacgacgaactcgactacctgcgccgcatgcgcttcatcaagggcgacttcatcgagtttctcgcgctgttccatctgaacgaaaaatacatttcgatcgggccttcgcccaagggcaatggcgaaatcgacatcgagatcaaggggccgtggctgcatacgatcctgttcgagattccgatgctcgcgatcgtcaacgaagtctacttccgcaacacccagcaaaagccggactatagcgaagggcgcggccgtctcgtcgagaagatcaagctcctcggcgcgcgtccggaattcgccgactgcaagatcgccgactacggtacgcgccgccgcttctcgaagcaatggcacgaggaagtgatcctcaagctcaaagagggcctcggcgagcagttcgccggcaccagcaacgtcttctacgcaatgaagcacggcctcacgccgctcggcacgatggcgcacgaatacctgcaggcgtgtcaggcgctcggtccgcggctgcgcgattcgcagattttcggcttcgagatgtgggccaaggaataccgcggcgacctgggtatcgcgctgtccgacgtgtacggcatggaggcgttcctgcgcgacttcgacatgtatttctgcaagctgttcgacggcgcgcgccacgattccggcgacccgttcgactggggcgaacgtctgctcaagcactacgaagcgaatcgctgcgacccgcgcaccaagatcctcgtattttccgacgcactcgacattcccaaagtgctgcaactctacgagcgctttcgcggccgctgcaagctggcgttcggcgtgggcacgaacctgaccaacgacctcggctataacccgctgcagatcgtcatcaagatggttcgctgcaacggccagccggtggcgaagctgtcggactcgccgggcaagaacatgtgcgaagacaaggcttacctcgcttacctgcgccaggtgttcggcattgcgcagcccgaggaagaggcggcgaagtaa

SEQ ID NO: 14058 - protein, 398 aa, Burkholderia fungorum LB400
MIITSLLDTDLYKFTMMQVVLHHFPAANVEYRFRCRTPNVDLVPYIGEIRDEVRKLCQLRFTDDELDYLRRMRFIKGDFIEFLALFHLNEKYISIGPSPKGNGEIDIEIKGPWLHTILFEIPMLAIVNEVYFRNTQQKPDYSEGRGRLVEKIKLLGARPEFADCKIADYGTRRRFSKQWHEEVILKLKEGLGEQFAGTSNVFYAMKHGLTPLGTMAHEYLQACQALGPRLRDSQIFGFEMWAKEYRGDLGIALSDVYGMEAFLRDFDMYFCKLFDGARHDSGDPFDWGERLLKHYEANRCDPRTKILVFSDALDIPKVLQLYERFRGRCKLAFGVGTNLTNDLGYNPLQIVIKMVRCNGQPVAKLSDSPGKNMCEDKAYLAYLRQVFGIAQPEEEAAK

SEQ ID NO: 14059 - DNA, 1428 bp, Oenococcus oeni PSU-1
  CDS (1)..(1428)
atgaatttatcaatggttaccgatctttacgaattatcaatggccaacggttatcagcaggccctcgaaaaagaagatggtgttttcgatgtgtttttccgccacgttcccgatgacggtagttttgtgatcacggctggactggctcaagccattcaagcagtttcagactttcatttcgacgaaaaagatttagcttatttaaagaaccttgatttatttacggataattttctgaattttctaaaaaaattcaaattcagtggaaatatttcggcaattccggaaggaacaccggtttttccaagggaaccactattaactatcagcggtcccttaattgaaactcaactttttgaaacaattttgctaaatatagtgaaccaccagtctctaatagctaccaaggctcggagaatctgttatgcagcccaaggaatgccgattatggaattcggcgcccgaagggctcaaggaccctcagcagcaaccttaggggctcgtgcggcaattattggcggatgcgcaagcacctctaatttattggcagctgaaaaatttggtttaaccgtcgccggaacaatggctcatagttggattgaagcttttcccaatgaactaagcgcctttgaaaaatgggccgaattatatcccgataattcttccctgcttgtcgacacatatgatgtcgtcagttcgggcgtgccaaacgcaattaaagtatttcaaaaacttgaagaaaagggccacaaaccaattggtatcagaatcgattcaggtgatattgcccatttatcaaaactagcaagaaaaatgctcgacgatgccggtttttccgaagctaaaattactgcttcgaatgccttggatgaaacaacgatccagtcattattgttcagccaaggggctccaattgataactttggagttggagaagaactaataaccagtgccagcgatcctgttttgagcggtgtttataaattagtagcaattaaaaaagagggtaaaattatcccgaaaataaaaataagcgacagtcgtgagaaggtcactctaccaggaatcaagcaactttatcgattgtataaaaaaggaacccgacaagcgtttgccgacgtaattgctttgaaagaagaacgcttgtcaaaaagaatgttggttaaatcggcagatccattagacacaaaacaaaatattaatctaatggattttgatttagaaacattgcaaacgaatatctttgaaaaaggaaaaattgtttacagctcacccactgtacagcaaatcaaaaaagtatctcagcagtcccttagcgaactgccagaagaaacaaaaagactaaagaatcctaataaatatcctgtttacattaccgagaagcttgctaaattacaggatgaattattgaacgatcaagaatattga

SEQ ID NO: 14060 - protein, 475 aa, Oenococcus oeni PSU-1
MNLSMVTDLYELSMANGYQQALEKEDGVFDVFFRHVPDDGSFVITAGLAQAIQAVSDFHFDEKDLAYLKNLDLFTDNFLNFLKKFKFSGNISAIPEGTPVFPREPLLTISGPLIETQLFETILLNIVNHQSLIATKARRICYAAQGMPIMEFGARRAQGPSAATLGARAAIIGGCASTSNLLAAEKFGLTVAGTMAHSWIEAFPNELSAFEKWAELYPDNSSLLVDTYDVVSSGVPNAIKVFQKLEEKGHKPIGIRIDSGDIAHLSKLARKMLDDAGFSEAKITASNALDETTIQSLLFSQGAPIDNFGVGEELITSASDPVLSGVYKLVAIKKEGKIIPKIKISDSREKVTLPGIKQLYRLYKKGTRQAFADVIALKEERLSKRMLVKSADPLDTKQNINLMDFDLETLQTNIFEKGKIVYSSPTVQQIKKVSQQSLSELPEETKRLKNPNKYPVYITEKLAKLQDELLNDQEY

SEQ ID NO: 14061 - DNA, 1380 bp, Trichodesmium erythraeum IMS101
  CDS (1)..(1380)
atggtacaagaatatctagaactttctctatctccagaagattacaccttgttaacagacctctatcaattaacaatgatagcttgctatgttggagaaaaaatagaccaacgacaagctagttttgagctatttgtgcgaaaactacctacaggttttggctatctcattgctatgggtttagcacaagcattagactatctcgagaaatttagatttagctctgagcaaattgacgccttaaagtcaacgggaatttttgctaatgcccctagtgaattttggtccttactagcagaagctaaattcactggaaatgtatgggcggtgaaagagggaacagccatttttccaaatcaacccctactgcggatagaagcaccgctttggcaagggcagttggtagaaacatatctactaaatacaatgaattaccaaaccctgatagcaacaaaagcagcgagaatgcgggatattgctggaaatagcaccaaattactagaatttggcacaagacgtgcatttagtccccaagctagtgttttggctgctcgtgctgctttggcaggaggaatggatgctacttctaatgttttggcagccttgaaattaggtcggaaaccagtaggaacgatggctcactctttggtgatggcaatatctgcagtggaaggtagtgaggaggatgcttttaaaagttttcagcgatatttccctacagccactttattgatagatacttatgatactttatcagctactcgtttattggcacgacgagttaaacagggtgaaatgcagataagtggggtcaggttagattctggaaatttggttgaattgtcccagaaggtgcgatcgctactgccaaaagtgaggatttttgctagtggagatatagatgagtgggaaatagctagacttcagaaggaaaatgcttgtattgatggatatggtattggtactaagttggtaactggtgttcctgtgaatggagtttataaactggtagaaatagatggtattcctgcgatgaaaaatactactggaaaagttagttatcctggtcgaaaacaaatatatagatatttggaaaatggtcaattgaaacaagattatttggggttaatggctgaagatgtattgagtcaaacagaacctcatactgattcttttgtaaaattaatgatacaagtagttaaaaatggggagatgctgcaaacatcagaaagtctagaagcgatcgctaaacgtactgctatttctgttgctagtttgccacctgaaactcgtagtttagaaaatcctattttgccaccaatgaaaatttctcataaattacaacaacttacacaaaaaactcaagctaacagctcttaa

SEQ ID NO: 14062 - protein, 459 aa, Trichodesmium erythraeum IMS101
MVQEYLELSLSPEDYTLLTDLYQLTMIACYVGEKIDQRQASFELFVRKLPTGFGYLIAMGLAQALDYLEKFRFSSEQIDALKSTGIFANAPSEFWSLLAEAKFTGNVWAVKEGTAIFPNQPLLRIEAPLWQGQLVETYLLNTMNYQTLIATKAARMRDIAGNSTKLLEFGTRRAFSPQASVLAARAALAGGMDATSNVLAALKLGRKPVGTMAHSLVMAISAVEGSEEDAFKSFQRYFPTATLLIDTYDTLSATRLLARRVKQGEMQISGVRLDSGNLVELSQKVRSLLPKVRIFASGDIDEWEIARLQKENACIDGYGIGTKLVTGVPVNGVYKLVEIDGIPAMKNTTGKVSYPGRKQIYRYLENGQLKQDYLGLMAEDVLSQTEPHTDSFVKLMIQVVKNGEMLQTSESLEAIAKRTAISVASLPPETRSLENPILPPMKISHKLQQLTQKTQANSS

SEQ ID NO: 14063 - DNA, 1434 bp, Campylobacter upsaliensis RM3195
  CDS (1)..(1434): transl_table=11
atgatttttctaaattcaatgaccaaaaaagcaatttttttgaaagcaaagttacaaattattctaaaggtagtatcagttttgacgacttttaaatatcatcttctttgtgatttttatgaatttactatgacgcaaggctatttaaaagagggttttgcggatagaatttgctattttgatattttttttagaaaggctcctgatggaggggcttttgccatttttgctggacttgaagatgttttagattttgtagaaaatttgcattttgatgcggaagaccttgcttttttgaggcaaaagggctttgatgaggactttttaaaatatttgaagcattttaaatttagtggtgaaatttattctgttaaagaaggtgcggtaatcttcgcaaatgaacctgtgatggtgattaaagctagggctattgaggcacaacttttagaaacttttttactttgcactctcaatcatcaaagtctaatcgccactaaggcaagtcgcattgtaagggcggctaggggtagggctgttttagaatttggagcaagaagagctcacggtggcgaggcagcacttaaaggtgctagagcagcgatgataggcggatgtttaggcacttcaaatacccttgcagctaaactttatagattaaaaacaagcggaactatggcacatgcttgggtgcaaatgtttgcagacgaatatgaggcttttagggcttttgtgaagctttaccctgaaaatgcaactttacttattgatacttatgattgctttttggggcttgaaaatgcgattagggtttttaaagaatttggcattaaaaagggggctgtgaggattgattctggaaatttatgtgaattaagccttaaaattcgcaaaagactcgatgaggttgggcttaaagagtgtaaaatcatcgcttcaaattctttggacgaaaaaagcattgaaaccctacttgaaaatggtgctaaaatcgatggatttggagttggagagcgtttaatcacggcttttagcgatgcgatttttggctgtgtttataagcttgtggcggtggagattaaaggagaaatttatcccaaaatcaaaatttctcaagactctttcaaaacgacaattccacattttaaaaagctctttcgcgtttatgagggagaaaaagctttgtatgatgagcttatgatttatgatgaagttttagaaaatttgccaccgaatttaaagcgtgaagagcttttgggctgtgtttttaaagagggaaaaagactttatgcaaataaaagcattgaaacattagccttttttacaaaagctcaactttcaagccttgatgaaggcttacttgatgcgaaaaaagcttacgagctaagactttctcctgctttgaaaagtcttaaaaaaagtctaagtcaaggttga

SEQ ID NO: 14064 - protein, 477 aa, Campylobacter upsaliensis RM3195
MIFLNSMTKKAIFLKAKLQIILKVVSVLTTFKYHLLCDFYEFTMTQGYLKEGFADRICYFDIFFRKAPDGGAFAIFAGLEDVLDFVENLHFDAEDLAFLRQKGFDEDFLKYLKHFKFSGEIYSVKEGAVIFANEPVMVIKARAIEAQLLETFLLCTLNHQSLIATKASRIVRAARGRAVLEFGARRAHGGEAALKGARAAMIGGCLGTSNTLAAKLYRLKTSGTMAHAWVQMFADEYEAFRAFVKLYPENATLLIDTYDCFLGLENAIRVFKEFGIKKGAVRIDSGNLCELSLKIRKRLDEVGLKECKIIASNSLDEKSIETLLENGAKIDGFGVGERLITAFSDAIFGCVYKLVAVEIKGEIYPKIKISQDSFKTTIPHFKKLFRVYEGEKALYDELMIYDEVLENLPPNLKREELLGCVFKEGKRLYANKSIETLAFFTKAQLSSLDEGLLDAKKAYELRLSPALKSLKKSLSQG

SEQ ID NO: 14065 - DNA, 1488 bp, Lactococcus lactis subsp. cremoris SK11
  CDS (1)..(1488)
atgggagaaaaaattatgccacatctatatcaagacgacagtcttacattacatacggacttatatcaaattaatatgatgcaaacttactttgagcttggaagacaccagcgccatgcagtctttgaagtttttttccgtgagatgccttttaaaaatggttatgctgtttttgctggtttagagcgaatggttgaatatttaaagaatctcaaattctcggaaacagatatcgcctatttgcgtgaattagactatccagaagattttctaaattatttaaaagaattacgctttacaggaacagtcagagccatgcaagaaggtcaacttgcctttgcaaatgaacctttggttcaggttgaaggttcacttgcggaatgccagttggtagaaacagctactttaaatattattaatttccaaactctgatagcaacaaaagccgcccgtatcaaatctgtaattggggaagaccctttgttggaatttggtacaagaagagctcaagaaatggatgcagcaatttggggaacaagagctgcggttatcgggggagctgatgcgacatcaaatgttcgggcggctaaaatctttggcttgaaagcaagtggaacacatgcgcatgctttagttcaatcttatggtaatgactatgaagcttttaaggcttatgctcaaacgcataaagattgtgttttcctcgttgatacttatgatactttacgtgttggggttccgtcagcgattaaagtggcgcgtgaatttggcgataaaattaattttcaaggtgtccgaattgattcaggagatatggcttatatctcgaaaaaagttcgtcagcaacttgatgaagctggctttactgacgcaaagatttatgcttcaaatgacttagatgaaaatactattttaagtttgaaaatgcaaaaagcaaaaattgatgtttggggagtcggaacaaaattaattaccgcctacgaccaaccagcgcttggtgcggtttataaattagtttctatggaagatgaacacggagaaatgcaagatacgattaagctttcaagtaatgcggaaaaagtatcgacaccaggtaaaaagcaagtttggcgcatcaccaaaaaagcagatggaaaatcagagggagattatatcactttttctgacgagcgtccagatgtagcagaagaaatctacatgttccacccgctctatacatacattaataaaaatgttcgggatttcaatgctaatccacttttaaaagatatttttattgatggtgagcttatttatcaacttccggaactacaggaaattaaaacatttgctcgtgaaaaccttgaggagctttgggatgaatataagcgtgatttgaatcctcaaccttacccagtagatttgtcacaagaattatggaatcataaaatgcgcctaatttcacaggtgcgtacaacagtatcaatgacgagattggatgatgaatga

SEQ ID NO: 14066 - protein, 495 aa, Lactococcus lactis subsp. cremoris SK11
MGEKIMPHLYQDDSLTLHTDLYQINMMQTYFELGRHQRHAVFEVFFREMPFKNGYAVFAGLERMVEYLKNLKFSETDIAYLRELDYPEDFLNYLKELRFTGTVRAMQEGQLAFANEPLVQVEGSLAECQLVETATLNIINFQTLIATKAARIKSVIGEDPLLEFGTRRAQEMDAAIWGTRAAVIGGADATSNVRAAKIFGLKASGTHAHALVQSYGNDYEAFKAYAQTHKDCVFLVDTYDTLRVGVPSAIKVAREFGDKINFQGVRIDSGDMAYISKKVRQQLDEAGFTDAKIYASNDLDENTILSLKMQKAKIDVWGVGTKLITAYDQPALGAVYKLVSMEDEHGEMQDTIKLSSNAEKVSTPGKKQVWRITKKADGKSEGDYITFSDERPDVAEEIYMFHPLYTYINKNVRDFNANPLLKDIFIDGELIYQLPELQEIKTFARENLEELWDEYKRDLNPQPYPVDLSQELWNHKMRLISQVRTTVSMTRLDDE

SEQ ID NO: 14067 - DNA, 1461 bp, Deinococcus geothermalis DSM 11300
  CDS (1)..(1461): transl_table=11
atgaccggaccttcctcgccccccacctcctcggccctcttcaccgatctctatcagctcacgatgatgcagggctactacgcccacggtctacacaccgaggaggcggtctttgatctgtacttccgcaagcagcccttcggcggcggcttcgcggtgtgggcggggctagaaccggcgctggagctgctcgaaaccctgcgcttcagcgaaacggacctcgcctacctggactcgctgggcctctttcagcccgagttccttacggcgctgcgcggctggaagttcagcgggcgcgtcacggccttccgcgagggcagcgtggtgttcgcgcacgagccgctgctgactgtcaccgcgccgctgtgggaggcgcagcttgtcgagacggcgctgctcaacaccctgaacttccagaccctggtggcgaccaaggcggcccgctgcgtcctggcggcagaggccagtccctacggcgggcagatcatcgagtttggtgcgcggcgagcgcaggggccggacggggcactcagcgccgcgcgtgccgcctttgtggggggagcagtcggcaccagcaacgtggaggcggggcgtatcttcggcctgccactgaccggcacgcacgcccacgcctgggtggagagctttcccgacgaattgacggccttccgcgcctatgccgccctgtaccccgacaacaccaccctgctgctcgatacggtggacacgctgcgcagcggtttgcccaatgcgctcattgtggcgcgggaactgcgcgcggcggggcatgagctgcgcggtgtgcggcttgacagcggtgacctcgcgtacctgtcgagccggattcgtgcggcgctcgacgcggcgggcttcccggacgtgaagattgtcgccagcaatgacctgtccgaatcggtgatcgcttcggtcatcgcagagggcgggcgggtggacgtgtacggcgtcggcacccagctggccacggcgggcggggagggcggcggcgcgctggggggcgtctttaaactcgcgcagctcggcggcgtgcccaagatgaagctgacgggcgaccccgccaaatccagcctgcccggggtgaagtatgtgtggcggggcgtgggcgaggacggacagtacgccctcgacgtgctgacgctgggcgaggtgccctgcccaggccagcgcgtcagcgaccctaccaacccgctgcgcttcgcgcggctgcccgacggcctcgcctggcgggatgcccgcgaggtggtgctcgagggcgggcggcgcaccggtccgcccgagacgctggggcaggcccaggcccgcgcccgcgctgacctcgcccggctcccagcgggtacgcgccgtcccctcaatccccatatctaccgcgtcagcctgggagatgacgtggccggattgcgcgaccgtgtggcagaggagctgcgtgcgcacgtggggagatga

SEQ ID NO: 14068 - protein, 486 aa, Deinococcus geothermalis DSM 11300
MTGPSSPPTSSALFTDLYQLTMMQGYYAHGLHTEEAVFDLYFRKQPFGGGFAVWAGLEPALELLETLRFSETDLAYLDSLGLFQPEFLTALRGWKFSGRVTAFREGSVVFAHEPLLTVTAPLWEAQLVETALLNTLNFQTLVATKAARCVLAAEASPYGGQIIEFGARRAQGPDGALSAARAAFVGGAVGTSNVEAGRIFGLPLTGTHAHAWVESFPDELTAFRAYAALYPDNTTLLLDTVDTLRSGLPNALIVARELRAAGHELRGVRLDSGDLAYLSSRIRAALDAAGFPDVKIVASNDLSESVIASVIAEGGRVDVYGVGTQLATAGGEGGGALGGVFKLAQLGGVPKMKLTGDPAKSSLPGVKYVWRGVGEDGQYALDVLTLGEVPCPGQRVSDPTNPLRFARLPDGLAWRDAREVVLEGGRRTGPPETLGQAQARARADLARLPAGTRRPLNPHIYRVSLGDDVAGLRDRVAEELRAHVGR

SEQ ID NO: 14069 - DNA, 1359 bp, Azotobacter vinelandii AvOP
  CDS (1)..(1359): transl_table=11
atgccgcacgatccgccatatctgcccgcccccggcgcactgctcaccgacctctaccagttgaccatgctgcagggctatgtcgagcgcgacatgctcgacggcgcggtgttcgagttcttcgcccgcaagccgccggcctgtcgcaatttctacctggccgccggactggagcaggtgctcgactacctggaacagttgcatttcacccagggcgagctcgactggctgagcggcctgggcctgttccgtccggcctttctcgactacctggccgggctgcgcttttccggcgaggtgcaggccatggccgagggcacgccgttcttcgccgacgagccgatcctgcgggtggtcgcgcccctgcccgaggcgcaactggtcgagtcgcggctgatcaacctgctgcatttccagacgctgatcgccagcaaggcggcgcggctgacgctggcggcgtcgggccggcgcctggtggacttcggcctgcgccgcgcccacggcgccgaggccgggctgctcgccgcccgcgccagctacctggccggcttccaggccagcgccacggtgctggccggcgcgcagttcggcatcccgctggccgggaccatggcgcattccttcgtccaggcccacctcgacgaggccgaggccttcgagcacttcgcccgcagcctgccgcagtcggtgctgctgctgatcgacacctacgacaccgaggcggcggcgcgcaaggtggtcgagctggcgccgcgcctggccgcggccggcatccgtgtccagggggtgcgcctggacagtggcgacctcggcgagcacgcccgccgggtgcgcgccatcctcgaccgtggcgggctgggcgacgcgaccgtcttcgccagcggcaacctggacgagtacgaggtgcgtcggctgctggcggagggcgcgccgatcgacggcttcggcgtcggcacccggctggatacctccagcgacgcgccgtacctggactgcgtctacaagctgcaggagtacgccggccagccgcggcgcaagcgttcggagggcaaggccacctggccggggcgcaagcaggtctggcggcgctacgacgacgacggccgctgccgtggcgacagcctgatgctggagggcgagacgggcgaggggcaggcgctgatccggccggtgatgcgcgacggacggcgcctggcgccttcgccatcgctgcgggaggtgcgcgctcatgccctgcgccagctcgacaccctgccggcggcgctgcgagcgctggagccggcgccgccctatccggtggcggtgagcgaggcgctgcgcgacctggcggagcgggccgaccggctggccgggctatga

SEQ ID NO: 14070 - protein, 452 aa, Azotobacter vinelandii AvOP
MPHDPPYLPAPGALLTDLYQLTMLQGYVERDMLDGAVFEFFARKPPACRNFYLAAGLEQVLDYLEQLHFTQGELDWLSGLGLFRPAFLDYLAGLRFSGEVQAMAEGTPFFADEPILRVVAPLPEAQLVESRLINLLHFQTLIASKAARLTLAASGRRLVDFGLRRAHGAEAGLLAARASYLAGFQASATVLAGAQFGIPLAGTMAHSFVQAHLDEAEAFEHFARSLPQSVLLLIDTYDTEAAARKVVELAPRLAAAGIRVQGVRLDSGDLGEHARRVRAILDRGGLGDATVFASGNLDEYEVRRLLAEGAPIDGFGVGTRLDTSSDAPYLDCVYKLQEYAGQPRRKRSEGKATWPGRKQVWRRYDDDGRCRGDSLMLEGETGEGQALIRPVMRDGRRLAPSPSLREVRAHALRQLDTLPAALRALEPAPPYPVAVSEALRDLAERADRLAGL

SEQ ID NO: 14071 - DNA, 1356 bp, Burkholderia vietnamiensis G4
  CDS (1)..(1356): transl_table=11
atggggcgatggcaggcctgcgcggtgacggcgccgccgcacgcgcgcgccggacggcttcacgatggtccgtcccgcattcgggtaacatggccggcagaccgggcggcgcgccgtgcgccggggccttgtcacgatattggcggtgccgcaaacatgatcattacttcgctgctcgatacggatctctacaagttcacgatgatgcaggtcgtcctgcatcactttcctgccgcaacggtcgagtaccgcttccggtgtcgcacgcgcggcgtcgatctcgtgccgtacatcgacgagatccgcgacgaggtgcgcggcctctgcgcgctgcgcttcaccgacgtcgagctcgactacctgcggcgcatgcgcttcatcaagagcgacttcgtcgatttcctcgcgctgttccacctcaacgagaagtacatttcgatcatgccttcgccgaagggcaacggcgagatcgacatcgtgatcgaagggccgtggctgcatacgatcctgttcgagatcccggtgctcgcgatcgtcaacgaagtctatttccgcaacacgcagcgcgagcccgactaccgcgaaggccgcgagcggctgcgcgacaagatcaagctgctcggcgcgaagcccgagttcgccgactgcaagatcgccgactacggcacgcgccgccgcttctcgaaggtgtggcacgaggaagtcgcgctgacgctgcgcgacgggctcggcccgcaattcgccggcacgagcaacgtgttctacgcgatgaagcacgacctcacgccgctcggcacgatggcgcacgaatacctgcaggcgtgtcaggcgctcgggccgcggctgcgcgattcgcagacctacggtttcgagatgtgggcgaaggagtatcgcggcgacctcgggatcgcgctgtcggacgtctacgggatggacgcgttcctgaacgacttcgacatgtacttctgcaagctgttcgacggcgcgcgccacgattcgggcgatccgttcgactggggcgagcgcatgctgcgccactacgaggcgaaccgctgcgacccgcgcaccaaggtgctcgtgttctcggacgcgctcgacatcccgaaggtcatgcagctgtacgaacggttccgcggccgctgcaagctcgcgttcggcgtcggcaccaacctgacgaacgatctcggctacgtgccgctgcagatcgtgatcaagatggtccgctgcaacggtcagccggtcgccaagctgtccgattcgccgggcaagagcatgtgcgacgacaaggcgtatctcgcgtacctgcgtcaggtattcgggatcgcgcagccggtcggcgacgacgcttcgcagtag

SEQ ID NO: 14072 - protein, 451 aa, Burkholderia vietnamiensis G4
MGRWQACAVTAPPHARAGRLHDGPSRIRVTWPADRAARRAPGPCHDIGGAANMIITSLLDTDLYKFTMMQVVLHHFPAATVEYRFRCRTRGVDLVPYIDEIRDEVRGLCALRFTDVELDYLRRMRFIKSDFVDFLALFHLNEKYISIMPSPKGNGEIDIVIEGPWLHTILFEIPVLAIVNEVYFRNTQREPDYREGRERLRDKIKLLGAKPEFADCKIADYGTRRRFSKVWHEEVALTLRDGLGPQFAGTSNVFYAMKHDLTPLGTMAHEYLQACQALGPRLRDSQTYGFEMWAKEYRGDLGIALSDVYGMDAFLNDFDMYFCKLFDGARHDSGDPFDWGERMLRHYEANRCDPRTKVLVFSDALDIPKVMQLYERFRGRCKLAFGVGTNLTNDLGYVPLQIVIKMVRCNGQPVAKLSDSPGKSMCDDKAYLAYLRQVFGIAQPVGDDASQ

SEQ ID NO: 14073 - DNA, 1200 bp, Burkholderia mallei 10229
  CDS (1)..(1200)
atgatcatcacttcgctgctcgataccgacctgtacaaattcacgatgatgcaggtcgtcctgcatcatttcccggccgcaagcgtcgaatatcgcttcaagtgccgcacgcccggcgtcgatctcgtgccgtacatcgacgagatccgcgccgaggttcgctcgctctgcgagctgcgcttcaccgattccgagctcgactatctgcgccggctgcgcttcgtcaagagcgatttcgtcgattttctcgcgctctttcacctgaacgagaagtacatctcgatcacgccgtcgcaaaagggcggcggcgagatcgacatcgagatcaaggggccgtggctgcacacgatccttttcgagattccggtactcgcgatcgtcaacgaggtgtacttccgcaacacgcagcgccggccggattaccgcgaagggcgcggccggctgcgcgagaagatcaagctgctcggcgtgaagcccgaattcgccgattgcaagatcgccgattacggcacgcgccgccgcttctcgaaggtctggcacgaggaggtgctgcgcacgctgcaggacgggctcgggccgcagttcgccggcacgagcaacgtctattacgcgatgacgcacgagatcacgccgctcggcacgatggcgcacgaatatctgcaggcgtgccaggcgctcggcccgcggctgcgcgattcgcagacctacggtctcgagatgtgggcgaaggaatatcgcggcgatctcggcatcgcgctgtccgacgtctacgggatggacgcgttcctgcgcgacttcgacatgtacttctgcaagctcttcgacggcgcgcgccacgattcgggcgatccgttcgactggggcgagcggctcatcaagcactacgaggagaaccgctgcgacccgcgcacgaaggtgctcgtgttctccgacgcgctcgatatcccgaaggtcatgcagctgtacgcacgctttcgcggacgctgcaagctcgcgttcggcgtcggcacgaacctcaccaacgatctcggctatcagccgttgcagatcgtcatcaagatggtgcgatgcaacgggcagccggtcgcgaagctgtcggattcgccgggcaagagcatgtgcgacgacaaggcctacctcgcgtatctgcgccaggtgttcgggatcacgcagccgcccgacgacgacgcgggcaagtaa

SEQ ID NO: 14074 - protein, 399 aa, Burkholderia mallei 10229
MIITSLLDTDLYKFTMMQVVLHHFPAASVEYRFKCRTPGVDLVPYIDEIRAEVRSLCELRFTDSELDYLRRLRFVKSDFVDFLALFHLNEKYISITPSQKGGGEIDIEIKGPWLHTILFEIPVLAIVNEVYFRNTQRRPDYREGRGRLREKIKLLGVKPEFADCKIADYGTRRRFSKVWHEEVLRTLQDGLGPQFAGTSNVYYAMTHEITPLGTMAHEYLQACQALGPRLRDSQTYGLEMWAKEYRGDLGIALSDVYGMDAFLRDFDMYFCKLFDGARHDSGDPFDWGERLIKHYEENRCDPRTKVLVFSDALDIPKVMQLYARFRGRCKLAFGVGTNLTNDLGYQPLQIVIKMVRCNGQPVAKLSDSPGKSMCDDKAYLAYLRQVFGITQPPDDDAGK

SEQ ID NO: 14075 - DNA, 1200 bp, Burkholderia cenocepacia AU 1054
  CDS (1)..(1200): transl_table=11
atgatcatcacttcgctgctcgacacggatctctacaagttcacgatgatgcaggtcgtcctgcatcacttcccggctgcaaacgtcgaataccgcttccggtgccgcacgcccggcgtcgatctcgtgccgtacatcgacgagattcgcgacgaggtgcgcggcctgtgctcgctgcgctttgccgacgtcgaactcgactacctgcggcggatgcgcttcatcaagagcgacttcgtcgacttcctcgcgctgttccacctgaacgagaagtacatctcgatcacgccgtcgccgaagggcaacggcgaaatcgacatcgtgatcgaggggccgtggctgcatacgatcctgttcgagatcccggtgctcgcgatcgtcaacgaagtctatttccgcaacacgcagcgcgagcccgactatcgcgaagggcgcgagcggctgcgcgagaagatcaagctgctcggcgcgaagcccgaattcgccgactgcaagatcgccgactacggcacgcgccggcgcttctcgaaggtctggcacgaggaagtcgcgctcacgctgcgtgacgggctcggcccgcagttcgcgggcacgagcaacgtgctgtacgcgatgaagcacgacatcacgccgctcggcacgatggcgcacgaatacctgcaggcgtgccaggcgctcggcccgcggctgcgcgactcgcagatctacggcttcgagatgtgggcgaaggaatatcgcggcgacctcgggatcgcgctgtcggacgtctacgggatggacgcgttcctgaacgacttcgacatgtacttctgcaaactgttcgacggtgcgcgccacgattcgggcgatccgttcgagtggggcgagcggatgctgcgccattacgaggcgaaccggtgcgacccgcgcaccaaggtgctcgtgttctcggacgcgctcgacatcccgaaggtcatgcagctgtacgaacggttccgcggccgctgcaagctcgcgttcggcgtcggcaccaacctcaccaacgatctcggctacgtgccgctgcagatcgtgatcaagatggttcgctgcaacggccagccggtcgcgaagctgtccgattcgccgggcaagagcatgtgcgacgacaaggcgtatctcgcgtacctgcggcaggtgttcggcatcgcgcagccggtcgacgaagacgcgtcgaagtag

SEQ ID NO: 14076 - protein, 399 aa, Burkholderia cenocepacia AU 1054
MIITSLLDTDLYKFTMMQVVLHHFPAANVEYRFRCRTPGVDLVPYIDEIRDEVRGLCSLRFADVELDYLRRMRFIKSDFVDFLALFHLNEKYISITPSPKGNGEIDIVIEGPWLHTILFEIPVLAIVNEVYFRNTQREPDYREGRERLREKIKLLGAKPEFADCKIADYGTRRRFSKVWHEEVALTLRDGLGPQFAGTSNVLYAMKHDITPLGTMAHEYLQACQALGPRLRDSQIYGFEMWAKEYRGDLGIALSDVYGMDAFLNDFDMYFCKLFDGARHDSGDPFEWGERMLRHYEANRCDPRTKVLVFSDALDIPKVMQLYERFRGRCKLAFGVGTNLTNDLGYVPLQIVIKMVRCNGQPVAKLSDSPGKSMCDDKAYLAYLRQVFGIAQPVDEDASK

SEQ ID NO: 14077 - DNA, 1356 bp, Burkholderia pseudomallei 1655
  CDS (1)..(1356)
atgagggcgaagcctgcctgcacgcgggcgctgctcgccgacctgtacgaattcacgatgctgcagtcgtacttcgactgcgggatgaacgatacggcgacgttcgagctgttcgtgcgcaggctgcccgcgcatcggaatttcatgatggcggcggggctcgagcaggcgctcgactatctggcgaacctcgcgttcgacgccgacgagatcgaagcgctcgcgggcatggggctcttcggcgacggctttctcgcgtcgctcgcatcgctgcgcttcacgggcacggttcgcgcgatgcgcgagggcaccgtgttcttcgcggacgagccgatcctgcaagtcaccgcgccgctgcgcgaggcgcaactgatcgagagccgcgtgatgaacctgctgcactacgaaacgatcgtcgcgagcaaggccgcgcgcgcggtgctcgcggcgccgggcaaggcgctcgtcgatttcgggctgcgccgcgcgcatggcgccgaggccgcgctgctgtcggcgcgcgcgagctacgtggcgggcttcgccggcacggcgacgctgcttgccggcctgcgctacgggattccgacgtacggcacgatggcgcattcgtacgtgcaggcgcacgacgacgaagcgctcgcgttcgagcatttcgcgcgctcgttcccgcgcaacgcgatgctgctcgtcgatacgtacgacaccgaggcggccgcgggcaaggtcatcgaagtcgcgaggaggctcgcgcgcgacggcgtcgaggtgaagggcgtgcggctcgacagcggcgatctcgcgcagcacgcgatgcgcgtgcgcgcgcagctcgatcgcgcggggctcggccgggtgacgctcttcgcgagcggcaatctcgacgaataccggctcgccgagctgatcgggcagggcgcgccgatcgacggcttcggcgtgggcacgcggatgaacacgtcggcggacgcgccgtacgcggattgcgcgtacaagctgaccgaatacgcgggcgtgccgcggcgcaagcgctcggagggcaaggcgacgtggccggggcgcaagcaggtgtttcgccgctatcgagacgatggcctgctcgacggcgattgcctcgcgctgcacgacgatgcgcaggcgggcgtcgcgctgctcgaaccggtgatgatcggcggcgagcgcgtcgcgccttcgccgagccttgccgacgttcgcgcgcatgcgcgcgcgcagctcgacacgctgcccgcggcgctgcgcgatctcgcgcgcgcggccgagtatccggtcgcggtggccggcacgttggcggcgctcgcgcaacggctcgatgcgcgggcggcgagcggcgcgtag

SEQ ID NO: 14078 - protein, 451 aa, Burkholderia pseudomallei 1655
MRAKPACTRALLADLYEFTMLQSYFDCGMNDTATFELFVRRLPAHRNFMMAAGLEQALDYLANLAFDADEIEALAGMGLFGDGFLASLASLRFTGTVRAMREGTVFFADEPILQVTAPLREAQLIESRVMNLLHYETIVASKAARAVLAAPGKALVDFGLRRAHGAEAALLSARASYVAGFAGTATLLAGLRYGIPTYGTMAHSYVQAHDDEALAFEHFARSFPRNAMLLVDTYDTEAAAGKVIEVARRLARDGVEVKGVRLDSGDLAQHAMRVRAQLDRAGLGRVTLFASGNLDEYRLAELIGQGAPIDGFGVGTRMNTSADAPYADCAYKLTEYAGVPRRKRSEGKATWPGRKQVFRRYRDDGLLDGDCLALHDDAQAGVALLEPVMIGGERVAPSPSLADVRAHARAQLDTLPAALRDLARAAEYPVAVAGTLAALAQRLDARAASGA

SEQ ID NO: 14079 - DNA, 1173 bp, Chromohalobacter salexigens DSM 3043
  CDS (1)..(1173): transl_table=11
atgctggattcgctcctcgataacgatttctacaagttcaccatgcaaagcgcggtcatcaagcgctttccctacgcgcgagcccgttatgcattcatcaaccggggggagcatgccttccctccgggcttcggcgagcaattgcgcgaggcggtggatgccatggcagacctctccctgagcgtcgaggaaaagcgctttctggagcgcacctgcccctacctggacccgacgtatctcgacttcctctcggggttccggtacgacccgagcgaggtcgacatcgtccagcagggtgagcgcttcgagttgcgcatcgaaggcctctggtaccgcaccatcctgtgggaagtccctctgatggcgctgatcagcgagatctggtaccgcatgggagacggcaagcgcgatgcggatgccatcatcgacatgcgcacccgcgacaagatcgaacactacaagcgcctggggctcaagatcgccgaattcggtacccgccggcgctattcctacgatgtgcacgaccgtgtggtggcctcgctgcgccaccacggcggcgataccttctccggctccagcaacgttcacctggccatgcgccacggcgtcaagccgatcggcacgcacgcccacgagtggttcatgttccacggcgcccgcttcggcttcaagatggccaacagcctcgccctggagcactgggtggacgtgtaccgtggcgacctgggcatcgcgctcacggacaccttcacgtcggcgaccttcttcgacagcttcgacaagaaattcgccaagctcttcgacggcgtgcgtcacgacagcggcgaccccctcgagttcgccgccgccaccatcgctcattacgagcgcatgggaatcgatccgcgtaccaagaccatcatcttctccgacgccctgacgcccgagcgcgtcgaacgcatcgacgccttctgtcgcggccgcatcaccacggccttcggcatcggcaccaacttcaccaacgatgtcggcgtcacgccgatgaacatggtgatcaagatgaccgaggcgcgcccggaagggcagcactggatgccggtcatcaagctctcggacgtgcccgacaagaataccggcgaccccgacatgatcgagctcgccaagcgtgtcctggcactctcgcggcgcgcctga

SEQ ID NO: 14080 - protein, 390 aa, Chromohalobacter salexigens DSM 3043
MLDSLLDNDFYKFTMQSAVIKRFPYARARYAFINRGEHAFPPGFGEQLREAVDAMADLSLSVEEKRFLERTCPYLDPTYLDFLSGFRYDPSEVDIVQQGERFELRIEGLWYRTILWEVPLMALISEIWYRMGDGKRDADAIIDMRTRDKIEHYKRLGLKIAEFGTRRRYSYDVHDRVVASLRHHGGDTFSGSSNVHLAMRHGVKPIGTHAHEWFMFHGARFGFKMANSLALEHWVDVYRGDLGIALTDTFTSATFFDSFDKKFAKLFDGVRHDSGDPLEFAAATIAHYERMGIDPRTKTIIFSDALTPERVERIDAFCRGRITTAFGIGTNFTNDVGVTPMNMVIKMTEARPEGQHWMPVIKLSDVPDKNTGDPDMIELAKRVLALSRRA

SEQ ID NO: 14081 - DNA, 1356 bp, Burkholderia pseudomallei 668
  CDS (1)..(1356)
atgagggcgaagcctgcctgcacgcgggcgctgctcgccgacctgtacgaattcacgatgctgcagtcgtacttcgactgcgggatgaacgatacggcgacgttcgagctgttcgtgcgcaggctgcccgcgcatcggaatttcatgatggcggcggggctcgagcaggcgctcgactatctggcgaacctcgcgttcgacgccgacgagatcgaagcgctcgcgggcatggggctcttcggcgacggctttctcgcgtcgctcgcatcgctgcgcttcacgggcacggttcgcgcgatgcgcgagggcaccgtgttcttcgcggacgagccgatcctgcaagtcaccgcgccgctgcgcgaggcgcaactgatcgagagccgcgtgatgaacctgctgcactacgaaacgatcgtcgcgagcaaggccgcgcgcgcggtgctcgcggcgccgggcagggcgctcgtcgatttcgggctgcgccgcgcgcatggcgccgaggccgcgctgctgtcggcgcgcgcgagctacgtggcgggcttcgccggcacggcgacgctgcttgccggcctgcgctacgggattccgacgtacggcacgatggcgcattcgtacgtgcaggcgcacgacgacgaagcgctcgcgttcgagcatttcgcgcgctcgttcccgcgcaacgcgatgctgctcgtcgatacgtacgacaccgaggcggccgcgggcaaggtcatcgaagtcgcgaggaggctcgcgcgcgacggcgtcgaggtgaagggcgtgcggctcgacagcggcgatctcgcgcagcacgcgatgcgcgtgcgcgcgcagctcgatcgcgcggggctcggccgggtgacgctcttcgcgagcggcaatctcgacgaataccggctcgccgagctgatcgggcagggcgcgccgatcgacggcttcggcgtgggcacgcggatgaacacgtcggcggacgcgccgtacgcggattgcgcgtacaagctgaccgaatacgcgggcgtgccgcggcgcaagcgttcggagggcaaggcgacgtggccggggcgcaagcaggtgtttcgcagctatcgcgacgatggcctgctcgacggcgattgcctcgcgctgcacgacgatgcgcaggcgggcgtcgcgctgctcgaaccggtgatgatcggcggcgagcgcgtcgcgccttcgccgagccttgccgacgttcgcgcgcatgcgcgcgcgcagctcgacacgctgcccgcggcgctgcgcgatctcgcgcgcgcggccgagtatccggtcgcggtggccggcacgttggcggcgctcgcgcaacggctcgatgcgcgggcggcgagcggcgcgtag

SEQ ID NO: 14082 - protein, 451 aa, Burkholderia pseudomallei 668
MRAKPACTRALLADLYEFTMLQSYFDCGMNDTATFELFVRRLPAHRNFMMAAGLEQALDYLANLAFDADEIEALAGMGLFGDGFLASLASLRFTGTVRAMREGTVFFADEPILQVTAPLREAQLIESRVMNLLHYETIVASKAARAVLAAPGRALVDFGLRRAHGAEAALLSARASYVAGFAGTATLLAGLRYGIPTYGTMAHSYVQAHDDEALAFEHFARSFPRNAMLLVDTYDTEAAAGKVIEVARRLARDGVEVKGVRLDSGDLAQHAMRVRAQLDRAGLGRVTLFASGNLDEYRLAELIGQGAPIDGFGVGTRMNTSADAPYADCAYKLTEYAGVPRRKRSEGKATWPGRKQVFRSYRDDGLLDGDCLALHDDAQAGVALLEPVMIGGERVAPSPSLADVRAHARAQLDTLPAALRDLARAAEYPVAVAGTLAALAQRLDARAASGA

SEQ ID NO: 14083 - DNA, 1269 bp, Polaromonas sp. JS666
  CDS (1)..(1269): transl_table=11
atgccaccttgctgtttgaagtcgacctgctggcaacctgagcctctgcgttttcagccgccccggagcaaagccgccaccatgatcatcaccagcctgcttgataccgacctgtacaagttcaccatgatgcaggtggtgttgcaccagtttccaggtgccgaggtggagtaccggttcaagtgccgcaacgccggggcgcccggcataggcaagctggcaccttatgtgaacgaaatccgcgaagagatccgcgggttgtgcaatttgcgctttcaggatgccgagctggcctacctgaaggccatgcgcttcatcaagagcgacttcgtcgattttctgggtatcttcaagctcaacgagaaatacgtgagcgtgacggccttgccatcgggcgagatcgaggtgtccatcaagggcccctggctgcacaccatcctgtttgaaatcccggtgctggccatcatcaatgaggtctactttcgcaacacgcaaaagcagcctgacctgaccgaaggccgcaaacgcctggacaccaagatactggagctgcaggccgatggcctgcgcgaactcaagatcgccgactacggcacgcgccggcgtttcggcaaggtctggcacgaggaagtgttgcgcacgctggtgacccgtctgggcacgggcatgtcgggccagctcgcggggaccagcaatgtgctgtttgccatgaagctgggcctgacgccgctgggcaccatggcgcacgaatacctgcaggcctgccaggcgctcgggccgcgcctgcgtgacagccaggtcttcggtttcgaatcgtgggcccgggagtaccggggtgacctggggattgcgctgtcggacgtatacggcatgagtgccttcctgcgcgatttcgacatgtacttctgcaagctgtttgacggggcgcgccatgacagcggcgacccgttcgagtggggtgagcgcatgctcgcgcactacgttaaaaaccgcgtcgatcccagaaccaagacgctgatcttcagcgacgcgctcaccgtgccgcgcaccattgagctgtaccagcagttcagggggcgttgccagctggctttcggcataggcaccaacctgaccaacgacctgggttacgagccgctgcagatcgtcatcaagatgattcgctgcaatggccagccggtggccaagctgtcggacacgccctccaaaaacatgtgcgaggacgaaaagtacctggcctatctgcgtcaggtcttcgagattggctga

SEQ ID NO: 14084 - protein, 422 aa, Polaromonas sp. JS666
MPPCCLKSTCWQPEPLRFQPPRSKAATMIITSLLDTDLYKFTMMQVVLHQFPGAEVEYRFKCRNAGAPGIGKLAPYVNEIREEIRGLCNLRFQDAELAYLKAMRFIKSDFVDFLGIFKLNEKYVSVTALPSGEIEVSIKGPWLHTILFEIPVLAIINEVYFRNTQKQPDLTEGRKRLDTKILELQADGLRELKIADYGTRRRFGKVWHEEVLRTLVTRLGTGMSGQLAGTSNVLFAMKLGLTPLGTMAHEYLQACQALGPRLRDSQVFGFESWAREYRGDLGIALSDVYGMSAFLRDFDMYFCKLFDGARHDSGDPFEWGERMLAHYVKNRVDPRTKTLIFSDALTVPRTIELYQQFRGRCQLAFGIGTNLTNDLGYEPLQIVIKMIRCNGQPVAKLSDTPSKNMCEDEKYLAYLRQVFEIG

SEQ ID NO: 14085 - DNA, 1341 bp, Crocosphaera watsonii WH 8501
  CDS (1)..(1341): transl_table=11
atgttaactttcaatcccagtttaaccccatcactccaagaaagtagcttgttgacagacttgtatcagttaacaatggctgcttgttacgcaggagaaggcattgccgaaaaaaaagccagttttgaactatttgtacgccgtttacccgataattttggttatttgatagctatgggactggctcaagggttacagtatctagaaaatttacgtttttcagcagaacagatagattatctgcaaagtacaggtatttttgaccatgtaaccccttatttttggtcattattgcaaaatcaaggctttacgggagatgtttgggctgttcccgagggaatccctatctttgccaatgaacccttattgcgggttgaggcaccgttatggcaagcacaaatagtagaaacctaccttttgaacaccatcaactatcagaccctaatcgccaccagagcagcgagaatgcgcgatatagcaggggaaaaggcaattttgttagaatttggtacaaggcgagcatttagccctcaaggggcaatttgggcggctagagcagctttaggagcgggttttgatgccacttctaatgttttagcagcgaaggaacttaaccagcaacccagtggcactatggcccacgctttggtgatggctattaaaggtttatctggcagcgaagacgaggcgtttatggcttttaatcgtcactttccaggggcaaccttattgatcgatacctatgataccttagctgcggcgcaacggttagccgaaaacagggaaatagagattaaaggggttcgtgtggactctggggacttggggagtttatctcaaaaagtgcgatcgctactaccaaaggtaaatatttttgccagtggggatattgatgaatgggagttgcaacggttacgatcagaaaacgctctttttgacggttatggggtgggaactcgtttggtgacgggacatccggttaatggggtctataaattagtagaaatagataacgttcctaccatgaaacaatctagcaataagatgacttatccgggaagaaaacagatatttcgtcgctataataacggaattatagaaagcgatcgcttagccttaatagaggaagagattgaatcaggagaaacccccttattagagttagtcataacagaaggtaacttgttaaaagaaaatgaatctttagacaccattcgtcaacgggttcaaacttctcttaaaagtttacctgaagatactcataagataaccaaaccgagtcctattcaagtgaatatttctcaacccttagaaaccttacgtcaatctttaattgtttaa

SEQ ID NO: 14086 - protein, 446 aa, Crocosphaera watsonii WH 8501
MLTFNPSLTPSLQESSLLTDLYQLTMAACYAGEGIAEKKASFELFVRRLPDNFGYLIAMGLAQGLQYLENLRFSAEQIDYLQSTGIFDHVTPYFWSLLQNQGFTGDVWAVPEGIPIFANEPLLRVEAPLWQAQIVETYLLNTINYQTLIATRAARMRDIAGEKAILLEFGTRRAFSPQGAIWAARAALGAGFDATSNVLAAKELNQQPSGTMAHALVMAIKGLSGSEDEAFMAFNRHFPGATLLIDTYDTLAAAQRLAENREIEIKGVRVDSGDLGSLSQKVRSLLPKVNIFASGDIDEWELQRLRSENALFDGYGVGTRLVTGHPVNGVYKLVEIDNVPTMKQSSNKMTYPGRKQIFRRYNNGIIESDRLALIEEEIESGETPLLELVITEGNLLKENESLDTIRQRVQTSLKSLPEDTHKITKPSPIQVNISQPLETLRQSLIV

SEQ ID NO: 14087 - DNA, 1431 bp, Geobacter metallireducens GS-15
  CDS (1)..(1431): transl_table=11
atgagctactcaccgcttctgaccgacctctaccaactcaccatgcttgccggatacctggaagaagggatggcggacaaaccggcggtgttcgacatcttcttccggcacaaccccttccagggggggtatgcggtgttcgccggccttgacacggccctcggctacctggagaacctccagttcacggaggatgatctcgagtatctccaggggctggaaatcttccgcccccgattcatcgattttctccgctcattccggttccggggaaaagtaacggcgcctcccgagggaacagtggttttcgccaatgagccccttgtgaccatcgaggcccccctggcccaggcgcaactggtggagacggcgctcttgaacatcatcaatttccagaccctggtggccaccaagggtgcccgaatcgtccatgcggcggtggacggcacggtgctggagttcggcctgcgccgcgcccaagggcccgacgggggagtgagcgaagcccgggccgcctacattggcggggttcggagcacgagcaacgtgctggcggggaagctcttcggcatcccggtaaaaggaacccatgcccacagctggatcatggcctttcccgatgagctgaccgccttccgcgcctatgccgaggtattccccgacacctgcatcctcctggtggacacctacgacaccctcaaaagcggcatccccaacgccatcaccgttgcccaggaactccgctcccaggggcacgaactggtcggggtgcggatcgattcgggtgacctggcctacctctcccgggagggacgccggatgttcgacgaggcgggcttccccggcgtaaagattgtcgcctccaacgagctggacgaatacgtgatcgaatcgatgcggagcgaagggggccgggtcgacatctacggcgtggggacacgtctcgccacctgcgccggagaggggggaggagccctgggcggagtctacaagctggtcaggatcggcgaccgcccaaaactcaaggtgaccagcgacgtcgccaaggcgacccttcccgaccgcaagcggctcctgcgggccgtggcccccgacggctccttcatccaggacgtgctctgcctcgccgacgaggacattgcccccggagccacggtgtacgacccttccaatccccttcagttcgttgccatcccgcaacaggcccgcttcgtcgagattcgtggcgttgtgatggaggacggtgtgcgaacggcgaaatctcctcccagcctggacgagatggccgaccgcagccgtgaccagctcacccgcctcccccagggatgcatgcgtttcatcaatccgcataaatacaaggtctccatcagcgccggtctcaacgagctacggctgcagcttatggacgaggttcaacggggatataaatag

SEQ ID NO: 14088 - protein, 476 aa, Geobacter metallireducens GS-15
MSYSPLLTDLYQLTMLAGYLEEGMADKPAVFDIFFRHNPFQGGYAVFAGLDTALGYLENLQFTEDDLEYLQGLEIFRPRFIDFLRSFRFRGKVTAPPEGTVVFANEPLVTIEAPLAQAQLVETALLNIINFQTLVATKGARIVHAAVDGTVLEFGLRRAQGPDGGVSEARAAYIGGVRSTSNVLAGKLFGIPVKGTHAHSWIMAFPDELTAFRAYAEVFPDTCILLVDTYDTLKSGIPNAITVAQELRSQGHELVGVRIDSGDLAYLSREGRRMFDEAGFPGVKIVASNELDEYVIESMRSEGGRVDIYGVGTRLATCAGEGGGALGGVYKLVRIGDRPKLKVTSDVAKATLPDRKRLLRAVAPDGSFIQDVLCLADEDIAPGATVYDPSNPLQFVAIPQQARFVEIRGVVMEDGVRTAKSPPSLDEMADRSRDQLTRLPQGCMRFINPHKYKVSISAGLNELRLQLMDEVQRGYK

SEQ ID NO: 14089 - DNA, 1206 bp, Methanosarcina barkeri str. fusaro
  CDS (1)..(1206): transl_table=11
gtgataaaatccatactcgataacgacctttataaattcaccatgcaacttgcagtgcttgaactttttcctaaagctgaggctgaataccggtttactaaccggggttcccagcgctttactacggagtttgtagaagaactggaaagaactatacgcgaagagatctcaaaattagcattaacagaagaagaatataactggctttcagagaattgcccttacctgaaacctatgtaccttgaatatcttaagaatttccgcttcaaacctggtgaggtaaaagtctgccttaccgaagaaaaagatctggacattcggataaaaggaccctggcacagcacgattctctgggaaattgtccttatggctacggtttcggaactatatttcacaactattgaaaaagagtggaacggagattcccaagggggttgtacttccgaatccgtactgactgcatacgaaaataagattcttgagatgggaaaagcccttgagaaaaacaactgccttttttcggaatttggaactcgcaggcgaagaagttccgaactccacgaccatgtgatgaaaacccttactggaataaaaaccctgacaggaacaagcaatgtgtattttgcaaaaaaatatggcctgaaaccgatcgggactgtcgggcacgaatggattatgggtacctcagcacttgtagggttaaggtatgcaaaccgttttgcttttgaaaactggatagatgtttataacggggatctgggaattgcccttacggacactttcggctcaaaagccttttttaaggatatggacctgaggttatcaaaaacttacgatgggttcaggcacgacagtggagatccttatgattttgtggacgctgtgatagaacactatcggaaaatgggtatagatcccatgaaaaagttacttgttttcagtgatgccctcaatgcagataccgcaatccaactcaaaaaatattgcgaaggtaaaatcaactgcagtttcggtataggcacaagccttacaaataactccgatttcttcaggaaaagccctcctcttaatatggtcataaagctgcacagtattgacggcattcctgttgtaaaactgagcgactccccggaaaaggaaaccggagaaaaagatgctataagggttgcaaattacatttttggaagaaaagggctggatgaatga

SEQ ID NO: 14090 - protein, 401 aa, Methanosarcina barkeri str. fusaro
MIKSILDNDLYKFTMQLAVLELFPKAEAEYRFTNRGSQRFTTEFVEELERTIREEISKLALTEEEYNWLSENCPYLKPMYLEYLKNFRFKPGEVKVCLTEEKDLDIRIKGPWHSTILWEIVLMATVSELYFTTIEKEWNGDSQGGCTSESVLTAYENKILEMGKALEKNNCLFSEFGTRRRRSSELHDHVMKTLTGIKTLTGTSNVYFAKKYGLKPIGTVGHEWIMGTSALVGLRYANRFAFENWIDVYNGDLGIALTDTFGSKAFFKDMDLRLSKTYDGFRHDSGDPYDFVDAVIEHYRKMGIDPMKKLLVFSDALNADTAIQLKKYCEGKINCSFGIGTSLTNNSDFFRKSPPLNMVIKLHSIDGIPVVKLSDSPEKETGEKDAIRVANYIFGRKGLDE

SEQ ID NO: 14091 - DNA, 1206 bp, Desulfuromonas acetoxidans DSM 684
  CDS (1)..(1206): transl_table=11
atgagtccacgcatcactgaccagcctctgattcacagtcttctcgataccgacctgtataaaataagcatgttgcaggcgttttttcatgccccggaatttcgcaccgtatccgtggagtggaagttcgcctgccgtaatgatcacggctttgatctgaccacgttgcgcgaggatgtgcagtggcagttacaacaggtgtgttcgcttcagtttactgacgaggaactggattatctcgatcaattccctttttttacccacgatttcatcgaatttctgcgcattttccatctcgatatgcgctttgtgtctctggccgttgttgaggggcagttggatatccgtttccgtggcccgctgctgcatgtgaccctgttcgagatttgcaccttggcaattatcagtgaactgcatacgctggcgcattacggcggcgttgatctggatgtggcccgccggcgcctcgaagagaagatcgaccagctcaaggcacccggaccgatgccgggatttcactttgccgatttcggcacccggcgtcgtgccagccgcgcctggcaggaggaagtggtttgccgcctgcatgaagcattacccgactattttaccggtaccagtaacctggatctggcgcgccgttataacctgatgccgatcggcaccatggcccacgaatggtttcaggcctggcaggctgtgacccgtttggccgatgcccagaaggcggcgctggaaagctgggtgcgggaataccgcgggcgtctcggcattgctctgaccgattgttacaacatggatgcgttcatgcgcgatttttccgatccctattttggcaaattgtatgatggtctgcgccatgacagtggcccacccatcgaatggggtgaaaaagccattgccatgtatcaggctatggggatcgacccgctgtcgaagaccctggtgtttagtgacagcctgacctttgaacggatgctggaaatttaccagtatttcaatggccgcgtgcaggtctcgttcgggattggtaccatgctgaccaacgatatcggtcaaccggctctgaacatggtgatcaaaatggtggcggctaacggcaagccggtggcaaaaatctccgatgaaccgggcaagagcatgtgcgaagatgccggatatttacgttatctggcgtcggtgtacgacattgagctgaacctgtaa

SEQ ID NO: 14092 - protein, 401 aa, Desulfuromonas acetoxidans DSM 684
MSPRITDQPLIHSLLDTDLYKISMLQAFFHAPEFRTVSVEWKFACRNDHGFDLTTLREDVQWQLQQVCSLQFTDEELDYLDQFPFFTHDFIEFLRIFHLDMRFVSLAVVEGQLDIRFRGPLLHVTLFEICTLAIISELHTLAHYGGVDLDVARRRLEEKIDQLKAPGPMPGFHFADFGTRRRASRAWQEEVVCRLHEALPDYFTGTSNLDLARRYNLMPIGTMAHEWFQAWQAVTRLADAQKAALESWVREYRGRLGIALTDCYNMDAFMRDFSDPYFGKLYDGLRHDSGPPIEWGEKAIAMYQAMGIDPLSKTLVFSDSLTFERMLEIYQYFNGRVQVSFGIGTMLTNDIGQPALNMVIKMVAANGKPVAKISDEPGKSMCEDAGYLRYLASVYDIELNL

SEQ ID NO: 14093 - DNA, 1293 bp, Jannaschia sp. CCS1
  CDS (1)..(1293): transl_table=11
atggtcgatatcgccacccgcgtctggaaccacaaatggaagatcgacccgatcgtccggtccctgatcgacacggatttctacaaactgctgatgtgtcagtccgtctttcgcaacaagcccgacacgcaggtgcgcttttcgctgatcaaccgcaccacgcgcattcccctcgccgaccttattgacgaaggcgagcttcgcgaacagctggaccacatccgcaccctccgcctcacccgcggcgagtcgacctggatgcgcggcaacaccttctacggtcagcggcagatgttctcgcccgaattcatggattggtttgaggccctgcaactccccccctatcatctggagcgggtcggcgatcagtatgagctgacgtttgaaggtgcctggcccgaggtcatgctgtgggaaatccccgcgctgtcggtgttgatggagcttcgcggtcgtgccgtcctcggcaccatgggccggtttgaacttcaggtcctctatgcccgcgccatgaccaaactgtgggaaaagatcgaacgcctcaaggacatccccgacctgcgcgtcgctgatttcggcacccggcggcggcattccttcctctggcaggattgggccgtccgcgcgatggacgagggcttgggtgataacttcaccggcacctctaactgcctcattgccaagaaccgcgatctggaggcgatcggcaccaacgcccacgaactccccatggtttacgccgctttggccgacagcgacgaggccctcttcaccgccccctacgacgtgctgtccgactggcatgaagagcattccggcaatttgcgcatcatcctgcccgacacctacggcacgcaaggcttcctcgacaacgcgccggattggctggccggttggaccgggatcaggatcgactccggcgacccagcgacggcggcggaagtggccatcgcctggtggaaaagccgtggcgaagacccccggtcaaagctggtgatattctccgacgggctggacgtcgacaagatcgagactcttcacaaacaattctcaggtcgcgtgcgggtcagcttcggctggggcactttgctgacgaacgacttccgaggcctcgtcacaaacgacgccctcgccccgttcagcctggtctgcaaagcggtgagcgcaaacggacgccccaccgtcaaactcagcgacaaccccgaaaaggccatggggcctgcggatcagatcgagcggtataagcgggtgttcggggttggcgagcaggaacgggtggaggtggtggtttaa

SEQ ID NO: 14094 - protein, 430 aa, Jannaschia sp. CCS1
MVDIATRVWNHKWKIDPIVRSLIDTDFYKLLMCQSVFRNKPDTQVRFSLINRTTRIPLADLIDEGELREQLDHIRTLRLTRGESTWMRGNTFYGQRQMFSPEFMDWFEALQLPPYHLERVGDQYELTFEGAWPEVMLWEIPALSVLMELRGRAVLGTMGRFELQVLYARAMTKLWEKIERLKDIPDLRVADFGTRRRHSFLWQDWAVRAMDEGLGDNFTGTSNCLIAKNRDLEAIGTNAHELPMVYAALADSDEALFTAPYDVLSDWHEEHSGNLRIILPDTYGTQGFLDNAPDWLAGWTGIRIDSGDPATAAEVAIAWWKSRGEDPRSKLVIFSDGLDVDKIETLHKQFSGRVRVSFGWGTLLTNDFRGLVTNDALAPFSLVCKAVSANGRPTVKLSDNPEKAMGPADQIERYKRVFGVGEQERVEVVV

SEQ ID NO: 14095 - DNA, 1458 bp, Desulfitobacterium hafniense DCB-2
  CDS (1)..(1458): transl_table=11
gtgcaggatgttgctctgttaactgatttatatcaactcacgatgatgcaaggctattaccaaaatggttatgaaaataaggaagcggtctttgatctttattttcgcaaaatccccagtgggggcggttatgttatagctgcgggcctggagcaggtcgtggagtatattgaaaatttgcggttttcttcagaggacatggcttatctcaggggattaaacatattcgatgaggggtttcttaatctattgaaggatttccgattccatggcgatatagatgccgttcctgaggggactgtggtttttccctatgaaccgttggtgcgggtgaaaggccggatccttgaagctcagcttatcgagacagcgctccttaatataataaactttgagacgcttattgccacgaaagcctcccgggtagtagctgctgccggtggaggaagtgtcatggaatttggtttaagacgggcccagggacctgatgccgggatattaggttcgcgagcggcctttatcggagggtgccaatttacttccaatgtgctggctggaaaacgctatggcatccccctatcgggaactcaagcccatagttggattcagtgctttcctgacgagctggaagctttccgggcctatgccagaaccttcccggatcaatgcctgcttttagttgatacttataatgtgcttaaatccggagtccccaacgccatcaaggtagggctggagctggaggcggaaggacatcgctttttaggcatccgcattgatagcggcgatttaacgtatctttcccgggaagcccgcaaaatgttggatcaagcaggccttgaacatgcacgaattgtggcctccaatgatttggatgagcataccatctcagctattcgcgctcaaggggcggctatcgattcctggggggtaggcactcacttaattacctccaaggataccccggctttaggcggagtctacaagctctcggccgaaggccagaagggggtctttgagccccgccttaaagtctcggagaatatctccaagataaccaaccctggtattaagaagatcgtgcgcttttacgatcggcgcggaaaagccatggcggatttaattgccttagaggatgagcattttgaagaacccttaaccatcttcgaccctattgagacatggaagcgcaaaaccctcactgattttaagacccgggagctcctgaggccggttttccgggggggcaggcgagtctatgaactgccctatctcaaagatatccagacctacgcccagcacgaatgtgagaccttatgggatgaagtgaaacgtctggttaacccacaccgctatatcgtggacttatcgccgaagctcttcgagctaaggcagtccctgctcctggaaatcagtactaagatagaggaagagcagactaaaagattatccaaatga

SEQ ID NO: 14096 - protein, 485 aa, Desulfitobacterium hafniense DCB-2
MQDVALLTDLYQLTMMQGYYQNGYENKEAVFDLYFRKIPSGGGYVIAAGLEQVVEYIENLRFSSEDMAYLRGLNIFDEGFLNLLKDFRFHGDIDAVPEGTVVFPYEPLVRVKGRILEAQLIETALLNIINFETLIATKASRVVAAAGGGSVMEFGLRRAQGPDAGILGSRAAFIGGCQFTSNVLAGKRYGIPLSGTQAHSWIQCFPDELEAFRAYARTFPDQCLLLVDTYNVLKSGVPNAIKVGLELEAEGHRFLGIRIDSGDLTYLSREARKMLDQAGLEHARIVASNDLDEHTISAIRAQGAAIDSWGVGTHLITSKDTPALGGVYKLSAEGQKGVFEPRLKVSENISKITNPGIKKIVRFYDRRGKAMADLIALEDEHFEEPLTIFDPIETWKRKTLTDFKTRELLRPVFRGGRRVYELPYLKDIQTYAQHECETLWDEVKRLVNPHRYIVDLSPKLFELRQSLLLEISTKIEEEQTKRLSK

SEQ ID NO: 14097 - DNA, 1218 bp, Methanococcoides burtonii DSM 6242
  CDS (1)..(1218): transl_table=11
gtgatccgatcgatactggacaatgacctttataagtttacaatgcaaatggcagtgttagaactgtttccaaatgcacgtgctgaataccgtttcatcaataggggcgctcagagttttacaaatgatttcgtgaatgagcttcggcgtatcatcaataaggatatttctaaaatcgcactttccgaagatgaatacatctggctcaaagataattgtcctttttttaaaccttcatatattgaatacctgaagaactttcgctttaatcctgaagaagtgaagatcgttctgacagaagataatgaacttgaactatgtattgaaggtccctggcacagttccatattgtgggagatcgtactcatgtcaaccatttcggaactttattttactgtaacggataacaaaggagaagaaatctcagctagcaatgccaatgatcctgaaaatactctaatggaggagtatagcagttttataggagatatgggaaaggaactggatgccaaaggctgcatcttctctgaatttggaactcgccgccgaagaggattcaaattacatgataaagtggtcgaagttctccatgaactggattctttttccggcactagcaatgtatattttgcaaaaaagtatggtgtgaggccgataggtaccattggccatgaatggataatgggcaactccgcccttgttggtctaaggaatgcgaacaagtttgcttttgataactgggtaaaggtgtacaaaggtgatcttagtattgctcttagtgatactttcggttcaaagcctttcttccaaaattttagtattggtcttgcaaagatctatgatggggtcagacatgacagtggtgatccgatcaagtttgcagatgaggtcattgagcattacaaaaagcttggcattgacccgatgaaaaaagtgctggttttcagtgattcccttcatgtaagtgatgctgtaaaacttaaagaatattgtagtggcaggataaattgcagtttcggtattggcacaacccttacgaacaatccggactttttcagctacaaccctcccctgaacatggtcatcaagctacacaaaatagatggcataccggtggtgaaacttagcgattcagtagaaaaggctactggggacaaggatgctttgagggtggctaattatatatttggcagaaaagggctggatgagcaattttga

SEQ ID NO: 14098 - protein, 405 aa, Methanococcoides burtonii DSM 6242
MIRSILDNDLYKFTMQMAVLELFPNARAEYRFINRGAQSFTNDFVNELRRIINKDISKIALSEDEYIWLKDNCPFFKPSYIEYLKNFRFNPEEVKIVLTEDNELELCIEGPWHSSILWEIVLMSTISELYFTVTDNKGEEISASNANDPENTLMEEYSSFIGDMGKELDAKGCIFSEFGTRRRRGFKLHDKVVEVLHELDSFSGTSNVYFAKKYGVRPIGTIGHEWIMGNSALVGLRNANKFAFDNWVKVYKGDLSIALSDTFGSKPFFQNFSIGLAKIYDGVRHDSGDPIKFADEVIEHYKKLGIDPMKKVLVFSDSLHVSDAVKLKEYCSGRINCSFGIGTTLTNNPDFFSYNPPLNMVIKLHKIDGIPVVKLSDSVEKATGDKDALRVANYIFGRKGLDEQF

SEQ ID NO: 14099 - DNA, 1575 bp, Frankia sp. EAN1pec
  CDS (1)..(1575): transl_table=11
atggactaccccgcggccaccccgagggctaccccaccgtcgtccctaggccccgcgcacgttcctgcccgtcacgtgccgccacccgcccccgcgaccgccgccacccgggccgcgaccggccacccgccgcggcccgcgggttcgtccgatgtggtgcaccggaagcctgtcgtccctaccctgttccggatgtccacggcgcttctgaccgatcactacgagttgaccatgctgcgggcggctctgcgctccggcgcggccgaacgcagagcggtcttcgaggtcttcacccggtccctgcccgccggccgtcgcttcggagtcatggccggcaccgggcgcctgctcgccgcgctcgccgacttccggttcggcccggccgagatcgaccacctgtccgcgaccggcgtcgtggatcccgacacggccgactggctggcctcctaccagttccgcggcgacgtcgacgggttcgccgagggcgagcccttcctgcccgacacccccgtcctcgtggtggagggcacgttcgccgagtgcgtcctgctggagaccctcgtcctgtcggtgctcaaccacgacagcgccatcgccgccgccggcagccgcatggtcgccgccgccggcgaccggccgtgcatagagatgggtggccggcgcacccacgagcaggccgcggtcgccgccgcgcgggccgcctacctcgtcggcttcaccgcgacgtccaacctggaggcggcgcgccgctacggcgtgcccagcgcaggcacgagcgcgcacgccttcaccctcgcgcaccacgacgaggcggcggcgttcgcggcccaggtcgcggcactcggcgccggcacgaccctgctggtggacacctacgacatcccgaccgggatcgccaacgccgtggccgcggcgggcagcgagctcggggcgatccgcatcgacagcggggacctcgccggcggcgcccgggcggcccgcacccagctcgaccagctcggcgccgagtccacccggatcatcgtcaccggcgacctcgacgagcactcgatcgcccgcctggcctcggcccccgtcgacggctacggcgtgggcaccagcctggtgaccgggtcgggcgcacccaccgccggcttcgtctacaaactcgtcgaggttgacggtgagccggtcgtcaagacttctgtgggcaagcgcagccgcggcgggcgcaaggacgtcctgcgccgcctgggcccgaacggactggccgtcgccgacctggtcatccccagagcacccctcgaccgctccgccgccccgcggcccgccggcggtgcgtccgctgcccgcgtacctggcggagaggcgctggacggggctgtggggcgccgggaccgccatctcctcgtccccctgatgcgcggcggccagctcgtcgcggacacgctcgtcggcgcggccggagtcgcccgggcccgggagcaccaccggctcgccctggagtccctaccggccggcgcgcgcgaggtctccttcggacgtccatgcctgccggtcgtggtcgcagcggcggagccgcggacctccttctga

SEQ ID NO: 14100 - protein, 524 aa, Frankia sp. EAN1pec
MDYPAATPRATPPSSLGPAHVPARHVPPPAPATAATRAATGHPPRPAGSSDVVHRKPVVPTLFRMSTALLTDHYELTMLRAALRSGAAERRAVFEVFTRSLPAGRRFGVMAGTGRLLAALADFRFGPAEIDHLSATGVVDPDTADWLASYQFRGDVDGFAEGEPFLPDTPVLVVEGTFAECVLLETLVLSVLNHDSAIAAAGSRMVAAAGDRPCIEMGGRRTHEQAAVAAARAAYLVGFTATSNLEAARRYGVPSAGTSAHAFTLAHHDEAAAFAAQVAALGAGTTLLVDTYDIPTGIANAVAAAGSELGAIRIDSGDLAGGARAARTQLDQLGAESTRIIVTGDLDEHSIARLASAPVDGYGVGTSLVTGSGAPTAGFVYKLVEVDGEPVVKTSVGKRSRGGRKDVLRRLGPNGLAVADLVIPRAPLDRSAAPRPAGGASAARVPGGEALDGAVGRRDRHLLVPLMRGGQLVADTLVGAAGVARAREHHRLALESLPAGAREVSFGRPCLPVVVAAAEPRTSF

SEQ ID NO: 14101 - DNA, 1200 bp, Ralstonia metallidurans CH34
  CDS (1)..(1200): transl_table=11
atgcccccgtctggcctcgttatgatcatccgttccctgctcgacactgacctgtacaaattcacgatgatgcaggtggtgctgcatcacttcccgcaggcccaggtggagtaccgcttcaagtgccgcaacgccggggtcgacctgacgccgtacgtcgacgagatccggtcccagatcacgcagctttgtcagttgcgattcaccgacgatgaactcaattacctgcgtggcctgcgcttcatcaaaagcgactttgtcgagtttctggcgctgttccatctgaacgagaagtacgtgcaggtgctgccgtcggccaagggtaatggcgaaatcgagatcatcatcaagggtccgtggcttcatacgatcctgttcgagattccgctgctggccatcgtcaacgaggtgtacttccgacgtacccagccgaagcccgatctggcggagggccgtcgccggctgcaggccaagctggagctgctcgcggcgccgccctatgtggattgcgtgatcgcggactacggcacccgccgccggttctcgtgcgactggcaggaggaggtcctgctgtcgatgcgcgacgccattggcccgcaattggccggcaccagcaacgtccacttcgcgcgtctgcacaacatgacgccgcttggcacgatggcgcacgagtacctgcaggcctgccaggcccttgggccgcgcctgcgtgattcgcaggtctacgcgctggagcggtgggcacacgagtatcgtggtgaccttggcatcgcgctttcggacacctacggcttcgacgcattcctgcgggacttcgatctctatttctgcaagctgttcgatggcgtgcgacacgattcgggcgatccgttcgaatggggcgagcggatgatcgcgcactacgcagcgaaccgcgtggatccgcgcggcaagacgctgatcttcagcgatgcgctggacattcccaaggtcatcgagctctatgagcgattccgtggccgttgcaagctcgcattcggtgtgggcaccaacctgaccaatgatcttggctacaagccattgcagatcgtgatcaagatggtgcgctgcaatgggcagcccgtggccaagctgtcggacacgcccgagaagacgatgtgcgacgatcccggctatctgtcgtacctgcggcaggtgttcgcggttcaggcccccgcttag

SEQ ID NO: 14102 - protein, 399 aa, Ralstonia metallidurans CH34
MPPSGLVMIIRSLLDTDLYKFTMMQVVLHHFPQAQVEYRFKCRNAGVDLTPYVDEIRSQITQLCQLRFTDDELNYLRGLRFIKSDFVEFLALFHLNEKYVQVLPSAKGNGEIEIIIKGPWLHTILFEIPLLAIVNEVYFRRTQPKPDLAEGRRRLQAKLELLAAPPYVDCVIADYGTRRRFSCDWQEEVLLSMRDAIGPQLAGTSNVHFARLHNMTPLGTMAHEYLQACQALGPRLRDSQVYALERWAHEYRGDLGIALSDTYGFDAFLRDFDLYFCKLFDGVRHDSGDPFEWGERMIAHYAANRVDPRGKTLIFSDALDIPKVIELYERFRGRCKLAFGVGTNLTNDLGYKPLQIVIKMVRCNGQPVAKLSDTPEKTMCDDPGYLSYLRQVFAVQAPA

SEQ ID NO: 14103 - DNA, 1341 bp, Magnetococcus sp. MC-1
  CDS (1)..(1341): transl_table=11
atgaaccattcgacggcggtggaacagaccccggccctgctgaccgatctctaccagctaaccatgttacagagttattggaaagaggggatggcgcagagcgccatctatgattttggcatgcgcagcctgcccggatgccgtaactatctggttatggccgggttggaaagtgtgctggagctgctggaaagtctgcattttacggcgcaggatttggcctatttaagcacccttgggctgtttggcgatgattttctaagctggttacaggattttcgttttaccggtaccgtacacgccttggccgagggtacgctgtttttccctcctgccccgatgctgctgattgaggccccgttaccccaggctcagttggtggaaacggcggtgatgaaccagctgcatttccagacattggtggccagtaaggccgcccgtgtgacccaagcctgtcagggcaagccctttatggagttcgccttgcgccgcacccacggtatggatgccggcttaaaggccagccgcagcgcctatttggcgggggcctctttaacctccaatgtggaagcggggcggcgttggcagattccggtctctggcaccatggcccacgcctttgtgcaggcccatggggatgaattgagcgcttttcgagcctatgccgcgctctatccggagggggccttgttggtggatacctacgataccctacaaggggtgcgtcacgtgatcgccttagcgaaggagctggggacagcgtttcgcattcgcgccatccgactggattcgggcgatctggtggctctggccaaaagcgcccgccagatgttggacgaagcgggtttgttacagatgaaaatctatgtttccggtgggttggatgaacactcagtggctcaactagaggccagtggcgcgcccattgatgcctatgcggtgggtacctcactgtgggtctccgaagatcttccggcaacctcctgtgtctataaatgcgccgtctacggggggcgcccggttatgaaaaaagccaccggtaagcgttctctgcccggctttaaacagctctatcgacatcaacaggatggacgttttagccacgactgtattgagttgcgcgatgcccaagccagcggaacccccctgttacagcgggttatggtggatggcaagcgtgtcaaccgccctgccaatcccctcgccgaggcgcgtgagcgctgcgccgaacagctgcggcaactccccgatgagctgttgggtctaacgcaggccagcaccccttatcctgtgcagatcgggccgcatttgacaaccttgatcgagcaactgtgcggttga

SEQ ID NO: 14104 - protein, 446 aa, Magnetococcus sp. MC-1
MNHSTAVEQTPALLTDLYQLTMLQSYWKEGMAQSAIYDFGMRSLPGCRNYLVMAGLESVLELLESLHFTAQDLAYLSTLGLFGDDFLSWLQDFRFTGTVHALAEGTLFFPPAPMLLIEAPLPQAQLVETAVMNQLHFQTLVASKAARVTQACQGKPFMEFALRRTHGMDAGLKASRSAYLAGASLTSNVEAGRRWQIPVSGTMAHAFVQAHGDELSAFRAYAALYPEGALLVDTYDTLQGVRHVIALAKELGTAFRIRAIRLDSGDLVALAKSARQMLDEAGLLQMKIYVSGGLDEHSVAQLEASGAPIDAYAVGTSLWVSEDLPATSCVYKCAVYGGRPVMKKATGKRSLPGFKQLYRHQQDGRFSHDCIELRDAQASGTPLLQRVMVDGKRVNRPANPLAEARERCAEQLRQLPDELLGLTQASTPYPVQIGPHLTTLIEQLCG

SEQ ID NO: 14105 - DNA, 1305 bp, Mesorhizobium sp. BNC1
  CDS (1)..(1305): transl_table=11
atgaccgttaccgatatcgcacgccgggtttacaatcacacctggaagcttgatcccatctgccgcagcttgctcgacacggatttttacaagcttctgatgctccaaatgatttggggcctctaccaggatgtggacgccactttttcgctgaccaaccggaaccatcgcgtccgccttgccgacgaaatagacgaggccgagttgcgtgcgcagctagaccacgcccgcacgatccgcttttcaaaaaaggagatgatctggctcgccggcaattccttctacggtcgcaagcagatcttcagccccgagttcctcgcttggctcgccgatttccaactgcctgaatatgagctgaggcgacgcgacggtcagtttgaacttcacttttacggccgctggatggaaaccaccatgtgggaaattccggctctggccataatcaacgaattgcgctcacgcgcggccatgcgcacccttggccgctttgccctggacgtgctctacgctcgcgccaaggcgaaggtctgggaaaaggtcgaacgcctgaagaagtacccggacattcgcatctccgacttcggaacgcgacgccgccattcctttttatggcaacgctggtgcgtggaggccttgaaggaaggaatcggcgaatccttcaccggcacgtccaatgtgctgctggccatggatacggacctggaagcgctgggaacgaatgcccacgagcttccgatggttcttgcggcgctaagcagctccgacgaggaactgaaagcctcgccctatcaggtcctcaaggattggcagagctattacggcggcaatctcttgatcgtgctgccggatacgttcggaaccgaatcgttccttgaggacgcaccgggatgggtcgcggattggaccggcttccgccccgatagcgcgccccccatcgaaggcggcgagcgcatcatctcctggtgggagcaacatggccgggacccgcgggaaaagctgctgatcttttccgacgccctcgacgtcgatacaatcgagcagacatatcggcacttcaagggccgttcccgcctgagcttcggctggggaaccaatcttacaaacgacttcgacggctgcgcccccgaaaagatcgacaggctgaaagcgatatcgcttgtttgcaaggtaagcagtgccaacggccgtcccgccgtgaagctctccgacaatccggaaaaggcaaccggcaggcctgaggagatccagcgttatctgcgcgttttcggcagccgcaaccgcgtgcaccagccggtagaggtgtag

SEQ ID NO: 14106 - protein, 434 aa, Mesorhizobium sp. BNC1
MTVTDIARRVYNHTWKLDPICRSLLDTDFYKLLMLQMIWGLYQDVDATFSLTNRNHRVRLADEIDEAELRAQLDHARTIRFSKKEMIWLAGNSFYGRKQIFSPEFLAWLADFQLPEYELRRRDGQFELHFYGRWMETTMWEIPALAIINELRSRAAMRTLGRFALDVLYARAKAKVWEKVERLKKYPDIRISDFGTRRRHSFLWQRWCVEALKEGIGESFTGTSNVLLAMDTDLEALGTNAHELPMVLAALSSSDEELKASPYQVLKDWQSYYGGNLLIVLPDTFGTESFLEDAPGWVADWTGFRPDSAPPIEGGERIISWWEQHGRDPREKLLIFSDALDVDTIEQTYRHFKGRSRLSFGWGTNLTNDFDGCAPEKIDRLKAISLVCKVSSANGRPAVKLSDNPEKATGRPEEIQRYLRVFGSRNRVHQPVEV

SEQ ID NO: 14107 - DNA, 1290 bp, Silicibacter sp. TM1040
  CDS (1)..(1290): transl_table=11
ttggatattgcaacgcgcgtctacaatcacaagtggaagattgatccaatcgtccggtcgctgattgatacggatttctacaaactcttgatgtgtcagtcggtctttcgcaacaaacctgatacgcaggtgaccttctcgctgatcaaccgctctgacaaggtgccgcttgcgcgtctcatcgacgagggcgagctgcgcgagcagctggatcacatccgctccctgagtctcagccgcggcgaaagcacatggctgcgcggcaacacgttctacggcaaacgccagatgtttcggcccgacttcatggagtggttcgaaaacctgcgcctgccgccttatcaccttgaacgcaagggtgatcaatacgagctgacctttgaagggtcctggcccgaggtcatgctgtgggaaattcccgcgcttgcggtgctgatggagctgcgctcgcgcgcggtcctgaatgacatgggccggttcgagctgcaggtgctctatgcccgagcgatgaccaaagtctgggagaaaatcgaacaattgcgccagatcgacggtctcgggatcgcggattttggcacccggcgccgccatagctttttgtggcaggactggtgcgtgcaggcgatgatggaagggcttggcgggtcttttaccggcacctccaactgtctcattgcgatgcgccgcgaggtcgaggccattggcaccaacgcgcatgagctgccgatggtctactctgctttggccgaagatgacgcggcgcttgcccgcgcgccctatgatgtcctgtcggactggcacgaggaacacgagggcaacctgcgcatcattctcccggacacctacggcaccaagggctttttggaaaatgcgccggactggctggcgggatggacgggtattcggatcgacagtggcgatccggcggcggcggcagaaatcgctatcaagtggtggcaggatcgcggcgaggatcccactgaaaaacgtgtgatcttttccgatgggctggatgtgggcaagatcgcagaattgcaccggcagttttcgggtcgggtcaaagcctccttcggctggggtacgcttttgaccaatgatttccgcggcctcgtccctgatgacggcctcgcgcccttctcggtggtgtgcaaggcggtttcggccaatgggcgcccgacggtcaagctctcggacaatcccgaaaaggcgatgggccccaaggatgagatcgcgcggtacaagcgggtgttcggcgtcggcacgcaagagcgtatcgacgtgattgtctga

SEQ ID NO: 14108 - protein, 429 aa, Silicibacter sp. TM1040
MDIATRVYNHKWKIDPIVRSLIDTDFYKLLMCQSVFRNKPDTQVTFSLINRSDKVPLARLIDEGELREQLDHIRSLSLSRGESTWLRGNTFYGKRQMFRPDFMEWFENLRLPPYHLERKGDQYELTFEGSWPEVMLWEIPALAVLMELRSRAVLNDMGRFELQVLYARAMTKVWEKIEQLRQIDGLGIADFGTRRRHSFLWQDWCVQAMMEGLGGSFTGTSNCLIAMRREVEAIGTNAHELPMVYSALAEDDAALARAPYDVLSDWHEEHEGNLRIILPDTYGTKGFLENAPDWLAGWTGIRIDSGDPAAAAEIAIKWWQDRGEDPTEKRVIFSDGLDVGKIAELHRQFSGRVKASFGWGTLLTNDFRGLVPDDGLAPFSVVCKAVSANGRPTVKLSDNPEKAMGPKDEIARYKRVFGVGTQERIDVIV

SEQ ID NO: 14109 - DNA, 1305 bp, Nitrobacter hamburgensis X14
  CDS (1)..(1305): transl_table=11
atgaccgttacggatatcgcgacgcgaacctataaccacggctggcgcctcgatcccatcgtgcgcagcctgctcgatacggatttctacaagcttctgatgctgcagatgatccgggaattctatccgaacgagcacgtcacgttttccgtcatcaatcggagccgccacgtccgcctcgccgaagcgatcgacgagggtgaactgcgcgcgcagctcgatcatgcccgctctatccgcttcagcaagaacgagctgatctggctcgcgggcaacaccttctacggcaagacccagatgttttcgccggacttcatcgattggctggcgacgttccggcttggcgaatatgaattgcggaaggtcgacggccagtacgaactgcatttccacggtccgtggacccacaccaccatgtgggagattccggcgctcgccattctcaacgagttacggtcgcgccaggtgaccaagggtcagggccgtttcgccctcgacgtgctttatgcgcgcgccaaggcaaagctgtgggccaaggtcgaacggttgcgcaagctggatgacttgtggctgtcggacttcggaacgcggcgacgtcacggctttctctggcagcgttggtgcgtcgaggcggccaaggaaggactgggacccgccttcaccggcacgtcgaacgttttgctcgcgatggacaacgacctcgaggccatcggcaccaacgcacatgaactgccgatggtcgcggctgcgctcgccgacgacgataccgcgttgcgccgggcgccctatcgtatcctcgaccaatggcgacacacctatgggggcaacctgctggtcgccctgcccgatgccttcggcacccaggcctttctgcgggacgcgccggagtgggtggcggactggaccggatttcgtcccgacagcctgccgccgatcgcggcgggcgaggaaatcatcaagtggtggaagcagaagagccgcgatccccgggagaagctgctggtgttttccgacggcatggacgtcgattcgatcgaggagacgtatcatcactttgctggccgcgtgcgggtcagtttcggctggggcaccaacctgaccaacgacttcgtgggatgttcgcccgacggcaccgtcgacctcgatccgatctcgatcgtctgcaaggtgacgtcggtcaacggccgtcctgccgtgaaactgtcggataatcccgagaaggcgaccggcgagccctcggagatcgaacgctacctgcgcgtgttcggaagcgccggccgcgtccgcgctcccgttcacgtctga

SEQ ID NO: 14110 - protein, 434 aa, Nitrobacter hamburgensis X14
MTVTDIATRTYNHGWRLDPIVRSLLDTDFYKLLMLQMIREFYPNEHVTFSVINRSRHVRLAEAIDEGELRAQLDHARSIRFSKNELIWLAGNTFYGKTQMFSPDFIDWLATFRLGEYELRKVDGQYELHFHGPWTHTTMWEIPALAILNELRSRQVTKGQGRFALDVLYARAKAKLWAKVERLRKLDDLWLSDFGTRRRHGFLWQRWCVEAAKEGLGPAFTGTSNVLLAMDNDLEAIGTNAHELPMVAAALADDDTALRRAPYRILDQWRHTYGGNLLVALPDAFGTQAFLRDAPEWVADWTGFRPDSLPPIAAGEEIIKWWKQKSRDPREKLLVFSDGMDVDSIEETYHHFAGRVRVSFGWGTNLTNDFVGCSPDGTVDLDPISIVCKVTSVNGRPAVKLSDNPEKATGEPSEIERYLRVFGSAGRVRAPVHV

SEQ ID NO: 14111 - DNA, 1308 bp, Paracoccus denitrificans PD1222
  CDS (1)..(1308): transl_table=11
atgatcccgacggtcgatatcgccacccgcgtctataaccacaaatggaagatcgacccgatcgtccgctcgctgatcgacgacgatttctacaagctgctgatgtgccagtcggtgttccgcaaccggcccgacacgcaggtcaccttcagcctgatcaaccgcagcagtcgcatccgcctggccgagctgatcgacgaaggcgagctgcgcgaacagctggaccatgcgcgtggcctgtcgctgacgcggggcgaaagcacctggctgcgcggcaataccttctatggcaagcggcagatgttccgcccggacttcatggagttcctcgagaacctgcgcctgccggcctatcacctggaaaagcgcgacggccagtatgagctggtcttcgagggcagatggcccgaagtcatgctgtgggagatcccggcgctggcgatcatcatggaactgcgctcgcgcgccgtgctcaaggacatgggccggttcgagctgcaggtgctctatgcccgcgccatggcccggctttgggaaaagatcgaggaattgcgcaagctcggccccgacctgcgcatcgccgacttcggcacccgccgccgccacagcttcctgtggcaggactggtgcgtgcaggccatggtcgaggggctgggcgaccagcggttcatcggcacctcgaactgcctgatcgccatgcgccgcgacatcgaggccatcggcaccaatgcccatgaactgcccatggtctatgccgcgctggccgacagcgacgccgaactgcgccaggcgccctatcgtgtgcttgccgactggcacgaggagcatgacgggatgctgcgcatcatcctgcccgacacctatggcaccaagggcttcctggaccatgcgcccgactggctggcaggctggaccggcatccgcgtcgacagcggcgacccggccgagggcgccgagacggcgatccgctggtggcaggagcgcggcgaggatccgcgcaacaagctgatcatcttttcggacggtctggacgtggacaagatcagggacctgttccaccgcttccacggtcgggccaaggtcagtttcggctggggcacgctgctgaccaacgattttcgcgggctggtgccgggcgacgggctggcgccgttttcgctggtctgcaaggcggtggcggccgagggacggccgaccgtcaagctttccgacaatcccgagaaggccaccggcccccaggacgagatcgagcgctacaagcgcgtattcgacgtcggccagcagcagcgcatggcggtggtggtctga

SEQ ID NO: 14112 - protein, 435 aa, Paracoccus denitrificans PD1222
MIPTVDIATRVYNHKWKIDPIVRSLIDDDFYKLLMCQSVFRNRPDTQVTFSLINRSSRIRLAELIDEGELREQLDHARGLSLTRGESTWLRGNTFYGKRQMFRPDFMEFLENLRLPAYHLEKRDGQYELVFEGRWPEVMLWEIPALAIIMELRSRAVLKDMGRFELQVLYARAMARLWEKIEELRKLGPDLRIADFGTRRRHSFLWQDWCVQAMVEGLGDQRFIGTSNCLIAMRRDIEAIGTNAHELPMVYAALADSDAELRQAPYRVLADWHEEHDGMLRIILPDTYGTKGFLDHAPDWLAGWTGIRVDSGDPAEGAETAIRWWQERGEDPRNKLIIFSDGLDVDKIRDLFHRFHGRAKVSFGWGTLLTNDFRGLVPGDGLAPFSLVCKAVAAEGRPTVKLSDNPEKATGPQDEIERYKRVFDVGQQQRMAVVV

SEQ ID NO: 14113 - DNA, 1230 bp, Pseudomonas fluorescens
  CDS (1)..(1230): transl_table=11
atggaaagtgcatttgaccgcaacaacggcgtgatccagagcctgctggataccgactactacaccttcaccatgatgcaggcggtgttgcaccagcaccccaatgtggacgtggaataccagttcatcgttcgttccagagagtccctggtgcacctgatccccgagatccgccaggagctggaaaagcttgccggcctgcagatgcgcgaaggcgaacagcgctttttgttcaacaagcgctttcgtgaatacctgacccctgacttcgaacagttcctcggcctgttccgcttcaacctgcgctacatccacgtggcggcggtcgacggccaactgagcatccgcgtccgcggcccgatgctgcactgcatcatgttcgagcagccggtgctggccatggtcagcgaactgcgcaaccgcgataagtaccccgaggtggagcttgaggatgtcactcgccggctctaccagaagttcgaatggctggagaaaaacgccagccgcgacgagcttgccgagttccgcgtttcggatttctctacccgccggcgcctgtcgttcaaggcccagcgcgaagtggtgaagatcatgcgcagcgatttccccggggtcttcgtcggcaccagcaatgcgcacctggcctatgagttcgacctgccgctgatcggcaccatggcccaccaatggctgatggtgcaccagcaactggggcggctgcgcgagagccagaatgcggcccttgagaactgggtgcacgagtatcgcgggcgcctgggcattgccctgaccgactgcatcagcaccgatttcttcctcaaggacttcgacctgtacttcgccaagctctacgacggcctgcgccaggattccggggacccgatcctctgggccgacaaggtcctggcccgctaccgggaactgggcatcgacccgcggaccaaggacctgatgttttccgatggcctgaacttcgagaaatgcctgccgatcctgcgccacgtgcgtggccaggcccgcttcggtttcggcatgggcaccagcctggcctgcgatgtggagggcgtggagccgctgagcatcgtgatgaagctggtgcgagtccacggtgaaccggtggtgaagttctccgacgacccgatcaagaacgtctgcgaagacccgtcgttcctccggtacgcggcccaggtgttcaacgtcgatcttgcccactcgcccctggaggcctga

SEQ ID NO: 14114 - protein, 409 aa, Pseudomonas fluorescens
MESAFDRNNGVIQSLLDTDYYTFTMMQAVLHQHPNVDVEYQFIVRSRESLVHLIPEIRQELEKLAGLQMREGEQRFLFNKRFREYLTPDFEQFLGLFRFNLRYIHVAAVDGQLSIRVRGPMLHCIMFEQPVLAMVSELRNRDKYPEVELEDVTRRLYQKFEWLEKNASRDELAEFRVSDFSTRRRLSFKAQREVVKIMRSDFPGVFVGTSNAHLAYEFDLPLIGTMAHQWLMVHQQLGRLRESQNAALENWVHEYRGRLGIALTDCISTDFFLKDFDLYFAKLYDGLRQDSGDPILWADKVLARYRELGIDPRTKDLMFSDGLNFEKCLPILRHVRGQARFGFGMGTSLACDVEGVEPLSIVMKLVRVHGEPVVKFSDDPIKNVCEDPSFLRYAAQVFNVDLAHSPLEA

SEQ ID NO: 14115 - DNA, 1215 bp, Pseudomonas fluorescens
  CDS (1)..(1215): transl_table=11
atgagcgagagtgtgtttgccgatcgcatcgtgcagaacctgctcgacaccgacttctacaaactgaccatgatgcaggcggtgctgcacaactaccccaacgtcgaggtggaatgggagtttcgttgccgtaacagcgaggacctgcggccctatctggcagagatccgctaccagttcgagcgcctggcggatctgagcctgagcgccgaccagttgggctttctcgaacggatcagcttcctcaagccggatttcctgcgctttctcgggctgtttcgcttcaacctgcgctacgtgcataccggcatcgaggacggcgagctgtttatccgcctgcgcggcccctggctgcacgtgatcctgttcgaagtgccgatgctggccatcatcagcgaggtgcgcaaccgctaccgctatcgcgagatccagctggtccaggcccgcgagcagctgtaccgcaagttcgactggctgaccgccaacgccagcagcgaagaactttccgagctgcaagtggctgatttcggcacccgccgacgcttttcctaccgggtccaggaagaagtagtgaacgtgctcaagcacgatttccccggacgttttgtcggcaccagtaacgtgcacctgtcccgggaactgaacatgaaacccctgggcaccatggcccacgaatggatcatggcccaccagcaactggggccgcggctgatcgacagccagatcgccgccctcgactgctgggtccgcgaataccgtggcttgctgggcatcgccctgacggattgcatcaccaccgatgccttcctcggcgatttcgacctgttcttcgccaagctgttcgacggcctgcgccacgactccggcgacccgatcctctgggcggaaaaggccatcgcccactaccacaagctgggcatcgatccgatgagcaagaccctggtgttctccgacagcctgagcctgccgcgcgccctggaaatattccgtgcgctgcgggggcggatcaatgtcagcttcggcatcggcaccaacctgacctgtgacattcccggtgtcgagccgatgagcatcgtgcttaaaatggctgcctgcaatggccagcccgtcgccaagatctccgatgaagcgggcaagacccattgcaaggatccgaacttcgtcgcttacttgcgccacgttttccaagtacctgcccaacctggcaaggagtga

SEQ ID NO: 14116 - protein, 404 aa, Pseudomonas fluorescens
MSESVFADRIVQNLLDTDFYKLTMMQAVLHNYPNVEVEWEFRCRNSEDLRPYLAEIRYQFERLADLSLSADQLGFLERISFLKPDFLRFLGLFRFNLRYVHTGIEDGELFIRLRGPWLHVILFEVPMLAIISEVRNRYRYREIQLVQAREQLYRKFDWLTANASSEELSELQVADFGTRRRFSYRVQEEVVNVLKHDFPGRFVGTSNVHLSRELNMKPLGTMAHEWIMAHQQLGPRLIDSQIAALDCWVREYRGLLGIALTDCITTDAFLGDFDLFFAKLFDGLRHDSGDPILWAEKAIAHYHKLGIDPMSKTLVFSDSLSLPRALEIFRALRGRINVSFGIGTNLTCDIPGVEPMSIVLKMAACNGQPVAKISDEAGKTHCKDPNFVAYLRHVFQVPAQPGKE

SEQ ID NO: 14117 - DNA, 1443 bp, Staphylococcus haemolyticus
  CDS (1)..(1443): transl_table=11
atgttacataatgacttataccaaattaacatggcagagagctattggaatgatggtattcatgaacgaaatgcagtatttgatttgtattttagaagtatgccatttgagagtggatatgcagtttttaatggtttaaaaagagtaattcaatttattgaacattttcattttagtgattctgatattgaatatttacagtcaataggttataaaaatgatttcttaaactatttaaaaaatttaaagttcactggtaatattcgctcaatgcaagaaggtgaattgtgttttggaaatgaaccattacttagagtggaggcaccattaattcaagcgcaacttatagaaaccgtattacttaatataatcaacttccatacattaatttcgactaaagcaagtagaattcgtcaagtagcacctgatgatacattaatggaatttggaactcgtcgtgcacaagagttagatgctgcgttatggggggctagagctgcttatatcggtggttttgattctactagtaatgtgcgttccggtaaattatttggtatacccgtttctggtacgcatgcacacgctttagttcaaacatatggtgatgaatataaagcttttaaaatttatgcagaacgccataaaaattgtgtgttcttagttgatacgttccacacgcttaaatcaggtgttcctacagctattaaagtagcgaaagaactaggggataaaatcaatttcattggtatccgtttagattctggagatattgcttatttatctaaagaagcacgcagaatgttagatgaagcgggattcaaagatgctaaaatcatcgcatctaatgacttagatgaacaaacgataatgagtttgaaatctcaaggagctaaagttgactcatggggtgtaggtacgaaattaattactggttatgaccaaccagcacttggtgcagtatataaactagtagcagttgaagatgacaacggccgatatgttgatagaattaaactgtccaacaatgcagaaaaagtgacaacacctggtaagaagaaagtgtatcgcattataaatactaaaacaggtaaagcagaaggcgactatattactctagaacatgagaatcctaataatgaaaaacctttaaaaatgttccatccagttcacacgtataaaatgaaacatatcaaacactttgaagcgattgacttgcatcattcaatctttgaaaatgggaaacttgtttaccaattaccgagtgaaaaagaggcacaagaatactctaaaaaggcattatctaaattatgggatgaaaataaacgttatttaaatcctcaagaataccctgtggatttaagtacagcttgttgggacaacaaacataagcgtattttcgaagttgcagaacacgtaaaagagatggaggaagacaatgactaa

SEQ ID NO: 14118 - protein, 480 aa, Staphylococcus haemolyticus
MLHNDLYQINMAESYWNDGIHERNAVFDLYFRSMPFESGYAVFNGLKRVIQFIEHFHFSDSDIEYLQSIGYKNDFLNYLKNLKFTGNIRSMQEGELCFGNEPLLRVEAPLIQAQLIETVLLNIINFHTLISTKASRIRQVAPDDTLMEFGTRRAQELDAALWGARAAYIGGFDSTSNVRSGKLFGIPVSGTHAHALVQTYGDEYKAFKIYAERHKNCVFLVDTFHTLKSGVPTAIKVAKELGDKINFIGIRLDSGDIAYLSKEARRMLDEAGFKDAKIIASNDLDEQTIMSLKSQGAKVDSWGVGTKLITGYDQPALGAVYKLVAVEDDNGRYVDRIKLSNNAEKVTTPGKKKVYRIINTKTGKAEGDYITLEHENPNNEKPLKMFHPVHTYKMKHIKHFEAIDLHHSIFENGKLVYQLPSEKEAQEYSKKALSKLWDENKRYLNPQEYPVDLSTACWDNKHKRIFEVAEHVKEMEEDND

SEQ ID NO: 14119 - DNA, 1245 bp, Leishmania major
  CDS (1)..(1245)
atggctcactcgaacgagttcgccccgattatcaaatcgttcctcgacacggatgcctacaaactgcacatgcagcaggccgtttttcaccagaacccaaccgtgactgcggcctacaagctcagctgccgtgacaaggatgtccaccttggcatctacgcggatcgggtatacgcgcatgtgcagcagatggcccatgtgcgactgaccgaagaggagtgtgcctacttggcaacgctgccctactttaaggaggactacctcgagtacctgcgcggctaccgctacaagtcggagcaggtgcagattcgcaccgtgctgccgacgatggcatgcgagaagaacgagttcggtgaggacggctccgacctggaggtgacggtggaggggccatgggtggaaacaattctgtgggaaatcccgctactggcgatcgtcagcgaggtcacccaacgcagccgccactcccgcgtgggtccggccgaggcgctggcgaacttgcacgagaagttggatctgtttttcgctaatcacacggaggaggagcttgccactttcaaggtcgctgagtttggcacgcgccggcgctgcagccaggcggtgcaggaggtggtcgtgcgagcgctgaaggaggatgcgcgattcggacctcgcctcgtgggcacgagtaactatgatctggcgcggcgccttggcctgccgcctgtgggcactcaagcgcacgagtggtttcaggcctttcagcagctctcttcagagctgcgccgttcccagattatggcgatggaccactggctacaggagtacccccagtgtctcggcatcgcgctaacggattgcatcacaatggacgccttcttgaaggacttcgacgcgcgtctggcgaacgcctatcagggactgcggcaagactcgggtgtgccgacggagtggggccagaaggccttgaatcactacaagcttctcgggatcgatccccgcaccaagactctcgtcttctcagacgggctcgacttggagaaggcggcggagttatacaacggcttcaaggaggacataaatgtgctatgcggcatcggtacgcagctgacgtgctccattaaaggagttcgctcgattaacatcgtcatgaaaatggtccgatgccagggcaggccagtcgcgaagctgtcggacagccccgggaagatcatgtgcgacgacctcgagtacgtcgagaagctgaaggaggcgtttaacgtgtaa

SEQ ID NO: 14120 - protein, 414 aa, Leishmania major
MAHSNEFAPIIKSFLDTDAYKLHMQQAVFHQNPTVTAAYKLSCRDKDVHLGIYADRVYAHVQQMAHVRLTEEECAYLATLPYFKEDYLEYLRGYRYKSEQVQIRTVLPTMACEKNEFGEDGSDLEVTVEGPWVETILWEIPLLAIVSEVTQRSRHSRVGPAEALANLHEKLDLFFANHTEEELATFKVAEFGTRRRCSQAVQEVVVRALKEDARFGPRLVGTSNYDLARRLGLPPVGTQAHEWFQAFQQLSSELRRSQIMAMDHWLQEYPQCLGIALTDCITMDAFLKDFDARLANAYQGLRQDSGVPTEWGQKALNHYKLLGIDPRTKTLVFSDGLDLEKAAELYNGFKEDINVLCGIGTQLTCSIKGVRSINIVMKMVRCQGRPVAKLSDSPGKIMCDDLEYVEKLKEAFNV

SEQ ID NO: 14121 - DNA, 1380 bp, Gibberella moniliformis
  CDS (1)..(1380)
atggatttcaacagctcctcgcccttcccggagggcgtcatctccttcctcgacactgatctatacaagttgacgatgcaatgtgccgtcttcaagttcttcaaagatgtgcctgtgacatacgcctacaccaaccgaactccagacaagaagctgtcgcgtaccgccttcaagtggctcgaagagcagattcgaaagctcggaaacatttctctttctaccgacgaatacctttttctcaagaagcattgcgactacctctccgacgactacctcaacttcctcaaggaattccgacttagcccccgagaacaagttgttgctaccttcactcccgtcggagaggataatggagacgactccattgagggcgacgtcgatatacagatcaagggcacttgggttgacacgatcctctacgaaatccccatgcttgctcttacatccgaggcgtacttcaagttcatggacacagactggaactatgagggccaagaaaagcaggcatttgagaagggactcaagttattagaggcaggatgcatcacatccgagttcggcacacgaagacgtcgcgactaccacacccaggcccttgtattccgaggattggtgcaagcttccaaagaagccgagaagaagggattccctggcaagctctctggaaccagtaacgtccatctcgctatgcgcttcaacatccctcccgtaggaactgtcgcccacgagtggttcatgggtgttgccgctattatcggtgactacaggtctgctactgaggttgcgctgcgacactgggtagcttgtttcggtaacaagctcggcattgctttgaccgacacctttggaactcaagagtttctgcgagctttcacccagcctgtgcaaactatcgagggtggcttcccagcagagaccttcaagaaggctgacggaaccatgaagacatatgcggagacttttgctggtattcgtcaagattccggcgaccctgcagagtacaccaagtggatgaaagagttctacgataagcagggtattaccgacaagaagctgattgtcttctctgactcactgaacattgagaggtgtctcgagtataaaaagattgctgaggaccttggcttccagccaacatttggtgtgggaacataccttaccaacgactttgtgcacctcacgactggcaaaaagtcagtgcctctgaacattgtcatcaagatcagctcggcggcaggccgcccagctgtcaagatcagtgacaacattgggaagaacacgggcgacaaggagactgtggagaaggtcaagcaggaacttggttatgtcgagcgcgagtggaaggagggcgacgaaacttctcgatggggcaaggaataa

SEQ ID NO: 14122 - protein, 459 aa, Gibberella moniliformis
MDFNSSSPFPEGVISFLDTDLYKLTMQCAVFKFFKDVPVTYAYTNRTPDKKLSRTAFKWLEEQIRKLGNISLSTDEYLFLKKHCDYLSDDYLNFLKEFRLSPREQVVATFTPVGEDNGDDSIEGDVDIQIKGTWVDTILYEIPMLALTSEAYFKFMDTDWNYEGQEKQAFEKGLKLLEAGCITSEFGTRRRRDYHTQALVFRGLVQASKEAEKKGFPGKLSGTSNVHLAMRFNIPPVGTVAHEWFMGVAAIIGDYRSATEVALRHWVACFGNKLGIALTDTFGTQEFLRAFTQPVQTIEGGFPAETFKKADGTMKTYAETFAGIRQDSGDPAEYTKWMKEFYDKQGITDKKLIVFSDSLNIERCLEYKKIAEDLGFQPTFGVGTYLTNDFVHLTTGKKSVPLNIVIKISSAAGRPAVKISDNIGKNTGDKETVEKVKQELGYVEREWKEGDETSRWGKE

SEQ ID NO: 14123 - DNA, 1233 bp, Schizosaccharomyces pombe
  CDS (1)..(1233)
atgagtgaaccggctgttgtctctatcctcgatacggatctttacaaactcaccatgcttcaagccgttttagagcattatccggatgctcaagtatcatataagtatacaaaccggtccccaaaaatggcattaaatcaggaggcttataactggttacgggaacaaataagaggcttacggaatttacatttacttcctgaagaagagcaatggcttcgcaagaactgtccttatttaaaggaatcattttatgaattcatgcatgagttcgaatttgatcctgaaaattcaatttcccttaattatgattctgaaactaaggatctctcaatctttattcacggcctctggaagaataccattttttatgaaattccactgcttgctctcgtctcagaatcttattttaaatttgtcgataaggactggtcacctgagggtcagtttgaaaaagcttacgagaagggtaagcgtctcatccgagccggatgtgcctttactgactttggcactcgtcgtcgtcgtgatcctcacacccaggaaattgttctccaaggtctcatgaaagcacaagaggattttaagggccctggaagtttccttggtacatctaatgtttacttcgccgccaaatataatctaaatgtctctggtacggttgctcacgagtggtatatgggcattgcagctattactcaaaattataaacaagcaaatcgtattgcttccttaaagtgggtccaaacttttggtactagtcttttaatagccttaacggatacattctctactgatgtgtttctcaaatcttttacagccaattctgccgacgatttagccaatgttttccatggtgttcgtcaagatagcggttgtgctgaggaatacattgaaaaagtcgtaaagcactataaatcaataggtgtcgatccttccacaaaagtaattgttcatagcgatgctttaaatgttgacagatgtatcgaactgtacaaatactgcgagaaatgtggcattaagtctgcatttggcatcggcacaaatcttaccagcgacttccaaaaagtttccaatcccagtgaagtgagcaaacctatgaatattgttattaagcttttttccgctgaaggaactaaagcagtgaagattagtgacgatatcatgaaaaatactggtgatcgtgatgctgttattcaagccaagcatcaattatgcctccctatagcataa

SEQ ID NO: 14124 - protein, 410 aa, Schizosaccharomyces pombe
MSEPAVVSILDTDLYKLTMLQAVLEHYPDAQVSYKYTNRSPKMALNQEAYNWLREQIRGLRNLHLLPEEEQWLRKNCPYLKESFYEFMHEFEFDPENSISLNYDSETKDLSIFIHGLWKNTIFYEIPLLALVSESYFKFVDKDWSPEGQFEKAYEKGKRLIRAGCAFTDFGTRRRRDPHTQEIVLQGLMKAQEDFKGPGSFLGTSNVYFAAKYNLNVSGTVAHEWYMGIAAITQNYKQANRIASLKWVQTFGTSLLIALTDTFSTDVFLKSFTANSADDLANVFHGVRQDSGCAEEYIEKVVKHYKSIGVDPSTKVIVHSDALNVDRCIELYKYCEKCGIKSAFGIGTNLTSDFQKVSNPSEVSKPMNIVIKLFSAEGTKAVKISDDIMKNTGDRDAVIQAKHQLCLPIA

SEQ ID NO: 14125 - DNA, 1290 bp, Saccharomyces cerevisiae
  CDS (1)..(1290)
atgtcagaaccagtgataaagtctcttttggacacagacatgtacaagattacgatgcatgctgctgtcttcactaattttccagatgttacagttacttataaatataccaacaggtcgtcccaattgaccttcaataaggaagccattaattggttgaaagagcaattttcgtatttgggaaatttgaggttcacagaagaggaaattgaatacttaaaacaggaaatcccatatttgccatcggcatatattaagtatattagcagttctaattacaaactacaccctgaagagcagatttccttcacttcagaagaaatcgagggcaagcccacccactacaaattgaaaattttagtcagtggtagttggaaggatactatcctttatgagatccccttactgtccctaatatcagaagcgtattttaaatttgttgacatcgactgggactacgaaaaccaattagaacaagctgagaagaaggcggaaactttgtttgataatggtattagattcagtgaatttggtacaagacgtcgtagatctctgaaggctcaagatctaattatgcaaggaatcatgaaagctgtgaacggtaacccagacagaaacaaatcgctattattaggcacatcaaatattttatttgccaagaaatatggagtcaagccaatcggtactgtggctcacgagtgggttatgggagtcgcttctattagtgaagattatttgcatgccaataaaaatgcaatggattgttggatcaatacttttggtgcaaaaaatgctggtttagcattaacggatacttttggaactgatgactttttaaaatcattccgtccaccatattctgatgcttacgtcggtgttagacaagattctggagacccagttgagtataccaaaaagatttcccaccattaccatgacgtgttgaaattgcctaaattctcgaagattatctgttattccgattctttgaacgtcgaaaaggcaataacttactcccatgcagctaaagagaatggaatgctagccacattcggtattggcacaaactttactaatgattttcgtaagaagtcagaaccccaggttaaaagtgagccgttaaacatcgttatcaaactattagaagtaaatggtaatcacgctatcaaaatttctgataacttaggtaaaaatatgggagatcctgccactgtgaagagagtgaaagaggaattgggatatactgaacgaagttggagtggtgataacgaagcgcacagatggacctaa

SEQ ID NO: 14126 - protein, 429 aa, Saccharomyces cerevisiae
MSEPVIKSLLDTDMYKITMHAAVFTNFPDVTVTYKYTNRSSQLTFNKEAINWLKEQFSYLGNLRFTEEEIEYLKQEIPYLPSAYIKYISSSNYKLHPEEQISFTSEEIEGKPTHYKLKILVSGSWKDTILYEIPLLSLISEAYFKFVDIDWDYENQLEQAEKKAETLFDNGIRFSEFGTRRRRSLKAQDLIMQGIMKAVNGNPDRNKSLLLGTSNILFAKKYGVKPIGTVAHEWVMGVASISEDYLHANKNAMDCWINTFGAKNAGLALTDTFGTDDFLKSFRPPYSDAYVGVRQDSGDPVEYTKKISHHYHDVLKLPKFSKIICYSDSLNVEKAITYSHAAKENGMLATFGIGTNFTNDFRKKSEPQVKSEPLNIVIKLLEVNGNHAIKISDNLGKNMGDPATVKRVKEELGYTERSWSGDNEAHRWT

SEQ ID NO: 14127 - DNA, 1200 bp, Pseudomonas aeruginosa
  CDS (1)..(1200): transl_table=11
atggccgaaagcgtctttgccgagcgcattgtgcagaacctgctcgataccgatttctacaagctgaccatgatgcaggcggtgctgcacaactaccccaacgccgaagtggagtgggaattccgctgccgcaacgccgaggacctgcgtccgtacctggcggagatccgctaccagatcgagcgcctcgccgaagtcgaggtaaccgccgaccagctcgccttcctcgaacgcatcccgttcatgaagccggacttcatccgcttcctcagcctgttccgcttcaacctgcgctacgtgcacaccggcatcgaggatggccaactggcaatccgcctgcgcggcccatggctgcacgtgatcctcttcgaggtgccgctgctggccatcgtcagcgaggtgcgcaaccgttatcgctaccgcgaggtggtcctggaacaggtcggcgagcagctctatcgcaagctcgactggctctccgcccaggccagcagcgaggaactcgcggaattccaggtcgccgacttcggcacccgccggcgcttctcctaccgcacccaggaggaagtggtgcatatcctcaagcgcgacttccccgggcgcttcgtcggcaccagcaacgtgcacctggcccgcgagtacgacctcaagccgatcggcaccatggcccacgaatggctgatggcccaccagcaactcggcccgcggctggtcgacagccagcaagcggcgctggactgctgggtccgcgagtaccgcggacagctcggcatagccctgaccgactgcattaccatggatgccttcctcgacgacttcgacctgtacttcgccaagctcttcgacggcctgcgccacgattcgggcgacccgctggcctgggcggagaaagccatcgcccactaccgccgcctgggtatcgacccgctgagcaagaccctggtgttctccgacgggctggacatgcccaaggcgttgcagctgttccgcgcgctacgtggcaagatcaacgtcagcttcggcatcggcaccaacctgacctgcgacatcccgggggtcgagccgatgaacatcgtcctgaagatgacggcctgcaacggccatccggtggcgaagatatccgacgccccgggcaagacccaatgccgcgacgagaacttcgtcgcctacctccgccacgtcttcaacgtgccggcctaa

SEQ ID NO: 14128 - protein, 399 aa, Pseudomonas aeruginosa
MAESVFAERIVQNLLDTDFYKLTMMQAVLHNYPNAEVEWEFRCRNAEDLRPYLAEIRYQIERLAEVEVTADQLAFLERIPFMKPDFIRFLSLFRFNLRYVHTGIEDGQLAIRLRGPWLHVILFEVPLLAIVSEVRNRYRYREVVLEQVGEQLYRKLDWLSAQASSEELAEFQVADFGTRRRFSYRTQEEVVHILKRDFPGRFVGTSNVHLAREYDLKPIGTMAHEWLMAHQQLGPRLVDSQQAALDCWVREYRGQLGIALTDCITMDAFLDDFDLYFAKLFDGLRHDSGDPLAWAEKAIAHYRRLGIDPLSKTLVFSDGLDMPKALQLFRALRGKINVSFGIGTNLTCDIPGVEPMNIVLKMTACNGHPVAKISDAPGKTQCRDENFVAYLRHVFNVPA

SEQ ID NO: 14129 - DNA, 1197 bp, Pseudomonas aeruginosa
  CDS (1)..(1197): transl_table=11
atggccgagagcgctttttccgaacgtatcgtgcagaacctgctggataccgacttctacaagctgaccatgatgcaggcggtgctgcacaactatcccaacgccgaggtggaatgggagttccgctgccgcaaccaggaagacctgcgcctgtacctgccggccatccgcgaacaactggaatacctggcgggcctggcgatcagcgacgagcaactggccttcctcgaacggattcccttcctcgcgccggacttcatccgcttcctcgggttgttccgcttcaacccgcgctacgtgcagaccggcatcgagaacgacgaattcttcctgcgcctgaaaggtccctggctgcacgtgatcctcttcgaagtgccgctgctggcgatgatcagcgaggtgcgcaaccgcgcccgctacccggccgccaccgtcgagcaggcgcgcgaacgcctgcaggaaaagttcgattggctgcgccgggaggccagcgccgaggaactggccggcttcaagatggccgacttcggtacccgccgccgcttctcctatcgggtccacgaggcggtggtgagcggtctgaaggaggactttccgggctgcttcgtcggcaccagcaacgtccacctggcacgcaagctcgacctcaagcccctcggcaccatggcccacgaatggctgatggcccaccagcagctcggtccgcgcctgatcgacagccagagtgccgcgttggactgctgggtccgcgaataccgtgggctgctcggcatcgcgctgaccgactgcatcaccaccgatgccttcctgcgcgacttcgacctctatttcgccaagctcttcgacggcctccgccacgactcgggcgacccattgctgtgggcggaaaagaccatcgcccactacctcaagctgggcatcgacccgctgaccaagaccctggtgttctccgacggcctcgacctgccgcgggccctgaagatctatcgcgcgctgcagggccggatcaacgtcagcttcggcataggcacgcatttcacctgcgacctgccgggcgtcgagccgatgaacatcgtggtgaagatgagcgcctgcaacggccatccggtggcgaagatctccgatacgcccggcaaggcgcaatgccgggaccctgacttcatccactacctcaagcacgtgttccaggtcgcctag

SEQ ID NO: 14130 - protein, 398 aa, Pseudomonas aeruginosa
MAESAFSERIVQNLLDTDFYKLTMMQAVLHNYPNAEVEWEFRCRNQEDLRLYLPAIREQLEYLAGLAISDEQLAFLERIPFLAPDFIRFLGLFRFNPRYVQTGIENDEFFLRLKGPWLHVILFEVPLLAMISEVRNRARYPAATVEQARERLQEKFDWLRREASAEELAGFKMADFGTRRRFSYRVHEAVVSGLKEDFPGCFVGTSNVHLARKLDLKPLGTMAHEWLMAHQQLGPRLIDSQSAALDCWVREYRGLLGIALTDCITTDAFLRDFDLYFAKLFDGLRHDSGDPLLWAEKTIAHYLKLGIDPLTKTLVFSDGLDLPRALKIYRALQGRINVSFGIGTHFTCDLPGVEPMNIVVKMSACNGHPVAKISDTPGKAQCRDPDFIHYLKHVFQVA

SEQ ID NO: 14131 - DNA, 1224 bp, Acinetobacter sp
  CDS (1)..(1224): transl_table=11
ttgttgtctatgtctccaatcattcattcattacttgataccgatctttataaattcaccatgttgcaagtggtgttacaccagtttccacaaacgcatagtgtctatcattttcgctgtcgtaatctggatgaaactcaatatcctttaaccgatattctggatgatttgaatgaacaactcgatcatttatgtacgctgaaatttaaggacgacgaactacaatatctgcgttcttttcggtttattaaaagtgattttgtcgattacttggaactgttccagcttaaacgtcgttttatcactgcgggtattgatgaagaaggccgcctggatatctgggttgaaggaccgatggttcaggccatgatgtttgaaatatttgtactggcgattgtgaatgagctttattttcgtcgtatacgaagtgatgctgtacttgaagagggtgagcgtcgcttacaggctaagctggctttacttgagcagtatcagacccagcatcagtcagatgagccaccatttttagtttctgattttggtacacgtcgccgttatagttttgaatggcaaaaacatgtcattgcagcatttcatcatcatttcccaaatatctttaggggaaccagtaatgtgctgttggcaaaagaactcaacattacaccaattggtacgatggcacatgagtttttgcaagcctttcaggcacttgatgtacgtttgcgtgattttcagaaagctgcacttgaaacgtgggtacaagagtatcgtggagatttagggattgcattaacggatgtcgtcggaatggatgcatttctacgcgacttcgatttgtattttgccaagttgtttgatggtttgcgtcatgacagtggtgacccttatgaatggggagataaagcctatgcacattatcgtaaattaaagatagacaccaagaccaagatgctcacgtttagtgatggcttaaatctggaaaaggcatgggaattgcatcaatattttaagggccgttttaaggtgagttttggaattgggactaatctcaccaacgatatggggcaaacgccgctcaatattgtgttgaaactggtagaatgtaatgggcaatctgtggctaaaatttcagatagtccaggcaaaaccatgactgataacgatacctttctggcttatttaagacaggtatttcaaattgctgaagaagagcctgtcgcctaa

SEQ ID NO: 14132 - protein, 407 aa, Acinetobacter sp
MLSMSPIIHSLLDTDLYKFTMLQVVLHQFPQTHSVYHFRCRNLDETQYPLTDILDDLNEQLDHLCTLKFKDDELQYLRSFRFIKSDFVDYLELFQLKRRFITAGIDEEGRLDIWVEGPMVQAMMFEIFVLAIVNELYFRRIRSDAVLEEGERRLQAKLALLEQYQTQHQSDEPPFLVSDFGTRRRYSFEWQKHVIAAFHHHFPNIFRGTSNVLLAKELNITPIGTMAHEFLQAFQALDVRLRDFQKAALETWVQEYRGDLGIALTDVVGMDAFLRDFDLYFAKLFDGLRHDSGDPYEWGDKAYAHYRKLKIDTKTKMLTFSDGLNLEKAWELHQYFKGRFKVSFGIGTNLTNDMGQTPLNIVLKLVECNGQSVAKISDSPGKTMTDNDTFLAYLRQVFQIAEEEPVA

SEQ ID NO: 14133 - DNA, 1218 bp, Bordetella pertussis
  CDS (1)..(1218): transl_table=11
atggtgtgccgaaacgtttcgcggcaacagtttcgcgccatcatgatcatcacatcgctgctcgacacggacctgtacaaattcagcatgatgcaggtcgtgctgcatcattttccggctgcacaggtcgagtaccgctacaagtgccgtactccgggcatcaatctgcggccctatctcgacgaaatacgcgccgaggtgcacgagctgtgccagctgcgcttcaccagcgaggagctggattatctgcgcggcctgcgcttcatcaagagcgatttcgtcgacttcctgggcctgttccatttgcccgagcgttgcatattcatcggcgagggcgagcagcccggcgaaatatccattacggtcaaggggccatggctgcacacgatattgttcgaaataccggtgctggccatcgtcaacgaagtctattttcgtaatacgcgcaggaatcccgattgggaggaaggccgcaagcgcttgcaatcgaagatgaacctggtgctcgacgaccccgcgctggccgatttccgggtcgcggaatacggcacccggcggcgcttctcgaaggtctggcacgaggaaatcgtctcgaccatgaaggcgcgcatgggggtgcatttcgccggcaccagcaacgtgctgctggccatgcggcacggcgtgctgccgctgggcaccatgggccacgagtatctgcaggcctgccaggcgctggggccgcggctgcgcgactcccaggtgttcgcactggaagtctgggccaaggaataccgcggcgatctcggcatcgccctgtcggacgtctatggcatggatgctttcctgcgcgacttcgacatgtacttctgcaaactgttcgacggcgcgcgccacgattcgggcgatccgttcgtgtggggcgagcggctgctcgagcactaccgcaccaatcgcgcggatccgcgcgccaagaccctggtgttctcggattcgctgacatttccgcgcgccatcgagctggcgcgccagttcgccggccgctgcaaggtgtcgttcggcatcggcaccaacctgaccaacgacctgggccacgagcccctgcagatcgtcatgaagatggtgcgctgcaatgggcagccggtcgccaaggtatcggatgcgcccgagaagacgatgtgcgacgatcccgcctatctggcctacctgcgccaggtgttccagcttccgccggcctga

SEQ ID NO: 14134 - protein, 405 aa, Bordetella pertussis
MVCRNVSRQQFRAIMIITSLLDTDLYKFSMMQVVLHHFPAAQVEYRYKCRTPGINLRPYLDEIRAEVHELCQLRFTSEELDYLRGLRFIKSDFVDFLGLFHLPERCIFIGEGEQPGEISITVKGPWLHTILFEIPVLAIVNEVYFRNTRRNPDWEEGRKRLQSKMNLVLDDPALADFRVAEYGTRRRFSKVWHEEIVSTMKARMGVHFAGTSNVLLAMRHGVLPLGTMGHEYLQACQALGPRLRDSQVFALEVWAKEYRGDLGIALSDVYGMDAFLRDFDMYFCKLFDGARHDSGDPFVWGERLLEHYRTNRADPRAKTLVFSDSLTFPRAIELARQFAGRCKVSFGIGTNLTNDLGHEPLQIVMKMVRCNGQPVAKVSDAPEKTMCDDPAYLAYLRQVFQLPPA

SEQ ID NO: 14135 - DNA, 1305 bp, Brucella melitensis
  CDS (1)..(1305): transl_table=11
atggccaaaaccgatcttgcgcggcgcgtctataaccatacctggaagctggatccgatcatccgcagcctgctggatacggatttttacaagctcctgatgctccagatgatctgggggctttatcccagggtggatgccaccttctcgctcatcaaccgcacgagttccgtgcgccttgccgacgagattgatgaaggtgaactgcgcgcgcagcttgaccatgcgcgcacattgcgtttttccaagaaggaaatgatctggcttgccggtaacacgttttatggccgcaagcagatttttcagccggaatttctggcatggctgcatgattgccaactgccggaatatgaactgcgccgcaaggacggccagtatgaactgcatttccacgggccatggacccacacgaccatgtgggaaattccggcgctggccatcatcaacgagcttcgctcgcgcgcggcaatgaaaaatctggggccgttctcgctcgatgtgctctatgcccgggccaaggcgaagatgtggagcaaggtggagcggctgcgccaactgcctgatttgaagatttctgacttcggcacccgccgccgccattccttcctgtggcaacgctggtgcgtggaagccttgaaggaggggatcggcagcgcctttaccggcacgtcaaacgtgctgcttgccatggatacggatctcgaagctctcggcaccaatgcacacgaattgccgatggtgctggccgcacttgcaaaaacggacgacgaattgcgcagcgccccctatcgtgtgttgcaggactggaaccgttattatggcggcaatcttctgatcgtgctgcccgacgccttcggcacggcggcgtttctgcgcaatgcgccggactgggtggctgactggacgggcttccgcccggacagcgccccgccgattgagggcggcgagcgcattatcgaatggtggaaatcgaagggcaaggacccgcgcgaaaagcttttgatcttttccgatgcgctcgatgtggacaccatcgaggagacctatcgccatttcgagggccgtgtgcgcatgggcttcggctggggcaccaacctcaccaatgattttgcgggctgtgcgccgcagagcattgatggcctcaaggccatttctttggtctgcaaggtaacggacgccaatggccatccggcggtcaagctttccgacaatccgcaaaaagcgacaggcgatccgaaggaagtggcgcgctatctcaggttcttcggcaatgaggaacgcgtggagcagctcgtccgcgtctga

SEQ ID NO: 14136 - protein, 434 aa, Brucella melitensis
MAKTDLARRVYNHTWKLDPIIRSLLDTDFYKLLMLQMIWGLYPRVDATFSLINRTSSVRLADEIDEGELRAQLDHARTLRFSKKEMIWLAGNTFYGRKQIFQPEFLAWLHDCQLPEYELRRKDGQYELHFHGPWTHTTMWEIPALAIINELRSRAAMKNLGPFSLDVLYARAKAKMWSKVERLRQLPDLKISDFGTRRRHSFLWQRWCVEALKEGIGSAFTGTSNVLLAMDTDLEALGTNAHELPMVLAALAKTDDELRSAPYRVLQDWNRYYGGNLLIVLPDAFGTAAFLRNAPDWVADWTGFRPDSAPPIEGGERIIEWWKSKGKDPREKLLIFSDALDVDTIEETYRHFEGRVRMGFGWGTNLTNDFAGCAPQSIDGLKAISLVCKVTDANGHPAVKLSDNPQKATGDPKEVARYLRFFGNEERVEQLVRV

SEQ ID NO: 14137 - DNA, 1305 bp, Brucella suis
  CDS (1)..(1305)
atggccaaaaccgatcttgcgcggcgcgtctataaccatacctggaagctggatccgatcatccgcagcctgctggatacggatttttacaagctcctgatgctccagatgatctgggggctttatcccagggtggatgccaccttctcgctcatcaaccgcacgagttccgtgcgccttgccgacgagattgatgaaggtgaactgcgcgcgcagcttgaccatgcgcgcacattgcgtttttccaagaaggaaatgatctggcttgccggtaacacgttttatggccgcaagcagatttttcagccggaatttctggcatggctgcatgatttccaactgccggaatatgaactgcgccgcaaggacggccagtatgaactgcatttccacgggccatggacccacacgaccatgtgggaaattccggcgctggccatcatcaacgagcttcgctcgcgcgcggcaatgaaaaatctggggccgttctcgctcgatgtgctctatgcccgggccaaggcgaagatgtggagcaaggtggagcggctgcgccaactgcctgatttgaagatttctgacttcggcacccgccgccgccattccttcctgtggcaacgctggtgcgtggaagccttgaaggaggggatcggcagcgcctttaccggcacgtcaaacgtgctgcttgccatggatacggatctcgaagctctcggcaccaatgcacacgaattgccgatggtgctggccgcacttgcaaaaacggacgacgaattgcgcagcgccccctatcgtgtgttgcaggactggaaccgttattatggcggcaatcttctgatcgtgctgcccgacgccttcggcacggcggcgtttctgcgcaatgcgccggactgggtggctgactggacgggcttccgcccggacagcgccccgccgattgagggcggcgagcgcattatcgaatggtggaaatcgaagggcaaggacccgcgcgaaaagcttctgatcttttccgatgcgctcgatgtggacaccatcgaggagacctatcgccatttcgagggccgtgtgcgcatgggcttcggctggggcaccaacctcaccaatgattttgcgggctgtgcgccgcagagcattgatggcctcaaggccatttctttggtctgcaaggtaacggacgccaatggccatccggcggtcaagctttccgacaatccgcaaaaagcgacaggcgatccgaaggaagtggcgcgctatctcaggttcttcggcaatgaggaacgcgtggagcagctcgtccgcgtctga

SEQ ID NO: 14138 - protein, 434 aa, Brucella suis
MAKTDLARRVYNHTWKLDPIIRSLLDTDFYKLLMLQMIWGLYPRVDATFSLINRTSSVRLADEIDEGELRAQLDHARTLRFSKKEMIWLAGNTFYGRKQIFQPEFLAWLHDFQLPEYELRRKDGQYELHFHGPWTHTTMWEIPALAIINELRSRAAMKNLGPFSLDVLYARAKAKMWSKVERLRQLPDLKISDFGTRRRHSFLWQRWCVEALKEGIGSAFTGTSNVLLAMDTDLEALGTNAHELPMVLAALAKTDDELRSAPYRVLQDWNRYYGGNLLIVLPDAFGTAAFLRNAPDWVADWTGFRPDSAPPIEGGERIIEWWKSKGKDPREKLLIFSDALDVDTIEETYRHFEGRVRMGFGWGTNLTNDFAGCAPQSIDGLKAISLVCKVTDANGHPAVKLSDNPQKATGDPKEVARYLRFFGNEERVEQLVRV

SEQ ID NO: 14139 - DNA, 1200 bp, Buchnera aphidicola
  CDS (1)..(1200): transl_table=11
atgaaacgatatgattatccaatagtaaaaacactgcttgatactgatgcatataaactgcatatgcaacaagctgttttttatcattataaaaatgtaaatgtagttgctgaatttctttgcagaggagataactttttaggttgctatgcaaatattttattagatcagattagtatgatgagatctttatctttaagtcatgaagaatatgtttatatgacctcttttcccttttttaaaaaagaatatttacattggttaaaaaaatttcgttataatgtttcgcaagtaaagatcaatagctatcaaggtcgattacatattcgtataagtggattatggaaagaagtaatattgtgggaagtacctattttagctttaattagcgaagtttttcatggaaatttttctccagaaattacttctcaatctgctttgcaatatttggatattaaattaaaaaaattctttaatcgtactaaatatatagatttatctcatttaaaaattgtagatttcggaacaagaagaagattttcttatgatgtgcaatattctattgttaaaagattaaaagaaagttttccctttttaattggttctagcaattaccatatagctcgtatattaaaaataaaaccagtaggaacacaagctcatgagtggtttcaagcacatcaacaaattggatcaaatttaaaaaatagtcagattttagcattacaaaaatggttatatcaatacaagaatcatctaggtattgctcttacagattcaatcactatggatgcatttttagatgattttaatttacattttgcttctttttaccaaggtattagacatgattcaggagatcctgtgaaatggggtgaaaaagctcttaaacattatgaaaaattaggtatagatccatgcacaaaaacattattgttttctgacaacttagattttaaaaaaattatatctttatataaaaaatttcataaaaaaattaatgttatttttggaataggtaccaaattaacttgtgatattccttatgtaaaaccgctaaatattgtcattaaattagtagaatgcaatggtaaacctgttgctaaaatatctgatagtccaggaaaaaccttttgtttagatcgaatttttttaaaaaatttatgtcaagtatttaatgtatcattaaaaaatagataa

SEQ ID NO: 14140 - protein, 399 aa, Buchnera aphidicola
MKRYDYPIVKTLLDTDAYKLHMQQAVFYHYKNVNVVAEFLCRGDNFLGCYANILLDQISMMRSLSLSHEEYVYMTSFPFFKKEYLHWLKKFRYNVSQVKINSYQGRLHIRISGLWKEVILWEVPILALISEVFHGNFSPEITSQSALQYLDIKLKKFFNRTKYIDLSHLKIVDFGTRRRFSYDVQYSIVKRLKESFPFLIGSSNYHIARILKIKPVGTQAHEWFQAHQQIGSNLKNSQILALQKWLYQYKNHLGIALTDSITMDAFLDDFNLHFASFYQGIRHDSGDPVKWGEKALKHYEKLGIDPCTKTLLFSDNLDFKKIISLYKKFHKKINVIFGIGTKLTCDIPYVKPLNIVIKLVECNGKPVAKISDSPGKTFCLDRIFLKNLCQVFNVSLKNR

SEQ ID NO: 14141 - DNA, 1197 bp, Buchnera aphidicola
  CDS (1)..(1197): transl_table=11
atgaaacaatataattatccaatagtgaaaacattacttgatactgatgcatataaattttatatgcagcaagctgttttttatcattataaaaatgtcgatgtagttgcagaatttatttgcagaggtcctaatattttaggttgttattctcatattttattagaccaaattaatatgatgtcttccttatctcttagtcatgaagagtatctttatatgactacttttccattttttaaaaaagaatatttacattggttaaaaaaatttcgttataatattacacaagttaaagttgataattatcatggtcaacttcatattcgtataagtggattatggaaagaagtaattttatgggaagtccctattttatcattaattagtgaaatttttcatagacattgttatccagaaattacttcgaatattgcagtacaacatttaaataaaaaattaaaagaattttttaaaaaaaacagagatgtagatttatctcgtttaaaaatagtagattttggaacaagaagacgattttcttatgatgtacaatattcaattatcaaaagattaaaagatacatttccatttttaattggttcaagtaactatcatatatcacgtattttaaaattattgccagtaggtacccaagctcatgaatggtttcaagcacaccaacaaattagttccaatctcagaaatagtcaaacattagcattaaaaacatggttgtctcaatataatcaacatttaagcatcgctcttacagattgtattacaatggattcgtttttacgtgattttaatttatttttttcaaaatcttatcaaggtatcagacatgattcaggagatccagtaaaatggggtgaaaaagctattgaacattatgaacgattaggtattgatcctactactaaaacgttattattttcagataatttaaattttagaaaaatgatatctctttataaaaaatttaataatagagtaaatattatatttggcatcggaacaaaattaacttgtgatattccaaatgttaagccgttaaatatagtaatcaaacttgtcaaatgtaatggtaaaccagttgctaaattatctgatagtcctggtaaaaccttttgtctagatagaaattttattaaatctttatgtaaagcatttgatttgtctttgacagtgtaa

SEQ ID NO: 14142 - protein, 398 aa, Buchnera aphidicola
MKQYNYPIVKTLLDTDAYKFYMQQAVFYHYKNVDVVAEFICRGPNILGCYSHILLDQINMMSSLSLSHEEYLYMTTFPFFKKEYLHWLKKFRYNITQVKVDNYHGQLHIRISGLWKEVILWEVPILSLISEIFHRHCYPEITSNIAVQHLNKKLKEFFKKNRDVDLSRLKIVDFGTRRRFSYDVQYSIIKRLKDTFPFLIGSSNYHISRILKLLPVGTQAHEWFQAHQQISSNLRNSQTLALKTWLSQYNQHLSIALTDCITMDSFLRDFNLFFSKSYQGIRHDSGDPVKWGEKAIEHYERLGIDPTTKTLLFSDNLNFRKMISLYKKFNNRVNIIFGIGTKLTCDIPNVKPLNIVIKLVKCNGKPVAKLSDSPGKTFCLDRNFIKSLCKAFDLSLTV

SEQ ID NO: 14143 - DNA, 1200 bp, Burkholderia mallei
  CDS (1)..(1200): transl_table=11
atgatcatcacttcgctgctcgataccgacctgtacaaattcacgatgatgcaggtcgtcctgcatcatttcccggccgcaagcgtcgaatatcgcttcaagtgccgcacgcccggcgtcgatctcgtgccgtacatcgacgagatccgcgccgaggttcgctcgctctgcgagctgcgcttcaccgattccgagctcgactatctgcgccggctgcgcttcgtcaagagcgatttcgtcgattttctcgcgctctttcacctgaacgagaagtacatctcgatcacgccgtcgcaaaagggcggcggcgagatcgacatcgagatcaaggggccgtggctgcacacgatccttttcgagattccggtactcgcgatcgtcaacgaggtgtacttccgcaacacgcagcgccggccggattaccgcgaagggcgcggccggctgcgcgagaagatcaagctgctcggcgcgaagcccgaattcgccgattgcaagatcgccgattacggcacgcgccgccgcttctcgaaggtctggcacgaggaggtgctgcgcacgctgcaggacgggctcgggccgcagttcgccggcacgagcaacgtctattacgcgatgacgcacgagatcacgccgctcggcacgatggcgcacgaatatctgcaggcgtgccaggcgctcggcccgcggctgcgcgattcgcagacctacggtctcgagatgtgggcgaaggaatatcgcggcgatctcggcatcgcgctgtccgacgtctacgggatggacgcgttcctgcgcgacttcgacatgtacttctgcaagctcttcgacggcgcgcgccacgattcgggcgatccgttcgactggggcgagcggctcatcaagcactacgaggagaaccgctgcgacccgcgcacgaaggtgctcgtgttctccgacgcgctcgatatcccgaaggtcatgcagctgtacgcacgctttcgcggacgctgcaagctcgcgttcggcgtcggcacgaacctcaccaacgatctcggctatcagccgttgcagatcgtcatcaagatggtgcgatgcaacgggcagccggtcgcgaagctgtcggattcgccgggcaagagcatgtgcgacgacaaggcctacctcgcgtatctgcgccaggtgttcgggatcacgcagccgcccgacgacgacgcgggcaagtaa

SEQ ID NO: 14144 - protein, 399 aa, Burkholderia mallei
MIITSLLDTDLYKFTMMQVVLHHFPAASVEYRFKCRTPGVDLVPYIDEIRAEVRSLCELRFTDSELDYLRRLRFVKSDFVDFLALFHLNEKYISITPSQKGGGEIDIEIKGPWLHTILFEIPVLAIVNEVYFRNTQRRPDYREGRGRLREKIKLLGAKPEFADCKIADYGTRRRFSKVWHEEVLRTLQDGLGPQFAGTSNVYYAMTHEITPLGTMAHEYLQACQALGPRLRDSQTYGLEMWAKEYRGDLGIALSDVYGMDAFLRDFDMYFCKLFDGARHDSGDPFDWGERLIKHYEENRCDPRTKVLVFSDALDIPKVMQLYARFRGRCKLAFGVGTNLTNDLGYQPLQIVIKMVRCNGQPVAKLSDSPGKSMCDDKAYLAYLRQVFGITQPPDDDAGK

SEQ ID NO: 14145 - DNA, 1209 bp, Chromobacterium violaceum
  CDS (1)..(1209): transl_table=11
atgcccaagaacacgcccatcatccggtcgctgctggataccgatctgtacaagttcaccatgctgcaggtggtgttgcaccaattccccgcagcccatggcgaatacgaattccgctgccgcaaccatccggacacgccgctgacccagctgaagcagcaactggaaacgcagctggacctgctgtgcgagctgcgcttcagccaggacgagctggattatctgcgcggcctgcgcttcatcaagagcgactacgtcgactacctggagctgttccacctgcagcgccgcttcatcagcgtcagcgaggaaggcgaacagctggccatccggatcaagggcccgatggtgcaggcgatgttcttcgagattttcgtgctggccatcgtcaacgagctgtatttccgccctctggacagcaaggccgtgcgcgaggaaggccgccgccggctggaagccaagctggcggagttggagcgcttccagcgcgaagaggcccccggccagcgctttccgctgctgatcgccgacttcggcacccgccgccgcttcagccgcgactggcaggcccacgtggtggagaggctgaaccacgcgctgccgcaggtgttccgcggcaccagcaacgtctacctagcccgcaagctgggcatcacgcctatcggcaccatggcccacgaattcttccaggccttccaggcgctgggcgtgcggctgcgggatttccagaaagcggcgctggaatcgtgggtgcaggaataccgcggcgacctgggcatcgcgctgaccgacgtggtcggcatggatgcctttctggccgatttcgatctctatttcgccaagctgttcgacggcctgcgccacgacagcggcgatccctacatctggggcgagaaggcgatcgcccattatcgcaagctgcggatagaccccgcgaccaagatgctgaccttcagcgacggcctcagcgtggacagcgcgctgcaactgcagcgccatttcagcccgcacatccaggtcagcttcggcatcggcacccacttcaccaacgacatggggctggagccgctgcagatcgtgctcaagctggtcagctgcaacggccagccggtagccaaactgtccgacagccccggcaaaaccatgtgcagcgacgaaactttcctggcctacctgcgccaggtattcaaggtccccgccctcgcctga

SEQ ID NO: 14146 - protein, 402 aa, Chromobacterium violaceum
MPKNTPIIRSLLDTDLYKFTMLQVVLHQFPAAHGEYEFRCRNHPDTPLTQLKQQLETQLDLLCELRFSQDELDYLRGLRFIKSDYVDYLELFHLQRRFISVSEEGEQLAIRIKGPMVQAMFFEIFVLAIVNELYFRPLDSKAVREEGRRRLEAKLAELERFQREEAPGQRFPLLIADFGTRRRFSRDWQAHVVERLNHALPQVFRGTSNVYLARKLGITPIGTMAHEFFQAFQALGVRLRDFQKAALESWVQEYRGDLGIALTDVVGMDAFLADFDLYFAKLFDGLRHDSGDPYIWGEKAIAHYRKLRIDPATKMLTFSDGLSVDSALQLQRHFSPHIQVSFGIGTHFTNDMGLEPLQIVLKLVSCNGQPVAKLSDSPGKTMCSDETFLAYLRQVFKVPALA

SEQ ID NO: 14147 - DNA, 1206 bp, Erwinia carotovora
  CDS (1)..(1206): transl_table=11
atgactttgcacacttccccgattctacactcattgctggataccgatgcctacaagctgcacatgcaacaggcagtgtatcatcactactatgatgtcgacgttgcggctgagtttcgctgtcgcggtgatgagttattaggcgtttacgccgacgagatagcccatcaggttgatctgatgcgtttcctgtcattgagtgacgatgaattcacctatctttcttctctgccgttctttcagcaggattatctcaactggctgcggaacttccgttttaatccacagcaggtttcgattaagaataatgctggcaagctggatatccgcatcaccgggccgtggcgtgaagtgatcttgtgggaagttcctctgcttgcggtgatcagcgaagtcgtgcatcggcatcgttcgcccaacgtcacgacagagcaggccgtcgctcagctttctacctcgttagaaagtttccgccagaacagcatgaatgttgatctcagtcagttcaaactgatggatttcggcacgcgtcgccgcttctcaggtgatatccagcaaaccatcgtgacggcactgcaagccgattttccttatctcatcggcaccagcaattacgatctggcgcgccgtttgggcatcacacctgtcggcacgcaggcgcacgagtggtttcaggcgcatcagcagattagtccgacgctggcaaacagccagcgtgccgcactacaaatgtggttacgtgaatatcccacgcatttgggcatcgcgttgaccgattgcatcaccatggatgccttcctgcgtgatttcgatttaccgttcgccgaggcctatcaggggctacgccacgattctggcgatcctgttgactggggagagaaagccattgctcattatcaacgcttgaacatcgatccgatgagcaaaacactggtcttctccgacaatctgaatctggataaagcgctggtgctttatcgtcacttctgccagcgcgtgaatttggtatttggcatgggtacacgcctgacgtgtgacattcccggcgtgaaaccgctgaatatcgtgatcaagctggtagaatgtaacggcaaaccggtagcgaaactctccgatagcccgggtaaaaccatctgtcaggatcagaacttcgtgtgcgagttacgcaaagcgtttgacttaccccgcgtgaaaaaggccagttaa

SEQ ID NO: 14148 - protein, 401 aa, Erwinia carotovora
MTLHTSPILHSLLDTDAYKLHMQQAVYHHYYDVDVAAEFRCRGDELLGVYADEIAHQVDLMRFLSLSDDEFTYLSSLPFFQQDYLNWLRNFRFNPQQVSIKNNAGKLDIRITGPWREVILWEVPLLAVISEVVHRHRSPNVTTEQAVAQLSTSLESFRQNSMNVDLSQFKLMDFGTRRRFSGDIQQTIVTALQADFPYLIGTSNYDLARRLGITPVGTQAHEWFQAHQQISPTLANSQRAALQMWLREYPTHLGIALTDCITMDAFLRDFDLPFAEAYQGLRHDSGDPVDWGEKAIAHYQRLNIDPMSKTLVFSDNLNLDKALVLYRHFCQRVNLVFGMGTRLTCDIPGVKPLNIVIKLVECNGKPVAKLSDSPGKTICQDQNFVCELRKAFDLPRVKKAS

SEQ ID NO: 14149 - DNA, 1215 bp, Methanosarcina acetivorans
  CDS (1)..(1215): transl_table=11
gtgataaaatcgatacttgataacgacctttataaattcaccatgcaaatggctgtactggaattatttccaaaagcagaggcagaatatcgttttaccaatcgtggatcccatcacttttccgaagagttcgtagaaaagctcaggagagtcatagacgaagatatctccgccctgatgctgacagaagacgaataccagtggcttggtgaaaactgctcttttttaaaaccgatgtaccttgaatacctcaaaaatttccgcttcaaacccggggaagtagaagtctgcctcaccgaagaaaaagaactggacatccgaataaaagggccctggcatagcacgattctctgggagattgttcttatggctgcggtctccgaactctacttcacgactatagaaaaggaatggaacggaaaggaatgggacggaaacatctccgcgacatccgaatccatccttacagcctatggagaaaaaatcctggaaatcggaaagatccttgaggaaaacggttgcctttttgccgagttcgggacccgcaggcgaagaagctttgaactccacgaccaggtgatgaaaacccttctgcagatagaaaccctcacagggaccagcaatgtcttttttgcaaaaaagtatggtttaaaacctataggtacggtaggccacgagtggattatgggcacttctgcgcttatagggctcaggtatgctaaccgcttcgctttcgaaaactgggtggaggtctacaaaggagaccttgggattgcccttacggataccttcggctctgaggccttttttaaggatatggatctgaaactgtcaaaaatctacgacgggttcagacacgacagtggagaccctttcacctttgtggacagggtgatagatcattacaggaaaatgggcatcgacccgatgaaaaaggtaatagttttcagcgatgccctcaacgccgaagccgcaatccggctcaaaaaatactgccaggacaaaatcaactgcagtttcgggataggtacaagccttaccaacaattcggaatttttccgggaaagtcctcccctgaatatggtgattaaactccacagtgttaacggcattccggtagtgaaattaagcgactctcccgaaaaagagacaggagaaagggacgccctgagggttgcaaactatatcgtcggaagaaaagggctggatgaatga

SEQ ID NO: 14150 - protein, 404 aa, Methanosarcina acetivorans
MIKSILDNDLYKFTMQMAVLELFPKAEAEYRFTNRGSHHFSEEFVEKLRRVIDEDISALMLTEDEYQWLGENCSFLKPMYLEYLKNFRFKPGEVEVCLTEEKELDIRIKGPWHSTILWEIVLMAAVSELYFTTIEKEWNGKEWDGNISATSESILTAYGEKILEIGKILEENGCLFAEFGTRRRRSFELHDQVMKTLLQIETLTGTSNVFFAKKYGLKPIGTVGHEWIMGTSALIGLRYANRFAFENWVEVYKGDLGIALTDTFGSEAFFKDMDLKLSKIYDGFRHDSGDPFTFVDRVIDHYRKMGIDPMKKVIVFSDALNAEAAIRLKKYCQDKINCSFGIGTSLTNNSEFFRESPPLNMVIKLHSVNGIPVVKLSDSPEKETGERDALRVANYIVGRKGLDE

SEQ ID NO: 14151 - DNA, 1209 bp, Neisseria gonorrhoeae
  CDS (1)..(1209)
atgaccggcatcatacattcgctgctcgacactgacctctacaaattcactatgctgcaagtagtcctgcaccagtttccgcagacgcacagcctttacgaattccgctgccgcaacgtctcgaccgtctatccgcttgccgacatcagggaagacttggaagccgaactcgacgcgctctgccggctgcgcttcacccacgacgaactcggctatctgcgctccctgcgtttcatcaaaagcgactttgtcgattatctcgaactcttccagctccaacgccgctttgtcgaagtcggcacagacgataaaggccgtctgaacatccgtatcgaaggcccgatgatacaggcgatgttttttgaaatcttcatcctcgccattgtcaacgaactttacttccgccggctggaaacccctgccgttatcgaagaaggcgaacgccggcttcaagccaaagccgcgcgcctgaaagaaatcgccgccgcacagaatccggacgaaccgcccttcctgatttccgacttcggcacgcgccgccgctacaagctcgcgtggcaggaacacgtcatccgcaccctgctcgaagccgccccaagcatcgtgcgcggcacaagcaacgtttacctcgccaaaaaactcggcatcacccccatcggcaccatggcgcacgaattcctccaagccttccaagccctcgacgtgcgcctgcggaatttccaaaaggccgcgctcgaaagctgggtgcacgaataccggggcgatttgggcgttgccctgaccgacgtggtcggtatggatgccttcctgcgcgatttcgacctctatttcgccaaactctttgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaaggccgcttcaaaaccggcttcggcatcggcaccaacctcaccaacgatatggggcatacgcccttgaatatcgtgttgaaactggtcgaatgcaacgggcagtccgtcgccaagctctccgactcgccgggcaaaaccatgaccaacaacagcaccttcctcgcctacctgcgccaagtgttcggcatacccgaacctagaacgccgtaa

SEQ ID NO: 14152 - protein, 402 aa, Neisseria gonorrhoeae
MTGIIHSLLDTDLYKFTMLQVVLHQFPQTHSLYEFRCRNVSTVYPLADIREDLEAELDALCRLRFTHDELGYLRSLRFIKSDFVDYLELFQLQRRFVEVGTDDKGRLNIRIEGPMIQAMFFEIFILAIVNELYFRRLETPAVIEEGERRLQAKAARLKEIAAAQNPDEPPFLISDFGTRRRYKLAWQEHVIRTLLEAAPSIVRGTSNVYLAKKLGITPIGTMAHEFLQAFQALDVRLRNFQKAALESWVHEYRGDLGVALTDVVGMDAFLRDFDLYFAKLFDGLRHDSGDPYVWGDKAYAHYQKLKIDSRTKMLTFSDGLDIERSWALHQYFKGRFKTGFGIGTNLTNDMGHTPLNIVLKLVECNGQSVAKLSDSPGKTMTNNSTFLAYLRQVFGIPEPRTP

SEQ ID NO: 14153 - DNA, 1209 bp, Neisseria meningitidis
  CDS (1)..(1209)
atgaccggcatcatacattcgttgcttgacaccgacctctacaaattcactatgctgcaagtagtcctgcaccagtttccgcagacgcacagcctttacgaattccgatgccgcaacgcctcgaccgtctatccgcttgccgacatcaaagaagacttggaagtcgaactcgacgcgctctgccaactacgcttcacccacgacgaactcgactatctgcgcagcctgcgtttcatcaaaagcgactttgtcgattatctcgaactcttccagctccaacgccgctttgtcgaagtcggcacagacgataaaggccgtctgaacatccgcatcgaaggtccgatgatacaggcgatgttttttgaaatcttcatcctcgccattgtcaacgaactttacttccgccggctggaaacccctgccgttatcgaagaaggtgaacgccggcttcaagccaaagccgcgcgcctgaaagaaatcgccgccgcacaaaaccccgacgaaccgcccttcctgatttccgacttcggcacgcgccgccgctacaagctcgcgtggcaggaacacgtcatccgcaccctgctcgaagccgccccaagcatcgtgcgcggcaccagcaatgtctttctcgccaaaaaactcggcatcacgcccatcggcaccatggcgcacgaattcctccaagccttccaagccctcgacgtgcgcctgcgtaatttccaaaaggccgcgctcgaaagttgggtacacgaataccggggcgatttgggcgttgccctgaccgacgtggtcggtatggatgccttcctgcgcgatttcgacctctatttcgccaaactctttgacgggctgcgccacgacagcggcgacccttacatttggggcgacaaagcctacgcccactatcaaaagctcaaaatcgacagccgcaccaaaatgctgaccttctccgacgggctggacatcgaacgctcttgggcattacaccaatatttcaaagaccgcttcaaaaccggcttcggcatcggcaccaacctcaccaacgatatggggcatacacccttaaatattgtgttgaaactggtcgaatgcaacgggcagtccgtcgccaagctgtccgactctccgggcaaaaccatgaccaacaacagcaccttcctcgcctacctgcgccaagtgttcgacgtacccgaacccgaaacgccgtaa

SEQ ID NO: 14154 - protein, 402 aa, Neisseria meningitidis
MTGIIHSLLDTDLYKFTMLQVVLHQFPQTHSLYEFRCRNASTVYPLADIKEDLEVELDALCQLRFTHDELDYLRSLRFIKSDFVDYLELFQLQRRFVEVGTDDKGRLNIRIEGPMIQAMFFEIFILAIVNELYFRRLETPAVIEEGERRLQAKAARLKEIAAAQNPDEPPFLISDFGTRRRYKLAWQEHVIRTLLEAAPSIVRGTSNVFLAKKLGITPIGTMAHEFLQAFQALDVRLRNFQKAALESWVHEYRGDLGVALTDVVGMDAFLRDFDLYFAKLFDGLRHDSGDPYIWGDKAYAHYQKLKIDSRTKMLTFSDGLDIERSWALHQYFKDRFKTGFGIGTNLTNDMGHTPLNIVLKLVECNGQSVAKLSDSPGKTMTNNSTFLAYLRQVFDVPEPETP

SEQ ID NO: 14155 - DNA, 1209 bp, Neisseria meningitidis
  CDS (1)..(1209): transl_table=11
atgaccggcatcatacattcgctgcttgacaccgacctctacaaattcactatgctgcaagtggttctgcaccagtttccgcagacgcacagcctttacgaattccgctgccgcaacgcctcgaccgtctatccgcttgccgacatcagggaagacttggaagccgaactcgacgcgctctgccaactacgcttcacccacgacgaactcggctatctgcgctccctgcgtttcattaaaagcgactttgtcgattatctcgaactcttccagctccaacgccgctttgtcgaaatcggcacagacgataaagaccgtctgaacatccgcatcgaaggtccgatgatacaggcgatgttttttgaaatcttcatcctcgccattgtcaacgaactttacttccgccgcctggaaacccctgcagtcatagaagaaggcgaacgccggcttcaagccaaagccgcgcgcctcaaagaaatcgccgccgcacaaaaccccgacgaaccgcccttcctgatttccgacttcggcacgcgccgccgctacaagctcgcgtggcaggaacacgtcatccgcaccctgcttgaagccgcccccggcatcgtacgcggcaccagcaatgtctttctcgccaaaaaactcggcatcacccccatcggcaccatggcgcacgagttcctgcaggcattccaggccctcgacgtacgcctgcggaatttccaaaaggccgcgctcgaaagctgggtgcacgaataccggggcgatttgggcgttgccctgaccgacgtggtcggtatggatgccttcctgcgcgatttcgacctctatttcgccaaacttttcgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaagaccgcttcaaaaccggcttcggcatcggcaccaacctcaccaacgatatggggcatacgcccttgaatatcgtcttgaaactggtcgaatgcaacgggcagtccgtcgccaagctgtccgactctccgggcaaaaccatgaccaacaacagcaccttcctcgcctacctgcgccaagtgttcgacgtacccgaacccgaaacgccgtaa

SEQ ID NO: 14156 - protein, 402 aa, Neisseria meningitidis
MTGIIHSLLDTDLYKFTMLQVVLHQFPQTHSLYEFRCRNASTVYPLADIREDLEAELDALCQLRFTHDELGYLRSLRFIKSDFVDYLELFQLQRRFVEIGTDDKDRLNIRIEGPMIQAMFFEIFILAIVNELYFRRLETPAVIEEGERRLQAKAARLKEIAAAQNPDEPPFLISDFGTRRRYKLAWQEHVIRTLLEAAPGIVRGTSNVFLAKKLGITPIGTMAHEFLQAFQALDVRLRNFQKAALESWVHEYRGDLGVALTDVVGMDAFLRDFDLYFAKLFDGLRHDSGDPYVWGDKAYAHYQKLKIDSRTKMLTFSDGLDIERSWALHQYFKDRFKTGFGIGTNLTNDMGHTPLNIVLKLVECNGQSVAKLSDSPGKTMTNNSTFLAYLRQVFDVPEPETP

SEQ ID NO: 14157 - DNA, 1215 bp, Photorhabdus luminescens
  CDS (1)..(1215): transl_table=11
atgacactagacgctaccccaattattaaatcactgcttgatactgacgcttataaacttcatatgcaacaagcagtgtaccaccgctacagccacatgcctgttgttgcagagtttcgctgccgcggcgacgaactgctaggtgaatatgccacagaattacgtcatcaagttaatatgatggctgatctggcattaaccgatgctgaatttaattacctttccagcctgccttttttcaaggctgattatctggactggttaaaaacctttcgttttaacccacagcaagtcaatatttctgttacaaatggcggccaattagctatccatatttcaggattatggtatgaagtgattatgtgggaagtcccattactggcgttaatcagtgaattaattcatcgtcatcactcaccagataatacggtggaaaatgccgtcaaccagctacgcaagttgatcaaactgttctatcaacatgctgaaaatgaaggaatcgatctctccagttttaaactgatggatttcggtacacgccgtcgtttctcacaccgtgttcaacacgctgtcgtcagtgagctgcaacagcatttcccttatctgattggcactagtaattaccaacttgcacaacagcttgggctccctcctgttggaacacaagcgcatgagtggtttcaagctcatcagcaaatcagcccggatctggctagcagtcaacgagaagcattacagagttggctgaaagaatatcctaaccaattaggtattgccttgactgactgcattacaatggacgcgtttctgcgggactttgatgcccagtttgccaaaaattatcaaggcttacgccatgattcgggtgatcccgttcaatggggtgaaaaagcgatcgcccactatcaaaaactgggtatcgacccaatgacaaagaccttagtgttctctgacagcttggactttcaaaaagcactagcgctctatcgtcatttccacaacagaataaacctgattttcggtatcggtacacagctcacctgcaatatcccaggggttaagccactgaacatcgtcatcaaacttgtcgagtgtaatggcaaaccggtcgcaaagctttcagacagccctggcaaaaccatttgtgaagataacgagtttgttaacaggctacgcgccgcttttgatataccccaggttaaacaagcttgttaa

SEQ ID NO: 14158 - protein, 404 aa, Photorhabdus luminescens
MTLDATPIIKSLLDTDAYKLHMQQAVYHRYSHMPVVAEFRCRGDELLGEYATELRHQVNMMADLALTDAEFNYLSSLPFFKADYLDWLKTFRFNPQQVNISVTNGGQLAIHISGLWYEVIMWEVPLLALISELIHRHHSPDNTVENAVNQLRKLIKLFYQHAENEGIDLSSFKLMDFGTRRRFSHRVQHAVVSELQQHFPYLIGTSNYQLAQQLGLPPVGTQAHEWFQAHQQISPDLASSQREALQSWLKEYPNQLGIALTDCITMDAFLRDFDAQFAKNYQGLRHDSGDPVQWGEKAIAHYQKLGIDPMTKTLVFSDSLDFQKALALYRHFHNRINLIFGIGTQLTCNIPGVKPLNIVIKLVECNGKPVAKLSDSPGKTICEDNEFVNRLRAAFDIPQVKQAC

SEQ ID NO: 14159 - DNA, 1218 bp, Photobacterium profundum
  CDS (1)..(1218): transl_table=11
atgaatcacacaaaactcattgggattattgactccctacttgataccgatgcgtataagctgcacatgcagcaagcgatttatcatcaatatccacacgtagaagccgttgctgaatttcattgccgaagcaaagaagacctccgtccctacgccaaggcaattcaagcacaaattcaacacatctcaacattgtcatttgcacaagaagagttagattaccttgcatcactctctttcttcaagaaagactaccttacttatttaaaagacttttcactcaacagtgaacaagtaacggtagatggttcaggcgatcagctttcaatcaagattaagggtaagtggattgatatcattttatgggaagtcccattacttgctatcatttgcgaaatacgttcatccatttgttacccacactccaccgcagatgacgcaattgcacagcttaaaactaagatcgaacgtttttacctaaatgctaaaacggtagatagtgcaacacaaacagccacggatttaagtcaatttgatctaattgattttggtagccgtcgacgtttctctaaagatgtgcaccacaaagttgtcgattatttagcggcaaacgtacctgagtttaaaggaacatcaaactaccatttggctcgaacacgaaatttaaccccctttggtacacaagcacatgaatggtttcaagctcaccaacaattaaccggtgaacttgccgattcacaacagttagcattaaaccgatggctacaagagtacccagattcgttaggtattgccctaaccgattgcattaataccgacgcgtttttacgtgattttaactcagagttatctgaacgtttcgtcgggttacgccacgatagcggcgacccaatcacttggggtgaaaaagccattaagcattatgaatctttggacattgatttaaggacaaaatctttaatcttttcagatagcttaacattggataaagcattaaacatttacaaacactttgcttcacgtattaacgtcagctttgggattggcactcaattaacgtgtgatttaccgggtgttgaaacattaaatgttgtgctaaaactaacgcaatgtgaaggtcgaccagtggctaaaatctctgatgaaccaggcaaaatcatgtgcagagatgaagattatttaacgcagcttcgccaagcatttaaaattgcgaactaa

SEQ ID NO: 14160 - protein, 405 aa, Photobacterium profundum
MNHTKLIGIIDSLLDTDAYKLHMQQAIYHQYPHVEAVAEFHCRSKEDLRPYAKAIQAQIQHISTLSFAQEELDYLASLSFFKKDYLTYLKDFSLNSEQVTVDGSGDQLSIKIKGKWIDIILWEVPLLAIICEIRSSICYPHSTADDAIAQLKTKIERFYLNAKTVDSATQTATDLSQFDLIDFGSRRRFSKDVHHKVVDYLAANVPEFKGTSNYHLARTRNLTPFGTQAHEWFQAHQQLTGELADSQQLALNRWLQEYPDSLGIALTDCINTDAFLRDFNSELSERFVGLRHDSGDPITWGEKAIKHYESLDIDLRTKSLIFSDSLTLDKALNIYKHFASRINVSFGIGTQLTCDLPGVETLNVVLKLTQCEGRPVAKISDEPGKIMCRDEDYLTQLRQAFKIAN

SEQ ID NO: 14161 - DNA, 1170 bp, Ralstonia solanacearum
  CDS (1)..(1170)
atgatcatccgctcgctgctcgacaccgatctgtacaagttcaccatgatgcaggtggtgttgcatcactttcccggtgcgcacgtcgaataccgcttcaagtgccgcaacccgggcgtcgacctggtgccgtacatcgaggcgatccgcgcggagatccgccacctgtgctcgctgcgcttcaccgaggcggaactggactacctgcgcgggctgcgcttcatcaagagcgatttcgtcgattttctcgacctgttccatctcagcgagaagtacatcgatatccgcccggcggcctccaacgacggccagatcgacatcgtcatcagcgggccgtggctgcacaccatcatgttcgaggtgccggtgctggccatcgtcaacgaggtgtacttcagccgcacccaggcccacccgcagtgggacgagggcaagcgccgcctgaccgagaagctcgcctcgctcacgcgcccgggcctggaggactgccgcatcgccgattacggcacgcgccgccgcttctcccacacctggcacgagcacgtgctgatggaggcgcgcagccagcttggcagccagtacgccggcaccagcaacgtctacttcgccatgaagcacaacatgacgccgctgggcaccatggcgcacgagtacctgcaggcgtgccagtcgctgggcccgcgcctgcgcgattcacaggtcttcgcgctggagacctgggcccgggaataccgtggcgacctgggcatcgcgttgtccgacacctacggattcgacgccttcctgcgcgacttcgacatgtttttctgcaagctcttcgatggcgtgcggcacgattccggtgatccgttcgagtggggcgagcgcatgctcaagcactacgagggcatgcgcgtcgacccgcaatccaaggcgctgatcttctccgacagcctggacatgcccaaggtggtgcgcctgtacgagcgcttccgcagccgctgcaagctggccttcggcgtcggcaccaacctgaccaacgacctcggctacacgccgctgcagatcgtcatcaagatggtccgctgcaacggccagccggtcgccaagctgtcggatgcgcccgagaagaccatgtgcgacgacccggcctacctggcctacctgaagcaggtgttcggcgtgcaatga

SEQ ID NO: 14162 - protein, 389 aa, Ralstonia solanacearum
MIIRSLLDTDLYKFTMMQVVLHHFPGAHVEYRFKCRNPGVDLVPYIEAIRAEIRHLCSLRFTEAELDYLRGLRFIKSDFVDFLDLFHLSEKYIDIRPAASNDGQIDIVISGPWLHTIMFEVPVLAIVNEVYFSRTQAHPQWDEGKRRLTEKLASLTRPGLEDCRIADYGTRRRFSHTWHEHVLMEARSQLGSQYAGTSNVYFAMKHNMTPLGTMAHEYLQACQSLGPRLRDSQVFALETWAREYRGDLGIALSDTYGFDAFLRDFDMFFCKLFDGVRHDSGDPFEWGERMLKHYEGMRVDPQSKALIFSDSLDMPKVVRLYERFRSRCKLAFGVGTNLTNDLGYTPLQIVIKMVRCNGQPVAKLSDAPEKTMCDDPAYLAYLKQVFGVQ

SEQ ID NO: 14163 - DNA, 1305 bp, Rhizobium loti
  CDS (1)..(1305): transl_table=11
atggcaagaaccgatatagcgcggcgtgtctacaaccacacctggaagctcgacccgatcgtgcgcagcctgctcgacacggacttctacaagcttttgatgctgcagatgatctggggcatgtacccaaaggtcgatgccaccttctcgctgatcaaccgcaccacctcggtgcggcttgccgacgagattgacgagggcgaactgcgcgagcagctcgatcatgcccgcaccttgcgcttctccaagaaggagatgatctggctcggcggcaacaatttctatggccgcaagcagatcttcgaaccggaattcctggcctggctggaaggtttccggctgccggactacgagctgtccaagcgtgacggccagtatgagctctccttcagcggcccgtggatgtacaccacgctgtgggaaatcccggcgctcgccatcatcaacgaactgcgctcccgggccgccatgcgggccttcggccccttcgcgctcgatgtgctctatgcccgcgccaaggccaagatgtgggccaagaccgagcggctgaaggcgctgccgggcatccgcatttccgatttcggcacgcgccgccggcattccttcctgtggcagcgctggtgcgtcgaagcgctgaaggaaggcataggcgaggcgttcaccggcacctccaacgtgctgcttgcgatggacaacgacctcgaagcgctcggcaccaatgcgcatgagctgccgatggtgtttgcagcccttgccaattcggagaaggagctgaaacaggctccctacaaggtgctgcaggactggcagcgctactatggcggcaacctcctgatcgtgctgcccgacgcttttggcaccgcctccttcctgcgcgacgcgccggactgggtggccgactggaccggatttcgccccgacagcgcgccgccgatcgagggcggcgaaaagatcctgtcctggtggcgcgagaggggcaaggacccgaagcaaaagctgctgatcttctccgacggtctcgaagtggaaaccatcgaggagacctaccgccacttcaagggcaaggtgcgcatgtccttcggctggggcaccaatctcaccaatgatttcgagggctgcgcgccgaccgaaaccaacagcctcgacgccatatcgctggtctgcaaggtgacggaagccaatggcaggccggcggtgaagctgtccgacaatcccgccaaggcgacgggggacgagaaggaaatcgagcggtatctcaggattttcggcgagaaggaccgggtggagcaactggtcaaggtgtga

SEQ ID NO: 14164 - protein, 434 aa, Rhizobium loti
MARTDIARRVYNHTWKLDPIVRSLLDTDFYKLLMLQMIWGMYPKVDATFSLINRTTSVRLADEIDEGELREQLDHARTLRFSKKEMIWLGGNNFYGRKQIFEPEFLAWLEGFRLPDYELSKRDGQYELSFSGPWMYTTLWEIPALAIINELRSRAAMRAFGPFALDVLYARAKAKMWAKTERLKALPGIRISDFGTRRRHSFLWQRWCVEALKEGIGEAFTGTSNVLLAMDNDLEALGTNAHELPMVFAALANSEKELKQAPYKVLQDWQRYYGGNLLIVLPDAFGTASFLRDAPDWVADWTGFRPDSAPPIEGGEKILSWWRERGKDPKQKLLIFSDGLEVETIEETYRHFKGKVRMSFGWGTNLTNDFEGCAPTETNSLDAISLVCKVTEANGRPAVKLSDNPAKATGDEKEIERYLRIFGEKDRVEQLVKV

SEQ ID NO: 14165 - DNA, 1305 bp, Rhizobium meliloti
  CDS (1)..(1305): transl_table=11
atgccaaagaccgatatcgcgcgacgggtctataaccatacctggaagctcgatccgatcgtccgcagcctgctcgatacggatttctacaagcttttgatgctgcagatgatctggcagctctatccggacgtggacgcgaccttttcgctgatcaaccgcacgaagacggtgcgccttgccgacgagatcgacgaacaggaactgcgcgaccagctcgaccacgcgcgaggcctgcgcttcaccaagaaagaaatgatatggcttgcgggtaacagcttctatggccgcacgcagatcttttcgccggaatttctcgcctggctcgcaagattccgccttccggaatacgagctgtcgcgtcgtgacggccaattcgaactgacctttcgtggccgctgggccgagacgacgatgtgggaaatccctgcgctcgcgatcatcaacgagttgcgctcgcgcgcggcgatgaaagggctcggcccattcacgctggacgtcctctatgcccgcgccaaggccaagatgtggtcgaaggtcgagcagttgcgggagcatccgaacctgcgcatttccgacttcggtacgcgccggcggcacagcttcctatggcagcgctggtgcgtcgaggcgctgaaggaaggcatcggctcgtccttcacaggctcgagcaacgtgctgctggcaatggacaatgatctggaggcggtcggcaccaatgcgcacgagctgccgatggtggctgcggcgcttacccgcaacgaccgcgagcttgcggccgcgccctacaaggttctgcaggactggaaccagctctatggcggcaacctcctgatcgtgctcccggacgcgttcgggacggccgcgttcctcagggatgcacccgactgggtggcggactggaccggcttccggccggacagtgccccgcccatcgagggaggcgagaagatcatcgcctggtggaagaagatgggccgagacccgcgggagaagcttctgatcttctccgacggcctcgacgtcgacacgatcatcaggacctactgccatttcgaagggcgcgtgcgcatgagcttcggctggggaacgaacctgacgaatgatttcgccggctgcgccccgaccgaaatcaacggcctcaacccgatctccatcgtatgcaaggtcagcgaggcaaatggccgtccggccgtcaagctctcggacaacccgcgcaaggcgacgggggatccagccgaggtcgagcgctatctgaaatttttcggcagcgaggatttcgtggagcaatccgtacgggtgtga

SEQ ID NO: 14166 - protein, 434 aa, Rhizobium meliloti
MPKTDIARRVYNHTWKLDPIVRSLLDTDFYKLLMLQMIWQLYPDVDATFSLINRTKTVRLADEIDEQELRDQLDHARGLRFTKKEMIWLAGNSFYGRTQIFSPEFLAWLARFRLPEYELSRRDGQFELTFRGRWAETTMWEIPALAIINELRSRAAMKGLGPFTLDVLYARAKAKMWSKVEQLREHPNLRISDFGTRRRHSFLWQRWCVEALKEGIGSSFTGSSNVLLAMDNDLEAVGTNAHELPMVAAALTRNDRELAAAPYKVLQDWNQLYGGNLLIVLPDAFGTAAFLRDAPDWVADWTGFRPDSAPPIEGGEKIIAWWKKMGRDPREKLLIFSDGLDVDTIIRTYCHFEGRVRMSFGWGTNLTNDFAGCAPTEINGLNPISIVCKVSEANGRPAVKLSDNPRKATGDPAEVERYLKFFGSEDFVEQSVRV

SEQ ID NO: 14167 - DNA, 1203 bp, Salmonella choleraesuis
  CDS (1)..(1203)
atgacacaattcgcttctcctgttctgcactcgttgctggatacagatgcttataagttgcatatgcagcaagccgtttttcaccactactatgatgtgcaggtagcggctgagtttcgttgccgtgacgacgacctgctgggtatttatgccgatgctattcgcgagcaggtggacgcgatgcagcacctgcgcctccaggaggacgagttccagtggctctccggcctgcccttttttaaaccggattatctgaactggttacgcgagtttcgctataacccggctcaagtctgtgtcaccaacgataacggcaagctgaatattcgcttaaccggcccgtggcgtgaagtcattatgtgggaagtgccgctgctggccgtgatcagtgagctggttcatcactaccgctcgccaaacgcgggcgttgatcaggcgctcgacgcgctggaaagtaagctggttgatttcactgcgttaaccgccaatctcgatatgtcccgcttccacctgatggacttcggcacccgccgccgtttctctcgtgaagtgcagcaggcgatagttaaacgtctccagcaggagtcatggttcgtcggcaccagcaactatgatctcgcgcgtcgcctggcgctgacgccgatgggcactcaggcgcacgaatggttccaggcgcatcaacaaatcagtccggacctggcgaccagccagcgtgccgcgttggccgcctggcttaacgaatatccggaccagcttggtatcgcattgacagattgcattacaatggatgcgtttttacgcgatttcggcattgaattcgccagccgttatcaggggttacgccacgactcaggagaccctgtcgcatggggcgaaaaggcgattgcccattatgaaaagctggggattgatccgctgacaaaaacgctggtcttttcagataaccttgatctgccaaaggcagtcgagctctatcgccatttcgcctctcgcgtgcagttaagcttcggcatcggtacccgcctgacatgcgatatccctcaggtaaaaccgctcaatatcgtgattaagctcgtggaatgtaacggaaagccggtggctaaactttccgacagccccggtaaaacgatctgtcatgataaagcgtttgtgcgcgcgctgcgtaaagcgttcgatctcccgcaggtgcgtaaagcaagttaa

SEQ ID NO: 14168 - protein, 400 aa, Salmonella choleraesuis
MTQFASPVLHSLLDTDAYKLHMQQAVFHHYYDVQVAAEFRCRDDDLLGIYADAIREQVDAMQHLRLQEDEFQWLSGLPFFKPDYLNWLREFRYNPAQVCVTNDNGKLNIRLTGPWREVIMWEVPLLAVISELVHHYRSPNAGVDQALDALESKLVDFTALTANLDMSRFHLMDFGTRRRFSREVQQAIVKRLQQESWFVGTSNYDLARRLALTPMGTQAHEWFQAHQQISPDLATSQRAALAAWLNEYPDQLGIALTDCITMDAFLRDFGIEFASRYQGLRHDSGDPVAWGEKAIAHYEKLGIDPLTKTLVFSDNLDLPKAVELYRHFASRVQLSFGIGTRLTCDIPQVKPLNIVIKLVECNGKPVAKLSDSPGKTICHDKAFVRALRKAFDLPQVRKAS

SEQ ID NO: 14169 - DNA, 1203 bp, Salmonella paratyphi
  CDS (1)..(1203): transl_table=11
atgacacaattcgcttctcctgttctgcactcgttgctggatacagatgcttataagttgcatatgcagcaagccgtttttcaccactactatgatgtgcaggtagcggctgagtttcgttgccgtggcgacgacctgctgggtatttatgccgatgctattcgcgagcaggtggacgcgatgcagcacctgcgcctccaggaggacgagttccagtggctctccggcctgcccttttttaaaccggattatctgaactggttacgcgagtttcgctataacccagctcaagtctgtgtcaccaacgataacggcaagctgaatattcgcttaaccggcccgtggcgtgaagtcattatgtgggaagtgccgctgctggccgtgatcagtgagctggttcatcactaccgctcgccaaacgcaggcgttgatcaggcgctcgacgcgctggaaagtaagctggttgatttcactgcgttaaccgccaatctcgatatgtcccgcttccatctgatggacttcggcacccgccgccgtttctctcgtgaagtgcagcaggcgatagttaaacgtctccagcaggagtcatggttcgtcggcaccagcaactatgatctcgcgcgtcgcctggcgctgacgccgatgggcactcaggcgcacgaatggttccaggcgcatcaacaaatcagtccggacctggcgaccagtcagcgtgccgcgttggccgcctggcttaacgaatatccggaccagcttggtatcgccttgacagattgcattacaatggatgcgtttttacgcgatttcggcattgaattcgccagccgttatcaggggttacgccacgactcaggagaccctgtcgcatggggcgaaaaggcgattgcccattatgaaaagctggggattgatccgctgacaaaaacgctggtcttttcagataaccttgatctgcaaaaggcggtcgagctctatcgccatttcgcctctcgcgtgcagttaagcttcggcatcggtacccgcctgacctgcgatatccctcaggtaaaaccgctcaatatcgtgattaaactcgtggaatgtaacggaaagccggtggctaaactttccgacagccccggtaaaacgatctgtcatgataaagcgtttgtgcgcgcgctgcgtaaagcgttcgatctcccgcaggtgcgtaaagcaagttaa

SEQ ID NO: 14170 - protein, 400 aa, Salmonella paratyphi
MTQFASPVLHSLLDTDAYKLHMQQAVFHHYYDVQVAAEFRCRGDDLLGIYADAIREQVDAMQHLRLQEDEFQWLSGLPFFKPDYLNWLREFRYNPAQVCVTNDNGKLNIRLTGPWREVIMWEVPLLAVISELVHHYRSPNAGVDQALDALESKLVDFTALTANLDMSRFHLMDFGTRRRFSREVQQAIVKRLQQESWFVGTSNYDLARRLALTPMGTQAHEWFQAHQQISPDLATSQRAALAAWLNEYPDQLGIALTDCITMDAFLRDFGIEFASRYQGLRHDSGDPVAWGEKAIAHYEKLGIDPLTKTLVFSDNLDLQKAVELYRHFASRVQLSFGIGTRLTCDIPQVKPLNIVIKLVECNGKPVAKLSDSPGKTICHDKAFVRALRKAFDLPQVRKAS

SEQ ID NO: 14171 - DNA, 1308 bp, Vibrio cholerae
  CDS (1)..(1308): transl_table=11
atgaatccacgcctgttttctccccacatcattcgtagcctgctcgatcttgatgcttataaaatcaatatgatgcaagcgatacaccatttttatccggatgtgtcggtgcgctatgaattgattgtacgcagtgaagaggatgccagcggacttcttgatgccatccgtcaagagatagctcatcttggcacattgcgtttttcggatgccgatattcattatttgactcagcatgcgccacatctcaaggcgaccttcttgcaatcgttgcgttatttccattttgtgcctcaagagcaagtagaaatggggattgtcaaacaaggcggaaaacagcaactgcggatcagtattcgtggcagttggcgtgacacgattttgtatgaaaccttagtcatggcgatcgtatctgaagtacgcagccgtcagcgttgggctgaggtgcctgctgatttaccactgaaggtgctcaaaaccaagcttgaccaattaaaagcggagattgagcgtcgtgggatcaacaacttttctttgaccgaaatggggacccgccgccgcttttctagccaagtacagcgtgatgtgttggcttgtcttaagcaagagatcccacaatgggtgctgggtaccagcaactaccatttcgctcgtgaatttgatttaaagccgattggcaccatcgcccatgaatggtttatggggcatcaagctttggttaatgagcgcgattcacaacaagtggcgctagagcgctggttgacggcgtttgatggtatgctcgccattgccccgaccgatactttaaccatcgatgcctttttaaatgatttcaaccgtcatctggcaaacgcttatgatggagtgcgccatgattcgggctgcccattccgttggggcgataaaatgattgcccactaccagcagttgggtattgatcctaccaccaagcttttcattttctcggatggtttagatttcgatcaagctctggaactgtgtgaatattttgctggacgggtgaagatttctttcgggatcggcacctttttaaccaatgatttagcaaattggcgcaacgcggcgggtgtggagtatcgcccactctcgattgtgattaagcttgctgagtgtcaaggtcgcccggtggcgaaaatcagcgatcaaccggaaaaagccatgtgtgaagatccaatctttttggccaatctcaaacggcgctttaacatcgaattggatgtggatgcgcttatccaagagctgcgtcatcaaaagcgttcaccacgacactatatttcagcggcctaa

SEQ ID NO: 14172 - protein, 435 aa, Vibrio cholerae
MNPRLFSPHIIRSLLDLDAYKINMMQAIHHFYPDVSVRYELIVRSEEDASGLLDAIRQEIAHLGTLRFSDADIHYLTQHAPHLKATFLQSLRYFHFVPQEQVEMGIVKQGGKQQLRISIRGSWRDTILYETLVMAIVSEVRSRQRWAEVPADLPLKVLKTKLDQLKAEIERRGINNFSLTEMGTRRRFSSQVQRDVLACLKQEIPQWVLGTSNYHFAREFDLKPIGTIAHEWFMGHQALVNERDSQQVALERWLTAFDGMLAIAPTDTLTIDAFLNDFNRHLANAYDGVRHDSGCPFRWGDKMIAHYQQLGIDPTTKLFIFSDGLDFDQALELCEYFAGRVKISFGIGTFLTNDLANWRNAAGVEYRPLSIVIKLAECQGRPVAKISDQPEKAMCEDPIFLANLKRRFNIELDVDALIQELRHQKRSPRHYISAA

SEQ ID NO: 14173 - DNA, 1311 bp, Vibrio parahaemolyticus
  CDS (1)..(1311): transl_table=11
atgacgaccacactattttcttctcgcatcattcaaagtgcattggactttgatgtgtacaaagtaaacatgatgagtgcagttgcggcgctttatcctgatgcgatggtgtcatacaaattcatcgtgcgtagcgaagaagatctgtcggaattgctgccagaggtaaaggcagaagttcttaaacttcaagatgttcgctttactgaagatgaaattgcgtacatgaagcgcgttgcgccgtacctaaagcccgagtttgtcgaagcgttacgtcacttccgttttaacccgcaaagcgatgtctctttccataacaaaaccatgtcggatggctcaagccagctacgcattacaatcaatggcttgtggaaggaaaccattctgtacgaaaccatcatcatgagcattgtgtcggaagttcgcagccgtcaacgttggtcagatatcccgttcgagcagttccaaaccgtattggaagacaaagttcgctatttgaaagccgaactagaacgtcgcaacattactaacttcaaattcgcagatatgtcgacgcgtcgccgtttctcttttcaagcgcagcgcaccatgttggagtacttaagcaaggaattgccacaatgcttgacgggaaccagtaactaccatttggcgagagagttagatcttaccccaattggcacggttgctcacgagtggtttatgggccatcaagcgttagtaaacgtacgtgattcgcagaaaattgccctgcaacgttggcaaaaaatgttcaatggcgcactgggtatcgcactgacggataccatcggcatcgatgcatttctcaaagacttcgatgaagagttgagtcatgcgtacgttggcgttcgtcacgacagcggttgcccattcacttggggcgaaaagatgattgcgcactatgagtcgcttggcatcgacccgatgacaaagacgctagtctttacggatggtttgaacttcgagcaagcgctagacatttgtgagcatttccaaggtcgtgtacaagtgagcttcggtatcggtacgtcgctggcaaacgacatgggtaattacgttaacgatcaaggcgaggcgtatcagccgctttccatcgtgattaaaatggtgacctgtaatggctctccagtcgccaagatcagtgacgagccagaaaaggcgatgtgtgaagatattttctttttgatgaatcttaaacgtcgctttgaacaaccgcttgatttaaatgaatgtcgtaagctcattgatcgcctcgaaagcgaagggcagaactaccttattgatgcgtaa

SEQ ID NO: 14174 - protein, 436 aa, Vibrio parahaemolyticus
MTTTLFSSRIIQSALDFDVYKVNMMSAVAALYPDAMVSYKFIVRSEEDLSELLPEVKAEVLKLQDVRFTEDEIAYMKRVAPYLKPEFVEALRHFRFNPQSDVSFHNKTMSDGSSQLRITINGLWKETILYETIIMSIVSEVRSRQRWSDIPFEQFQTVLEDKVRYLKAELERRNITNFKFADMSTRRRFSFQAQRTMLEYLSKELPQCLTGTSNYHLARELDLTPIGTVAHEWFMGHQALVNVRDSQKIALQRWQKMFNGALGIALTDTIGIDAFLKDFDEELSHAYVGVRHDSGCPFTWGEKMIAHYESLGIDPMTKTLVFTDGLNFEQALDICEHFQGRVQVSFGIGTSLANDMGNYVNDQGEAYQPLSIVIKMVTCNGSPVAKISDEPEKAMCEDIFFLMNLKRRFEQPLDLNECRKLIDRLESEGQNYLIDA

SEQ ID NO: 14175 - DNA, 1314 bp, Vibrio vulnificus
  CDS (1)..(1314): transl_table=11
atgtgcgcgccactttttcaaccagccattattcaaagtgttcttgatttagatgtgtataaaatcaatatgatgcaagccgcgtatcgattttatcctcaaacacaagtgcgctacgaactgatcgttcgctctgatgataacttgtctgatttagtggaagaggttcgtgaggaaatcaaccgcctcgcagagcttcgctttgatgctgcccagttggcttacttggcagagaaagcgccctatttaacggcagagtttctctcctatttagaaaccttccgcttccaccctcagcaacaagtctctgtcggtattttccgcaccgcacagggcgactgccagctcagagtcaccataaatggcatttggcacgaaaccattctctatgaaaccttagtgatgagtattatctcagagctgcgcaatcgtcgttattgggcacaaataccccagtctcaactgcacaaagtattagaggacaaactggactttttagattcggaacttaaacgccgtaatattactaatttccgtttctctgagatggggacacgacgccgatttagctttgctgcgcaaaaaacgatgcttgacgtattgcgtgcacgagtgccagaactgctcttaggcaccagtaattatcaccttgctcaagagttcaatttaacgccaattggcacggtcgcacatgaatggaccatggcacatcaagcgcttgtcgctattcaacactctcagcgtgtcgcattagacaaatggcttgaggcgtttaatggtagtcttggtatcgctctaaccgacaccatcggtattgatgcgtttcttagcgattttgacctagacaaagccactgcctatgcaggcgtgagacacgattccggcagtccatttgtttggggagataaaatcattgcccattacgaaagtctaggcatcgatccaaccactaaaaccttgatttttaccgatggactggattttgcgcgtgcgcttgatatttgcgagtatttcgccggacgcgcacagataagttttggcattggcactttcctcgccaatgatatggggaattggaccaatgacaaaggcacccgttaccaaccgatatcaatggtggtcaagatggcggaatgtaatggctccccagtggcaaaaatcagcgacgagccagagaaagccatgtgtgaagacatctttttcttgatgaacctcaagcaacgctttggcttagaagtggaccttgataaagcgatcgaaacgctaaagcagatgaaacgtcagcagaaaaagcgcattcaaagcgtcgcttaa

SEQ ID NO: 14176 - protein, 437 aa, Vibrio vulnificus
MCAPLFQPAIIQSVLDLDVYKINMMQAAYRFYPQTQVRYELIVRSDDNLSDLVEEVREEINRLAELRFDAAQLAYLAEKAPYLTAEFLSYLETFRFHPQQQVSVGIFRTAQGDCQLRVTINGIWHETILYETLVMSIISELRNRRYWAQIPQSQLHKVLEDKLDFLDSELKRRNITNFRFSEMGTRRRFSFAAQKTMLDVLRARVPELLLGTSNYHLAQEFNLTPIGTVAHEWTMAHQALVAIQHSQRVALDKWLEAFNGSLGIALTDTIGIDAFLSDFDLDKATAYAGVRHDSGSPFVWGDKIIAHYESLGIDPTTKTLIFTDGLDFARALDICEYFAGRAQISFGIGTFLANDMGNWTNDKGTRYQPISMVVKMAECNGSPVAKISDEPEKAMCEDIFFLMNLKQRFGLEVDLDKAIETLKQMKRQQKKRIQSVA

SEQ ID NO: 14177 - DNA, 1314 bp, Vibrio vulnificus
  CDS (1)..(1314): transl_table=11
atgtgcgcgccactttttcaaccagccattattcaaagtgttcttgatttagatgtgtataaaatcaatatgatgcaagccgcgtatcgattttatcctcaaacacaagtgcgctacgaactgatcgttcgctctgatgataacttgtctgatttagtggaagaggttcgtgaggaaatcaaccgcctcgcagagcttcgctttgatgctgcccagctggcttacttggcagagaaagcgccctatttaacggcagagtttctctcctatttagaaaccttccgcttccaccctcagcaacaagtctctgtcggtattttccgcaccgcacagggcgactgccagctcagagtcaccataaatggcatttggcacgaaaccattctctacgaaaccttagtgatgagtattatctcagagctgcgcaatcgtcgttattgggcacaaataccccaatctcaactgcacaaggtattagaggacaaactggactttttagattcggaacttaaacgccgtaatattactaatttccgcttctctgagatggggacacgacgccgatttagctttgctgcgcaaaaaacgatgcttgacgtattgcgtgcacgagtgccagaactgctcttaggcaccagtaattatcaccttgctcaagagttcaatttaacgccaattggcacggtcgcacatgaatggaccatggcacatcaagcgcttgtcgctgttcaacactctcagtgtgtcgcattagacaaatggcttgaggcgtttaatggcagccttggtatcgctctaaccgacaccatcggtattgatgcgtttcttagcgattttgacctagagaaagccactgcctatgcaggcgtgagacacgattccggcagtccatttgtttggggagataaaatcattgcccattacgaaagtctaggcatcgatccaagcactaaaaccttgatttttaccgatggactggattttgcgcgtgcgcttgatatttgcgagtatttcgccggacgcgcacagataagttttggcattggcactttcctcgccaatgatatggggaattggaccaatgacaaaggcatccgttaccaaccgatatcaatggtggtcaagatggcggaatgtaatggctccccggtggcaaaaatcagcgacgagccagagaaagctatgtgtgaagacatcttcttcttgatgaacctcaagcaacgctttggcttagaagtggaccttgataaagcgatcgaaacgctaaagcagatgaaacgtcagcagaaaaagcgcattcaaagcgtcgcttaa

SEQ ID NO: 14178 - protein, 437 aa, Vibrio vulnificus
MCAPLFQPAIIQSVLDLDVYKINMMQAAYRFYPQTQVRYELIVRSDDNLSDLVEEVREEINRLAELRFDAAQLAYLAEKAPYLTAEFLSYLETFRFHPQQQVSVGIFRTAQGDCQLRVTINGIWHETILYETLVMSIISELRNRRYWAQIPQSQLHKVLEDKLDFLDSELKRRNITNFRFSEMGTRRRFSFAAQKTMLDVLRARVPELLLGTSNYHLAQEFNLTPIGTVAHEWTMAHQALVAVQHSQCVALDKWLEAFNGSLGIALTDTIGIDAFLSDFDLEKATAYAGVRHDSGSPFVWGDKIIAHYESLGIDPSTKTLIFTDGLDFARALDICEYFAGRAQISFGIGTFLANDMGNWTNDKGIRYQPISMVVKMAECNGSPVAKISDEPEKAMCEDIFFLMNLKQRFGLEVDLDKAIETLKQMKRQQKKRIQSVA

SEQ ID NO: 14179 - DNA, 1179 bp, Xanthomonas axonopodis
  CDS (1)..(1179): transl_table=11
atgatcatccattcgctgctcgacaccgatctgtacaaattcaccatgatgcaggcggtgctgcaccagcacccggcagcgcaggtggattaccgcttcaaatgccgcactcccggcgtggacctggcgcagttcatcgatgagatctcgcgcgagatcgatgcgctgtgccggttgcggttgcgcgaggacgaagtggattacctgcgcagcctgcgcttcatcaagccggacttcgccgacttcctggcgctgttccatctggatcgcaagtatctgagcctgaccgcatcggccacccatccgggcgagatcgagctgaccatccgcgggccgtggttgcacaccatcctgttcgaggtgccgctgctggcgatcatcaacgaggtctggttccgcaatacctccgagccggatttcgaagagggccgcagccgcctgcgcgaaaaggtagccagcctgcgcagcatgccggccggctgcaagatcgccgattacggcacccggcggcgctactcgcggcaatggcatggcgagttgctgccgctgctgcgcgatggcctgggcgagcagttcgtcggcaccagcaacgtgtacttcgccaagcagtacgggctgaccccgctgggaaccatggcgcacgagtatctgcaggcgttccaggcgttggggccgcggctgcgcgattcgcaggtggcggcgctggaatcgtgggcgcgcgaataccgtggcgatctgggtatcgcgttgtcggacgtggtcgggctggatgcgttcctgcgcgatttcgatctgtatttctgcaagttgttcgatggcatgcgccacgattcgggcgacccgttcgaatggggcgagcgcgtcatcgcgcatctggaagcgcaccgcgtcgatccccggaccaaggtgctggtattcagcgacggcctcaatatcgacaaggtgatgcggctgtaccagcacttccacacgcgctgccggctggccttcggggtgggcaccagcctcaccaacgatctggggccgacgccgctgcagatcgtgatcaagatggtccgctgcaatggccagccggtggccaagctcagcgactcgcccggcaagagcatgtgcgaggacatcggatatctgcgctatctgcgcgacgtgttcgggttgccgccgatggcagagacatga

SEQ ID NO: 14180 - protein, 392 aa, Xanthomonas axonopodis
MIIHSLLDTDLYKFTMMQAVLHQHPAAQVDYRFKCRTPGVDLAQFIDEISREIDALCRLRLREDEVDYLRSLRFIKPDFADFLALFHLDRKYLSLTASATHPGEIELTIRGPWLHTILFEVPLLAIINEVWFRNTSEPDFEEGRSRLREKVASLRSMPAGCKIADYGTRRRYSRQWHGELLPLLRDGLGEQFVGTSNVYFAKQYGLTPLGTMAHEYLQAFQALGPRLRDSQVAALESWAREYRGDLGIALSDVVGLDAFLRDFDLYFCKLFDGMRHDSGDPFEWGERVIAHLEAHRVDPRTKVLVFSDGLNIDKVMRLYQHFHTRCRLAFGVGTSLTNDLGPTPLQIVIKMVRCNGQPVAKLSDSPGKSMCEDIGYLRYLRDVFGLPPMAET

SEQ ID NO: 14181 - DNA, 1197 bp, Xanthomonas campestris
  CDS (1)..(1197): transl_table=11
atgatcattcattcgctgctcgacaccgatctgtacaagttcaccatgatgcaggcggtgctgcatcagcacccggccgcgcaggtggactaccgcttcaagtgccgcacacccggcgtggatctggcgcagttcatcgacgagatctcgcgtgagatcgacgcgctgtgccggctgcgcctgcgcgaggacgaggtggactacctgcgcagcctgcgcttcatcaagccggacttcgccgactttctcgcgttgttccacctggaccgcaaatacctggccctggccgcctcggccgcccacccgggcgagatcgagctgaccatccgcgggccctggttgcacaccatcctgttcgaagtgccgctgctggcgatcatcaacgaggtgtggttccgcaacacctccgagccggattttgaagaaggccgcagccgcctgcgcgagaaggtacgcagcctgcgcagcatgccggccggttgcaagatcgccgattacggcacgcgccgccgctattcgcggcaatggcatggcgaactgctaccgctgctgcgcgatggtttgggcgagcaattcgtcggtaccagtaatgtgtttttcgccaagcaatacgggctgaccccactgggcaccatggcgcacgaatacctgcaggcattccaggcgctgggcccgcggctgcgggattcgcaggtcgcggcgttggactcgtgggcgcgcgaataccgcggcgacctcggcattgcgctgtcggatgtggtgggcctggacgcgttcctgcgcgacttcgatctgtatttctgcaagctgttcgacggcatgcgccacgattccggcgacccgttcgactggggcgagcgggtgatcgcgcatctggaagcgcaccgcgtggatccgcgcaccaaggtgctggtcttcagcgacgggctgaacatcgacaaggtgatgcggctgtacgaacacttcagcccgcgctgccggctggcgttcggcgtgggcaccagcctgaccaacgacctgggcccgacgcccttgcagatcgtcatcaagatggtccgctgcaatgggcagccggtggccaagctcagcgattcgccgggcaagagcatgtgcgaagacctgggctacctgcgctacctgcgcgatgtgttcggcctgccgccgatgccggaagcgggtgacccagcgcgtcagtga

SEQ ID NO: 14182 - protein, 398 aa, Xanthomonas campestris
MIIHSLLDTDLYKFTMMQAVLHQHPAAQVDYRFKCRTPGVDLAQFIDEISREIDALCRLRLREDEVDYLRSLRFIKPDFADFLALFHLDRKYLALAASAAHPGEIELTIRGPWLHTILFEVPLLAIINEVWFRNTSEPDFEEGRSRLREKVRSLRSMPAGCKIADYGTRRRYSRQWHGELLPLLRDGLGEQFVGTSNVFFAKQYGLTPLGTMAHEYLQAFQALGPRLRDSQVAALDSWAREYRGDLGIALSDVVGLDAFLRDFDLYFCKLFDGMRHDSGDPFDWGERVIAHLEAHRVDPRTKVLVFSDGLNIDKVMRLYEHFSPRCRLAFGVGTSLTNDLGPTPLQIVIKMVRCNGQPVAKLSDSPGKSMCEDLGYLRYLRDVFGLPPMPEAGDPARQ

SEQ ID NO: 14183 - DNA, 1185 bp, Xylella fastidiosa
  CDS (1)..(1185): transl_table=11
atggaatttattataaagtcgctcctcgacactgacttatataaattcacgatgatgcaggcggtgttgcatcaataccccggggcacaggtggagtacaggtttaaatgccgtacgcctggtgtggatctggcgcgtttcatcaacgaaatctctcatgagattgatgggctatgtgcgctacgtttttctaaggaggaactggattatttgcgcggcttgcgcttcatgaagccagatttcgttgattttcttgggctgttccatttagaccgtaaatacctgcaattgcgtgcttcgacccaggtgtcgggcgagattgaattggatattcgtggcccatggttacatacgattctgtttgaggtgccgttgttggcgattatcaatgaggtttggttccgcaatacaagcatgttgaatcttgacgtgggccgcgcccgattggatgccaaggtgcgtttgcttaaaggcgagagtggttatgaagagtgcagcatcgctgactatggcactcgccgccgttactcgcggcagtggcatgccgagttgctgccattgttggcacaaggtttagggtcgaacttcgttggtaccagtaatgtttatttcgccaagcagtatggctataccccattggggacgatggcacacgagtatctacaggcatttcaggcattgggaccgcgcctgcgtgattcccaggtggcagggttggaagcctgggcgcgtgagtaccgcggcgatttaggaattgcgttgtcggatgttgttgggttggacgcgtttttgggtgactttgacttgtacttttgcaagttgttcgacggaatgcgccacgactccggagatccattcaaatggggagagcgcatcattatgcatctggagtcgcatcgtatcgatccacgtaccaaggtgctggtattcagtgatggacttgatatgaataaggtcatgcggttgtaccagcacttccgtggccgttgtcgcttggcgtttggtgtaggcacgagtttgacgaatgatctcgggccgacgccattgcagatcgtgattaaaatggtccgttgcaatggtcagccagtggcgaagctcagtgattctccgggtaaaagcatgtgcgatgatccagcgtacctgcattacttgcgtcaggtgtttggggtatctgccgatgtttga

SEQ ID NO: 14184 - protein, 394 aa, Xylella fastidiosa
MEFIIKSLLDTDLYKFTMMQAVLHQYPGAQVEYRFKCRTPGVDLARFINEISHEIDGLCALRFSKEELDYLRGLRFMKPDFVDFLGLFHLDRKYLQLRASTQVSGEIELDIRGPWLHTILFEVPLLAIINEVWFRNTSMLNLDVGRARLDAKVRLLKGESGYEECSIADYGTRRRYSRQWHAELLPLLAQGLGSNFVGTSNVYFAKQYGYTPLGTMAHEYLQAFQALGPRLRDSQVAGLEAWAREYRGDLGIALSDVVGLDAFLGDFDLYFCKLFDGMRHDSGDPFKWGERIIMHLESHRIDPRTKVLVFSDGLDMNKVMRLYQHFRGRCRLAFGVGTSLTNDLGPTPLQIVIKMVRCNGQPVAKLSDSPGKSMCDDPAYLHYLRQVFGVSADV

SEQ ID NO: 14185 - DNA, 1185 bp, Xylella fastidiosa
  CDS (1)..(1185): transl_table=11
atggaatttattataaagtcgctcctcgacactgatttatataaattcacgatgatgcaggcggtgttgcatcaataccctggggcacaggtggagtacaggtttaaatgccgtacgcctggtgtggatctggcgcgtttcatcaacgaaatctctcatgagattgatgggctatgtgggctgtgtttttctaaggaggaactggattatttgcgcggcttgcgcttcatgaagccagatttcgttgatttccttggactgtttcatttagaccgtaaatacctgcaattgcgtgcctcgtcccaggtgccgggcgagattgaattggatattcgtggcccatggttacatacgattctgttcgaggtgccgttgttggcgattatcaatgaggtttggttccgcaatacaagcgtgttgaatcttgatgtgggtcgtgaccgattggatgccaaggtacgtttacttaaagacgagagtggttatgaggagtgcagcattgctgactatggcacccgccgccgttactcgcggcagtggcatgccgaattattgccgttgttggcgcaaggtttagggtcgaacttcgttggtaccagtaacgtttatttcgccaagcagtatggctataccccattggggacgatggcacacgagtatctacaggcatttcaggcattgggaccgcgcctgcgtgattcccaggtggcagggttggaagcctgggcgcgtgagtaccgcggcgatttaggaattgcgttgtcggatgttgttgggttggatgcgtttttgggtgactttgacttgtatttttgcaagttgtttgacggaatgcgccacgactccggagatccatttaaatggggggagcgcatcattatgcatctggagtcgcatcgtatcgatccacgtaccaaggtgctggtattcagtgatggacttgatatgaataaggtcatgcggttgtaccagcacttccgtggccgttgtcgcttggcgtttggcgtagggacgagtttgacgaatgatctcgggccgacgccattgcagatcgtgattaaaatggtccgttgcaatggtcagccagtggcgaagctcagtgattctccgggtaaaagcatgtgcgatgatccagggtacctgcattacttgcgtcaggtgtttggggtatctgccgatgtttga

SEQ ID NO: 14186 - protein, 394 aa, Xylella fastidiosa
MEFIIKSLLDTDLYKFTMMQAVLHQYPGAQVEYRFKCRTPGVDLARFINEISHEIDGLCGLCFSKEELDYLRGLRFMKPDFVDFLGLFHLDRKYLQLRASSQVPGEIELDIRGPWLHTILFEVPLLAIINEVWFRNTSVLNLDVGRDRLDAKVRLLKDESGYEECSIADYGTRRRYSRQWHAELLPLLAQGLGSNFVGTSNVYFAKQYGYTPLGTMAHEYLQAFQALGPRLRDSQVAGLEAWAREYRGDLGIALSDVVGLDAFLGDFDLYFCKLFDGMRHDSGDPFKWGERIIMHLESHRIDPRTKVLVFSDGLDMNKVMRLYQHFRGRCRLAFGVGTSLTNDLGPTPLQIVIKMVRCNGQPVAKLSDSPGKSMCDDPGYLHYLRQVFGVSADV

SEQ ID NO: 14187 - DNA, 24 bp, Primer
atgacacaattcgcttctcctgtt

SEQ ID NO: 14188 - DNA, 26 bp, Primer
ttaactggcttttttaatatgcggaa

SEQ ID NO: 14189 - protein, 581 aa, consensus
  MISC_FEATURE (1)..(581): consensus for the disclosure of Xaa see table VIII
IIXSLLDTDLYKLTMMQAVXXXXXFPXXXVXYXFXXRXXXXXXXXXXXXXXXXLRXXLDXLXXLRFTXDELXYLXXLXFXXXXXXXXXDFLDYLXXFRFXXXXVXVXXXXXXXXXXXXXXXXXXXXLXIXIXGXWXXXILWEIPLLAIISELXXRXLXXXXXLXXXXXXXXXKXXXLXXXXXXXXXXXXXXXXXXXXXISDFGTRRRXSXXXQXXVVXALXXGXXXXXXXXXXXXXFXGTSNVXXAKKYXLXPIGTMAHEWLXAXXALXXXXXXXXXXXXXXXXXXXXLXXSQXXALXXWVXXYXXXXXXXXXXXXGXLGIALTDXXXXDAFLXDFXXXXXXXXXXXXXXXXXXXXXXXXXXXXXXXXXXXXXXXXXXXXXXXXXXXXXXXFAXLFXGVRXDSGDPXXWGEKIIAXYXXXXXXXXXXLGXDPXXXXXXXXXXTKLLVFSDGLXLXKXLXLXXXXXXRXXXXXXXIKLSFGIGTXLTNDXXXXXXXXXXXXXXXXXXXXXXXXXXXXXXXXXXXXXXXXXXXPLNIVIKLVXXNGXPVVKLSDXPGKXMXXXXXXXXXXXXXXXXXVLXXLR

SEQ ID NO: 14190 - protein, 10 aa, consensus
  MISC_FEATURE (1)..(10): consensus for the disclosure of Xaa see table VIII
LXXDXYXXXM

SEQ ID NO: 14191 - protein, 25 aa, consensus
  MISC_FEATURE (1)..(25): consensus for the disclosure of Xaa see table VIII
GXXXTSNXXXXXXXXXXXXGTXAHX

SEQ ID NO: 14192 - DNA, 1482 bp, Escherichia coli
  CDS (1)..(1482)
atgatgaagaaaacgcccacctctacgaaagactccttacccaacaaggagatgaatgatttgccccggctggcgagcgcggtgctgccactgtgttcgcaacatcccggtcagtgtggcctttttcctctggagaaaagtctggatgcgtttgccgcccggtatcgtctggccgaaatggcagagcatacgctcgatgttcagtattacatctggcaggacgatatgtcgggtcggttactgttttccgccctgttagccgcagcaaagcgtggcgttcgcgtccgtttgttgctggacgacaacaatacgcccggacttgacgacattttacgcttgcttgacagtcatccacgcattgaagtccggctttttaatcctttctcgtttcgcttgctgcgtccgcttggttatatcaccgacttttcccgtcttaatcgccgtatgcacaataaaagtttcactgtcgatggcgtggtgaccctggtgggaggacgaaatattggtgatgcctattttggagcaggggaggagccacttttttcggatttagatgtcatggcaataggacccgtggtagaggacgttgccgatgatttcgcccgctactggtattgcaaatcggtttcacccttacagcaggtgctggatgtcccggagggtgaaatggcggatcgcatcgagttacccgcctcctggcataacgatgccatgacgcatcgttatttacgcaaaatggaatccagtccatttataaatcatctggttgatggaacattgccgcttatctgggcgaagacacgtttattaagtgatgatccggcgaaaggggagggcaaggcaaaacggcattcactgttaccgcagcgcctgttcgatatcatgggctcacccagtgaacgcatcgatattatctcttcctattttgtaccgacacgcgcaggtgtggcgcaactcttacggatggtgagaaaaggggtaaagattgcgatcctaaccaattctcttgccgctaacgatgttgctgtcgtccatgccggatacgcgcgctggcgcaaaaaattgctccgctatggcgtggaattatatgaactcaagccgacgcgtgaacaaagtagtacgttacacgatcgcggcataaccggtaattccggagccagcctgcatgctaaaacctttagcatcgatggtaaaacggtgtttatcggctctttcaatttcgatccgcgttcaacattgctcaatactgaaatgggcttcgtgatagagagcgaaacgctggcacagttaattgataaacgctttattcagagccagtatgatgcggcctggcagctccgtctggacaggtggggacggatcaactgggttgatcgtcatgcaaagaaagagattattctcaaaaaagaacccgccaccagtttctggaagcgggttatggtcagactggcgtcgatattgcccgtggaatggttattgtaa

SEQ ID NO: 14193 - protein, 493 aa, Escherichia coli
MMKKTPTSTKDSLPNKEMNDLPRLASAVLPLCSQHPGQCGLFPLEKSLDAFAARYRLAEMAEHTLDVQYYIWQDDMSGRLLFSALLAAAKRGVRVRLLLDDNNTPGLDDILRLLDSHPRIEVRLFNPFSFRLLRPLGYITDFSRLNRRMHNKSFTVDGVVTLVGGRNIGDAYFGAGEEPLFSDLDVMAIGPVVEDVADDFARYWYCKSVSPLQQVLDVPEGEMADRIELPASWHNDAMTHRYLRKMESSPFINHLVDGTLPLIWAKTRLLSDDPAKGEGKAKRHSLLPQRLFDIMGSPSERIDIISSYFVPTRAGVAQLLRMVRKGVKIAILTNSLAANDVAVVHAGYARWRKKLLRYGVELYELKPTREQSSTLHDRGITGNSGASLHAKTFSIDGKTVFIGSFNFDPRSTLLNTEMGFVIESETLAQLIDKRFIQSQYDAAWQLRLDRWGRINWVDRHAKKEIILKKEPATSFWKRVMVRLASILPVEWLL

SEQ ID NO: 14194 - DNA, 1401 bp, Mesorhizobium loti MAFF303099
  CDS (1)..(1401): transl_table=11
atggacgtctcgattacgcaaacatcggccgataaaatcaaagcaggtaagagcggcctgctgctgatttctgacaattacgatgcgttcgccgcgcgtgttttagcggcaaggggcgcggctcgcactctcgatctcatgtactatctctggcatgacgaccacacggggcgcttgcttttgcaggaagttgtccgggcggcccagcgaggcgtacgggtcagaatgctgctcgacgacgtcaatccgcgcaagagcgatgccgcctatttggcgctgagcaaccatccaaacatcgaactcaaattgttcaacccgagcggcatcagagcgcgcggcctcatgcgcggcgcggaagtcctcttgcggctttttgcattgacaaggcggatgcacaacaaggcgtggattgccgacgacaacatcgcaattgtcggtgggcgcaatgtcggcgatgcatattttgacgcggcggagacgaatttccgtgacctcgacatgctgcttctcggtcccgccgtccagcaaaccgcacagatcttccaaactttctgggtatgccaggacgcgaagccaatagccgaactcggtgcagccgctccaggctcgcatgccccttatttcgagggaagagaggagaaaaccgagtcgacgcttctgagcgggatcagggacaagggctccatcgccgagttcatatcggcgagcagcaacgtacattgggtcgagcgcgtgcgcgtgatctccgaccctccggaaaaggtccgaggctggagaccgcgcagttggctgatgaaggagttgctcccaatcattcaatcggcgcgcaagcgtgttgaaatcgtgtccccgtattttatccccggcaagaagggatcaaaaatcctcggcgacctcgtcgacgacggggtgcaggtcgctgtgttgaccaactccttggccgcgaccgatgtcgccgcggtccacggggcatacgccaactatcgcaagcgcttgctgagaatgggcgtgcagcttttcgagctccaaccctttagccggcagcccaagatttccgtatttggatccaagggtgccagcctgcacaccaaagcgttcagcgtcgacaacaggatcggtttcgtcggatcttttaacttcgatccgcggtccgtatccctgaattcggaaatgggagtgctttttgaagacgagaatctggtcgcggaactgcggcataggttcaaatcggagatagcgccggaagcgagctaccggctcgaattgaagaacgaggttcttcgctggcatggcagcgatgaaggcaggctgcaaacctatactcgcgaacccgaggcagcatggttccgccgcatcctggccgccctggtcaggcacctccccatcgaatctcagctttag

SEQ ID NO: 14195 - protein, 466 aa, Mesorhizobium loti MAFF303099
MDVSITQTSADKIKAGKSGLLLISDNYDAFAARVLAARGAARTLDLMYYLWHDDHTGRLLLQEVVRAAQRGVRVRMLLDDVNPRKSDAAYLALSNHPNIELKLFNPSGIRARGLMRGAEVLLRLFALTRRMHNKAWIADDNIAIVGGRNVGDAYFDAAETNFRDLDMLLLGPAVQQTAQIFQTFWVCQDAKPIAELGAAAPGSHAPYFEGREEKTESTLLSGIRDKGSIAEFISASSNVHWVERVRVISDPPEKVRGWRPRSWLMKELLPIIQSARKRVEIVSPYFIPGKKGSKILGDLVDDGVQVAVLTNSLAATDVAAVHGAYANYRKRLLRMGVQLFELQPFSRQPKISVFGSKGASLHTKAFSVDNRIGFVGSFNFDPRSVSLNSEMGVLFEDENLVAELRHRFKSEIAPEASYRLELKNEVLRWHGSDEGRLQTYTREPEAAWFRRILAALVRHLPIESQL

SEQ ID NO: 14196 - DNA, 1401 bp, Mesorhizobium loti MAFF303099
  CDS (1)..(1401): transl_table=11
atggacgtctcgattacgcaaacatcgaccgataaaatcaaagcaggtaagagcggcctgctgctgatttcagacaattacgatgcgttcgccgcgcgtgttttggcggcaaggggcgcggttcgcacgctcgatctcatgtattatctctggcacgacgaccacacgggacgcttgcttttgcaggaagttgtccgggcggcccagcggggcgtgcgcgtcagaatgctgctcgacgacgtcaatccgcgcaagagcgatgccgcttatttggcgctgaacaaccacccaaacatcgaactcagattgttcaatccgagcggcatcagagcgcgcggcatcatgcgcggcgcggaagtcctcttgcggctttttgcattgacaaggcggatgcacaacaaggcgtggattgccgacgacagcatcgccatcgtcggtgggcgtaatgtcggagatgcctattttgacgcggcggagacgaatttccgtgacctcgatgtgctggtcctcggtcccgccgtgcaacaaactgctcgaatcttccagactttctgggcatgccaggacgccaagccaataggtgaactcggcgcagccgcgccgggctcgcatgcccctaatttcgagagaagcgacgccgaaaccgagtcgacgcttttgagcggtatcggcgacaagggctccaccgccgagtttatagcagcgagcagcgacgtacattgggtcgaccgcgtgcgcgtgatctctgaccctccggagaaggtccgaggctggagaccgcgcggttggctgatgaaggagttgctcccaatcattcagtcggcgcgcaagcgcgtggaaatcgtgtccccgtattttatccccggcaagaagggttcaaaaatcctcggcgacctcgtcgacgacggagtgcaagtcgctgttttgaccaactccttggccgcgaccgatgtcgccgccgtccacggagcctacgccaactatcgcaagcgcttgttgagaaagggcgtacagctcttcgagcttcagccctttagtaggcagcccaagatttctgtatttggatcaaagggcgccagcctccacaccaaagcgttcagcgtcgacgacaggatcggtttcgtgggatcattcaacttcgatccgcggtccgtatcgttgaactcggaaatgggagtgctttttgaagaccagaaactggtcatggaactgcggcaccgcttcaaatccgagactgcgccggaagcaagctaccggcttgaactcaagaacggggttctgcgctggcatggcagcgatgaaggcagaccgcaaacctatgctcgcgaacccgaggcagcattgttccgccgcatcctgtccgccctggtcaggtacctcccgatcgaatcccagctttag

SEQ ID NO: 14197 - protein, 466 aa, Mesorhizobium loti MAFF303099
MDVSITQTSTDKIKAGKSGLLLISDNYDAFAARVLAARGAVRTLDLMYYLWHDDHTGRLLLQEVVRAAQRGVRVRMLLDDVNPRKSDAAYLALNNHPNIELRLFNPSGIRARGIMRGAEVLLRLFALTRRMHNKAWIADDSIAIVGGRNVGDAYFDAAETNFRDLDVLVLGPAVQQTARIFQTFWACQDAKPIGELGAAAPGSHAPNFERSDAETESTLLSGIGDKGSTAEFIAASSDVHWVDRVRVISDPPEKVRGWRPRGWLMKELLPIIQSARKRVEIVSPYFIPGKKGSKILGDLVDDGVQVAVLTNSLAATDVAAVHGAYANYRKRLLRKGVQLFELQPFSRQPKISVFGSKGASLHTKAFSVDDRIGFVGSFNFDPRSVSLNSEMGVLFEDQKLVMELRHRFKSETAPEASYRLELKNGVLRWHGSDEGRPQTYAREPEAALFRRILSALVRYLPIESQL

SEQ ID NO: 14198 - DNA, 1197 bp, Bacillus halodurans C-125
  CDS (1)..(1197): transl_table=11
atgatcggagtcgtactcttatttcttatcgttgcgattattttgtggttacgctttgattacacccaagggttaaagaaacaacgggggaaagccgttagacgaaaccaaccaatccgccacgggacagttcgactattgccaactggcgatgagtttatcggttccctcattcatgacataaaagctgctgaacaccacattcacattttattttatatctttcgtgacgatcacatcgggaaaaaaattcttcagcaccttgaacaaaaagcaaaggaaggggtggctgtccggttgctcgtcgatcgattcggcgccgatgtgaaaaatcgttccattcagagcctgaagcaagcaggggcgcaatttgagtacgctcatcggatcagctttccgtactggtttttctctttaaatcgccgtaatcatcggaaaatcactgtcattgatggaaagatcggctacattggtggctataacatcggggatgagtatttagggcgtgatccgaagttaggtttttggcgtgactaccatcttcgactgacaggggatggcgttcaagatttacaggatcaatttattcaagactgggagcgagagtcccgactccctgtcacaagagatcgctggctgtatccgccattggcaaaaggaccccatgaactacggatcattccaacgaacggctcttttttagaagacagttttcttcaactcgtcgaacaagcggaggaaacgattacgatcggaaccccttacttcattcctggggaaaaattgcaccatgcccttttggatgcagccgctagaggggtggctgttcgtctactcgtaccgaaaaaaggcgatcacccactcgtgaaggaagcagcgttcccttactttaaggagctccttgaagggggcatcaacatttatcgttactatcgcggcttttttcatggaaaggcaatcgtaatcgatgataagctggccgatgtaggaacagccaattttgataagcgcagctttcggttgaattatgaaatcaactgtcttttatatgacaaagagatgattcagctcgttcgcgaagaattggattatgatttttccatatcggaacggcttcaaatggaggacctcgcgaaccgctccttcttccatcgtacgaaagaacaagtagctaccctgttctctggttttttttag

SEQ ID NO: 14199 - protein, 398 aa, Bacillus halodurans C-125
MIGVVLLFLIVAIILWLRFDYTQGLKKQRGKAVRRNQPIRHGTVRLLPTGDEFIGSLIHDIKAAEHHIHILFYIFRDDHIGKKILQHLEQKAKEGVAVRLLVDRFGADVKNRSIQSLKQAGAQFEYAHRISFPYWFFSLNRRNHRKITVIDGKIGYIGGYNIGDEYLGRDPKLGFWRDYHLRLTGDGVQDLQDQFIQDWERESRLPVTRDRWLYPPLAKGPHELRIIPTNGSFLEDSFLQLVEQAEETITIGTPYFIPGEKLHHALLDAAARGVAVRLLVPKKGDHPLVKEAAFPYFKELLEGGINIYRYYRGFFHGKAIVIDDKLADVGTANFDKRSFRLNYEINCLLYDKEMIQLVREELDYDFSISERLQMEDLANRSFFHRTKEQVATLFSGFF

SEQ ID NO: 14200 - DNA, 1545 bp, Pasteurella multocida subsp. multocida str. Pm70
  CDS (1)..(1545): transl_table=11
atgctgatcgtgattatcaaaaaactgtttcttttactcgccctgattctgtttagcctcgtgatacttgccctaataagctaccaacgattacccacatccgatcgtccaatcagtacgcatcctccccttaatcccaacgggctgttagcacgccatatcttgccgcaagttgcccaacatcccaacttaacgggattgtatcctttaggcgatgggaaagatgcctttctcgctcgcttggcgctcagcgaacatgccgaacatacactcgacttacagtattatatttggcataacgatgtgtctggtcacttactcttacaaagtctatataaagccgcagtccgcggagtaaaagtccgtttattattggacgacaataataccaaaggcatggacacgatcttggcttcactcaatgcacaccctaatatccaaatccgcttattcaatccctttatgcaacgtcaatatcgttggttaggctttttgagcgacttttttagactcaatcgtcgtatgcacaataagtccttcaccgcagatggcgtcatgagtattcttggcgggcgtaatattggtgatgaatattttgatgtgggtaatggtgtattatttgctgatcttgatgttgccgcaaccggcgccgtcgttacacacattcagactgattttgatcgctattggaatagcccatcaagttatcctttagaaagcattatcatacgcgatcctattacgccttttaatccgttgcctgcattagatgatgaaacccaaacttatttaaaacaactcactgaactgccctttgctaaaagcttaaaagcaggcaccttagcttttacatgggcagaggcagaattaatcagcgatgatcctaaaaaggcactaggcaaatcattgattcaagacagtgtcttagcacatattgctcccacaatgttaaatgcgaaaaacaacttaatcattgtgtcgccttattttgtaccaacccatgttggtgtggatttcttaagtcgtatcagccagactggcacacaggtttccattctaaccaattcactggaagcaaccgatgttagcattgtacattctggttatgctaaacaccgcaaaacattgttacaaaagcaaatccaactgtatgagctgaaacctcatgcaaccattcaaatggaatcctcagggcatttattaaaaggagccagtagcgccagtttacatgccaaaacatttactcttgataatcgctatttatttgttggttcctttaatatggatccgcgctctgctatgttgaatacggaaatgggattactcattgacagccctgaattggctcgcttactcagtgatggactgcaacaaaatcaagcaaattatgctttttcggttaagttaaatgaggcgcaagcactgtattgggaaacgcaagaaaatgggaaatggattcgctatgaaaatgagccacacaccagttggtttaagcgttttagtgtgtggtgtttatcttggttacctgttgaacatttgctataa

SEQ ID NO: 14201 - protein, 514 aa, Pasteurella multocida subsp. multocida str. Pm70
MLIVIIKKLFLLLALILFSLVILALISYQRLPTSDRPISTHPPLNPNGLLARHILPQVAQHPNLTGLYPLGDGKDAFLARLALSEHAEHTLDLQYYIWHNDVSGHLLLQSLYKAAVRGVKVRLLLDDNNTKGMDTILASLNAHPNIQIRLFNPFMQRQYRWLGFLSDFFRLNRRMHNKSFTADGVMSILGGRNIGDEYFDVGNGVLFADLDVAATGAVVTHIQTDFDRYWNSPSSYPLESIIIRDPITPFNPLPALDDETQTYLKQLTELPFAKSLKAGTLAFTWAEAELISDDPKKALGKSLIQDSVLAHIAPTMLNAKNNLIIVSPYFVPTHVGVDFLSRISQTGTQVSILTNSLEATDVSIVHSGYAKHRKTLLQKQIQLYELKPHATIQMESSGHLLKGASSASLHAKTFTLDNRYLFVGSFNMDPRSAMLNTEMGLLIDSPELARLLSDGLQQNQANYAFSVKLNEAQALYWETQENGKWIRYENEPHTSWFKRFSVWCLSWLPVEHLL

SEQ ID NO: 14202 - DNA, 1206 bp, Pseudomonas aeruginosa PAO1
  CDS (1)..(1206): transl_table=11
atgaacttcccctggcgcgacggcaaccgcgtagaactgctgatcaacggcgaagagtactttccgcgcctgttccagtgcatcgccgaggcgcgccgggagatcctcctggaaaccttcatcatcttcgaggacgaggtcggccggcagttgcaggaagccctcagcgccgccgccgagcgcggtgtcgaggtgcaggtcaccgtggacggctacggcaccgcctcgctcagcccggactacctggccaggctgaccgcctccggggttcgcgtgcacctgttcgacccgcgcccgcgcctgctcggcatgcgcaccaacctgtttcgccggttgcaccgcaagctggtggtgatcgatcgccggcaggccttcgtcggtggcatcaattacggcgaggaccacctggtacgtcgcggcaacatggccaagcaggactacgcggtgcgcgtcgagggcccggtggtgcgcgatatccgccaggcctgcctggcgctgctcgaaccggacgccgactacccgccgttgcggccgtcgggcgccgggcagccggcgcgggtgcgcctggtgatccgcgacaacgaccagtccagcgacgacatcgagcgcgagtacctgcaggcgatccgccaggcgcggcgacgcctgctgatcgccaacgcctatttcttccccggctaccgcctgcttcgcgagctgcgcgatgcggcgcgccgcggcgtgcgcgtcgacctggtactacagggcatgccggacatgccgctggtgcgcctgtgcagccggctgctctacgactacctgctgcgcgagggcgtgcgtatccacgaatactgccagcgtccgctgcacggcaaggtcgcggtgatcgacgacgactggtcgaccatcggctcgagcaatctcgatcccctcagcctgtcgctgaacctggaggccaacctggtgatccgcgacgtcgccttcaacggccagctctaccagcacctgcgcgagctggcgcgccgccactgccggcgcatcagccgccgccacgcgaggcgcggctactggtggcgagcgccgctgatcttcctcggcttccacttttccaggcactttccggctatcgccggttgggtacccgcccatctgccgcgcctgaaatcgctggagccgcgtccgtcgcggcgctggcaggaacgccagggccagcggggcaacccatga

SEQ ID NO: 14203 - protein, 401 aa, Pseudomonas aeruginosa PAO1
MNFPWRDGNRVELLINGEEYFPRLFQCIAEARREILLETFIIFEDEVGRQLQEALSAAAERGVEVQVTVDGYGTASLSPDYLARLTASGVRVHLFDPRPRLLGMRTNLFRRLHRKLVVIDRRQAFVGGINYGEDHLVRRGNMAKQDYAVRVEGPVVRDIRQACLALLEPDADYPPLRPSGAGQPARVRLVIRDNDQSSDDIEREYLQAIRQARRRLLIANAYFFPGYRLLRELRDAARRGVRVDLVLQGMPDMPLVRLCSRLLYDYLLREGVRIHEYCQRPLHGKVAVIDDDWSTIGSSNLDPLSLSLNLEANLVIRDVAFNGQLYQHLRELARRHCRRISRRHARRGYWWRAPLIFLGFHFSRHFPAIAGWVPAHLPRLKSLEPRPSRRWQERQGQRGNP

SEQ ID NO: 14204 - DNA, 1080 bp, Pseudomonas aeruginosa PAO1
  CDS (1)..(1080): transl_table=11
atgctgctggccatcgaggcggcgcagcggagcatcgagctggagctgtacctggtggaagacgggcattgcgccgaactgtttctcgtcgccctgctggatgcccgccgccggggcgtcgccgtgcgctgcctgttcgacggcttcggctgcctcggcctgggcagcgcctggatccagcgcctgcgcgaggccggcggcgaactgcggctgtacaacccgctgcgctggaagctgactggcggcaatctctaccgcgaccatcgcaagctgctgctggtggacgggcgcctcggttatgtcggcggcgccgggatcaccgacgaattctgggaaccggtcagcgacgtcagcgcctggcgcgaggtgatggtcgagatggacggcccggtggtggcggactgggcggcgctgttcgagcggcaatggctggcctgtctcgaagagaaagcctggaagccccgcgagggcatgacccttacccgccttccgccgcagccgggggcggcccgtgggttgggccgggtggcctacgccgacgcccgccagcaccgcgacatcctgcaatcgctggtccgcgcgctgaacggctcgcgccgacggatctggctggcgacgccgtacttcctgccgacctggaaggttcgccgggccctgcgcaaggccgcccagcgcggcgtggaggtgcgcctgctgctggccgggcggctcaccgaccacgccccggtgcgctatgccgggcagcgctactacccgcgcctgctgcgcgccggcgtgcgcatccacgaataccagccgcgcttcctgcacctgaagatggtcatggtcgacgattgggtgagcgtcggctcctgcaacttcgatcattggaatctacgcttcaacctcgacgccaatctcgaggccctcgacccggacttcaccaatgaggcggcggcgagcctgctggcggacttcgccgacagccgcgaggtgaccctggcgatgtggcgcgcgcgacccctgtggatgcgcctgcaccagcgcctgtggggttggcttgaccgggtagtggtgaatttcctcgaccgccggcgctag

SEQ ID NO: 14205 - protein, 359 aa, Pseudomonas aeruginosa PAO1
MLLAIEAAQRSIELELYLVEDGHCAELFLVALLDARRRGVAVRCLFDGFGCLGLGSAWIQRLREAGGELRLYNPLRWKLTGGNLYRDHRKLLLVDGRLGYVGGAGITDEFWEPVSDVSAWREVMVEMDGPVVADWAALFERQWLACLEEKAWKPREGMTLTRLPPQPGAARGLGRVAYADARQHRDILQSLVRALNGSRRRIWLATPYFLPTWKVRRALRKAAQRGVEVRLLLAGRLTDHAPVRYAGQRYYPRLLRAGVRIHEYQPRFLHLKMVMVDDWVSVGSCNFDHWNLRFNLDANLEALDPDFTNEAAASLLADFADSREVTLAMWRARPLWMRLHQRLWGWLDRVVVNFLDRRR

SEQ ID NO: 14206 - DNA, 1590 bp, Pseudomonas aeruginosa PAO1
  CDS (1)..(1590): transl_table=11
atgagccggtcgttcgagtttccacgggagatatccttgcttcgccgattcctcctgctggccctcctggccctctccggctgcgccagcactcctccgccgcaaccgtcgtcggcactgcccgccgagggtacctggctggccaggcaggccgaaatccagggacgcgaccaccccggccagtccggcttccacctcctgagcgccagcgaggatgccttcgtcgcccgcgcggcgctgattcgcgcagcccagcgcagcctcgacatccagtactacatcgtccacgacggactgaccacgcgcgccctcgcctacgagttgctcaaggcagccgaccgtggcgtgcgggtacgcatcctcatcgacgacaccgccagcgatggctgggactacgagatcggtgtgctctccgcccatccgaacatccaggtgcgcctgttcaacccattgcacctgggccgcgccaccggcatcacgcgaggcgtcggccgcctgttcaacctgtcccagcaacaccggcgcatgcacaacaagctgtggctggccgacggcacggcggccatcgtcggcggacgcaacctcggcgacgagtatttcaacgccaagccggagatgaacttcaccgacctcgacctgctcggcgtcggccccatcgccaaccagctctcgcacagcttcgaccagtactggaacagcgccatcagccggccgatcgaggatttcctctggcgcgcgccctatcccggcgaactggagtcggcccgacgcaagttgcagcgctacctgcgcaaggagtcggtgaaggagtccggctacatccgccacctgttcgaccgcggcgaccagccacgcctgggcaactggctggagaatctcacctgggcccgcgccgaggcgatctgggatgcgccgctgaaggtattgagccgcggcgagcccgacccgcacctattgctcagtccgcacctggcgggcctgttcaagggcgtgcagaaggaactgatcctggtctcggcgtatttcgttccggccaaggacggtctcaactacctcaccggcaaggccgacagcggcgtccgcgtgcgcctgctgaccaactccctggaagccaccgacgtgcccgccgtgcatgccggctacgcgccctatcggatggcgctgcttgagcatggcgttaagctctacgagctgcgcgccaatcccgaccagccgctgagcggcgcgccctggcgcctgcacggatcgagcagcgccagcctgcacagcaaggcgatggtcttcgaccggcgcaaggtattcatcggttcgttcaacttcgatccgcgctcgatcctgtggaacaccgaggtcggggtcatcgtcgacagtccgctgctggccgagcaggtccgccaactggcgctggagggcatggcgccgagcgtcagctaccaggttcgcatcgaccgcagcggcagccggccgaagctggtctggatcgacgaacgcgacggccgggcccaggtcctgcgccacgagccgggtagcctgtggcgacgcctgaacgcctgggtcgcgggaatgatcggactggaaaagatgctctga

SEQ ID NO: 14207 - protein, 529 aa, Pseudomonas aeruginosa PAO1
MSRSFEFPREISLLRRFLLLALLALSGCASTPPPQPSSALPAEGTWLARQAEIQGRDHPGQSGFHLLSASEDAFVARAALIRAAQRSLDIQYYIVHDGLTTRALAYELLKAADRGVRVRILIDDTASDGWDYEIGVLSAHPNIQVRLFNPLHLGRATGITRGVGRLFNLSQQHRRMHNKLWLADGTAAIVGGRNLGDEYFNAKPEMNFTDLDLLGVGPIANQLSHSFDQYWNSAISRPIEDFLWRAPYPGELESARRKLQRYLRKESVKESGYIRHLFDRGDQPRLGNWLENLTWARAEAIWDAPLKVLSRGEPDPHLLLSPHLAGLFKGVQKELILVSAYFVPAKDGLNYLTGKADSGVRVRLLTNSLEATDVPAVHAGYAPYRMALLEHGVKLYELRANPDQPLSGAPWRLHGSSSASLHSKAMVFDRRKVFIGSFNFDPRSILWNTEVGVIVDSPLLAEQVRQLALEGMAPSVSYQVRIDRSGSRPKLVWIDERDGRAQVLRHEPGSLWRRLNAWVAGMIGLEKML

SEQ ID NO: 14208 - DNA, 1446 bp, Lactococcus lactis subsp. lactis Il1403
  CDS (1)..(1446): transl_table=11
ttgagttttattgcactttttgagctggcgctttttttccttaatgttatattatcctttgtcattatttttagggaaagaaaatcaacagcggcaacttggtcatggctctttgtagttaatttactgcctatcataggctttattttatatttactcattggacgtggcatttcgcattatcgtatttttaaagaccgaaaaaggtttcagttgggttttgaaaaacaattagaacatgctgaaaaatcttacacagatcgattatttattaaaaaaatgagacaaaatcatgtaattggtcagttgattcatatgctttatgttgaagaaaaatcaattatttcaacaaatactggtgtgaaaatcttcaatgatggacgtcagaaatttaatgctctgattgatgatattaataaagcaaaacatcacgttcatatggaatattatatttttcggatggatcgaatgggtcatgaaatctatgatgctttacttgcagctgcaaaacgaggagtcgaagttaaacttttaattgacgcttggggttcaaataaaacaaaaatgtctaattttaaagaacttcaggaggctggtgggcatgtagcgcaattttttccattaattatgcctttagttaatccacgaacaaactatcgtttacaccgtaaaattgtagttattgatggaattattggatacacaggtggatttaatgttggtgatgaatatgcttcaattacaaagaaatttggctattggcgtgacaatcatttacgtttgactggtgatattgtttatagtctacaacatcgttttattttagactggaattctcaacatcattttgaagtgaccgagggagagccttatttcccagattcgattgttgaaggtcatgtagcgactcaacttgtaacttcgggaccagatgaggacaaagagcaaattaaattaacttacatgaagatgatttcaggtgcagagcgagagattatcattcaaaccccttattatattccgtctgatgctttacatgaatctataaaattagcattgttatcgggtgtacaggttaaattattgattccaaataagccggaccatccactggtttattgggcgacttatttccatgctgctgatttagttaaatatggcgcgaaagtttatacttacgaaaatggatttgttcactctaaaacattgattattgatggagagtatgcctcagttgggtcagctaatttagattatcgaagtttgcaattatgttttgaagctaatgttgttatctatgattatgacatttctcaaaaattacgaaatgattttatgaaggatttgaaattgagtcgtccattaactttagagcgttatgaggaacgctctaagttagttcgttttaaagaaggtttagctcgtttaattgcaccaatgctctga

SEQ ID NO: 14209 - protein, 481 aa, Lactococcus lactis subsp. lactis Il1403
MSFIALFELALFFLNVILSFVIIFRERKSTAATWSWLFVVNLLPIIGFILYLLIGRGISHYRIFKDRKRFQLGFEKQLEHAEKSYTDRLFIKKMRQNHVIGQLIHMLYVEEKSIISTNTGVKIFNDGRQKFNALIDDINKAKHHVHMEYYIFRMDRMGHEIYDALLAAAKRGVEVKLLIDAWGSNKTKMSNFKELQEAGGHVAQFFPLIMPLVNPRTNYRLHRKIVVIDGIIGYTGGFNVGDEYASITKKFGYWRDNHLRLTGDIVYSLQHRFILDWNSQHHFEVTEGEPYFPDSIVEGHVATQLVTSGPDEDKEQIKLTYMKMISGAEREIIIQTPYYIPSDALHESIKLALLSGVQVKLLIPNKPDHPLVYWATYFHAADLVKYGAKVYTYENGFVHSKTLIIDGEYASVGSANLDYRSLQLCFEANVVIYDYDISQKLRNDFMKDLKLSRPLTLERYEERSKLVRFKEGLARLIAPML

SEQ ID NO: 14210 - DNA, 1464 bp, Lactococcus lactis subsp. lactis Il1403
  CDS (1)..(1464): transl_table=11
atggagaaatattttatgtcacttgcgacaatttatagtttgatgggaacactaataacgattaacacattgcttgcccttgtgacaatttttcggaaacctaggtctattgccagtatttttgcgtggtctatgttcttgttctttttaccaggggttggtttccttggctatctttttttaggaagagggcttgatcgaacaacaacaaatcgttttgaagaagaaaataaatataatctgtctattcttgctcaaagggtgcgtgaaaataatgaaaaatttgagccaaaagaaatggcaccccatgaaagattactgaaaaggtattttaataatatggaacgtacaccactttgtcgtgggaataaagtgaatttttatctgaatggagaagataaattttcagccttgtttgatgacataaagaatgctaaagataatattcatgtagaatactatgcattctttaatgacaaaattggaactgcttttcgcgataatctaattgaaaaagctaaagaaggggtggaagttagagtagtttacgatccatggggaggaaaaacgagaaaggatttctttaaacctttggaagaggcaggaggtaaggtcacagcctttatcacatcgcgtaatacactaacaaaaacccgacttaactatcatttacatcgtaaaattgtagtgatagatggtcaaattggttggactggcggatttaatgttggtgatcaatatatttataacagtaaaaagtttggcttctggcgcgatacacacggtagaattgttggtacagcagcttttggtcttcaagaaacatttattcgagattggaatgtttcagtcagagatcctaaagataagcttgaaagagaagattcatattttgtggtaccggaagaagaagggaacattgatattcagattgtcgctaacggaccaaagagtgataataaaaccttaagaacaggttttattaaaatgattatggatgcggaagactatatttggcttcaatcgccttacttgatacctgatgactctatgataacagcgcttgtagcagcggcgaattctggtgttgatgtaagaattatgattcccaatatgccagatcatccgtttatttttagagcaacacaatattacgcaaattatctacataaacacggtgtgaaaatatacaattatacaaatggcttcatacactctaaaactcttgtaatggatggaaaattaggagtatttggtacaactaatcaagatattcgcagttatgaattaaatttcgagataagtgctttttgttatgatgaaactgtagcaaaagagatgagcaggacctttgagggagacttaagaaattcaaagctacttactgatgaagaaattgcccaacaatctatctggcttaaaatcaagcaaaacttttcgagattacttagtccgatattataa

SEQ ID NO: 14211 - protein, 487 aa, Lactococcus lactis subsp. lactis Il1403
MEKYFMSLATIYSLMGTLITINTLLALVTIFRKPRSIASIFAWSMFLFFLPGVGFLGYLFLGRGLDRTTTNRFEEENKYNLSILAQRVRENNEKFEPKEMAPHERLLKRYFNNMERTPLCRGNKVNFYLNGEDKFSALFDDIKNAKDNIHVEYYAFFNDKIGTAFRDNLIEKAKEGVEVRVVYDPWGGKTRKDFFKPLEEAGGKVTAFITSRNTLTKTRLNYHLHRKIVVIDGQIGWTGGFNVGDQYIYNSKKFGFWRDTHGRIVGTAAFGLQETFIRDWNVSVRDPKDKLEREDSYFVVPEEEGNIDIQIVANGPKSDNKTLRTGFIKMIMDAEDYIWLQSPYLIPDDSMITALVAAANSGVDVRIMIPNMPDHPFIFRATQYYANYLHKHGVKIYNYTNGFIHSKTLVMDGKLGVFGTTNQDIRSYELNFEISAFCYDETVAKEMSRTFEGDLRNSKLLTDEEIAQQSIWLKIKQNFSRLLSPIL

SEQ ID NO: 14212 - DNA, 1527 bp, Neisseria meningitidis MC58
  CDS (1)..(1527): transl_table=11
atgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggcaggctgctgttcaacctcgtgtaccttgccgcagaacgcggtgtgcgcgtacgcctgctgttggacgacaacaacacgcgcggattggacgacctcctgcttgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgatttggacatcctcgccaccggcagcgtcgtcggcgaagtatcgcacgacttcgaccgctactgggcaagccattccgcccacaacgccacgcgcatcatccgcagcggcgacatcggcaagggtcttcaagcactcggatacaacgacgaaacgtccagacacgcgctcctgcgctaccgcgaaaccgtcgaacagtcgcccctctaccaaaaaatacagacaggatgcatcgactggcagagcgtccgaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgttcccacaaaatccggcacagacgcactggcaaaactggtgcaggacggcatagacgttaccgttctgaccaactcgctgcaggcgaccgacgttgccgccgtccattccggctatgtcaaataccgaaaaccgctgctcaaagccggcatcaaactctacgagctgcaacccaaccatgccgtccccgccacaaaagacaaaggcctgaccggcagctccgtaaccagcctgcacgccaaaaccttcattgtggacggcaaacgcatcttcatcggttcgttcaacctcgacccccgttccgcgcgtctcaacaccgaaatgggcgttgttatcgaaagccccaaaatcgcagaacagatggagcgcacccttgccgataccacacccgcctacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaggtttattatag

SEQ ID NO: 14213 - protein, 508 aa, Neisseria meningitidis MC58
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGDIGKGLQALGYNDETSRHALLRYRETVEQSPLYQKIQTGCIDWQSVRTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPAYAYRVTLDRHNRLQWHDPATRKTYPNEPEAKLWKRIAAKILSLLPIEGLL

SEQ ID NO: 14214 - DNA, 1959 bp, Xylella fastidiosa 9a5c
  CDS (1)..(1959): transl_table=11
ttgaatatattcatacgtttgttattgctagcagctattttgttgggcagtgcttgcgctagcttgtcgcatgcccagttggatcatgctgcgtcggttgccgtggctgcgcgcccggccacgctggattgcgacaggcccaatcattgtgcgttggattcgccgttgtacgcgcttgggagccgagcgctgagtgaatctacgcctgtgacaccacttcactatgtgaccatcctcgataaaggcgagagcgcgttggttgcacggatcaatttgatccgcagtgctacccgcagtatcgatatgcagacttacatttttgacaaggacgatagtgcccggttgattatggatgagctattgactgctgctagacgtggtgttcgagttcgtttactgattgaccagctttcggcgatttctgatctgaatattctgggtgccttggctggtgcacacgttaatttccaactgcgtatctacaacccgatttttggcaaagccaagctgaactatggcgactatgttgccagcgtgctgtgttgttttcgtcgctttaatcagcgcatgcacaataaattgttggtcattgatgaaatgatcggcgtggtcggcgggcgtaattaccaagatgactattatgattgggatcttgaatataactttcgtgaccgtgatgtgcttgtcgccggaccggcggtgctgcaaatggcagttaactttgatgcgttttgggcggctgagcgcagcgtaccggtagagtgcctcagggatgttggacgcatggtgctgcaggatggggtgccgatgctgccatcagctgtcttccatccactggaacgggtccagcgtgttactgctgaggccaacgatccggactatgtcaagcgtacctttgtcgatcctgccttggctgtgaacaaagtgcaatatgttgctgacctgccgcaaaagcatcgccatgagcacaatgcaaatccggtttccattgggccacggttggatagtttgatttctaatgcgcgtcatgaggtgatcttgcagaccccatatctggtgttatccaaaccagcgctgaacatcttccgtcgcctcaatcggactcaggacaaaccgcgtgtggttgtggtgaccaacagtttggctgctaccgataatcccatcgtctatgccttattttacaaatacaagcggcgtaacatgcgtgacctggggttcgacatttacgagtacaagccgtttccgcaaaatccgccaatcgacctgacgggcgttgttccgatggatggatggaacaatgactctcttcagacgcgacaggaccttttggctgctgccaaagtctccgatgattcagacaatgctcgtcagttaccctcgcttgaaaataaaggtcaagtggataggcgtgtgttacgtactgaaacgcgtccaccctttttgggcattcacactgtcaataaaccattgcctgtgactcgcccgggcgcacgcatgggcttgcatgcaaaatcattggtggttgatcgtaaggttggggtgattggtacccacaacttcgatccgcgcggtgagagttacaatactgaagctgttgtggtgattgaggatccagcgttcgcccgtctgctggcttccagcattgagggtgatatggatccaggtaatgcgtgggttgtggcaccgcggaagaagttacctgggctctataagctcaattattcggtaggtaaactgtctgaggcattgcctgtgctggacctgtggccttggcgttatgcaaccaactatgaattcaaacccgggttggattgtccaatgccattgccacgttgggatccgagttttatgcaatgttatgaacctgtcggtgactttcctgaagtcaatgttggtccaaagtggttgttggtccggatgctgattgcattcggtgctgggctggtgcctatcttgtaa

SEQ ID NO: 14215 - protein, 652 aa, Xylella fastidiosa 9a5c
MNIFIRLLLLAAILLGSACASLSHAQLDHAASVAVAARPATLDCDRPNHCALDSPLYALGSRALSESTPVTPLHYVTILDKGESALVARINLIRSATRSIDMQTYIFDKDDSARLIMDELLTAARRGVRVRLLIDQLSAISDLNILGALAGAHVNFQLRIYNPIFGKAKLNYGDYVASVLCCFRRFNQRMHNKLLVIDEMIGVVGGRNYQDDYYDWDLEYNFRDRDVLVAGPAVLQMAVNFDAFWAAERSVPVECLRDVGRMVLQDGVPMLPSAVFHPLERVQRVTAEANDPDYVKRTFVDPALAVNKVQYVADLPQKHRHEHNANPVSIGPRLDSLISNARHEVILQTPYLVLSKPALNIFRRLNRTQDKPRVVVVTNSLAATDNPIVYALFYKYKRRNMRDLGFDIYEYKPFPQNPPIDLTGVVPMDGWNNDSLQTRQDLLAAAKVSDDSDNARQLPSLENKGQVDRRVLRTETRPPFLGIHTVNKPLPVTRPGARMGLHAKSLVVDRKVGVIGTHNFDPRGESYNTEAVVVIEDPAFARLLASSIEGDMDPGNAWVVAPRKKLPGLYKLNYSVGKLSEALPVLDLWPWRYATNYEFKPGLDCPMPLPRWDPSFMQCYEPVGDFPEVNVGPKWLLVRMLIAFGAGLVPIL

SEQ ID NO: 14216 - DNA, 1404 bp, Xylella fastidiosa 9a5c
  CDS (1)..(1404): transl_table=11
atggaaggaacttggctgtttgcattggattgggtgatccgtttggttgcgttgctttggattccagcacgaaccacccctagtgctgcacgcagctggttattgctgattggtttcgtccctgtatttggtttgccgctttacttggtgtttggccatccttggctgtcacgtaagcgtgtgttgcgtcaggcgttggcttctcaggtgatccgtgagtggcagcgtgggttgagtgcgttgcgctggcagcctcaggagaatagtgtcgccgcggaattggtgcctttggtggagcatcagggcgattttatgccaacacgtggtaacgccttggatctattggatgattaccaatcttcgctgcgtttgttgatcaatgatattgattccgcgtgcgaacgtgtgcacttgctgtattacttgatgttcgatgatgcggtgggtgatgcggttgtggctgcattacagcgtgctgcggcgcgtggcgtttcttgccgattgctgctggatgcagttggtgctaaacgcggtctacgtgcctatcagcagtgccttcgtgcgcatggtgtcgaggtgcacgctatgttgcctggtgggttgcgctggcgtcgcagtgggcgtatggatttgcgtaaccatcgtaaaattgctgtgattgacaatcgtgtcgcttatatcggttcgcagaatttggcctgcccagattttgtgccgcatttccctaaccgtgaactggtcgcacgcgtgtgcggtcccgcggtaagtcatctggaggcggtgtttctcagtgattggtttgttgaaactggtcaacgtttgaggatgcgttcagatgttcccatatgtgagcaaaatgttgcggcccagctagtggccagcggtccggcttacccgtacgagaatgcgcgtgatgcggtgaatacaatgatccatttggcacggcggcgtgttgtcttgacgacgccgtatttcgtgcctgatgaggctacactcagtgcgttgcgtattgccggcacgtctggagtagacgtgcagttgatcctgtccgagagtaataatcagtttctgatggcctgggctcaggaggcgtacttcgaggagctgttgcgcgcaggaatcaaaatcgcattgtatcgtccccatttcctacatgctaagcatctaagtgtggatgatgatattgcgttgttcggatcgattaatttggacatccgctcgtttgcgcttaacgctgagatcggcatgatttgttacgactcacgtattgtgagtcggttacgcgaggtggagagtgattatctggccaatgcgtgccagcttaatttggttgagtggcagcaacgtcccgcttggcgtcgtagccgtgagggtattgcacgcttggcagatgctctgatgtag

SEQ ID NO: 14217 - protein, 467 aa, Xylella fastidiosa 9a5c
MEGTWLFALDWVIRLVALLWIPARTTPSAARSWLLLIGFVPVFGLPLYLVFGHPWLSRKRVLRQALASQVIREWQRGLSALRWQPQENSVAAELVPLVEHQGDFMPTRGNALDLLDDYQSSLRLLINDIDSACERVHLLYYLMFDDAVGDAVVAALQRAAARGVSCRLLLDAVGAKRGLRAYQQCLRAHGVEVHAMLPGGLRWRRSGRMDLRNHRKIAVIDNRVAYIGSQNLACPDFVPHFPNRELVARVCGPAVSHLEAVFLSDWFVETGQRLRMRSDVPICEQNVAAQLVASGPAYPYENARDAVNTMIHLARRRVVLTTPYFVPDEATLSALRIAGTSGVDVQLILSESNNQFLMAWAQEAYFEELLRAGIKIALYRPHFLHAKHLSVDDDIALFGSINLDIRSFALNAEIGMICYDSRIVSRLREVESDYLANACQLNLVEWQQRPAWRRSREGIARLADALM

SEQ ID NO: 14218 - DNA, 1506 bp, Mycoplasma pulmonis UAB CTIP
  CDS (1)..(1506): transl_table=4
atggacaaaaaaaacttcactagatttctttgatattttttatcatttttgtttcttgtaattaacatagtagttttttgacttatttttcatctaaattatgtttattttagtttaatgattgctattgtttatttaattaacactggagtggtagtttttatttttatgcaaaataggaactcttcatcaaagctttcttgaattgttgtaattactattttgcctttttttggacatcttctttattttctagttggtcaaaaatatagacatagaaaagactatgatgcttattataaaaattttaataacatcttaaaagatgggaccaacattgatgatttttcaactatgattcatgactttggagaaaaaaatttatttaatcaactctcacttttaagtcaaaagccaatacttccagctaaattcaaaatgtttagtcatccttataaatattttaattctctttttgagcatattgaaaaagctcaaaaagaaatttgaattgtttcttactatgcaaaagatggtgaattagttgatgaatttttttcacttctaattaaaaaagcaactaatggtgtaaaaattaaatgactaattgatgattttggtcaaaggcatttaaaaagaaaaaccttagataggctaaaacatcctaatattgaaattgaatttattggtagattacgctttggttttttgatctcttcaaatttctacagaaaccatagaaaattttttatcattgataaaaaaatagtttttaacggaggatcaaatatatcagatagatatatttcactagactctcaatttggttattaccatgatattaactatatgattaagggtccttatgttcattcttacatcatcatttttatttacatgtgaaaaagatgaagaaatatagaactacgatataaagagccaattggtgaattagaaaataactttgagtcaagagcaattatctttgaagatggtcctgagttaaatgactcaattattgaagactcacttatcaaattaattgcaaatgctaaagaagaaataaaaatatcaactccttatttttctctttcaaatggtcttttcaatgcttttaaaatagctcttctttcaggggtaaaggtatctattttttatcctggttattcagctcaaaaacttgttcaccaaataggattagttgagcttaaaaaacttgaaaaatatggaatcaaaatttattttacaaatggctttttcaatcactcaaaaatgggaatttttgataaaaatattgcttacataggaactttaaattttgatattagaagtttttatgctcaatatgaaacaattgatattgttgaaggtgaagttgtcaaagatattcaaaaactttttgatgatcttgaacaaagatcagtgcactttttaaaagactatcaaaatatgagaagttttttaccaaaacaaattctttttaaaattttaaaacctcttacttag

SEQ ID NO: 14219 - protein, 501 aa, Mycoplasma pulmonis UAB CTIP
MDKKNFTRFLWYFLSFLFLVINIVVFWLIFHLNYVYFSLMIAIVYLINTGVVVFIFMQNRNSSSKLSWIVVITILPFFGHLLYFLVGQKYRHRKDYDAYYKNFNNILKDGTNIDDFSTMIHDFGEKNLFNQLSLLSQKPILPAKFKMFSHPYKYFNSLFEHIEKAQKEIWIVSYYAKDGELVDEFFSLLIKKATNGVKIKWLIDDFGQRHLKRKTLDRLKHPNIEIEFIGRLRFGFLISSNFYRNHRKFFIIDKKIVFNGGSNISDRYISLDSQFGYYHDINYMIKGPYVHSYIIIFIYMWKRWRNIELRYKEPIGELENNFESRAIIFEDGPELNDSIIEDSLIKLIANAKEEIKISTPYFSLSNGLFNAFKIALLSGVKVSIFYPGYSAQKLVHQIGLVELKKLEKYGIKIYFTNGFFNHSKMGIFDKNIAYIGTLNFDIRSFYAQYETIDIVEGEVVKDIQKLFDDLEQRSVHFLKDYQNMRSFLPKQILFKILKPLT

SEQ ID NO: 14220 - DNA, 1533 bp, Clostridium acetobutylicum ATCC 824
  CDS (1)..(1533): transl_table=11
ttgagattttttataaaatttatatttcatagagctacctttgtagttatttcagcattaatacagctatttgttttgatttttgtaattataaaatttaacgagtattttgtgttcttttatggaattagcattgtagtaagcataattgcagtattgtatatactttacaataatagtaatccagcatataaaattgtgtggattattccaatattagtatttcctctttttgggggattattttatttattttttggcggaagtaagttaagcagaagaactagaaaaaagatggagtgtatagtagctaagtcaagagcggtattgataaagggtgaagtgataataaatgagataaggaataataatgaaacagcagcgaatcaatcaagttatattcaaaattattctctttttcctccatataaatacacaaaggcagaatatttttcaacaggagaagaaacatttaacgaacttatagaacaacttaaaaaagcaaaacaatatattttccttgaatactttattattaaagaaggagttatgtggaatagtgttttacaaatattaagagataaggtacaagaaggagtggaggtcagagttatatatgatgacatagggtgtatgtttactctgcctaacggatatcataaagaacttgagaaaattggcattaaatgctgcgtattcaatcctctcattcctatggtatcttttaaatttaataatagagatcataggaaaattgcagtaattgatggtttggtaggatttactggtggaataaatctatcggatgagtacataaataaatatcaaaagtatggctattggaaggatactgcaattaaagtggaaggaaaagcagcttggaatttatcagttatgtttttatctatgtggagctttcttagaggaatagatgaggactttaatacattcaaaaagaatattgaaaaagaattttcttctagagagggatatgttcagccatttgcggatagcccattagacggagaacctgttggggaaattatatatatgaacttgataagtaaggctacaaaatatgtttatattactacaccttatttagttataggaaacgagatggtaacagcactgacctctgccgcaaagggaggagtagatgttagaattattaccccacacataccagacaaaaaaattgttcattctgtaactaaatcctactataaagttttaattgagagcggagttaaaatttatgagtatatgccaggcttcatacattcaaaaacttatgtttgtgataatgaatacggagttgtaggcagtataaatatggattttagaagtctttatcttcattttgagtgcggtgtttggatgtataaaaccaatactgtatacgatattaagaaggattttatggatacattagataaaagtaaagagataactttagaagagattaacaaagttaagtggtatagtactttatggcgcgtggttctaagagtttttgcacctttgatgtaa

SEQ ID NO: 14221 - protein, 510 aa, Clostridium acetobutylicum ATCC 824
MRFFIKFIFHRATFVVISALIQLFVLIFVIIKFNEYFVFFYGISIVVSIIAVLYILYNNSNPAYKIVWIIPILVFPLFGGLFYLFFGGSKLSRRTRKKMECIVAKSRAVLIKGEVIINEIRNNNETAANQSSYIQNYSLFPPYKYTKAEYFSTGEETFNELIEQLKKAKQYIFLEYFIIKEGVMWNSVLQILRDKVQEGVEVRVIYDDIGCMFTLPNGYHKELEKIGIKCCVFNPLIPMVSFKFNNRDHRKIAVIDGLVGFTGGINLSDEYINKYQKYGYWKDTAIKVEGKAAWNLSVMFLSMWSFLRGIDEDFNTFKKNIEKEFSSREGYVQPFADSPLDGEPVGEIIYMNLISKATKYVYITTPYLVIGNEMVTALTSAAKGGVDVRIITPHIPDKKIVHSVTKSYYKVLIESGVKIYEYMPGFIHSKTYVCDNEYGVVGSINMDFRSLYLHFECGVWMYKTNTVYDIKKDFMDTLDKSKEITLEEINKVKWYSTLWRVVLRVFAPLM

SEQ ID NO: 14222 - DNA, 1518 bp, Staphylococcus aureus subsp. aureus Mu50
  CDS (1)..(1518): transl_table=11
atgttttttgtgcctttctttataggagaaaagactatgcgatatacattttcaaatgatttaggaacactttttaccattattttagccattggattcatcattaatttagtattggcttttattattatctttttagaaagaaatagacgtacagcgagttcaacttgggcatggctatttgtactttttgtcttaccattgattggttttattctttacttgttttttggtagaaccgtttcggcacgtaaattgaataaaaacaatggtaacgtgttaacggatttcgatggacttttaaaacaacaaatagaaagctttgataaaggtaattatggtactgataacaaacaagttcaaaaacatcatgatttagtaagtatgcttttgatggatcaagatggttttttaactgaaaataataaagttgatcatttcattgatggaaatgatttatatgatcaagttttaaaagatattaaaaatgcaaaagaatatatccatttagagtactatactttcgctttagatggtttaggtaaaagaattttacatgctttagaagaaaaattgaaacaaggtctagaagtaaaaatattatatgatgatgttggatctaaaaatgttaagatggcaaattttgatcactttaaatcattaggtggcgaagttgaagcattttttgcttctaaattacccttattaaatttccgtatgaataacagaaatcatagaaaaatcatcgtaatcgatggtcaactaggttatgtcggaggatttaacattggtgatgaatatctaggattaggtaaactagggtattggagagatacgcatttacgtatacaaggggatgcggttgatgcactgcagttgcgatttattttagactggaattcgcaagcgcaccgtccacagtttgaatatgatgttaagtatttccctaaaaagaacggaccattgggcaattcaccaattcaaatagctgcaagtggcccagctagtgactggcatcaaattgaatatggttatacaaaaatgattatgagcgctaagaagtcggtatatttgcaatcgccttatttcattccggataactcatatataaatgccattaaaattgcagctaaatcaggtgtagatgttcatctaatgattccatgtaagccagatcatcctttagtttattgggcgacattttcaaatgcctctgacttattatcaagtggtgttaaaatttatacgtatgaaaatggatttatacattctaaaatgtgcttaattgatgatgaaatcgtatcagtgggcacagcaaatatggactttagaagttttgaattaaattttgaagtaaatgcctttgtatatgatgaaaatcttgctaaggatttaagggtggcttatgaacatgatattacaaaatcaaaacaactaaccaaagaatcatatgccaatagaccgctgtctgttaaattcaaagaatcgttagcaaaattagtttcgccaattttataa

SEQ ID NO: 14223 - protein, 505 aa, Staphylococcus aureus subsp. aureus Mu50
MFFVPFFIGEKTMRYTFSNDLGTLFTIILAIGFIINLVLAFIIIFLERNRRTASSTWAWLFVLFVLPLIGFILYLFFGRTVSARKLNKNNGNVLTDFDGLLKQQIESFDKGNYGTDNKQVQKHHDLVSMLLMDQDGFLTENNKVDHFIDGNDLYDQVLKDIKNAKEYIHLEYYTFALDGLGKRILHALEEKLKQGLEVKILYDDVGSKNVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATFSNASDLLSSGVKIYTYENGFIHSKMCLIDDEIVSVGTANMDFRSFELNFEVNAFVYDENLAKDLRVAYEHDITKSKQLTKESYANRPLSVKFKESLAKLVSPIL

SEQ ID NO: 14224 - DNA, 1566 bp, Sinorhizobium meliloti 1021
  CDS (1)..(1566): transl_table=11
atgtggtcgtgggttgcactttttctcgtagcgctctgcgggctcttcctggtcgcggtcctctatgtctacggctggtttggccgcaggccgcggaccgaaccctcattcgcgctccccatcggcggagacgagacgggcatcgatcggcaattgggcccactgctgggtgccgcccaccccggcgagagcgtggtcgcgctcatttccgataacatcgaagccttcgttgcgcgggcgctttcggcgcgccgggcggggcgcagcctcgacctgcaatattactactggaaggacgacctgacggggtttctgctgacgcgcgagatcatccgggcggccgaccgcggcgttcgcgtccgcctgctgctcgacgatatcaatgcaggaatccatgatcgtctctgcatttcgctcgacgcccatccgaatgtcgacgtgcgcctcttcaatccaagccgggcacgaacggaccgcttccgccgcgggttcgaaatggcgatacgggccttcagtgcgacgcgccggatgcacaacaagctgtgggttgccgatggccggctggcgatatccggtgggcgcaacatcggtgacgcctatttcgacgcggccgaactgtcgaacttccgtgacctcgacgtctggatggcgggtccggtcgtcgaccaggcgacggccatgttcgatctctactggaacagcacgtcggtgctgccgatcgcagccctcaggacgccgcgcaagcagtaccttccggcgctgcgagaggcgctggacgggctggcgcgcacggcggccgcgcgcttctatctggaaagggtcgcagacgcggcggctgcgggtcccggctcctactggggaagccggaccctccatcgcagcgcggatgtgcgcatggcgttcgacccgccggaaaaggcgctgatgcagaagcggcagaactggctgctgcgcgaactgttcccgctgatcaagggcgccagccatgatctgcggatcatctcgccctacttcatccccggcgcagcggggacgcgcgtgctggcgctcctcgcgggaaagggcgcgagggtggcggtactgacgaattcgctcgctgcaaccgatgtcgcggcagtgcatggcggctacgtgaagtatcgcaaagggctgcttgacggcggtgtcgagctctacgagctcaaggagcgcggtgatttcttcgatcgtcaccgtatgtcgctgttcggagcgcgaaacgcgagcctccacaccaaggccttcgtcgtcgatggcctctgcggctacgtcggctccatgaatttcgatccgcgttccgcgtcgctcaacaccgagatgggcatcgtcttttccgacgaggcgctcgccgccgagctccaatcgatattcgacgaggaaacggcgccggaacggagctatcgcctgatgctgaaggacggccggcccgcatggcgggatcggacgaacggctcgctgcggctgctgcggcgcgagccggacgcaggcattctccggcggctgatcgctggcgtgatccgctttctgccgttggagtcacagctttga

SEQ ID NO: 14225 - protein, 521 aa, Sinorhizobium meliloti 1021
MWSWVALFLVALCGLFLVAVLYVYGWFGRRPRTEPSFALPIGGDETGIDRQLGPLLGAAHPGESVVALISDNIEAFVARALSARRAGRSLDLQYYYWKDDLTGFLLTREIIRAADRGVRVRLLLDDINAGIHDRLCISLDAHPNVDVRLFNPSRARTDRFRRGFEMAIRAFSATRRMHNKLWVADGRLAISGGRNIGDAYFDAAELSNFRDLDVWMAGPVVDQATAMFDLYWNSTSVLPIAALRTPRKQYLPALREALDGLARTAAARFYLERVADAAAAGPGSYWGSRTLHRSADVRMAFDPPEKALMQKRQNWLLRELFPLIKGASHDLRIISPYFIPGAAGTRVLALLAGKGARVAVLTNSLAATDVAAVHGGYVKYRKGLLDGGVELYELKERGDFFDRHRMSLFGARNASLHTKAFVVDGLCGYVGSMNFDPRSASLNTEMGIVFSDEALAAELQSIFDEETAPERSYRLMLKDGRPAWRDRTNGSLRLLRREPDAGILRRLIAGVIRFLPLESQL

SEQ ID NO: 14226 - DNA, 1464 bp, Sinorhizobium meliloti 1021
  CDS (1)..(1464): transl_table=11
atgatcgtgttcatagagagttactggccgcattttctggcgctgctttcggtcgtcctcggcgtcccggcaatcatccatgcggcgatgacgaaagacgatgtgcgggcggccgccggctgggtcggggttgtgctgctctcaccggtcatcggtgcggtcatctacgcggttgccggcatcaatcggatgcgccgctcgtctatcggcttgcagcgctcgctgctgcgctcgaccgagcgggaccctttcgggcgcttcgatgtcacgcatgatcaggtggtggcccgtttcggacagcgtttcgcggcaatgaagatgcttggagaccgcgttgcgcgcttcacgatgtcggcgggaaaccacatcaccatgctcgagggcggcgacgcggtctatgcggcgatgctcgacgagatctcctccgcccgtcgcagcattctcatcgagagctatattttcgaccgcgatcccatcggcatgcgtttcgccgatgccctgatcgccgcagtgaaacgcggcgtcgccgtgcgcgtcctgatcgacgccgtgggtgcgcgctattccgtgccgtccattgtgggctatctgaaggaaggaggcgtgccgaccgccgtcttcaacggcaatatcatcatgggcctgaggctgccctatgccaatctcaggacacaccgcaagatcatggttgtcgacggcgcggtcgctttcgccggcggcatgaacatccgcgcgggctttgccgctgaaatcgcaggcaaggctgcttctttcgacacgcatttccgcgtgaccggacccgttgtcgccgatatctttcaggttgccgcggaagactggcagttttcgagcaaggaggtactgacaggcgacggctggcggctcgccgaccttccggcggagccggacgggcgatcggtgctgatgcgggccgttccctcaggtcctgacaataccaacgagacaaatcacaagatgcttatgggcgccttttcgatggcgcgaaaacatatccggttgatgtcgccctatttcctcccggacaaggaattggtcagcgcgctcgtgacggcggcgaggaagggcgtcgaagtcgacatcgtcgtgccctctgtcaacaatctgacactcgtcgaccgcgcgatgacggcacagttcgaccaggtgctgaaaggtcattgccgcgtctggcgggcaaagggcgccttcaaccattccaagctgatggtcatcgacgatcgctgggcctatgtcggttcgaccaatctcgatccccgctccctgcgcctcaatttcgagttcgacctcgaaatactcgacgaagccttcgcacgcgcaatcggcgaaaaggtctgtgccatacgcgcggccgcggatgaagtgacccttgcagggctccgcgcgcagccgctcgtaaaccgtctggcaaaccgattgctctggctcggatcgccctacctttag

SEQ ID NO: 14227 - protein, 487 aa, Sinorhizobium meliloti 1021
MIVFIESYWPHFLALLSVVLGVPAIIHAAMTKDDVRAAAGWVGVVLLSPVIGAVIYAVAGINRMRRSSIGLQRSLLRSTERDPFGRFDVTHDQVVARFGQRFAAMKMLGDRVARFTMSAGNHITMLEGGDAVYAAMLDEISSARRSILIESYIFDRDPIGMRFADALIAAVKRGVAVRVLIDAVGARYSVPSIVGYLKEGGVPTAVFNGNIIMGLRLPYANLRTHRKIMVVDGAVAFAGGMNIRAGFAAEIAGKAASFDTHFRVTGPVVADIFQVAAEDWQFSSKEVLTGDGWRLADLPAEPDGRSVLMRAVPSGPDNTNETNHKMLMGAFSMARKHIRLMSPYFLPDKELVSALVTAARKGVEVDIVVPSVNNLTLVDRAMTAQFDQVLKGHCRVWRAKGAFNHSKLMVIDDRWAYVGSTNLDPRSLRLNFEFDLEILDEAFARAIGEKVCAIRAAADEVTLAGLRAQPLVNRLANRLLWLGSPYL

SEQ ID NO: 14228 - DNA, 1488 bp, Salmonella typhimurium LT2
  CDS (1)..(1488): transl_table=11
atgatgaagaaactgcccggctttacgcaagattacttactcagcaaggcgacgaccctgcctgataaaacacgcctggagcgtgccgttgaaccgctatgcgcgcgccatcccggagagtgcggcattctcgcgctggataacagtctggacgcttttgccgcccgctaccgcctgaccgaaatggcggcgcggacgctggatgtgcagtattatatttgggaagacgatatgtccgggcggctgctcttttcggtactgctgtcggcggcgaagcgcggcgttcatgttcgtctgctgctggatgataacaatacgcctggtctggatgatacgttgcgcttgctggatagccatcctaatatcgaagttcgtctgtttaatcctttctcttttcgtacgctacgcgcgctgggatatttgacggattttgcgcggctgaatcggcggatgcacaataaaagttacactgccgacggcgtagtgacgctggtcggtgggcgcaacatcggcgatgcctatttcggcgctggcgaggagccgctattttccgatctggacgtgatggccattggcccggtggtcaatgatgtcgccaatgattttgaacgttactggcgctgtagttcagtgtcgacattgcagcaagtattatccctttctgagcaggaactgacgcagcgtatcgaacttcccgaatcctggtataacgatgagatcacccgccgttatctgcataagctggaaaccagccagtttatggcggatctcgatcgcggaacgttgccgctgatttgggcaaaaacacgcttgcttagcgatgacccttctaaaggcgaggggaaggcgcagcgccattcgcttcttccgcagcgattatttgacgtgatggggtcgccgacggagcgtatcgacattatttccgcttactttgtccctacgcgcgcaggcgtggcgcagttgcttaatctggtcaggaaaggcgtgaagatcgccatcttaactaactctctggcggccaacgatgtggcggtcgttcacgcagggtacgcgcgctggcgcaagaaattactgcgctatggcgtggagctctacgaactgaaaccgacccgcgaacatgaaaccgccgtacatgatcgcggactcaccgggaactcaggttccagcttacatgctaaaacgttcagtattgatggtagtaaggtgtttatcgggtcgcttaattttgatccccgttcaacgcttttaaataccgaaatgggctttgtcattgaaagtgaaacgctggcgacgcttatccataagcgttttacacagagccaacgcgatgcggcctggcaactgcggctggatcgctggggacgaattaactggatcgatcgtcagcaagaagaggaaaaggtgttaaagaaagaacccgctacgcgtttctggcaacgagttctggtacggttggcggcaattttacctgtggaatggttgctgtga

SEQ ID NO: 14229 - protein, 495 aa, Salmonella typhimurium LT2
MMKKLPGFTQDYLLSKATTLPDKTRLERAVEPLCARHPGECGILALDNSLDAFAARYRLTEMAARTLDVQYYIWEDDMSGRLLFSVLLSAAKRGVHVRLLLDDNNTPGLDDTLRLLDSHPNIEVRLFNPFSFRTLRALGYLTDFARLNRRMHNKSYTADGVVTLVGGRNIGDAYFGAGEEPLFSDLDVMAIGPVVNDVANDFERYWRCSSVSTLQQVLSLSEQELTQRIELPESWYNDEITRRYLHKLETSQFMADLDRGTLPLIWAKTRLLSDDPSKGEGKAQRHSLLPQRLFDVMGSPTERIDIISAYFVPTRAGVAQLLNLVRKGVKIAILTNSLAANDVAVVHAGYARWRKKLLRYGVELYELKPTREHETAVHDRGLTGNSGSSLHAKTFSIDGSKVFIGSLNFDPRSTLLNTEMGFVIESETLATLIHKRFTQSQRDAAWQLRLDRWGRINWIDRQQEEEKVLKKEPATRFWQRVLVRLAAILPVEWLL

SEQ ID NO: 14230 - DNA, 1515 bp, Listeria monocytogenes EGD-e
  CDS (1)..(1515): transl_table=11
atgcgcaaactgattcaatttctgtttatagcagtagttttatttttagtggaatatgttttaatcaatcaagcagctatattattcttagtaacaagtgggattatccaactatgcggggttattatcgccattcgactactcctatttgaccaacggaatactagctcaaaagtcgcctgggttgcggttatttttattttgcctgtactcggaacgattagttaccttgtgttcggtagaaatccagcaactagaaaattcagcacagctcaagtaaaggaaaaaacaaaattaattaatgcgattcatgcaattccaaacaacactaatgaaaaattgccacgactatcaaaaagaatagcgcatttaacgtccatagagccaatcaaggggaataaaatcgaaatattaacaaatggtgaggaaacttttccagtgctcctagacgcgcttagaaaggctgaaaaccacattcacattcaatattacattttcaaaacggatgcgatttctactgaaattcgtgatattttggtggaaaaggcgaaatctggtgttgaggttagatttatgtttgatggtctcggatcaagcaaactgggtaaagcctttttagctcctttgaaagaggctggagttagtattcacgcatttgatccaattgcctccccctggattgtaagaacagccaatttaagaaatcaccgtaaaatcgtggtgattgatggccaaattggctttacaggtgggcttaatattggggaagaatatcgttccaatacacctgattttcgtgtttggcgcgatacacacataaaaataacaggccaagctgtaatcgaactccaagaatccttcctaaacgattgggtatacatggaaaatcaagctggcgccgctgacgggtttattagcgaatctggttcaaaacaatatttttctccagtcgatatgggtgatgaatgggctcaagttatttacggcggaccatatgataaagaaaaatgggttcgggattcgatgcttgatttgattgattccgctaaagaatcagtttggattgtatcaccctatttcgttccagatgaggagtcgcttgcggttattcgccgggttgcgatgagtggtgttgacgtgcgggttattattcctggtaaaggcgatcgcgggatttcattccacggaagtaatgcttatgtaaaaacaatgattgaagcaggcgcgaaaatgtatgcttatgccgatgactcttttgttcatgccaaagcaatgcttgtggacggaacacgtgcggctattggaactgccaattttgacgtgcgtagttttagattgaatcatgaattaatggtattcttatatgatgaaagcgaggctatgcatcatttaaaacgtgacttcaaaaaagattttgaagatagccgactatttacgatgaaagatatggaaaacaaaccattattgactcgtataaaagaagttctatccagtttactatcaccaattttataa

SEQ ID NO: 14231 - protein, 504 aa, Listeria monocytogenes EGD-e
MRKLIQFLFIAVVLFLVEYVLINQAAILFLVTSGIIQLCGVIIAIRLLLFDQRNTSSKVAWVAVIFILPVLGTISYLVFGRNPATRKFSTAQVKEKTKLINAIHAIPNNTNEKLPRLSKRIAHLTSIEPIKGNKIEILTNGEETFPVLLDALRKAENHIHIQYYIFKTDAISTEIRDILVEKAKSGVEVRFMFDGLGSSKLGKAFLAPLKEAGVSIHAFDPIASPWIVRTANLRNHRKIVVIDGQIGFTGGLNIGEEYRSNTPDFRVWRDTHIKITGQAVIELQESFLNDWVYMENQAGAADGFISESGSKQYFSPVDMGDEWAQVIYGGPYDKEKWVRDSMLDLIDSAKESVWIVSPYFVPDEESLAVIRRVAMSGVDVRVIIPGKGDRGISFHGSNAYVKTMIEAGAKMYAYADDSFVHAKAMLVDGTRAAIGTANFDVRSFRLNHELMVFLYDESEAMHHLKRDFKKDFEDSRLFTMKDMENKPLLTRIKEVLSSLLSPIL

SEQ ID NO: 14232 - DNA, 1515 bp, Listeria innocua Clip11262
  CDS (1)..(1515): transl_table=11
atgcgcaaactggtccaatttctgtttatagcagtagttttatttttagtggaatatgttttaatcaaccaagcagctatcttattcttaataacaagtggaatcatccaactatgcggggttattatcgcaattcggctacttctgttcgatcagcggaatactagctcaaaagtcgcttggattgccgttattttcattttgccagtgcttggaacaattagttaccttgtgtttggtagaaatccagcaactagaaaattcagtacagctcaagtgatggaaaaagctaaattaattaatgcgattcatgcaattccaaacaacaccaatgaaaaattaccaaggctttctaaaagaattgcgcatttaacgtccatagagccgattaagggaaataaaattgaaatattaacaaatggtgaggaaacttttccagtgctcctagacgcgcttagaaaggctgaaaaccatattcacattcaatattacatttttaaaacggatgcgatttctacagagattcgtgatattttggtggaaaaagcgaaatccggtgttgaggttaggtttatgtttgacggtcttggatcaagcaaactgagtaaagcctttttagctcctttgaaagaagctggagttagtattcacgcatttgacccaattgcctccccttggattgtaagaacagccaacttaagaaatcaccgtaaaattgttgtgattgacggacaaattggctttacaggtggacttaacattggggaagaatatcgctctaatacaccagattttcgtgtctggcgtgatacacacatgaaaatcacaggacaggctgttatcgaacttcaagaatcttttctaaatgattggatttatatggaaaatcaggctggggctgctgatcaatttattagtgaagctggattacaacaatatttttcaccagttgatgtaggtgatgaatgggcgcaagtgatatacggcggaccatatgataaagaaaaatgggttcgtgattcgatgcttgatttgattgattccgctaaagaatcagtttggattgtatcgccctattttgttccagatgaggaggctcttgcggttattcgccgggttgcaatgagtggtgtcgacgtacgggttattattcctggaaaaggcgatcgcgggatttcattccacggaagtaatgcttatgtaaaaacgatgattgaagcaggcgcgaaaatgtatgcttatgccgatgactcttttgttcatgcaaaagcaatgcttgtggacggaacacgtgcggctattggaactgccaattttgacgtgcgaagttttagattgaatcatgaattaatggtattcttatatgatgaaagtgaggctatgcttcatttaaaacgtgattttaagaaagattttgaagatagccgactatttacgatgaaagatatggaaaataaaccattattgactcgtataaaagaagttctatccagtttactatcaccaattttataa

SEQ ID NO: 14233 - protein, 504 aa, Listeria innocua Clip11262
MRKLVQFLFIAVVLFLVEYVLINQAAILFLITSGIIQLCGVIIAIRLLLFDQRNTSSKVAWIAVIFILPVLGTISYLVFGRNPATRKFSTAQVMEKAKLINAIHAIPNNTNEKLPRLSKRIAHLTSIEPIKGNKIEILTNGEETFPVLLDALRKAENHIHIQYYIFKTDAISTEIRDILVEKAKSGVEVRFMFDGLGSSKLSKAFLAPLKEAGVSIHAFDPIASPWIVRTANLRNHRKIVVIDGQIGFTGGLNIGEEYRSNTPDFRVWRDTHMKITGQAVIELQESFLNDWIYMENQAGAADQFISEAGLQQYFSPVDVGDEWAQVIYGGPYDKEKWVRDSMLDLIDSAKESVWIVSPYFVPDEEALAVIRRVAMSGVDVRVIIPGKGDRGISFHGSNAYVKTMIEAGAKMYAYADDSFVHAKAMLVDGTRAAIGTANFDVRSFRLNHELMVFLYDESEAMLHLKRDFKKDFEDSRLFTMKDMENKPLLTRIKEVLSSLLSPIL

SEQ ID NO: 14234 - DNA, 1443 bp, Nostoc sp. PCC 7120
  CDS (1)..(1443): transl_table=11
atgctgatagacagtagcgtccttgctttttttagcgcagctacagttgttattcatggtttgggaattgcccatgctgcccatgccgtgatggatgtgcgttcttctcgtggggcgatcgcttggagtatttccttaatcacttttccctggctgactattcctttatattggatcttaggcagaactaagtttcatggatattctgaagctatccgctcagtttacgcccaacattatcaatttgttcgtcaaacttatattgagattacaaaatttcaggtggtagtttcggcaaaattggaaccattgcaactattagctgaggccttcattggtattccttttacatctggtaataatgccaaattactaattaatggtcagcaaacttatgcagccatgttgagtgcgatcgcatctgccaatagttatattttgctgcaatcctacattgttgttgatgacaaagctgggaatgagtttaaagatgctctaattgccaaggcaaagcaaggaataagagtttacttaatttatgatgaaattggttctaataaaatctctcgcctttatgttaaatctctgcaaaaatatgatattcaagtgagtgcatttcatactaccagaggcagaggtaatcgttttcaattaaatttccgcaaccatcgcaaaattttagtagttgatgggagaactgcgtttattggtggtttgaatattagtgatgaatatctaggtaaaaatcctcgcctgagtccttggcgtgatacccacatgatgttagaaggccccactgtccaaagtctgcaaggatgttttttgcaagattggtattgggcgactcgtcaagttatcgatgtaaactggcaagtgcaacccaattgggaaagtgactacacagcattggtatttcctacaggccccgcagataagctgaaagcttgtaaactgtttttcgtcagcgctatcaatcaagcacaaactcgtctctggattgctactccctattttgtgccggatgattccactttgacagccttgaaattggcagcactacgcggcgtggatgtgcgaattattttaccaaatcgacccgatcatttacttgtgtacttgtgttccttttcttattacacagagatgaaggcaacgaatattaaattatatcgatataaacatggatttatgcaccagaaggtaatactgattgacaaagaaatggcaggtgtgggaacagttaatctagataatcgctcattctttctcaattttgaagttatgggttttgttgccaattctcagtttgtgaaaagtgtggaggagatgttacaagctgatttaaaggctgctttggctgtggatttttctgattatgagaggaaatatttgtggtttaagttagctgtgagaatatctagtttgttgaaacctttgttgtga

SEQ ID NO: 14235 - protein, 480 aa, Nostoc sp. PCC 7120
MLIDSSVLAFFSAATVVIHGLGIAHAAHAVMDVRSSRGAIAWSISLITFPWLTIPLYWILGRTKFHGYSEAIRSVYAQHYQFVRQTYIEITKFQVVVSAKLEPLQLLAEAFIGIPFTSGNNAKLLINGQQTYAAMLSAIASANSYILLQSYIVVDDKAGNEFKDALIAKAKQGIRVYLIYDEIGSNKISRLYVKSLQKYDIQVSAFHTTRGRGNRFQLNFRNHRKILVVDGRTAFIGGLNISDEYLGKNPRLSPWRDTHMMLEGPTVQSLQGCFLQDWYWATRQVIDVNWQVQPNWESDYTALVFPTGPADKLKACKLFFVSAINQAQTRLWIATPYFVPDDSTLTALKLAALRGVDVRIILPNRPDHLLVYLCSFSYYTEMKATNIKLYRYKHGFMHQKVILIDKEMAGVGTVNLDNRSFFLNFEVMGFVANSQFVKSVEEMLQADLKAALAVDFSDYERKYLWFKLAVRISSLLKPLL

SEQ ID NO: 14236 - DNA, 1269 bp, Ralstonia solanacearum GMI1000
  CDS (1)..(1269): transl_table=11
atgaaggtcgcgcgcgatgccgggccgttgcgttcggagtggcggcggggcaagcccctgccgggcaaccggatcgacctgctgcacggcggcgccgcgttctttcccgcgctgatcgaagccatcgatgccgcgcgccgccgcatcgcgctggaaacctacatctatatcgacgacgacaccgggcgccgcgtgaccgaggcgctggcgcgcgcggcgcggcgcggcgtggacgtgcgcgtcaccgtggacggctttggtaccggcacgctgcccgccggcatcgcggcgatgctggatgcggccggcgcggcctggcgggtgtaccggccggtgcgcggctttcgcctgcagcgccgctacctgcgccgcctgcatcgcaaggtcgccgtgatcgatgacgaggtggcgttcgtcggcggcatcaacatcatcgacgacctgaaccacaccccgttccgcgacgacgcactgggtgcccgctatgacttcgccgtgcgcgtgcgcgggccgctggtcggccagatcgcgctgatggtcgaccggctgtggtggcagacgggcctgctcgccggcgtgcgcgaggtgggcgtgaccggcgtggccgccgagtttccggtgatgaccgacacgcccaagccggggcggcgcggtgcctcggggacgcagcacgatcaggcgccggacaacgtgctggcgtcgctggtgctgcgcgacaacgtgcgcaaccgccgcgccatcgagcgcgagtacctgcgcgcgctgggcacggcgcggcacgaggtgatcatcgccaatgcctatttcctgccgggcgtgcgcttcatgcgcgcgctggccgcgtgccggcgccgcggcgtgcgggtgcgcatgctgctgcagggccatgtcgaatatgcggtgcagcattacgcaacgcgttcgctgtatcacatgctgctgcgcgacggcgtggagatccacgaatacacggccagcttcctgcacgccaaggtcgcggtcgtggatgggcgctgggcgacggtgggttcgagcaacatcgatccgttcagcctgctgctggcgcgcgaagccaacgtggtcgcctgggacgcgggggtcgccgggcagctgcgcgccgcgctggaagacgccattgcgcgccatgcgcggccgatcctcgccgatgcgcatgcggcccggccctggtggtggcgcgtggtcgactggtgcgcgtatcggctggtgcggctgggcgtcgtcatcagcggccgcgcggcgcactactga

SEQ ID NO: 14237 - protein, 422 aa, Ralstonia solanacearum GMI1000
MKVARDAGPLRSEWRRGKPLPGNRIDLLHGGAAFFPALIEAIDAARRRIALETYIYIDDDTGRRVTEALARAARRGVDVRVTVDGFGTGTLPAGIAAMLDAAGAAWRVYRPVRGFRLQRRYLRRLHRKVAVIDDEVAFVGGINIIDDLNHTPFRDDALGARYDFAVRVRGPLVGQIALMVDRLWWQTGLLAGVREVGVTGVAAEFPVMTDTPKPGRRGASGTQHDQAPDNVLASLVLRDNVRNRRAIEREYLRALGTARHEVIIANAYFLPGVRFMRALAACRRRGVRVRMLLQGHVEYAVQHYATRSLYHMLLRDGVEIHEYTASFLHAKVAVVDGRWATVGSSNIDPFSLLLAREANVVAWDAGVAGQLRAALEDAIARHARPILADAHAARPWWWRVVDWCAYRLVRLGVVISGRAAHY

SEQ ID NO: 14238 - DNA, 1557 bp, Agrobacterium tumefaciens str. C58
  CDS (1)..(1557): transl_table=11
gtgactgcatttacggtcttcatcatcattcttctcatgctcattgggccgagcctgttcgtcgtcatcggcaaacagcgggaaaaagccattcccaaacgcccctccaccgctctgccggttaccgaagacgaaacggcgctggaccggcactggcaatcgatcagaaacggctggaacgagaagaatgcactctgcctcttacattccaacctcgatgcctttgccgtgcgtgtggcggcggcgcgggccgccgggcgcagcctcgatctcatgtattacatgtggaatgccgacctgaccgggcggctgatgatgcgcgaggtcatcgccgccgctgatcgcggcgtgcgggtgcggctgctgctcgatgatctcggcgtctccatgtcagaccgcatcttccatgccatcgacagccaccccaatatcgaactccgcctgttcaatcccacccgggcacgggaaaacatcctgcatcgcagcctcgaactggtgctgcgctttcgaagcgtcaaccggcgcatgcacaacaaggcatggattgccgatggccgcgccgtgatcgtcggcggccgaaatattggcgacgcttacttcgacgccgccgaacgggcaaatttccacgatttcgacattctcggtttcggcgggatcgttgccgacgccaccgaaatcttcgacgattactggaacagcgccgtttccgtgccagtacgctcgctgctggcgcgccgaccgaacaaacttgccaaactgcggcgcgaactggacgccctgccgcaaagcgaagccgcgagaccctatctggagcgggtggagagccaatatggtcgtgatcatttcctgatgtcggaccgcctgcactgggtcgatacggcagatgtgcttgccgatccgcccgaaaaagcggcgggaaaacgccgcaagggccataatttcctgatggaaagcctattgccgctgatgcaggcggcgggagagagcctgcacattacttctccctatttcattcccggtaaacagggtgtggagatttttctcgatctcgccgaacgcggcgtgtcgctcgccatcctcaccaattcactggccgcaaccgatgtcgccgccgttcacgccggttatgcgcgttaccggaaaccgcttctctccggcggggtacgtttgcatgaattgcgttcgcaggcggatcagggcagcttcaccctgcgcggttcgggacaggcaagcctgcacaccaaggccttcacccgcgatggcgagaccggctatatcggctcactcaatttcgatccccgctccgcctcgctcaatacggaaatgggcgtggtgttcaattcagccccgctggtggcccgcatggacgagatattcgccgaagaaatccgccgcacgatgagcttcgaacttgatatcgacagcgccaaccgtatcgtctggatgacggaagaacgggggcagccaaagatctaccggcgcgaacccgacgcggcgatcagccgccggatcatcgccggcatcatgcgtgtcctgccgcttgaatctcagctttga

SEQ ID NO: 14239 - protein, 518 aa, Agrobacterium tumefaciens str. C58
MTAFTVFIIILLMLIGPSLFVVIGKQREKAIPKRPSTALPVTEDETALDRHWQSIRNGWNEKNALCLLHSNLDAFAVRVAAARAAGRSLDLMYYMWNADLTGRLMMREVIAAADRGVRVRLLLDDLGVSMSDRIFHAIDSHPNIELRLFNPTRARENILHRSLELVLRFRSVNRRMHNKAWIADGRAVIVGGRNIGDAYFDAAERANFHDFDILGFGGIVADATEIFDDYWNSAVSVPVRSLLARRPNKLAKLRRELDALPQSEAARPYLERVESQYGRDHFLMSDRLHWVDTADVLADPPEKAAGKRRKGHNFLMESLLPLMQAAGESLHITSPYFIPGKQGVEIFLDLAERGVSLAILTNSLAATDVAAVHAGYARYRKPLLSGGVRLHELRSQADQGSFTLRGSGQASLHTKAFTRDGETGYIGSLNFDPRSASLNTEMGVVFNSAPLVARMDEIFAEEIRRTMSFELDIDSANRIVWMTEERGQPKIYRREPDAAISRRIIAGIMRVLPLESQL

SEQ ID NO: 14240 - DNA, 1479 bp, Agrobacterium tumefaciens str. C58
  CDS (1)..(1479): transl_table=11
gtgctctatagtcttatcatgctcgatctcgtcattgcctattggccgcatatccttgccgttctctccatcttgatgggtaccgtggcggccgtgcatgccacgatgacgaaggaggaggtgcgttccgcgctgggctgggtgggcgtcatcgtgctgtcgccgatcgtcggcgcggtcatctacgccatcgccggcatcaaccgcattcgccggtcgaacatcacgcagcagcggtccttcatgctggacgagatcatggatcgcgtggcgcgcctcgatgccagcaacgatatgatcgcgacgcgtttcggccgccgtttcgaggcgatgaagacgcttggcgaccgggtgacgcgccacgcgctgacgaccggtaacggcatcgagccgctggtgagcggggatgtcgcctatgccgccatgctggaggcgatcggggaggcgaagcggtcgatcattctcgaaacatatattttcgataatgaccggatcggcgcccgtttcgtcgcggcgcttgaaagggcgaagctgcgtggcgtggaggtgagggtgctcatcgatgcggtcggcgcccgttattcggttccgagcatcctgccgacactcagggataaggacatcgttgccgatgtcttcaacggcaatgtcatcatggggctgcggctgccctatgccaatctgcgtacccaccgcaagatcctcgtggtggacggacgtatcgccttcagcggcggcatgaatatccgcgagggtttcaccctggaattcggtggcgaaagccagtcgcacgacacccatttcaagattaccgggccggtggtctccgattttttctccatcgctgcggaggactggcgcttcacgacgggggaggttctcgacgcaccggtctgggatatcgccattcccgatggcgtgccggggtcgcaaatcgttgcccgcgtctgctcctcggggccggacaaaagcatcgagaccagtcacaagatgctgatgggggccttttcggtggcgcgttcctccattctcatcatgtcgccctattttctccccgatcgggagcttatttcggcgctcattaccgcagcaaggcgggggtgcgtggtggatatcatcgtgccgaaaagcaacaatctggtgcttgtcgacagggcgatgacggcgcagttcgaccagatgctgaagaattattgccgcatctggcgggcgaccggggctttcaatcattccaagcttctggtgatcgacgggcgctggagctatattggctcctccaatctcgatccgcgatcgctgcggttgaacttcgagatcgatctcgaagtcatggacgaagaatttgccggggcgatcggagatcgtatccggaatgcgcgtgcaactgccttgcccgtccggctcagcgaactgaatgctcggccattcgttgtccgttttgtggagcgtgtgctgtggctcgcttcaccctatctttag

SEQ ID NO: 14241 - protein, 492 aa, Agrobacterium tumefaciens str. C58
MLYSLIMLDLVIAYWPHILAVLSILMGTVAAVHATMTKEEVRSALGWVGVIVLSPIVGAVIYAIAGINRIRRSNITQQRSFMLDEIMDRVARLDASNDMIATRFGRRFEAMKTLGDRVTRHALTTGNGIEPLVSGDVAYAAMLEAIGEAKRSIILETYIFDNDRIGARFVAALERAKLRGVEVRVLIDAVGARYSVPSILPTLRDKDIVADVFNGNVIMGLRLPYANLRTHRKILVVDGRIAFSGGMNIREGFTLEFGGESQSHDTHFKITGPVVSDFFSIAAEDWRFTTGEVLDAPVWDIAIPDGVPGSQIVARVCSSGPDKSIETSHKMLMGAFSVARSSILIMSPYFLPDRELISALITAARRGCVVDIIVPKSNNLVLVDRAMTAQFDQMLKNYCRIWRATGAFNHSKLLVIDGRWSYIGSSNLDPRSLRLNFEIDLEVMDEEFAGAIGDRIRNARATALPVRLSELNARPFVVRFVERVLWLASPYL

SEQ ID NO: 14242 - DNA, 1479 bp, Brucella melitensis 16M
  CDS (1)..(1479): transl_table=11
ttgcttaaagtttgctggatgcttgatctcgtttcccattattggccgcacattctgtttgtcctgtcgatcgttctcggagcgattgccgccattcatgcgacgatgaccaaggaggaagtgcgcacggccattggctgggtcggcgtgatcgtgctgtcgcccatcgtgggggcggttgtctatgcgattgcgggcgtcaaccgtatccggcgttcgacactgagctatcagcgcgccaatctcagcaatatcgcgctctaccacctctcgcatttcgacacgacgaacgaccgggtgcgggccgctttcgggcggcagttcggcgcgatgaaaattctgggcgatgcggtgagcctttatgattttaccagcggcaacactattgaaatgctggaagcgggtgatgaagcctatgccgcaatgcttggcgccataggccgggccgagcgcagcattgtgctggaaacctatattttcgaccatgacgccattggtaaaaaatttgccgatgcgcttggcgatgcggtgcagcgcggcgtggaagtgcgggtgctggtggatgcggtgggcgcgcgttattcctttccaagcattgtgaagcttttgaaagaaaagggcgtcaaggtcgctgtgttcaacggcaatatcatcatcggcctgcgtctgccctatgcgaacctgcgcacccaccgcaagatgctgattgtcgatggtcagactgcctttaccggcggcatgaatattcgcgccgggtttgtgagggctatcgcaggcgatgcggttgccttcgatacacatttcaaactcgaagggcctgccattgccgacctcttccatattgcctcggaagactggcgttttgcgaccggcgagcttttgacgggcgaagcctggagcatcgcgccaccggaaaatccacccggaacgggaacgctggtgcgtgtcgtcgggtcagggccggacaagaacctcgaaacgaaccatcgcatgatgatgggggcgttttcgattgcccagcagcatattctcatcatgacgccctatcttttgccggaccgcgaattgataagtgcgctggtgacggcggcacggcgcggcgtatcggtcgatatcgtggtgccgggtgtcaacaatctgaagctggtggaccgcgccatgcgcgcccagtttgatcagcttttgcgggacggctgccgcatctggcgtgctggcggggccttcaatcactcaaagctcatgaccatcgatggcgcctggtcctatgtcggctcgtccaatatcgatccgcgctcgctgcggctcaatttcgaggtcgatcttgaaatcctcgaccgggatgtggcacggcaggtggaagagcgtatcggacgggtgatcgagaaaagccgtgaggtcaaccttgtgcgcctgaagaaccgcccttttctggagcggctgcttgacaggatcatctggctcggctcaccttttctttga

SEQ ID NO: 14243 - protein, 492 aa, Brucella melitensis 16M
MLKVCWMLDLVSHYWPHILFVLSIVLGAIAAIHATMTKEEVRTAIGWVGVIVLSPIVGAVVYAIAGVNRIRRSTLSYQRANLSNIALYHLSHFDTTNDRVRAAFGRQFGAMKILGDAVSLYDFTSGNTIEMLEAGDEAYAAMLGAIGRAERSIVLETYIFDHDAIGKKFADALGDAVQRGVEVRVLVDAVGARYSFPSIVKLLKEKGVKVAVFNGNIIIGLRLPYANLRTHRKMLIVDGQTAFTGGMNIRAGFVRAIAGDAVAFDTHFKLEGPAIADLFHIASEDWRFATGELLTGEAWSIAPPENPPGTGTLVRVVGSGPDKNLETNHRMMMGAFSIAQQHILIMTPYLLPDRELISALVTAARRGVSVDIVVPGVNNLKLVDRAMRAQFDQLLRDGCRIWRAGGAFNHSKLMTIDGAWSYVGSSNIDPRSLRLNFEVDLEILDRDVARQVEERIGRVIEKSREVNLVRLKNRPFLERLLDRIIWLGSPFL

SEQ ID NO: 14244 - DNA, 1443 bp, Clostridium perfringens str. 13
  CDS (1)..(1443): transl_table=11
attataaactatacaacaacatttttatacttggcatttataattaatgtaatcttgtctgtcataattgtggtactagaaagaaaacaaccggaaaaaacaatagcatggttactaatactaactctattgcctcctataggattaatactttatatattcttaggacgtaattggaaaagaaataaacttaatgatagggttaatcctgagattaatgagttaataaatcctattttagatgaatatcctgaaaaacaatatgtacctttaatggagcttttagcttttaacagtgattctcctatctttgttaataatgatataaagatatataaggatggtgttgaaaagtttaaagatttaaaagaggaacttcttaaggctaagcatcatattcatcttgagtactatatagtaaatagtgatgaaataggtaatgaaattaaagatatattgataaagaaagctctagaaggagttaaggttagatttattattgataaagttggttcaagcagcttaaaaagaagctacattaaagatttaaaaaaagcaggaatctcagttattatgtattcatacttcttagcaccccttcttaaagtaataaatactcaaattaactatagaaatcatagaaaaatagttgttatagatggtcaagttggttttttaggtggtattaatataggagatgaatatttaggaagaaacaaaaagtttggttattggagagatactcacataatgattaaaggtgattttgttttagcactacaagcagttttcctagatgacttcataaccatagaaaaagctaataatagttatactttttatgataaagaatttgataaatattttcctgaaaatatagttgctaaggaaagagttttaatgcagttagttaaaagcggacctgattcaacatttcctgcaataatgcaaagcgttttaaaaatgattatgactgcaagggaaaatatttatataactactccttattttgtacctccatcaagcataatagaagctcttagaatagcttctttaagcggggttgatgtaaagattatttttcctgaaaaatcagatcactttatggtaaataaggcatctaaaagttatttagccgaacttatggattgtggaattgaagtttatttttatgataaaagttcttttatacattctaaaacaatgacaatagatggaaaaatatgtactttaggaacagctaatatggacatacgtagttttgaacttaattatgaaataaatactgttatatatgataaggaaataacatgtaagttagatgccttattttttgaagatttacttaagtctagacattttaaaattgaagaatatgaaaaatcaactaagtttgataagtttatagagggatttgctagaattttctcatcattattataa

SEQ ID NO: 14245 - protein, 480 aa, Clostridium perfringens str. 13
MINYTTTFLYLAFIINVILSVIIVVLERKQPEKTIAWLLILTLLPPIGLILYIFLGRNWKRNKLNDRVNPEINELINPILDEYPEKQYVPLMELLAFNSDSPIFVNNDIKIYKDGVEKFKDLKEELLKAKHHIHLEYYIVNSDEIGNEIKDILIKKALEGVKVRFIIDKVGSSSLKRSYIKDLKKAGISVIMYSYFLAPLLKVINTQINYRNHRKIVVIDGQVGFLGGINIGDEYLGRNKKFGYWRDTHIMIKGDFVLALQAVFLDDFITIEKANNSYTFYDKEFDKYFPENIVAKERVLMQLVKSGPDSTFPAIMQSVLKMIMTARENIYITTPYFVPPSSIIEALRIASLSGVDVKIIFPEKSDHFMVNKASKSYLAELMDCGIEVYFYDKSSFIHSKTMTIDGKICTLGTANMDIRSFELNYEINTVIYDKEITCKLDALFFEDLLKSRHFKIEEYEKSTKFDKFIEGFARIFSSLL

SEQ ID NO: 14246 - DNA, 1536 bp, Clostridium perfringens str. 13
  CDS (1)..(1536): transl_table=11
atggaaaagtttctgaaaaaactactaagtagagcatttatagttggatttcttatattcatacagtttgttatacttatgggggcaatatggaaagtaagcgaagatttcatatatgtgtattttctgtttatctttattagtatagtagtatttatttatattgttagtagaaaagataatccatcctataaattagcatgggcagttcctgtattattagttcctgtctttggaggattattttatttaatatttgggggaaataagacaagcaaaaagtttagaaaacaaataaaagcttcttatgatgaaacggcacacttattatatgatgatagaacagttttagaggagctagaaaacttagataaaagcatagctaatcaatcaaggtacatagctgattactctcagtttccagtatataaaaatactacaactgagtatttatctcctggagaggtattttttgaaaggttaaaggaagagttaaaaaaggcaaagcactacatatttatggaatatttcatagtacatgaaggagttatgtggaactctattttagaaatattagaggaaaaggttaaagaaggggtagaggttagattcgtttatgatgatatgggatgcttaggaactttaccatataagtataatgaagttttagaggctaagggaattaaatgtatggtatttaatccttttgtgccccttttatccttaagaatgaataaccgtgatcatagaaaaataactgttatagatgggcatactgggtttactgggggaataaacttagctgatgaatacataaatgaaattgttagatttggacattggaaggatgcctccataatgataaagggggatgctgtttggaatttaacagttatgtttcttcaaatatggaatttctatagtgaaggaaaagagcaatatgaaaaatattacccatattttcatcatgaagatgaatttgaaagtgatggatatgttcagccctatggagatagtcctttagatgatgaaatagtaggggagaatgtatatttaaatattataaataaggcaaaggactatgtttatataaatactccataccttattattgataatgagcttgttacagcgcttactcttgctgctaaaagtggaatagatgttagaatagttactcctcacattgaggacaaatggtatgctcatatagttacaagggcctattatcctcagcttatagaatctggtgttaagatatatgaatatactccaggatttattcactcaaagacctttgtctctgatgatgaaataggaatagtaggtactataaatatggattatagaagtttataccttcactttgaatgtggagtttggttatataaaactaaatcagtaggacagataaaggatgatttcttaaaaactttagaaaaatgtcaaagaataactttagaagattgtgctaaggttaaagttcctactagaattttaagatctataataagagtatttgctccacttatgtaa

SEQ ID NO: 14247 - protein, 511 aa, Clostridium perfringens str. 13
MEKFLKKLLSRAFIVGFLIFIQFVILMGAIWKVSEDFIYVYFLFIFISIVVFIYIVSRKDNPSYKLAWAVPVLLVPVFGGLFYLIFGGNKTSKKFRKQIKASYDETAHLLYDDRTVLEELENLDKSIANQSRYIADYSQFPVYKNTTTEYLSPGEVFFERLKEELKKAKHYIFMEYFIVHEGVMWNSILEILEEKVKEGVEVRFVYDDMGCLGTLPYKYNEVLEAKGIKCMVFNPFVPLLSLRMNNRDHRKITVIDGHTGFTGGINLADEYINEIVRFGHWKDASIMIKGDAVWNLTVMFLQIWNFYSEGKEQYEKYYPYFHHEDEFESDGYVQPYGDSPLDDEIVGENVYLNIINKAKDYVYINTPYLIIDNELVTALTLAAKSGIDVRIVTPHIEDKWYAHIVTRAYYPQLIESGVKIYEYTPGFIHSKTFVSDDEIGIVGTINMDYRSLYLHFECGVWLYKTKSVGQIKDDFLKTLEKCQRITLEDCAKVKVPTRILRSIIRVFAPLM

SEQ ID NO: 14248 - DNA, 1458 bp, Clostridium perfringens str. 13
  CDS (1)..(1458): transl_table=11
atgatttttacttttttctctaatttagttcatattgtaaatttattaactattttttatatgatttttaaagagaatcgttcttctaagagtataatttcttggacattagtattaattatattaccatacataggttttattctatttttaatcttaggaagaaaagttaatactaaagatatttttataatgaaaaaatctgaacttactctctttgataaatatataaaaaaattaaaaagtgctgataattcaaatgatgatttaaaaagagccaagcattctgatatgattaaagctattgaaagtatggagtactcaccttatagaaaagatgtggaaactaaagtattttttgatggtaaggaattatttgatgatattttagaaagcttaaagaaagcacaaaaaagcataaatatagaattttacatatttaaaaatgatgatattggttcaaaagtcttagatattcttaaagaaaaagctaaatctggcgttgaagtaagattattatatgactctgtaggaagtagaactaccaatagaaaaaaacttcagtctgcaattgatgctagtgtaaaagttggtgaattcttcccttccctacttagattaataaacataaacatgaactttagaaaccatcgtaaaataatagttatagataataaagtaggctatgttggtggctttaatgtaggagatgaatatttaggtaaagatcctaagtttggttactggagagatactcatataaaattcatgggtgactcagtaagagacttagatttaagattttgggctgattggagatatgctactaaggaagatattgatttaagccacttaatagattataaaaatgaacaagccccttctacaatggctaattattcaaagtgtggtatgcaaataatatctagtggccctaaccctgataacttttatgaaatcaaattatcatatttagaaatgattcaaaaagctaaaaaatatatttatatacaatcaccatacttaattttagataacagcatatctgatagtttaaaacttgcatctatttctggagttgatgtaagaataatgatacctggtaaaggtgatcacccctttgtttattgggcaaatctaaaatacgctggagatttactaaactttggagtaaaaatatatcattatgacaaaaatgctttccttcactctaaaaccttagttatagatgatgaagtatgttcaataggaactgccaatatggatacaagaagctttgaactaaactttgaagtaattgctatgctatactcagatgaaatagcaaaaatacaacgtaaacagtttgaaaaggacatgcttatttcaaaagaattgactaggaaagactatcttaagagaggaacttctgttaaaattaaagaatcattttcaaagctcttctcagctttactttaa

SEQ ID NO: 14249 - protein, 485 aa, Clostridium perfringens str. 13
MIFTFFSNLVHIVNLLTIFYMIFKENRSSKSIISWTLVLIILPYIGFILFLILGRKVNTKDIFIMKKSELTLFDKYIKKLKSADNSNDDLKRAKHSDMIKAIESMEYSPYRKDVETKVFFDGKELFDDILESLKKAQKSINIEFYIFKNDDIGSKVLDILKEKAKSGVEVRLLYDSVGSRTTNRKKLQSAIDASVKVGEFFPSLLRLININMNFRNHRKIIVIDNKVGYVGGFNVGDEYLGKDPKFGYWRDTHIKFMGDSVRDLDLRFWADWRYATKEDIDLSHLIDYKNEQAPSTMANYSKCGMQIISSGPNPDNFYEIKLSYLEMIQKAKKYIYIQSPYLILDNSISDSLKLASISGVDVRIMIPGKGDHPFVYWANLKYAGDLLNFGVKIYHYDKNAFLHSKTLVIDDEVCSIGTANMDTRSFELNFEVIAMLYSDEIAKIQRKQFEKDMLISKELTRKDYLKRGTSVKIKESFSKLFSALL

SEQ ID NO: 14250 - DNA, 1503 bp, Corynebacterium glutamicum ATCC 13032
  CDS (1)..(1503): transl_table=11
atgatctttcagatcaacctcgaatcttggcaaaccgttggtttgatcatcgactacaccatcaaaatcatcgccattggctacgtacccgaaggacgccgacccagctcctccaccgcgtggctcctggcaattttgctgctcccctacgtcggactcccactgttcctgcttatgggatcgccatacatcaaccggcgacgccaccgcatccaacaagaaatcaacgacctcatcgaagacgtccacgacgacgtccccgacatccccaccggaatggatgtctccgcggaagttgaatctgtcatcaaactcaaccgccgcctcacccgcatgccagcagtgaccggcggaaacaacggcttctactccgactaccgtgaatccctcaaacggatgaccgccgcaatcgacgaagccgaagaatacatctacgtcgagatctacatcatggcctgggattcctacacccaaccattcttcgcagcactcgaacgagcccacaaccgcggcgtcaaagtccgactccttttcgaccacgtcggcagctggaaataccccggctaccaccgcctcaaaaaagaactcaaccgcatgggcttcgcctggtacctcatgctccccctccaaccctggcgacgccgcttccgccgacccgacctgcgcaaccaccgcaaaatgctcatcatcgacggccacaccgcattcatgggctcccaaaatctcatcgccccgagttacctacaaaagaaaaacatcaaactcggccgcgaatggaaagacctcatggtcgaactcaccggccccatcgtctcctccatggaaatgatcttcgccggcgactggtacgtcgaatccaacgaagccctcgacatccgcgaccacgcagaagcccacggctacatcggcaacactcaaaaagactccgccaccaacctcgtgcagctcatcccctccggccctggttacaccacagaacccaacctgcgcatgttcaactccatcgttcaccacgccaaagaacgactcatcttgtgcagcccctacttcatccccgacgaatccctcctcgaagccgtcacctcagcctgctaccgcggagtaaccgtcgaactattcgtctctgaacaagccgaccaattcgccatcgaccacgcccaatcctcctactaccaggcactccttgaagccggcgtgaaaatctaccaattccccaaacccgacgtcctccacaccaagtacatgatcgccgaccccgacgacaccaccggcaacgaagccctcggagtcctcggatcctccaacctcgacatccgcagctttggcctcaactacgaaatctccctgatgatcgccaaaggcaacctcatccacgaactcaacgccctcaccgaccgttaccgcacagtaagtttcaagctcaccttggataagtggaaccagcgcagttggcggcgccgctacgtggacaatgtcatgcgtttgacctcggcgctgcagtag

SEQ ID NO: 14251 - protein, 500 aa, Corynebacterium glutamicum ATCC 13032
MIFQINLESWQTVGLIIDYTIKIIAIGYVPEGRRPSSSTAWLLAILLLPYVGLPLFLLMGSPYINRRRHRIQQEINDLIEDVHDDVPDIPTGMDVSAEVESVIKLNRRLTRMPAVTGGNNGFYSDYRESLKRMTAAIDEAEEYIYVEIYIMAWDSYTQPFFAALERAHNRGVKVRLLFDHVGSWKYPGYHRLKKELNRMGFAWYLMLPLQPWRRRFRRPDLRNHRKMLIIDGHTAFMGSQNLIAPSYLQKKNIKLGREWKDLMVELTGPIVSSMEMIFAGDWYVESNEALDIRDHAEAHGYIGNTQKDSATNLVQLIPSGPGYTTEPNLRMFNSIVHHAKERLILCSPYFIPDESLLEAVTSACYRGVTVELFVSEQADQFAIDHAQSSYYQALLEAGVKIYQFPKPDVLHTKYMIADPDDTTGNEALGVLGSSNLDIRSFGLNYEISLMIAKGNLIHELNALTDRYRTVSFKLTLDKWNQRSWRRRYVDNVMRLTSALQ

SEQ ID NO: 14252 - DNA, 1440 bp, Fusobacterium nucleatum subsp. nucleatum ATCC 25586
  CDS (1)..(1440): transl_table=11
atgcaagatatttctaaaattttattaacattagtacaactttttttacagtatgtttgggtggcaaatttattttttatcattgttattattatgatagagaaaaaaaatccattgtatacaattttatggatatttttattaacgcttgtgccttatgttggattttttatttatttattctttggtttaacttttaagaaaaaaagagttgcaaataaaatttataaaataaaaaaattaaaaagtagaaaagatgtttctaaatctgataatgaagaattaaaaagatggaagggacttataacttatcttgaaatgagtactgataaccatatttcttctaataatgatattcaagtttattttactggtgaagatttttttcctgaattaaaaaaagaaatagctaatgcaaaaaaatttataaatatggagtactttatttttcaatttgatggtataggaaaagaaatagcagatttattaattgaaaaagctaaggaaggagtagaagtaaatttaataatagatggagttaatttggccaattttagattaaaacaatattttaagaatactggagttaatttacatctattttttagaacatatattccaatatttaatatcagattaaattatagaaaccatagaaaagttacaataatagataatagaattgcctttgttggtggaatgaatataggagatgaatatttaggtaaaggaaaaatcggttattggagagatacttcagtaaaaatttatggagatatagtttcatcttttgaaaaagaattttatttttcattaagtatagtaaaaaatgaatttttaaaagatgagaaattttcaaatgaaatttccttaaaatatgaagaagatgaaggtatttatatgcaacttataagttcgggacctaattatgaatttccagctataagagataattatataaaacttattcaagaagctagaaaatctgtatttattcaaacaccttattttgttcctgatgatttattattagatacattgaaatcagctgttttatcaggtatagatgttaaaattatgatacctaataaagctgatcacccatttatttattgggttaatcaatattatgtttgggaacttttaagattaggggcgaatatttatagatatgaaaatggttttatacattctaagactatattagttgatgaagaagtagtttcagttggaacttgtaattttgattatagaagtttttatctaaactttgaaattaatttaaatatctataataaagaagttgctaattcttttaaagcacaatactacaaagatattacaatatccaaaaaattaacatttgctgattttaaaaagagaagtatttttacaaaagtgaaagaatcagtatttagattactatcacctataatgtag

SEQ ID NO: 14253 - protein, 479 aa, Fusobacterium nucleatum subsp. nucleatum ATCC 25586
MQDISKILLTLVQLFLQYVWVANLFFIIVIIMIEKKNPLYTILWIFLLTLVPYVGFFIYLFFGLTFKKKRVANKIYKIKKLKSRKDVSKSDNEELKRWKGLITYLEMSTDNHISSNNDIQVYFTGEDFFPELKKEIANAKKFINMEYFIFQFDGIGKEIADLLIEKAKEGVEVNLIIDGVNLANFRLKQYFKNTGVNLHLFFRTYIPIFNIRLNYRNHRKVTIIDNRIAFVGGMNIGDEYLGKGKIGYWRDTSVKIYGDIVSSFEKEFYFSLSIVKNEFLKDEKFSNEISLKYEEDEGIYMQLISSGPNYEFPAIRDNYIKLIQEARKSVFIQTPYFVPDDLLLDTLKSAVLSGIDVKIMIPNKADHPFIYWVNQYYVWELLRLGANIYRYENGFIHSKTILVDEEVVSVGTCNFDYRSFYLNFEINLNIYNKEVANSFKAQYYKDITISKKLTFADFKKRSIFTKVKESVFRLLSPIM

SEQ ID NO: 14254 - DNA, 1188 bp, Streptomyces coelicolor A3(2)
  CDS (1)..(1188)
atgaccgtcgttgaaccgactcccggtgccgaccgggtcagcatccaacggctgcgtcgccgtttggaaaggctgatcggtgtcgccgccaccgaagggaacgaactcgtcgcgctgcgcaacggcgacgagatcttccccgccatgctgggggcgatccgggcggccgagcacacgatcgacatgatgacgttcgtgtactggcgcgggcagatagcccgcgacttcgccgccgctctcgccgaccgggcccggtcgggagtacgggtccggctgctgctggacggcttcggcgccaaggagatcgaacaggacctgctggacgctatggaggccgcgggagtacagatcgcctggttccgtaaaccgctgtggctgtcgccgttcaagcagaaccaccgctgccaccgcaaggccctcgtcattgacgagcacactgccttcaccggaggcgtcggcatcgccgaggagtggtgcggcgacgcccgcggccccggcgagtggcgcgacacccacgtccaggtgcgcggcccggccgtggacggcgtcgccgccgccttcgcccagaactgggccgagtgccacgacgagttgtacgacgaccgggaccggttctccgatcacacccagcccggcacatccatcgtccaggtggtgcgcggttcggccagcttcggttggcaggacatgcagaccctcatccgcgtcatgctcacctccgcggagcaccgcttccgcctggcgaccgcctacttcgccccggatacatacttcatcgacctgctctgcgccaccgcccggcgcggtgtcacggtggagatcctgctccccggcccgcatacggaccagcgggcctgccaactggccggccagtaccactacacccgtttgctggacgccggggtgtcaattcgcgagtaccagccgaccatgatgcacgccaagatcatcaccgtggacgggctggccgccctgatcgggtccaccaacttcaaccggcgctccatggaccacgacgaggagatcatgctcgccgtcctggaccaggagttcaccaacggcctggaccgggacttcgacgccgacctggaacgcagcaccgccatcgagccgacccgctggaagcgccgcgccaccctgcgacgcctccgggagacggccgtcctgcccctgcgccggttcctgtga

SEQ ID NO: 14255 - protein, 395 aa, Streptomyces coelicolor A3(2)
MTVVEPTPGADRVSIQRLRRRLERLIGVAATEGNELVALRNGDEIFPAMLGAIRAAEHTIDMMTFVYWRGQIARDFAAALADRARSGVRVRLLLDGFGAKEIEQDLLDAMEAAGVQIAWFRKPLWLSPFKQNHRCHRKALVIDEHTAFTGGVGIAEEWCGDARGPGEWRDTHVQVRGPAVDGVAAAFAQNWAECHDELYDDRDRFSDHTQPGTSIVQVVRGSASFGWQDMQTLIRVMLTSAEHRFRLATAYFAPDTYFIDLLCATARRGVTVEILLPGPHTDQRACQLAGQYHYTRLLDAGVSIREYQPTMMHAKIITVDGLAALIGSTNFNRRSMDHDEEIMLAVLDQEFTNGLDRDFDADLERSTAIEPTRWKRRATLRRLRETAVLPLRRFL

SEQ ID NO: 14256 - DNA, 1461 bp, Xanthomonas campestris pv. campestris str. ATCC 33913
  CDS (1)..(1461): transl_table=11
atgctcgcacttgcacagggcgcgtgggattggctggccgacattccccacctcaaagcgctcctcttcgccgcctacgtgctgtatctgctgtggatcgtcagctggatcatcctgcagaagcgcgagccggtggccacgctgagctgggtgctgtcgctggccgcgctgccgtatctgggcctgctgatctactactggctgggcccgcaaaaggtcaaacgccagcgtctacgccgcgggcggtcgcgttcgggtatggaaagctacagcagcgtgtgtccgcccgatgccgattgcaccgagctggccaagatcgcccaatccaccaccggcctggccccaagcagcgcgacagaagccttgtggctggtggatggcgcgtccacctatgcggcgatcatcgaggcgatcacacaggcgcgcgaccacatccacctggagtactacattttccagcccgaccgcagcggcatgccgatctgcgaggccttgatggaacgcgcgcgggcgggggtcaaggtgcggctgttgatggatgcagtcggttcctcggcgatgacccggcgcaccctgcgcacgctgcgtgcggccggcgtggagaccgcctggttccatcccacccagctgctcaagccgttcaagcggccgtggttgaacctgcgtacgcaccgcaagttgatcgtcatcgacggccgcatcgcgttcaccggcggcatcaatgtcaccgacgaagagaacgaacaggttcgccccgacgcgtttcgcgacctgcatgtgcgtctgcagggccacgtggtgcgcagcctgcagctggtgttcctggaggactggctctacgccacccgccaggcccagggcgccttccatggccaacaactgtggccggaggatgtgcccacccgcaagcagggcagcatcgatgcgcaggtgctggtgtccggccccgattcgtcctgggaagcgatccaccggctgatggtggccgccatccacgaagccaggcatcgggtctggctggtcacgccgtacttcgtgccgggcgaggccgcgcgcatggcgctcacctctgcggcgctgggcgggctggacgtgcgcctgctgatcccgcgcgtcagcgattcgcgcctggtcacctatgccgcgcgctcgtatttcgatgaactgctggaggccggcgtgcgtatctacgagtacggcccgcgcatgttgcacaccaaggcgctgatcgccgacgacgatgtctgcatcgtcggtagcgccaatttcgacagccgcagcttccggctgaacttcgagctgtcgatgctgttccgcgaccaggcagtagccgccgagctcgccggcatgatcggcaccgacatggcccaggcacaggaagtgcgcttcaacctgcgccggccgttctggcgatcgcgcctgccggaagccttcgcgcggctgctatcgccgctgctctga

SEQ ID NO: 14257 - protein, 486 aa, Xanthomonas campestris pv. campestris str. ATCC 33913
MLALAQGAWDWLADIPHLKALLFAAYVLYLLWIVSWIILQKREPVATLSWVLSLAALPYLGLLIYYWLGPQKVKRQRLRRGRSRSGMESYSSVCPPDADCTELAKIAQSTTGLAPSSATEALWLVDGASTYAAIIEAITQARDHIHLEYYIFQPDRSGMPICEALMERARAGVKVRLLMDAVGSSAMTRRTLRTLRAAGVETAWFHPTQLLKPFKRPWLNLRTHRKLIVIDGRIAFTGGINVTDEENEQVRPDAFRDLHVRLQGHVVRSLQLVFLEDWLYATRQAQGAFHGQQLWPEDVPTRKQGSIDAQVLVSGPDSSWEAIHRLMVAAIHEARHRVWLVTPYFVPGEAARMALTSAALGGLDVRLLIPRVSDSRLVTYAARSYFDELLEAGVRIYEYGPRMLHTKALIADDDVCIVGSANFDSRSFRLNFELSMLFRDQAVAAELAGMIGTDMAQAQEVRFNLRRPFWRSRLPEAFARLLSPLL

SEQ ID NO: 14258 - DNA, 1983 bp, Xanthomonas campestris pv. campestris str. ATCC 33913
  CDS (1)..(1983): transl_table=11
gtgacgtccttgttgaggattcttgtgctggcaaccttgttgctcggcaccggatgcgccggcctgtcgcaaaccgaacgtcaccgcgccgccggcattgccgtggccgcgcgcagcaccgtggtgacctgcacccaggccgatcgctgcgcccagccctcgccgctgcgtgcgctgggcggcgacgccatcgccgcctccaccgctgcagcgccacgccactacgccaccatcgtggaccacggcgaggaatcgctggttgcgcggttgaacctgatccgcagcgccacccgcagcatcgacctgcagacctacatcttcgacaaggacgacagcgcccgcatggtgctggacgcgctgaccgccgccgcgcaacgtggggtcaaggtgcggatcctgatcgatcagctctcggcgatcgccgatctgcagatcctgggcgcgctggccagcagccacgaaaacctgcagctgcgcatctacaaccccaccttcggcaaggtgaagctcaactacttcgactacgccggcagcgtggtgtgctgtttccgccgcttcaatcagcgcatgcacaacaagctgctggtggtggacgatgtgctcggcgtggttggtgggcgcaactaccaggacgactacttcgactgggacagcgagtacaactttcgcgaccgcgatgtgattctggccgggccggaagtgcgcgcgatggcggtcaacttcgatgcgttctggaacgcgcgccgcagtgtcccggccgagcggctcaacgatgtcgggcggttgttgctggacgacggcccacagaccatgccgccggccaagttccgccggcccgagcgggtggcgcgggtggaccgcgaagccaatgacccgcagttcgtgcaggctgccttcgtggccccggcaatgccggtacagcgtgtgctgtacgtggccgacctgccgcagaaacaccgcaaggaacatggcgccaaggcggtatccaccgcgccggagctggacagcctgatcgccggagcgcagcaggaagtgctgctgcagacgccgtatctggtgttgtccgatcccgcgcaggaaatcttccgcaccttgcgcaagcgcgcgcagccgccgcgcatcgtggtgtccaccaacagcctggcggccaccgataaccccatcgtgtatgcgctgtcgtacaagttcaaacgccgcaacatgcgcgagttgggcttcaacgtgtatgagttcaaaccgttcccgctggatgcgccggtggactacgccaacctgctgcccgacccgctgacggccgccgcgggcgaggccgccgagaacgaccgcagcaatcgcctgatcggcggcagcgcggccggcaatgcggtgcgtggtagcagcggtggtagtggtggcggcgggcgtacgcccggcggcagcgatgtcgaccgccgcgtgctgcgcaccgaaacccggccctcgttcctgggcacccgcgcggtcaacaagccgttgccggtgacgcgcgccggtgcgcgcatggggctgcacgccaaatcgctggtggtggaccgccgcatcggcgtgatcggcacgcacaacttcgatccgcgcagcgagaactacaacaccgaggcggcggtggtgatcgacgatccgcgctttgcacaggcgctggccgccagcatcgagcgcgacatcgcccccgacaacgcctggacggtggcgccgcgggaaaagccgccggtgctcagcggcttgaactacagcgtgggcaaggtgtccgaagcgttgccggtgctggatttctggccgtggcgctacgccaccaactacgaattccagccgggcccgggctgcccgttcccgctcaagcgccaggacccgcagttccgccagtgctacgtggcggtgggcgatttccccgaggtcaatgttggcccgaagtggctgctggtgcggatgctgaccgccttcggcgccgggctggtgccgatcctctga

SEQ ID NO: 14259 - protein, 660 aa, Xanthomonas campestris pv. campestris str. ATCC 33913
MTSLLRILVLATLLLGTGCAGLSQTERHRAAGIAVAARSTVVTCTQADRCAQPSPLRALGGDAIAASTAAAPRHYATIVDHGEESLVARLNLIRSATRSIDLQTYIFDKDDSARMVLDALTAAAQRGVKVRILIDQLSAIADLQILGALASSHENLQLRIYNPTFGKVKLNYFDYAGSVVCCFRRFNQRMHNKLLVVDDVLGVVGGRNYQDDYFDWDSEYNFRDRDVILAGPEVRAMAVNFDAFWNARRSVPAERLNDVGRLLLDDGPQTMPPAKFRRPERVARVDREANDPQFVQAAFVAPAMPVQRVLYVADLPQKHRKEHGAKAVSTAPELDSLIAGAQQEVLLQTPYLVLSDPAQEIFRTLRKRAQPPRIVVSTNSLAATDNPIVYALSYKFKRRNMRELGFNVYEFKPFPLDAPVDYANLLPDPLTAAAGEAAENDRSNRLIGGSAAGNAVRGSSGGSGGGGRTPGGSDVDRRVLRTETRPSFLGTRAVNKPLPVTRAGARMGLHAKSLVVDRRIGVIGTHNFDPRSENYNTEAAVVIDDPRFAQALAASIERDIAPDNAWTVAPREKPPVLSGLNYSVGKVSEALPVLDFWPWRYATNYEFQPGPGCPFPLKRQDPQFRQCYVAVGDFPEVNVGPKWLLVRMLTAFGAGLVPIL

SEQ ID NO: 14260 - DNA, 1020 bp, Xanthomonas campestris pv. campestris str. ATCC 33913
  CDS (1)..(1020): transl_table=11
atgagccggcagcccgcgctctgctggcgccaagggcatcgcatgcgtctgctggaaaatggcgagaactacttcgcacgcttttaccagatgatcgccgccgcgcaagacgagattctgctggaaacgttcatcctgttcgaggatgcggtgggcctgcaattgcagcagcacctgatcgacgcggcacaacgcggcgtgcgggtacacctgctggtggatgcattcggctcgtgcgcattgtccccgcggtacgcacgcgaccttgccgaggcgggcgtgcagctgcgcctgttcgacccggagcccacaccgctgcgcaggcgcatcaatatgttccgccgcctgcatcgcaagctgctcgtcgtcgatcaggccattgccttcgtcggcggcatcaattattcggccgatcaactggccgggtcagggccgcagggcaaacaggattacgccatcgagctgcaggggccggtggtgtgtgatatcgctgccttcatgcagcaggccgcgcgtggcagcggggccggcgagggctggacgccggatccgtcatcacccgcatcaacagctgccgagagcggcgaggtttgctttatcgcgcgtgacaacggctcacgctcgcgcagcatcgaacaggcgtaccggcaggcatttgccgatgcgcggcaggaaatcatcatcgccaacgcgtacttcttcccgggctacggatgtctgcgtgatctgtgtgcggccgcgcggcgcggcgtccacgtgcgcctcatcgtgcagggacaacccgacaccccgcttgccttgttggcagcgcgtttgctgtaccgccagttgctcgctgccggggtgcagatcttcgagtactgcgagcgaccgttccatggcaaggttgcggtgatcgatgggtattggagcacggtcggttccagcaacctggacccactcagcctggcactgaacctggaggcgaacgtgctggtacgcaaccatgccttcgcagaggtcttgcgtgagcgcttgtaa

SEQ ID NO: 14261 - protein, 339 aa, Xanthomonas campestris pv. campestris str. ATCC 33913
MSRQPALCWRQGHRMRLLENGENYFARFYQMIAAAQDEILLETFILFEDAVGLQLQQHLIDAAQRGVRVHLLVDAFGSCALSPRYARDLAEAGVQLRLFDPEPTPLRRRINMFRRLHRKLLVVDQAIAFVGGINYSADQLAGSGPQGKQDYAIELQGPVVCDIAAFMQQAARGSGAGEGWTPDPSSPASTAAESGEVCFIARDNGSRSRSIEQAYRQAFADARQEIIIANAYFFPGYGCLRDLCAAARRGVHVRLIVQGQPDTPLALLAARLLYRQLLAAGVQIFEYCERPFHGKVAVIDGYWSTVGSSNLDPLSLALNLEANVLVRNHAFAEVLRERL

SEQ ID NO: 14262 - DNA, 1563 bp, Xanthomonas campestris pv. campestris str. ATCC 33913
  CDS (1)..(1563): transl_table=11
gtgaccaaacgcaagatcttcaagtgggcgggcatcggcgtgctggtgctggcgctgggcagcgtgctgtcgctgtatggctacggccgctttgccgatcgcgagcgcggccctgccagccatgccttgccggtggcggcgcaggcaacgccaatcgaccaggtcgtcgctccgttgcagcaggcgcatgccggcaagaccggcatggtgatcctgtccgacaacatcgatgcgtttgcggtgcgcgcgttgaccgcgcgtgcggccggccgcagcctggatctgcagtactacatctggcatgccgacttcaccggcaacctgttgcacaacgaattgctgcgtgcggccgaccgtggcgtgcgcgtgcgcctgttgctggacgacatgaacatccatggcagcgactcggtgctggccgcgttggacagccatccgctgatcgagatccgcctgttcaaccccacccgtgcacgcgagggcacgctgatgcgcggcgtggaaatggtgctgcgcatgttcagcatcaaccgacgcatgcacaacaaggcgtggattgccgatggccgcatcgcggtggtgggtgggcgcaatgtgggcgacgaatatttcgacgccgcgcgcgacaccaacttcatggacatggacgcggccttgatcggcccgacggtgcgtcagtccgaacaggtgttcgatgcctactggaacagccccaatgcattgccgctggcggcgctggtcaccgccaagccgcaggcgctggagcaactgcgcggcagcctggacgccgggatggcgtcggtgggcgcgcacccgtacgtggagcgcctgcgccaatcgccaagcgtgcatgccttgatgcagggcaatcgcccggtgcattgggtgcagcaggcgcgcatcgtggccgacccgccggagaaggccgaaggtgcgccaccgcaaccggactggatgacgccgatcctgatcggcgagatggccaacgcacgccgcgaactgaaattgatctcaccttatttcgtgcccggcgacgacggcatgcgctggatcggtggcctgcgcaagcgcgatgtacgcgtcagcgtattgaccaattcactggccgccaacgatgtcgtggccgtgcacagcggctatgcggactaccgcattccgctgctgcaacaaggcgtgcgcctgcacgagctcaagccgatggggcgcccggatggcagcctgttcggttccagtggtgcgagcctgcataccaaggccttcgtggtggacgacagcgccggtttcatcggttcgttcaacctggacccgcgggcgatgaatctcaacaccgagatgggcctgctattcgaagaccgcaccgtgaccgcggagctggagcggctatacaaccacaaggtgagcgcgccggtgagctaccgggtgacgttggagcagggcggattgcgctggcacgacgatgccgcgcagccaccggcggtgtggacgcgcgaaccggccgccagtgtgtggcgtcgcggcgcggccaaggtgttgggctggttgccgctggattcgcagttgtaa

SEQ ID NO: 14263 - protein, 520 aa, Xanthomonas campestris pv. campestris str. ATCC 33913
MTKRKIFKWAGIGVLVLALGSVLSLYGYGRFADRERGPASHALPVAAQATPIDQVVAPLQQAHAGKTGMVILSDNIDAFAVRALTARAAGRSLDLQYYIWHADFTGNLLHNELLRAADRGVRVRLLLDDMNIHGSDSVLAALDSHPLIEIRLFNPTRAREGTLMRGVEMVLRMFSINRRMHNKAWIADGRIAVVGGRNVGDEYFDAARDTNFMDMDAALIGPTVRQSEQVFDAYWNSPNALPLAALVTAKPQALEQLRGSLDAGMASVGAHPYVERLRQSPSVHALMQGNRPVHWVQQARIVADPPEKAEGAPPQPDWMTPILIGEMANARRELKLISPYFVPGDDGMRWIGGLRKRDVRVSVLTNSLAANDVVAVHSGYADYRIPLLQQGVRLHELKPMGRPDGSLFGSSGASLHTKAFVVDDSAGFIGSFNLDPRAMNLNTEMGLLFEDRTVTAELERLYNHKVSAPVSYRVTLEQGGLRWHDDAAQPPAVWTREPAASVWRRGAAKVLGWLPLDSQL

SEQ ID NO: 14264 - DNA, 1425 bp, Xanthomonas campestris pv. campestris str. ATCC 33913
  CDS (1)..(1425): transl_table=11
atgccgatgctgcctgactggttgcaagggacctggctgctggcgctggactgggcgatccgcctggccgcgctgctgtggatccccacccgcaccacgcctggggcggcgcgcagctggttgctgctgatcggcttcgtgccggtggtgggcctgccgctgtacctgttgttcggccacccgtggctatcgcggcagcgcgtacaacgccaggccacggcctcgcaggtgatccgtgagcagcagctgccattgcacgccttgcgctggaccccgcagccggacaccagcagcgccgaggtggtgccgttgatcgagcggcagggcgatttcatgcccacgctgggcaatgcggtggaactgttggacgactacgaggcctcgctgcaggcgttgattaccgcgatcgaccaggcgcaggaacgtgtgcatctgctgtattacctgatgttcgacgatgcggtgggcgaggcggtggtggctgcgctggaacgcgcctgcgcacgcggcgtgcgctgccgcttgctgctggatgccatgggcgccaagcgtggcctgcgccgttatcgccagcgcctgcaggccagtggcgtggaggtgctggccttgctgcccggcgggctgcgctggcgccgcagcgggcgcatggacctgcgcaaccaccgcaagattgcggtgatcgacaaccaggtcggctttgtcggctcgcagaacctggccgcacccggcttcatcgccggcgcgcccaatcgcgaactggtcgcgcgcgtacgcgggccggtggtcaaccacctggaagcggtgttcgccagcgactggttcaccgaaaccgggcagcgcctggacgtgtggccggacgcaccggtgtacgacgacaacatcgccacccagttgctgcccagcgggccggcgtatccgttcgagaacgcgcgcgatgcaatcaacgcagtgatccatctggcgcgccgcaaggtggtgctggtcacgccgtatttcgtgccggacgaagccatgctcagtgcgctgcgcattgccgggatgtctggcgtggacgtgcagttgatcctgtccgaacacaacaaccagcggctggcggcgtgggcgcaggaggcctatttcgaagagttgctgcgctgtggagtgaagattgcgctgtaccggccgcactttctgcatgccaagcatctgagcgtggatgaagacattgcgttggtgggctcgatcaacctggacatccgctcgttcgcgctcaatgccgagatcggcatgctctgctacgaccgcaacgtggtgctacgcctgcgcgagatcgagcaggattacctggcgcagtcgcagccggtggacatcgcgcagtggcgccgccgcccggcctggcggcgaagccgcgaaggcatcgcacgcctggcggatgcattgatgtag

SEQ ID NO: 14265 - protein, 474 aa, Xanthomonas campestris pv. campestris str. ATCC 33913
MPMLPDWLQGTWLLALDWAIRLAALLWIPTRTTPGAARSWLLLIGFVPVVGLPLYLLFGHPWLSRQRVQRQATASQVIREQQLPLHALRWTPQPDTSSAEVVPLIERQGDFMPTLGNAVELLDDYEASLQALITAIDQAQERVHLLYYLMFDDAVGEAVVAALERACARGVRCRLLLDAMGAKRGLRRYRQRLQASGVEVLALLPGGLRWRRSGRMDLRNHRKIAVIDNQVGFVGSQNLAAPGFIAGAPNRELVARVRGPVVNHLEAVFASDWFTETGQRLDVWPDAPVYDDNIATQLLPSGPAYPFENARDAINAVIHLARRKVVLVTPYFVPDEAMLSALRIAGMSGVDVQLILSEHNNQRLAAWAQEAYFEELLRCGVKIALYRPHFLHAKHLSVDEDIALVGSINLDIRSFALNAEIGMLCYDRNVVLRLREIEQDYLAQSQPVDIAQWRRRPAWRRSREGIARLADALM

SEQ ID NO: 14266 - DNA, 1461 bp, Xanthomonas axonopodis pv. citri str. 306
  CDS (1)..(1461): transl_table=11
atgctcgcacttgcacagggcgcgtgggagtggctggccaccattccccacctcgaagcgctcctcctcgccgcctatgtgctgtacctgctatggatcgccggctggatcgtgctgcagaagcgcgaaccggtggccacgctgagctgggtgttgtcgctggcggcgctgccgtacctggggctgctgatctactactggctcgggccgcaaaaggtcaaacggcagcggctgcggcgcgggcgctcgcgctcgggcatggagagctacagcagcgtctgcccgccggatgccgattgcaccgagctggccaagatcgcccagtccaccaccgggctagcgcccagcagcgccaccgaagtgcactggctggtggatggcgctgccacgtacgccgccatcatcgaagcgatccggggcgcacgcgaccatatccatctggagtactacatcttccagcccgaccacagcggcaccgcgatctgcgctgcgctgatggaacgtgcccgtgccggggtcaaggtgcggctgctgatggatgcgatcggctcatcggcaatgacccgacgcgccttgcgcacgctgcgcgaggccggggtggaaaccgcctggttccacccctcgcagttgctcaagccattcaagcggccgtggttgaacctgcgcacccaccgcaaggtgatcgtcatcgatggccgcatcggtttcaccggtggcatcaacgtcaccgacgacgagaacgagcaggtgcgcaagcaggcgtatcgcgatctgcacgtgcgcctgcaaggccatgtagtgcgcagtctgcagctggtgttcctggaggattggctctatgccaccagccagggccgcgcagctttccacggccagcagctatggcccgacgatatgcccacccgcgcgcaaggcacggtcgatgcgcaggtgctggtgtcgggtccggattcgtcgtgggaagcgatccaccgtctgatggtcgccgccatccatgaagccaagcaccgcgtgtggctggtgactccatacttcgtgcccggcgaggcggcgcgtatggcgctgacctcggccgcgctcggcgggctggacgtgcgcctgttggtgccgcgggtcagcgattcgcgcctggtcacctacgcggcacgctcgtatttcgacgagctgctggaagccggtgtccgcatctacgagtacgggccgcgcatgctgcacaccaaggcgctgctggccgacgacgatgtctgcatcgtcggcagcgccaatttcgacagccgcagcttccggctgaatttcgagctgtcgatgctgttccgcgaccaggccgtggcggcagagatggccgggctgatcggcaccgatctgcaacaggcgcaggaagtgcaattcgcgcgacaccggccgttatggcgctcgcgcctgcccgaagcgtttgcccggctgctgtcgccgctgctctga

SEQ ID NO: 14267 - protein, 486 aa, Xanthomonas axonopodis pv. citri str. 306
MLALAQGAWEWLATIPHLEALLLAAYVLYLLWIAGWIVLQKREPVATLSWVLSLAALPYLGLLIYYWLGPQKVKRQRLRRGRSRSGMESYSSVCPPDADCTELAKIAQSTTGLAPSSATEVHWLVDGAATYAAIIEAIRGARDHIHLEYYIFQPDHSGTAICAALMERARAGVKVRLLMDAIGSSAMTRRALRTLREAGVETAWFHPSQLLKPFKRPWLNLRTHRKVIVIDGRIGFTGGINVTDDENEQVRKQAYRDLHVRLQGHVVRSLQLVFLEDWLYATSQGRAAFHGQQLWPDDMPTRAQGTVDAQVLVSGPDSSWEAIHRLMVAAIHEAKHRVWLVTPYFVPGEAARMALTSAALGGLDVRLLVPRVSDSRLVTYAARSYFDELLEAGVRIYEYGPRMLHTKALLADDDVCIVGSANFDSRSFRLNFELSMLFRDQAVAAEMAGLIGTDLQQAQEVQFARHRPLWRSRLPEAFARLLSPLL

SEQ ID NO: 14268 - DNA, 2019 bp, Xanthomonas axonopodis pv. citri str. 306
  CDS (1)..(2019): transl_table=11
gtgacgtatctgttgagggtttgcgtgctggcaacgttgttgctcggcaccggatgcgccagcctgtcacaaaccgaacgcaaccgtgccgccggtgtcgccgctgcggcacgcagcacggtggtcaattgcacccaggccaatcgctgtgcgcaaccctcgccattgcgcgcgctgggcggcgaagcgatcaccgcctccacaccaggagcgccgcggcattacgccaccatcgtcgaccatggcgaagaatcgctggtggcccggctcaacctgatccgcagcgccacccgcagcatcgatctgcagacctacattttcgataaggacgacagcgcgcgcatggtgctggacgcactggtggacgccgcccagcgcggggtcaaggtgcgcatcctgatcgatcagttgtcggcgatcgccgatctgcagattctcggtgcgctcgccagcagccatgaaaacctgcagctgcgcatctacaaccccaccttcggcaaggtcaagctcaattacttcgattatgctggcagcgtgctgtgttgcttccgccgcttcaaccagcgcatgcacaacaagctgctggtggtggacgacgtgctgggcgtggtcggtgggcgcaattaccaggacgactattacgactgggacagcgagtacaacttccgcgaccgcgacgtgattctggccgggccggaagtgcgcgccatggccgccaatttcgatgcgttctggcgtgcccggcgcagcgtaccggccgagcgtctgaacgatgtcgggcgcctgctgctggagcagggcgtgccgacgatgccgccggccgagttccgccggcccgaccgggtggcgcgagtggaccgcgaagcgcacgacccgcaattcgtgcgcgacgccttcgtgaccccggccatgccggtgaagcgtgtgctgtacgtggccgatctgccgcaaaaacaccgccgggaacatgcggccaaggcagtgtccacggcgccggaactggatggcctgattgccggcgcgcagcaggaagtgctgctgcagaccccctacctggtcttgtccgaccaggcgcaggcgatcttccgcacgttgcgcaaacacccgcagccgccgcgcatcgtggtgtcgaccaatagcctggccgccaccgacaaccccatcgtgtatgcgctgtcgtacaagttcaaacgccgcaacatgcgcgagctgggcttcaatgtgtacgagttcaagccgtttccgctcgatgccccggtggattacgccaacctggtgacggacccgctcaaccccgcctccgacgtcaatcaggacagccgcaacaatcgcctgatcggcggcagcgcagcgggcaatgcgatgcgcggcagcagcggcccggagggcaacgccagcgcgagcgccggcagcgtgctgcgcggcagtggtggcggccgtgcgccgggcgggagcgaagtcgatcggcgcgtgttgcggaccgaaacgcggccctcgttcctgggcacgcgcgcggtcaacaagccgctgccggtgacccgcgccggtgcgcggatgggcttgcatgccaagtcgttggtggtggatcgccgcatcggcgtgatcgggacgcacaacttcgacccgcgcagcgaaaactacaacaccgaagcggccgtggtgatcgacgatgcgcgctttgcgcaggcgttggctgccagcatcgaacgcgacatcgctccggaaaatgcgtggacggtggcgccgcgcgaaaagccgccggtgctgagcgggttgaactacagcgtgggcaaggtctccgaagccttgccggtgctggacttctggccatggcgctacgccaccaactaccagttccagcccggcccggattgtccgtttccgctcaagcggcaggacccgcagttccgccagtgctatgtggcggtgggcgatttcccggaggtcaatgtcggcccgaagtggctgctggtgcgcatgctgaccgctttcggcgccgggctggtaccgattctctga

SEQ ID NO: 14269 - protein, 672 aa, Xanthomonas axonopodis pv. citri str. 306
MTYLLRVCVLATLLLGTGCASLSQTERNRAAGVAAAARSTVVNCTQANRCAQPSPLRALGGEAITASTPGAPRHYATIVDHGEESLVARLNLIRSATRSIDLQTYIFDKDDSARMVLDALVDAAQRGVKVRILIDQLSAIADLQILGALASSHENLQLRIYNPTFGKVKLNYFDYAGSVLCCFRRFNQRMHNKLLVVDDVLGVVGGRNYQDDYYDWDSEYNFRDRDVILAGPEVRAMAANFDAFWRARRSVPAERLNDVGRLLLEQGVPTMPPAEFRRPDRVARVDREAHDPQFVRDAFVTPAMPVKRVLYVADLPQKHRREHAAKAVSTAPELDGLIAGAQQEVLLQTPYLVLSDQAQAIFRTLRKHPQPPRIVVSTNSLAATDNPIVYALSYKFKRRNMRELGFNVYEFKPFPLDAPVDYANLVTDPLNPASDVNQDSRNNRLIGGSAAGNAMRGSSGPEGNASASAGSVLRGSGGGRAPGGSEVDRRVLRTETRPSFLGTRAVNKPLPVTRAGARMGLHAKSLVVDRRIGVIGTHNFDPRSENYNTEAAVVIDDARFAQALAASIERDIAPENAWTVAPREKPPVLSGLNYSVGKVSEALPVLDFWPWRYATNYQFQPGPDCPFPLKRQDPQFRQCYVAVGDFPEVNVGPKWLLVRMLTAFGAGLVPIL

SEQ ID NO: 14270 - DNA, 1563 bp, Xanthomonas axonopodis pv. citri str. 306
  CDS (1)..(1563): transl_table=11
gtgacaaagcggaaatttttcaaatggttcggcattgcgctgctggtgctggtgctggccagcgcgttatcgctgtacggctacgggcgctttgccgaccgccaacgcgggccggtcagtcatgtgctgcctgccacggcggtcgcgacgcccatcgacaaggtggtggcgccattgcaacaggcgcatgccgatcagaccggcatggtgatcctgccggacaacgtcgatgcatttgcggtacgtgcgctcaccgcgcgtgcggccgggcgcagcctggatctgcagtactacatctggcacgccgatttcaccggcaacctgctgcacaacgagttgctgcgcgcggccgatcgcggcgtacgcgtgcgattgctgctggacgacatgaatatccatggcagcgattcggtgctggccgccctggatagccatccgctgatcgagattcgcctgttcaacccgacccgcgcgcgcgaaggcaccttgatgcgcggcgtggagatggtgctgcgcatgttcagcatcaaccgccgcatgcacaacaaggcctggattgccgatggccgcatcgcggtggtgggtgggcgcaacgtgggcgacgaatatttcgatgcggcgcgcgacaccaatttcatggatatggatgcggcgctgatggggccggcggtgggccaggccgagcaggtattcgatgcgtactggaatagccccaatgccttgccgctgtctgcgctggtcaccgcaaaaccgcaggcactggaggccttgcgtggcagcctggacgccggcatggcatcggtgcgcgcgcatccgtatgtggagcggctcaagcgctccccaagcgtgcgcgaactgatgcagggcgaccgcccggtgcactgggtgtcgcaggcgcgcatcgtttccgacccgccggaaaaagccgaaggtgcgccgccgcaagccgattggatgacgccagtgctgatcggcgaaatggcgcacgcacagcgcgaactgaaagtgatttcgccgtatttcgtgccgggcgacgagggcatgcgctggatcggccatctgcgccagcgcaacgtgcgcgtgagcattctgaccaattcgctggcagccaacgacgtggtggcagtgcacagcggctacgccggctatcgcgtgccgcttctgcagctgggcgtgcgcctgcatgagctcaagccgatgggcaagccggacggcagcctgttcggttccagcggtgccagcttgcataccaaggcgtttgtcgtggacgacagcagcggtttcatcggctcgttcaacctggacccgcgttcgatgaacctcaataccgaaatgggcctgttgttcaacgaccgtgtggtcaccgcggagctggagcggctgtacaaccacaaggtcagtgcgccagtgagttaccgcgtcaccctggaccggggcgaactgcgttggcacgacgatgccgcgcagccgcccgaggtgtggtcgcgcgagccggccgcgagcgtgtggcgacgtggtgcagcagcggtgatgggctggttgccgctggagtcgcagctgtag

SEQ ID NO: 14271 - protein, 520 aa, Xanthomonas axonopodis pv. citri str. 306
MTKRKFFKWFGIALLVLVLASALSLYGYGRFADRQRGPVSHVLPATAVATPIDKVVAPLQQAHADQTGMVILPDNVDAFAVRALTARAAGRSLDLQYYIWHADFTGNLLHNELLRAADRGVRVRLLLDDMNIHGSDSVLAALDSHPLIEIRLFNPTRAREGTLMRGVEMVLRMFSINRRMHNKAWIADGRIAVVGGRNVGDEYFDAARDTNFMDMDAALMGPAVGQAEQVFDAYWNSPNALPLSALVTAKPQALEALRGSLDAGMASVRAHPYVERLKRSPSVRELMQGDRPVHWVSQARIVSDPPEKAEGAPPQADWMTPVLIGEMAHAQRELKVISPYFVPGDEGMRWIGHLRQRNVRVSILTNSLAANDVVAVHSGYAGYRVPLLQLGVRLHELKPMGKPDGSLFGSSGASLHTKAFVVDDSSGFIGSFNLDPRSMNLNTEMGLLFNDRVVTAELERLYNHKVSAPVSYRVTLDRGELRWHDDAAQPPEVWSREPAASVWRRGAAAVMGWLPLESQL

SEQ ID NO: 14272 - DNA, 1416 bp, Xanthomonas axonopodis pv. citri str. 306
  CDS (1)..(1416): transl_table=11
ttgcccgattgggtcacaggcacttggctgctggcactggactgggcgatccgcctggccgcactgctctggattcccgcccgcaccacgccgggtgcggcgcgcagctggctgctgctgatcggcttcgtaccggtggtcggcctgccgctgtatctgttgttcggccacccgtggttgtcgcggctgcgggtggagcgccaagccactgcctcgcaggtgattcgcgaacaacaactgcccttgcatgcgttgcgctggatgccccaggcagacaccagcagtgccgaagtggtgccgctgatcgaacgcgaaggcgatttcatgcccacgctgggcaacgcggtggaattgctcgacgactatgcgcagtcgttgcaggccctgatcgcggcgatcgacgcggccgacaaacgtgtgcacttgctgtactacctgatgttcgacgatgcggtgggcgaggcggtggtcgtggcgctggaacgcgccagcgcgcgcggcgtgcgttgtcgcgtgctgctggatgcggtgggcgccaagcgcggcctgcgtcgctaccgcaagcgcctgcaggacggtggcgtgcaggtgttggcggtattgccgggcggcctgcgctggcgtcgcagcggccgcatggatctgcgcaaccatcgcaagattgcggtgctcgacaaccgggtggcgtttgtcggttcgcagaatctggccgaggccggcttcattgatggcgtgcccaatcgcgaactggtggcacgcgtgcgcgggccggtggtcaatcatctggaagcggtcttcgccagcgactggttcaccgaaaccggagagcggctggacgtgtggcccgatgcaccggtgtgcgaggccaatatcgccacgcaattgctgcccagcgggccggcgtatccgttcgaaaatgcgcgcgatgcgatcaatgcggtgatccatctggcgcggcgcaaggtggtgctggtcacgccgtacttcgtgcccgacgaagccttgctgagcgcattgcgcatcgccccagtctcgggagtggatgtgcagttgatcctgtccgagcacaacaaccaacgcttggccgcgtgggcgcaggaggcctatttcgaagagctgctgcgttgcggggtgaagattgcgctgtatcgcccgcactttctgcatgccaagcacctgagcatggatgaagacatcgcgctggtgggctcgatcaatctggacatccgctcgttcgcgctcaacgccgagatcggcatgctctgctacgacactggcgtggtgcagcggttgcgcgagatcgagcaggactatctggccaacgcgcggcaactgacgttggaacagtggcgccgccgcccggcctggcgccgcagtcgcgagggcattgcgcggctggccgatgcgttgatgtag

SEQ ID NO: 14273 - protein, 471 aa, Xanthomonas axonopodis pv. citri str. 306
MPDWVTGTWLLALDWAIRLAALLWIPARTTPGAARSWLLLIGFVPVVGLPLYLLFGHPWLSRLRVERQATASQVIREQQLPLHALRWMPQADTSSAEVVPLIEREGDFMPTLGNAVELLDDYAQSLQALIAAIDAADKRVHLLYYLMFDDAVGEAVVVALERASARGVRCRVLLDAVGAKRGLRRYRKRLQDGGVQVLAVLPGGLRWRRSGRMDLRNHRKIAVLDNRVAFVGSQNLAEAGFIDGVPNRELVARVRGPVVNHLEAVFASDWFTETGERLDVWPDAPVCEANIATQLLPSGPAYPFENARDAINAVIHLARRKVVLVTPYFVPDEALLSALRIAPVSGVDVQLILSEHNNQRLAAWAQEAYFEELLRCGVKIALYRPHFLHAKHLSMDEDIALVGSINLDIRSFALNAEIGMLCYDTGVVQRLREIEQDYLANARQLTLEQWRRRPAWRRSREGIARLADALM

SEQ ID NO: 14274 - DNA, 1224 bp, Xanthomonas axonopodis pv. citri str. 306
  CDS (1)..(1224): transl_table=11
gtggggctgctgctgctcaacttcgccacgccggagaaaaagctcgagcacatccccaaacacctctacgacgttgccgatccgcaattcaaacgcgagatgtcggtgttgctggggccggccatcctgcccggcaacaggatcgacgtgctcaataacggccgcgagatctttccggccatgctggaggccatccgcagcgcgcagcacaccatcacgttcgaaacctatatctattggtcgggcgagatcggccgagaattcagcgacgccttgtccgagcgcgcgcgcgccggggtggatgtgcgggtcaccatcgactggggcggcagcctgaagatggaccatgcactggtagacaccatgaccgaggccggcgtggacgtgcaccgctaccgcccgctggcctggtacaacctgcaccgcatcaacaaccgcacgcaccgcaagctgctggtgatcgacggccgtatcggcttcaccggcggcgtgggcgtggccgaccagtggatgggcgacgcgcaggatccggaccattggcgcgacacccactaccgcatcgaaggcccggtggtggcgcaggtgcagaccgccttcaacgacaactggatcaagaccaccggccgcgtggtcaatggcgcccggtactacccggcgctggaggcggtcggcgacagcgatgcgcagttgttcgtggcctcgccggccggcggcagcgaaagcatgcacctgatgtatctgatcgccatcgccgccgcatgcagcaccatcgacctggccgcggcgtatttcgtgcccgatgcgctgatcacccgcgcgctgctggaagcgcgcagtcgcggcgtcagcatccgcgtgctgctgcccggcaagcacatcgatgcggtgtcggtgcggctggcctccaaggccagctgggagccactgctgcaggccggcatcgagatccacgaataccagcccaccatgctgcataccaaactgctgatcatcgacggcctgttggtctcggtaggctccaccaatttcgacatccgctcgttccgcctcaacgacgaggccagcctgaatgtctacgaccgcacgctggctgcacgcatgaccgaggtgttcgagcgcgatctgcaacgcgccgagcagtattcgctggagcgctggcgcgcgcggccgttgcggcagaagcttggcgagaaactggtgttcccgttccgctcgcaggtgtga

SEQ ID NO: 14275 - protein, 407 aa, Xanthomonas axonopodis pv. citri str. 306
MGLLLLNFATPEKKLEHIPKHLYDVADPQFKREMSVLLGPAILPGNRIDVLNNGREIFPAMLEAIRSAQHTITFETYIYWSGEIGREFSDALSERARAGVDVRVTIDWGGSLKMDHALVDTMTEAGVDVHRYRPLAWYNLHRINNRTHRKLLVIDGRIGFTGGVGVADQWMGDAQDPDHWRDTHYRIEGPVVAQVQTAFNDNWIKTTGRVVNGARYYPALEAVGDSDAQLFVASPAGGSESMHLMYLIAIAAACSTIDLAAAYFVPDALITRALLEARSRGVSIRVLLPGKHIDAVSVRLASKASWEPLLQAGIEIHEYQPTMLHTKLLIIDGLLVSVGSTNFDIRSFRLNDEASLNVYDRTLAARMTEVFERDLQRAEQYSLERWRARPLRQKLGEKLVFPFRSQV

SEQ ID NO: 14276 - DNA, 1518 bp, Staphylococcus aureus subsp. aureus MW2
  CDS (1)..(1518): transl_table=11
atgttttttgtgcctttctttataggagaaaagactatgcgatatacattttcaaatgatttaggaacactttttaccattattttagccattggattcatcattaatttagtattggcttttattattatctttttagaaagaaatagacgtacagcgagttcaacttgggcatggctatttgtactttttgtcttaccattgattggttttattctttacttgttttttggtagaaccgtttcggcacgtaaattgaataaaaacaatggtaaggtgttaacggatttcgatggacttttaaaacaacaaatagaaagctttgataaaggtaattatggtactgataacaaacaagttcaaaaacatcatgatttagtacgtatgcttttgatggatcaagatggttttttaactgaaaataataaagttgatcatttcattgatggaaatgatttatatgatcaagttttacaagatattaaaaatgctaaagaatacatccatttagagtattatacattcgctctagatggcttgggccaaagaattttaaaagcgttagaagagaaattgaaacaaggtctagaagtgaaaattttatatgatgacgttggttcaaagaaagttaagatggctaattttgatcattttaaatcgttaggtggagaagttgaagcattttttgcttctaaattaccgttattgaatttcagaatgaataacagaaatcatagaaaaatcatcgtaatcgatggtcaactaggttatgtcggaggatttaacattggtgatgaatatctaggattaggtaaactagggtattggagagatacgcatttacgtatacaaggggatgcggttgatgcactgcagttgcgatttattttagactggaattcgcaagcgcaccgtccacagtttgaatatgatgttaagtatttccctaaaaagaacggaccattgggcaattcaccaattcaaatagctgcaagtggtccggctagtgactggcatcaaattgaatatggttatacaaaaatgattatgagcgctaagaagtcggtatatttgcaatcgccttatttcattccggataactcatatataaatgccattaaaattgcagctaaatcaggggtagatgttcatctaatgattccatgtaagccagatcatcctttagtttattgggcgacatattcaaatgcttcagatttactatctagtggcgtaaaaatttacacgtatgaaaatggatttatacattctaaaatgtgtttaatagatgatgaaatggtttcagtcggaactgctaatatggactttagaagttttgaattgaatttcgaagtcaatgcttttgtatatgatgaaaagcttgctaaagatttaagggtggcttatgaacatgatattacaaaatcaaaacaactaaccaaagaatcatatgccaatagaccgctgtctgttaagtttaaagaatcgttagctaaattagtttcgccaattttataa

SEQ ID NO: 14277 - protein, 505 aa, Staphylococcus aureus subsp. aureus MW2
MFFVPFFIGEKTMRYTFSNDLGTLFTIILAIGFIINLVLAFIIIFLERNRRTASSTWAWLFVLFVLPLIGFILYLFFGRTVSARKLNKNNGKVLTDFDGLLKQQIESFDKGNYGTDNKQVQKHHDLVRMLLMDQDGFLTENNKVDHFIDGNDLYDQVLQDIKNAKEYIHLEYYTFALDGLGQRILKALEEKLKQGLEVKILYDDVGSKKVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATYSNASDLLSSGVKIYTYENGFIHSKMCLIDDEMVSVGTANMDFRSFELNFEVNAFVYDEKLAKDLRVAYEHDITKSKQLTKESYANRPLSVKFKESLAKLVSPIL

SEQ ID NO: 14278 - DNA, 1482 bp, Yersinia pestis KIM
  CDS (1)..(1482): transl_table=11
gtgaacaggatttacgcccttatgacgacattttataccgtaatcagttggctttccgtttttggctactggttactcattgccggggtaacattgcgtattctgatgaaacgcagggccgttccttctgctatggcttggttactgattatctacattctgccattggtggggataattgcttacctttcattcggtgaattgcatttgggtaagcggcgtgctgaacgagctaaagccatgtggccatcgaccgctcgctggctgagtgaactcaaggaatgccaacatatctttgctaactctaatagcgaagttgccagcccactgtttcaattatgtgaacggcgtcaaggaataaacggtgttaaaggaaatcaactacaactattaacaacaaccgatgacacactaaaagcgctagtacgagatattgaactcgcccgccacaatatagaaatggtgttttatatttggcaacctggtggtctggtcgatcaggtggctgaatcgttgatggctgcggctcgacgcggcgttcattgccggctgttactcgattcagcgggtagcaagcaatttttccgcagcccttatcccgcaatgatgcgtaatgcaggtattgaggtggttgaggcacttaaagttaatgtatttcgtatgttcttgcgccgaatggatctgcgccaacatcggaaaattgtgttaatcgacaactatgttgcttataccggcagtatgaacatggtagatccccggttcttcaaacaagatgccggggttggtcagtggattgatatgatggcgcgcatggaaggcccggtagccacaaccctaggtattgtttatgcctgtgactgggaaattgaaacaggcaaacgtattttacccccgccccccgacgcgaatattatgccattcgaagaagagactggtcatacgattcaagtcatcgcttctggccctggtttcccagaagaaatgatccaccaggcattattaacagctgtgtatgccgcacgtgaacagttaattatgactacgccatattttgtccccagtgatgacttattacatgccatctgtaccgcggcacaacgcggggttgatgtcagtattattgtcccgcgtgagaatgattcgatgatggttcgctgggccagccgagcattcttcaccgaattgctgaatgcaggcgttaaaatttatcagtttgaaggcggcctattacacagtaaaagtgttctggtcgatggacagctaagtttagtcggcactgttaatctggatatgcgcagtttgtggctgaattttgaaatcacactggtgattgatgatgatggctttggggctgatttagcacaagttcaggatgattatatcgcccgctctgccttattggatggtgaacggtggaacaagcgccctctttggcaccgagtaactgagcgtttattctattttttcagcccattattgtaa

SEQ ID NO: 14279 - protein, 493 aa, Yersinia pestis KIM
MNRIYALMTTFYTVISWLSVFGYWLLIAGVTLRILMKRRAVPSAMAWLLIIYILPLVGIIAYLSFGELHLGKRRAERAKAMWPSTARWLSELKECQHIFANSNSEVASPLFQLCERRQGINGVKGNQLQLLTTTDDTLKALVRDIELARHNIEMVFYIWQPGGLVDQVAESLMAAARRGVHCRLLLDSAGSKQFFRSPYPAMMRNAGIEVVEALKVNVFRMFLRRMDLRQHRKIVLIDNYVAYTGSMNMVDPRFFKQDAGVGQWIDMMARMEGPVATTLGIVYACDWEIETGKRILPPPPDANIMPFEEETGHTIQVIASGPGFPEEMIHQALLTAVYAAREQLIMTTPYFVPSDDLLHAICTAAQRGVDVSIIVPRENDSMMVRWASRAFFTELLNAGVKIYQFEGGLLHSKSVLVDGQLSLVGTVNLDMRSLWLNFEITLVIDDDGFGADLAQVQDDYIARSALLDGERWNKRPLWHRVTERLFYFFSPLL

SEQ ID NO: 14280 - DNA, 1461 bp, Brucella suis 1330
  CDS (1)..(1461): transl_table=11
atgcttgatctcgtttcccattattggccgcacattctgtttgtcctgtcgatcgttctcggagcgattgccgccattcatgcgacgatgaccaaggaggaagtgcgcacggccattggctgggtcggcgtgatcgtgctgtcgcccatcgtgggggcggttgtctatgcgattgcgggcgtcaaccgtatccggcgttcgacactgagctatcagcgcgccaatctcagcaatatcgcgctctaccacctctcgcatttcgacacgacgaacgaccgggtgcgggccgctttcgggcggcagttcggcgcgatgaaaattctgggcgatgcggtgagcctttatgattttaccagcggcaacactattgaaatgctggaaacgggtgatgaagcctatgccgcaatgcttggcgccataggccgggccgagcgcagcattgtgctggaaacctatattttcgaccatgacgccattggtaaaaaatttgccgatgcgcttggcgatgcggtgcagcgcggcgtggaagtgcgggtgctggtggatgcggtgggcgcgcgttattcctttccaagcattgtgaagcttttgaaagaaaagggcgtcaaggtcgctgtgttcaacggcaatatcatcatcggcctgcgtctgccctatgcgaacctgcgcacccaccgcaagatgctgattgtcgatggtcagactgcctttaccggcggcatgaatattcgcgccgggtttgtgagggctatcgcaggcgatgcggttgccttcgatacacatttcaaactcgaagggcctgccattgccgacctcttccatattgcctcggaagactggcgttttgcgaccggcgagcttttgacgggcgaagcctggagcatcgcgccaccggaaaatccacccggaacgggaacgctggtgcgtgtcgtcgggtcagggccggacaagaacctcgaaacgaaccatcgcatgatgatgggggcgttttcgattgcccagcagcatattctcatcatgacgccctatcttttgccggaccgcgaattgataagtgcgctggtgacggcggcacggcgcggcgtatcggtcgatatcgtggtgccgggtgtcaacaatctgaagctggtggaccgcgccatgcgcgcccagtttgatcagcttttgcgggacggctgccgcatctggcgtgctggcggggccttcaatcactcaaagctcatgaccatcgatggcgcctggtcctatgtcggctcgtccaatatcgatccgcgctcgctgcggctcaatttcgaggtcgatcttgaaatcctcgaccgggatgtggcacggcaggtggaagagcgtatcggacgggtgatcgagaaaagccgtgaggtcaaccttgtgcgcctgaagaaccgcccttttctggagcggctgcttgacaggatcatctggctcggctcaccttttctttga

SEQ ID NO: 14281 - protein, 486 aa, Brucella suis 1330
MLDLVSHYWPHILFVLSIVLGAIAAIHATMTKEEVRTAIGWVGVIVLSPIVGAVVYAIAGVNRIRRSTLSYQRANLSNIALYHLSHFDTTNDRVRAAFGRQFGAMKILGDAVSLYDFTSGNTIEMLETGDEAYAAMLGAIGRAERSIVLETYIFDHDAIGKKFADALGDAVQRGVEVRVLVDAVGARYSFPSIVKLLKEKGVKVAVFNGNIIIGLRLPYANLRTHRKMLIVDGQTAFTGGMNIRAGFVRAIAGDAVAFDTHFKLEGPAIADLFHIASEDWRFATGELLTGEAWSIAPPENPPGTGTLVRVVGSGPDKNLETNHRMMMGAFSIAQQHILIMTPYLLPDRELISALVTAARRGVSVDIVVPGVNNLKLVDRAMRAQFDQLLRDGCRIWRAGGAFNHSKLMTIDGAWSYVGSSNIDPRSLRLNFEVDLEILDRDVARQVEERIGRVIEKSREVNLVRLKNRPFLERLLDRIIWLGSPFL

SEQ ID NO: 14282 - DNA, 1503 bp, Corynebacterium efficiens YS-314
  CDS (1)..(1503): transl_table=11
atgagcatatccatcgacctggaagtctggcagaccatcggtctgatcgtggactacacgatcaagatcatcgccatcggttatgtccccgagggccgccgccccagcacctccaccgcctggctgctggccattctcctcatccccttcctgggcctgccgctgttcctgctcatggggtcgccctatatcaataaacggcgacaccgcatccagcaggagatcaatgatctcatcgaggacgtccacgatgatgtccccgactatcccgacggggtcagtgtccacccggagctcgaatccgtcatccgcctgaaccggcgcctgaccaacatgcccgccgtgatcggtgtcaaccacggggtgcactccgactatgacgccaccatcaaacgcatgaccgcggccgtggatgaggcacaggactacatctacgtcgagatctacatcatggcctgggatgacacgaccaagcccttcttcgaggccctggaacgcgccgagaaacgcggggtgaaggtgcgtctgctcttcgaccacgtgggcagctggaaataccccggctaccgcaaactgaagaagaacctcaccgccatgggcatcgagtggtacctcatgctgcccctgcagccgtggcgccgacgcttccgccgacccgacctgcgcaaccaccgcaagatgctcatcatcgacggacacctcggtttcatggggtccctcaacatgatcgatgccagctacctgcagcgcaagaacatcaagatcggccgcaaatgggtggacctcatggtggaactctccggccccatcgtgtcctccatggagatggtcttcgccggtgactggtacgtcgaatccaatgaggccctggagatccgcgaccacgaggaggcccacaccaccatccccgacaccgcccagaactcccagaagaacctggtgcagctggtgccgtccggccccgggtacaacaccgaacccaacctgcggatgttcaactccatcgtgcaccacgcgaaatcacggctggtgctgtgcagcccctatttcatccccgatgaatccctcctggaagccgtcacctccgcctgctaccggggtgtgcaggtggaactgttcgtctccgaggaggccgaccagttcatggtcaaccatgcccagtcctcctactaccaggcgctgctggaggccggggtgaaaatctacatgtaccccaagcccttcgtcctgcacaccaaatatgtcctcgcggatcccgaccactccgccgacggtgtgccggtgggcgtggtcggatcctccaacctggatatgcgcagtttcggcctgaactatgagatctccatgatggtggccaagggcgatctgatcaacgatctcaacgacctgaccgagcactacaaggacatctgcctccggctcaccctggaccagtggaaccagcgcagctggggaaggcgttatctggacaatgtcatgcggctgacctcggcgctgcagtag

SEQ ID NO: 14283 - protein, 500 aa, Corynebacterium efficiens YS-314
MSISIDLEVWQTIGLIVDYTIKIIAIGYVPEGRRPSTSTAWLLAILLIPFLGLPLFLLMGSPYINKRRHRIQQEINDLIEDVHDDVPDYPDGVSVHPELESVIRLNRRLTNMPAVIGVNHGVHSDYDATIKRMTAAVDEAQDYIYVEIYIMAWDDTTKPFFEALERAEKRGVKVRLLFDHVGSWKYPGYRKLKKNLTAMGIEWYLMLPLQPWRRRFRRPDLRNHRKMLIIDGHLGFMGSLNMIDASYLQRKNIKIGRKWVDLMVELSGPIVSSMEMVFAGDWYVESNEALEIRDHEEAHTTIPDTAQNSQKNLVQLVPSGPGYNTEPNLRMFNSIVHHAKSRLVLCSPYFIPDESLLEAVTSACYRGVQVELFVSEEADQFMVNHAQSSYYQALLEAGVKIYMYPKPFVLHTKYVLADPDHSADGVPVGVVGSSNLDMRSFGLNYEISMMVAKGDLINDLNDLTEHYKDICLRLTLDQWNQRSWGRRYLDNVMRLTSALQ

SEQ ID NO: 14284 - DNA, 1158 bp, Pseudomonas putida KT2440
  CDS (1)..(1158): transl_table=11
atggcggggccggtcttcccctggcgggatggcaatcagttcgaactgcttatcgacggccctgcgttctttccgcgcatgctcctggcgatcatgcgtgccgagttccaggttgacctggagctgtacctggtcgaggccggtgcctgtgccgaggcggtggtcgacgcgctggagcaggctgcccggcgtggcgtgcgggtgcggtgcctgttcgatgactacggttcattggccttcaacagcgcgttgcgtcagcgcctgctggacgctggcgtgtacttgcgctggtataaccgcctgcgctggaagcgtggcctgcgtaacctctaccgtgatcatcgcaaattgctactggttgacgaacgttgggcagtggtgggggggacgggcgttaccgacgagttctggacgccgggtgaggcgaccagcgaatggcacgaagtgatggtgcagatgcaggggccggtggtgagcgactggcagttgctgttcgaccgtcagtggcaagccaacaaccgccgcaccgcctggcgccctgctgaaggctttggcctgccgcgtctgcccaaggtgcctgcgcaggggcagggcatgggccgggtcgcttatgccgacgcccgccagcaccaggacatcctgcacgcgctggtacgggcgctgaacagcggccagaaacgggtgtggctggccacgccgtacttcttgccgacctggagcgtgcgccggtcgttgcgccgggctgccagcaagggcctggacgtgcgtctgttgttgaccggcccgcgtaccgatcacccctcggtacgctacgccgggcatcgttactacccgcgtctgttgcgcgcgggcgtacggattttcgagtaccagccgtgcttcctgcacctgaagatggctgtggtagacgactgggtcagcgtcggttcgtgcaacttcgaccactggaacttgcgcttcaaccttgaagccaacatcgaagcgctcgacccgccgttgacagcggcggtggtggccagcttcgagcgcgacttcgcccagagcgaagaagtcgacctcgcccactggcatgcgcgcccttggtggcgcagggtgaagcaacggatctggggctggctcgatcggctggtggtcaacttcctcgaccgccgtgactga

SEQ ID NO: 14285 - protein, 385 aa, Pseudomonas putida KT2440
MAGPVFPWRDGNQFELLIDGPAFFPRMLLAIMRAEFQVDLELYLVEAGACAEAVVDALEQAARRGVRVRCLFDDYGSLAFNSALRQRLLDAGVYLRWYNRLRWKRGLRNLYRDHRKLLLVDERWAVVGGTGVTDEFWTPGEATSEWHEVMVQMQGPVVSDWQLLFDRQWQANNRRTAWRPAEGFGLPRLPKVPAQGQGMGRVAYADARQHQDILHALVRALNSGQKRVWLATPYFLPTWSVRRSLRRAASKGLDVRLLLTGPRTDHPSVRYAGHRYYPRLLRAGVRIFEYQPCFLHLKMAVVDDWVSVGSCNFDHWNLRFNLEANIEALDPPLTAAVVASFERDFAQSEEVDLAHWHARPWWRRVKQRIWGWLDRLVVNFLDRRD

SEQ ID NO: 14286 - DNA, 1554 bp, Pseudomonas putida KT2440
  CDS (1)..(1554): transl_table=11
ttgagactccagcgagccttgcctctgctgctggtgttgttgctcggcgttgccggttgcacaagcatcagcgcgccccgcgaaaccagccaggcgttgcctgcccacgaatcggcctttggccgctcggtgctgcgccaggccgcgccctatggcggccgctcgggctttcgcctgctgcccaacagcaacgaggcatttcgcgcccgcgccgaactgatacgcaacgcccaggcgagcatcgacctgcagtactacatcgtccacgacggtctcagtacccgcgcccttgtgcatgaactgctgcgcgctgccgaccgtggcgtgcgcgtgcgcatcctgctcgacgacaccaccagcgacggcctggacaccgtcatgggcaccctcgatgcccatccgaacatccacattcgcgtgttcaacccactgcatctggggcgcagtaccggcgttacgcgcgccgtgggccggctgttcaacttgtcgcgccagcaccggcgcatgcacaacaagctgttcctggtggacaacagcatggccatcgtcggcgggcgcaacctgggcgacgagtatttcgatgccgagcccaacctcaacttcaccgacatcgacctgctgggcgtgggcccggtagccgagcagctggggcacagcttcgaccagtactggaacagcgccctcagccggccgatcaccgatttcctctggcatgacccggatgccaacgacctgcgggctagccgccagcgcctggaagtgtcgctggccaaagccaggacccagcgcaaggccctgtacgaccgcttgatggcctatcagtcgcagccgcgcctggatgtgtggcgcaacgagctgatctgggctcacgcacaggccctatgggatgcgcccagcaaggtgttggccgaagacgaaccggacccgcaattactgctgagccagcaactggctccggacctggctaacgtgcaccgcgagttggtcctggcatcggcctactttgtaccgggcgaaccggggctgctgtacctgaccggccgcgccgacgctggcgtttcggtgaagctgctgaccaactcgctggaagccaccgacgtgccggcagtgcatggaggctatgcaccctatcgtcgtgccttgcttgagcacggggtgcagctttacgagcttcgccgccagccaggcgaccccagcgcggggcgactgagtttccgtggcagctcggattcgagcctgcacaccaaggcgatcgtgttcgaccggcgcaagaccttcatcggctcgttcaacttcgacccgcgctcagtattgtggaacaccgaggtcggggtactggtggacagcccggagctggccgaatacacccgcgaactggcccagcagggtatggcgcctgcgctgagctatcaggtgaaactgataggtaacaagctggtgtgggcgaccgaggacaatggccaacggcacgtgctgacgtctgagccgggcgggatctggcgacgcttcaatgcctggatcagcaaggcggttggcttggagaagatgctatag

SEQ ID NO: 14287 - protein, 517 aa, Pseudomonas putida KT2440
MRLQRALPLLLVLLLGVAGCTSISAPRETSQALPAHESAFGRSVLRQAAPYGGRSGFRLLPNSNEAFRARAELIRNAQASIDLQYYIVHDGLSTRALVHELLRAADRGVRVRILLDDTTSDGLDTVMGTLDAHPNIHIRVFNPLHLGRSTGVTRAVGRLFNLSRQHRRMHNKLFLVDNSMAIVGGRNLGDEYFDAEPNLNFTDIDLLGVGPVAEQLGHSFDQYWNSALSRPITDFLWHDPDANDLRASRQRLEVSLAKARTQRKALYDRLMAYQSQPRLDVWRNELIWAHAQALWDAPSKVLAEDEPDPQLLLSQQLAPDLANVHRELVLASAYFVPGEPGLLYLTGRADAGVSVKLLTNSLEATDVPAVHGGYAPYRRALLEHGVQLYELRRQPGDPSAGRLSFRGSSDSSLHTKAIVFDRRKTFIGSFNFDPRSVLWNTEVGVLVDSPELAEYTRELAQQGMAPALSYQVKLIGNKLVWATEDNGQRHVLTSEPGGIWRRFNAWISKAVGLEKML

SEQ ID NO: 14288 - DNA, 1575 bp, Vibrio vulnificus CMCP6
  CDS (1)..(1575): transl_table=11
atgcctgccgtgccacttccagaatatctgaagaatccattttttgggcttggtccgttgcgaacatttatccataaagcattgacgtattgttctgtgatgttgctctgcgcgtgtacatcactcgaaaatcactcaccgttcgacaagcaaccgagctaccaactgggctaccaagccgactctcgcctttcggcctatcttaaccatcatcctcaagacagagaaaacttgaccgcttttttccctctggacaaagggcatgatgcgcttctcgcgagattggcgttaatcgaggcagccgataaaacgctcgatttgcaatactacatcttccgcaatgacgaaaccggacaattactgacatggcgtttatttgaagctgcccaacgaggggtccgagttagaattctcctcgatgatatgcagaaaaggaacgatgaaggattggctcgattaagcgctcatcccaacattcagattcgcttgtttaacccgcatcaatatcgaacggcacgtacgcttgcgatggccagtgatttttcacgactcaatcggcgcatgcacaataagtccctcaccgcagacagtgtggtggccattgttggtggccgtaacatcggtaacgagtatttttcggttaactctccagtcgaatttggggattttgatttgatgctttatggcaacagcgttgaacagaccgccgagcaatttgatttgtattggaacagtctccatgccgtaccaattgagtggctcaccgacaaccccattcccgtcaccgaagaggaattgcaagcttggctaaaagaaacccaactagaacaaaagtttactcaaggtcgatacgactttactcagttgcaactgtaccaacagtttaccgataagagtttggtttggtattggggtaaagggcaggtttggtatgatctgcctgacaaagtcgacacacaagcaccacaattagcagacaacctcgcttcgcttttaagaaccgtgaaggattccctcgtccttatctcgccctatttcgttccaacggaacgcggcacacaagccttggtagaagcggcccatcgcggcgtcgacatcactattgtcaccaacagcttggcctcaaatgacgtctttgctgtgcacggctggtacgccaagtatcgacaagatcttgtcgaagcgggcattcagttatgggaaaccaaagccagcgcaagaattgacagcaaatggagtttcactggcagcagccgctcaagcctgcatgctaaagtgctgttaatcgaccaccgattgctgtttgccggctccatgaactgggatcctcgttcggctttgctcaacaccgaaatggcagcagtgatcgaacatcctgattacgttcaatcgtcagaagccaaattgcctatgggtttagaaaccaatgcctatcaggtgcgaatgaaaaacggtgaagtggcttggtttgatcaccaatctcaagtttggtttgattccgaaccggaagccacggtatggcggaaaatcggcgcttggtttgctggcattttacccattgaagagcaactttag

SEQ ID NO: 14289 - protein, 524 aa, Vibrio vulnificus CMCP6
MPAVPLPEYLKNPFFGLGPLRTFIHKALTYCSVMLLCACTSLENHSPFDKQPSYQLGYQADSRLSAYLNHHPQDRENLTAFFPLDKGHDALLARLALIEAADKTLDLQYYIFRNDETGQLLTWRLFEAAQRGVRVRILLDDMQKRNDEGLARLSAHPNIQIRLFNPHQYRTARTLAMASDFSRLNRRMHNKSLTADSVVAIVGGRNIGNEYFSVNSPVEFGDFDLMLYGNSVEQTAEQFDLYWNSLHAVPIEWLTDNPIPVTEEELQAWLKETQLEQKFTQGRYDFTQLQLYQQFTDKSLVWYWGKGQVWYDLPDKVDTQAPQLADNLASLLRTVKDSLVLISPYFVPTERGTQALVEAAHRGVDITIVTNSLASNDVFAVHGWYAKYRQDLVEAGIQLWETKASARIDSKWSFTGSSRSSLHAKVLLIDHRLLFAGSMNWDPRSALLNTEMAAVIEHPDYVQSSEAKLPMGLETNAYQVRMKNGEVAWFDHQSQVWFDSEPEATVWRKIGAWFAGILPIEEQL

SEQ ID NO: 14290 - DNA, 1485 bp, Staphylococcus epidermidis ATCC 12228
  CDS (1)..(1485): transl_table=11
atgatagaagtctttactatggcacttcatcaatctaatattataattaatattttattagttagtgcctttttattaaatttagtttttgcattcattattattttcatggagaggcgtacagcaaattctatatgggcgtggttattggttttagtttttctacctttagtaggattcatattgtatttattattaggtcgccaaatacagagagaacatatatttaaactcgccaaagaggataaagttggtcttgaaatgattgttgacgagcaattagaggcattgaaaaagcaagacttttctaagggtaatcatcaaattgttaaatttaaagaaatggtacaaatgttactttataataatgctgcttttttaacaactgataatgatctaacaatttatacagatggtcatcagaagttcgatgatttaattaatgatattagacacgcacaatcatatattcacatccaatactacattattcatagtgataatctcggaaagcaattgttacatgaattagaaaaaaaagctgaagaaggtatagaagttaaaatgctatacgatgatatgggctcaagagatttacgaaagaaagatctaaaaaagtttcgtcaaaaaggcggtcacgctgaatctttctttccatcaaaattaccacttattaatttaagaatgaataatagaaaccacagaaaaatagtagtcattgacggtacgattggatatgttggtggttttaatgtaggagatgaatatataggtaaatctaagaaatttggttattggagggacacacacttacgtattaaaggtgacgcggtaaatgcccttcaacttagattcatcttagattggaactcacaatcaactcgtgacaatttaacttatgaatctcgatattttcctgatgttgactctggtggtacgataggcatacaaattgcttcaagtgggcctgatgaagattgggaacaaattaaatatggttatttaaaaatgatttcatcagccaaagaatctatatacattcaatcaccatacttcattcccgatcaagcttttttagattcgattaaaattgcagcgcttggtggtgtggatgttaacatcatggttcctaacaaacgtgatcatccctttgtttattgggctacgcttaaaaacgtagcgtctttacttgaagctggcgttaatgtctatcattatgataatggttttctacattcaaaaacacttgtcattgatgatgaggtagcaagtgtaggaactgccaatatggataatcgaagctttacattaaactttgaggtcaatgcttttatttatgatgaaggcgtagcacgatcattaaaacaagctttcattaatgatatgaaattatctaacaagctcacttctgaagaatatgctaaacgaaatctgctagttaaattcaaagaagggatttcacaactactttctccaattttataa

SEQ ID NO: 14291 - protein, 494 aa, Staphylococcus epidermidis ATCC 12228
MIEVFTMALHQSNIIINILLVSAFLLNLVFAFIIIFMERRTANSIWAWLLVLVFLPLVGFILYLLLGRQIQREHIFKLAKEDKVGLEMIVDEQLEALKKQDFSKGNHQIVKFKEMVQMLLYNNAAFLTTDNDLTIYTDGHQKFDDLINDIRHAQSYIHIQYYIIHSDNLGKQLLHELEKKAEEGIEVKMLYDDMGSRDLRKKDLKKFRQKGGHAESFFPSKLPLINLRMNNRNHRKIVVIDGTIGYVGGFNVGDEYIGKSKKFGYWRDTHLRIKGDAVNALQLRFILDWNSQSTRDNLTYESRYFPDVDSGGTIGIQIASSGPDEDWEQIKYGYLKMISSAKESIYIQSPYFIPDQAFLDSIKIAALGGVDVNIMVPNKRDHPFVYWATLKNVASLLEAGVNVYHYDNGFLHSKTLVIDDEVASVGTANMDNRSFTLNFEVNAFIYDEGVARSLKQAFINDMKLSNKLTSEEYAKRNLLVKFKEGISQLLSPIL

SEQ ID NO: 14292 - DNA, 1959 bp, Xylella fastidiosa Temecula1
  CDS (1)..(1959): transl_table=11
ttgaatatattcatacgtttgttgctgctagcagctgttttgttgggcagtggttgcgctagcctgtcgcatgcccagttggattatgctgcgtcggtcgccgtggctgcgcgcccggctacgctggattgtgacaggcccaatcgttgtgcgttggattcgccgttgtacgcgcttgggagccgagcgctgagtgaatctacgcctgtgacaccacttcactatgtcaccatcctcgataaaggcgagagcgcgttggtcgcacggatcaatttgatccgcagtgctacccgcagtatcgacatgcagacttacatttttgacaaggacgatagtgcccggttgatcatggatgagctattgactgctgccagacgtggtgttcgagttcgtttactgattgaccagctttcggcgatttctgatctgaatattctgggtgccttggctggtgcacacgttaatttccaactacgtatctacaacccgatttttggcaaagccaagctgaactatggtgactatgttgccagcgtgctgtgttgttttcgtcgatttaatcagcgcatgcacaataaattgttggtcattgatgaaatgatcggcgtggtcggcgggcgtaattaccaagatgactattatgattgggatcttgaatataattttcgtgaccgtgatgtgcttgtcgccggaccggcggtgctgcaaatggcagttaactttgatgcgttttgggcggctgagcgcagcgtaccggtagagcgcctcagggatgttggacgtatggtgctgcaggatggggtgccgatgctgccatcagctgtcttcaatctgttggaacgggtccagcgtgttactgctgaggccaacgatccggactatgtcaagcgcacttttgtcgatgcggccttggctgtgaacaaagtgcaatatgttgctgacctgccgcaaaagcatcgctatgagcacaacgcaaatccggtttccatcgggccacggttggatagtttgatttctaatgcgcgtcatgaggtgatcttgcagaccccatatctggtgttgtccaaaccagcgctgaacatcttccgtcgcctcaatcggactcaggacaaaccgcgcgtggttgtggtgaccaacagtttggctgctaccgataatcccatcgtctatgccttattttacaaatacaagcggcgtaacatgcgtgacctggggttcgacatttacgagtacaagccgtttccggaaaatccgccaatcgacctgacgggcgttgttccgattgaaggatggaacaatgactctcttcagaggcgacaggaccttttggctgctgccaaagtctccgatgattcagacaatgctcgtcagttacctcagcttgaaaataaaggtcaagtggataggcgtgttttacgtactgaaacgcgtccgcccttttggcgcattcacactgtcaataaaccattacctgtgacccgtccgggcgcacgcatgggcttgcatgcaaaatcattggtggttgatcgtaaggttggagtgattggtacccacaacttcgatccgcgcagtgagagttacaatactgaagctgttgtggtgattgaggatccagcgtttgccggtctgttggcttccagtattgagggtgacattgctccaggtaatgcgtgggtcgtggcaccgcggaagaagttacctgggctctataagctcaattattcggtaggtaaactgtctgaggcattgcctgtgctggacctgtggccttggcgctatgcaaccaactatgaattcaaacccgggttggattgtccaataccattgccacgtcgggatccgaatttcatgcaatgttatgaacctgtcggtgactttcctgaagtcaatgttggtccaaagtggttgttggtgcggatgctgattgcattcggtgctgggctggtgcctatcttgtaa

SEQ ID NO: 14293 - protein, 652 aa, Xylella fastidiosa Temecula1
MNIFIRLLLLAAVLLGSGCASLSHAQLDYAASVAVAARPATLDCDRPNRCALDSPLYALGSRALSESTPVTPLHYVTILDKGESALVARINLIRSATRSIDMQTYIFDKDDSARLIMDELLTAARRGVRVRLLIDQLSAISDLNILGALAGAHVNFQLRIYNPIFGKAKLNYGDYVASVLCCFRRFNQRMHNKLLVIDEMIGVVGGRNYQDDYYDWDLEYNFRDRDVLVAGPAVLQMAVNFDAFWAAERSVPVERLRDVGRMVLQDGVPMLPSAVFNLLERVQRVTAEANDPDYVKRTFVDAALAVNKVQYVADLPQKHRYEHNANPVSIGPRLDSLISNARHEVILQTPYLVLSKPALNIFRRLNRTQDKPRVVVVTNSLAATDNPIVYALFYKYKRRNMRDLGFDIYEYKPFPENPPIDLTGVVPIEGWNNDSLQRRQDLLAAAKVSDDSDNARQLPQLENKGQVDRRVLRTETRPPFWRIHTVNKPLPVTRPGARMGLHAKSLVVDRKVGVIGTHNFDPRSESYNTEAVVVIEDPAFAGLLASSIEGDIAPGNAWVVAPRKKLPGLYKLNYSVGKLSEALPVLDLWPWRYATNYEFKPGLDCPIPLPRRDPNFMQCYEPVGDFPEVNVGPKWLLVRMLIAFGAGLVPIL

SEQ ID NO: 14294 - DNA, 1404 bp, Xylella fastidiosa Temecula1
  CDS (1)..(1404): transl_table=11
atggaagggacttggctgtttgcattggattgggtgatccgtttggttgcgttgctttggatcccggcacgaaccacccctagtgctgcgcgcagctggttgttactgattggtttcgtccctgtgtttggcttgccactttacttggtgtttggccatccttggctgtcacgtaagcgtgtgttgcgtcaggcgttggcttctcatgtgatccgtgagtggcagcgtgggttgggtgcattgcgctggcagcctcaggagaatggcgtcgctgcggaattggtacctttggtggagcatcagggcgattttatgccaacacgtggtaacgccttggatctattggatgattaccaagcttcgctgcatttgttgatcaatgatattgattccgcgtgcgaacgtgtgcacttgctgtattacttgatgttcgatgatgcggtgggtgatgcggttgtggctgcattacagcgtgctgcggcgcgtggcgtttcttgccgattgctgctggatgcagtcggtgctaaacgcggtctacgtgcctatcagcagtgccttcgtgcccatggtgtggaggtgcacgctatgttgcctggtgggttgcgctggcgtcgcagtgggcgtatggatttgcgcaaccaccgtaagattgctgtgatcgacaatcgggtcgcttatatcggttcgcagaatttggcatgtccagattttgtgccgcatttccccaaccgtgaattggtcgcacgcgtgtgcggccctgcggtaagtcatctggaggcggtgtttctcagtgattggtttgttgaaactggtcaacgtttggggatgcgtccagatgttcccatatgtgagcaaaatgttgcggcccagctagtggccagcggtccggcttacccgtacgagaatgcgcgtgatgcggtgaatacaatgatccatttggcacggcggcgtattgtcttgacgacgccgtacttcgtgcctgatgaggccacactcagtgcgttgcgtattgcaggcacatctggagtagacgtgcagttgatcctgtccgagagtaataaccagtttctgatggcctgggctcaggaggcgtactttgaggagctgttgcgcgcaggaatcaaaattgcgttgtatcgtccccatttcctgcatgccaagcatctgagtgtggatgatgatattgcgttgttcggatcgattaatttggacatccgctcgttcgcgcttaacgctgagattggcatgatttgttacgactcacgtattgtgactcagttacgtgaggtggagagtgattatctggccaatgcgcgccagcttaatttggttgagtggcagcaacgtcccgcttggcgtcgtagccgtgagggtattgcacgcttggcagatgctctgatgtag

SEQ ID NO: 14295 - protein, 467 aa, Xylella fastidiosa Temecula1
MEGTWLFALDWVIRLVALLWIPARTTPSAARSWLLLIGFVPVFGLPLYLVFGHPWLSRKRVLRQALASHVIREWQRGLGALRWQPQENGVAAELVPLVEHQGDFMPTRGNALDLLDDYQASLHLLINDIDSACERVHLLYYLMFDDAVGDAVVAALQRAAARGVSCRLLLDAVGAKRGLRAYQQCLRAHGVEVHAMLPGGLRWRRSGRMDLRNHRKIAVIDNRVAYIGSQNLACPDFVPHFPNRELVARVCGPAVSHLEAVFLSDWFVETGQRLGMRPDVPICEQNVAAQLVASGPAYPYENARDAVNTMIHLARRRIVLTTPYFVPDEATLSALRIAGTSGVDVQLILSESNNQFLMAWAQEAYFEELLRAGIKIALYRPHFLHAKHLSVDDDIALFGSINLDIRSFALNAEIGMICYDSRIVTQLREVESDYLANARQLNLVEWQQRPAWRRSREGIARLADALM

SEQ ID NO: 14296 - DNA, 1437 bp, Clostridium tetani E88
  CDS (1)..(1437): transl_table=11
atgaaaattagtttcacatcctttttgtccatattcttctttataaatattataataattacattagttataatattagaaagaaaaagaccagaaaaaaccattgcatggcttttaataataactctattaccacctataggtatttttttatatgtatttttaggccgaaattggaaaattcataaattaaataatgatttttctcctaaaattagagaacttatctatagatctatggataaaatagatgatcctgattatgtaccccttattcatttaatagctgaaaatagtgaatctcctttatttctaaataattcaatagaaatatttaaagatggtacagaaaaatttcaagctttgaaaagagaaatattaaatgctaaacatcatatacatttagaatattacatcgtaaaaaatgacataataggtaatgaaataaaaaatttgttaatagaaaagtctttagaaggtgtcgaagtacgatttattttggatagagtaggatccataaagcttggtaaagaattcattaatgatatgattaaaaatggtattgatgtagttcagtactcatattttcttgctcctttactaaagaaaataaatactcaagttaactatagaaaccatagaaaacttgtcattatagacggtgaagttggatttattggtggtattaatattggagacgaatatttaggaaaaggcgaattaggatattggcgagatactcacataatggtcaaaggagactttgtattaggactccaagccgtgtttatagatgacttttggacaataaaaaaagcaaataatgatagtattttaataaatacagactttcattcctactttcctaaggttaatcaatctgggaaaaaattaatgcagctagctaaaagtggccctaattctccatattcatcaattatgcaaggaatattaaaaatgatatatatggctactgatcatatatacatcacaacaccatattttgttccttccgaaagtattatggaagctttaaaaatagcttgtttgagtggaatagatgtaagaattttatttcctggtcaatatgatcattttacagtatactctgcttcgagaacttatttagctgaactcctaaagtctggagccaaagttcatttttatgacgaaaattcctttgttcacgcaaaaattattactgtagatggaaaggtgtctactataggtactgctaatatggatattagaagttttgatttaaattatgaaataaatgctataatatatgatgaagaaacaactattaagttagaagaaatgttttttgaagatcttaaccatagtaaaaatgtaacagaacaggatttcaatgaaacctctaactttatgaagtttatagaagctataactaggttgttttcttctctgctataa

SEQ ID NO: 14297 - protein, 478 aa, Clostridium tetani E88
MKISFTSFLSIFFFINIIIITLVIILERKRPEKTIAWLLIITLLPPIGIFLYVFLGRNWKIHKLNNDFSPKIRELIYRSMDKIDDPDYVPLIHLIAENSESPLFLNNSIEIFKDGTEKFQALKREILNAKHHIHLEYYIVKNDIIGNEIKNLLIEKSLEGVEVRFILDRVGSIKLGKEFINDMIKNGIDVVQYSYFLAPLLKKINTQVNYRNHRKLVIIDGEVGFIGGINIGDEYLGKGELGYWRDTHIMVKGDFVLGLQAVFIDDFWTIKKANNDSILINTDFHSYFPKVNQSGKKLMQLAKSGPNSPYSSIMQGILKMIYMATDHIYITTPYFVPSESIMEALKIACLSGIDVRILFPGQYDHFTVYSASRTYLAELLKSGAKVHFYDENSFVHAKIITVDGKVSTIGTANMDIRSFDLNYEINAIIYDEETTIKLEEMFFEDLNHSKNVTEQDFNETSNFMKFIEAITRLFSSLL

SEQ ID NO: 14298 - DNA, 1458 bp, Lactobacillus plantarum WCFS1
  CDS (1)..(1458): transl_table=11
gtgcctccattgcaatatattcagccaattttctatacaattatcgttttaaacgcggccgcggcgttcgttaccgtgttccgggatcgtaatcgggacatcgcggccacttgggcttggctactcgtgttgatttggttgccgattattgggtttatcgcgtacgcctttgtcggtcgtaagttaccgaaaaaccggttatttcggttacgtaaagagacgcaaattagactcgaacagatgattcagcggcaacgtgaagccctgggaacggaattgatgcccgcagatgcggtcactagctcggttcgtgggatggtcagtttattcttgaattccgatggcgcgttactaagccgtaaaaaccgggtcaagatttatacggatggacatgagaagttccatgcgatgttccaagatattgaagcagctaagaatcatattcatattgaatattacacattttataatgaccagattggaaatgaattattacaccttttagaacggaaagcagcccaaggcgtcgacgttcgtgtcttgtatgatccgtgggggtcgatgggcacgttccgcagcttctttaagcatttagaagaacttggtgggcatgcccgaccgttcttgggtgctcattcagcgattttggacttccgtctcaacttccgtgatcaccgtaagatcgtggtaacggatggccgggtcggctacgtcggtggttttaacgttggtgaccagtaccttggtcgtagtaagaagtttggttactggcgtgatacccatttgcggatcgtcggttcaggagtttttgaattgcaggaacgtttcattcgtgattggaacgccaccgatgcggaacatcgaatcgtgccagacgttaatatgttcccagtcattcgcgttaaagggaatacttcgttacagatcgtctccagtggtccggacagtgatgcgcaacagattaaattgggttatattaaaatgattatgacagctcaacaccgtttatggattcagtcgccatacctaattccggacgattccgtattagatgcgattaaaatcgctgcgatgtcaggggttgacgtccgcattatggtgccggacaaacctgatcatgcctttgtttaccgggcaactcagtactatgcccgggagctggcagatgctggtgtaaaaatctattattataataatggttttattcatgccaagaccatcgtgattgatggtcaggtggcgtcagtgggctcagctaatatggacttccggagctttaagctcaactttgaagtgaacgcctttttatatgatgctgatttagcacaagaattggaacggattttcttagaagatcaaaaaatcagtagtttgattaccgttcaagactttaaaaatcaatcattctggttgaagttcaagcagacattttcacggttgttatcaccaattttataa

SEQ ID NO: 14299 - protein, 485 aa, Lactobacillus plantarum WCFS1
MPPLQYIQPIFYTIIVLNAAAAFVTVFRDRNRDIAATWAWLLVLIWLPIIGFIAYAFVGRKLPKNRLFRLRKETQIRLEQMIQRQREALGTELMPADAVTSSVRGMVSLFLNSDGALLSRKNRVKIYTDGHEKFHAMFQDIEAAKNHIHIEYYTFYNDQIGNELLHLLERKAAQGVDVRVLYDPWGSMGTFRSFFKHLEELGGHARPFLGAHSAILDFRLNFRDHRKIVVTDGRVGYVGGFNVGDQYLGRSKKFGYWRDTHLRIVGSGVFELQERFIRDWNATDAEHRIVPDVNMFPVIRVKGNTSLQIVSSGPDSDAQQIKLGYIKMIMTAQHRLWIQSPYLIPDDSVLDAIKIAAMSGVDVRIMVPDKPDHAFVYRATQYYARELADAGVKIYYYNNGFIHAKTIVIDGQVASVGSANMDFRSFKLNFEVNAFLYDADLAQELERIFLEDQKISSLITVQDFKNQSFWLKFKQTFSRLLSPIL

SEQ ID NO: 14300 - DNA, 1497 bp, Tropheryma whipplei str. Twist
  CDS (1)..(1497): transl_table=11
gtgaagccctatttgtttatattggcggccctgctattggccgaccttgtcatccgtattggctgcctttttgttgttcctcgcaatagacgtcctaattctgccaacgcctggcttctcacaatattctttctgccgtttattggatggtttctttttttgataataggcagctacaagctcccaaaatcaagaagagaaaaacaggctcttataaaccagcttgttgcaaatgcactgtcagatcatgcagtattggacaatgtagatctgcaatggctaccatctctggtaaaactaaacagaaatcttggatctatgccgatggttgcgggaactcgtgtacatattcttactgatacaagtgtgattatggagcagatggtatctgccattgattcagctaaaagcagtgtacacgttgagttctacatcttttcgctggatgaatttacgcagggctttttcacaagccttgaaaatgcgaccgcccgcggggtaaaggttcgggttttatatgatcacatcgcaactttgcgcgtccctggatatctgaatatgaagtctcgccttaagcgcaatgggattgaattttatccgatgcttccgattcagcccttcaagttgaaatatcagaggcctgacctgcgcaatcatcgaaaattgcttgtaattgatgatgcaattgcatttgttggatcgctaaacattattgatcctttttataacacgaggggtcgcaagaaaatgttttggcaagatgcgatgctgcgccttgaaggacccgttataagcgggataagcgcggtttttgtctctgattggtacgcagaaacaggccagctcctgagagactacagaattgtaaaaacttcatccggcgattccttcacagaaaaccgcacacaatcaaacagtgttgataggagttgcccgagtacaaataacgttttatgtcaagtagttccttctggtcctggatttgagggggaaaataacctccaattgtttctaatgctcctttatgcatcgcaaaaacgggttgcaattacatcaccgtacttcgtgccggacgaggcaatgactttagcaatcgcgtcggcgactaaaaggggggttagtgtcgaactgtttttatctgaaaaccatgaccaaaaaattgtttaccacgctcagtgttcgtactacgaacagctattgagaagcggcgtaaagatttggctataccgtgcaccaaatttcttacacagcaaatatgtaactgttgatgatgatgttgccgtttttggatcaagcaattttgatatgcgctctttcaatctgaatatggaaatgtcactgttgctctacagcaaggaatttgttgcaaaactgcaggcggttgaacaggaaaaccgagcaaatagctccctgctcaccctcgatgaatggatgcaccgcgggaaaatggaccgcttgaaagataatctagctagacttacatccgccctgcaatag

SEQ ID NO: 14301 - protein, 498 aa, Tropheryma whipplei str. Twist
MKPYLFILAALLLADLVIRIGCLFVVPRNRRPNSANAWLLTIFFLPFIGWFLFLIIGSYKLPKSRREKQALINQLVANALSDHAVLDNVDLQWLPSLVKLNRNLGSMPMVAGTRVHILTDTSVIMEQMVSAIDSAKSSVHVEFYIFSLDEFTQGFFTSLENATARGVKVRVLYDHIATLRVPGYLNMKSRLKRNGIEFYPMLPIQPFKLKYQRPDLRNHRKLLVIDDAIAFVGSLNIIDPFYNTRGRKKMFWQDAMLRLEGPVISGISAVFVSDWYAETGQLLRDYRIVKTSSGDSFTENRTQSNSVDRSCPSTNNVLCQVVPSGPGFEGENNLQLFLMLLYASQKRVAITSPYFVPDEAMTLAIASATKRGVSVELFLSENHDQKIVYHAQCSYYEQLLRSGVKIWLYRAPNFLHSKYVTVDDDVAVFGSSNFDMRSFNLNMEMSLLLYSKEFVAKLQAVEQENRANSSLLTLDEWMHRGKMDRLKDNLARLTSALQ

SEQ ID NO: 14302 - DNA, 1497 bp, Tropheryma whipplei TW08/27
  CDS (1)..(1497): transl_table=11
gtgaagccctatttgtttattttggcggccctgctattggccgaccttgtcatccgtattggctgcctttttgttgttcctcgcaatagacgtcctaattctgccaacgcctggcttctcacaatattctttctgccgtttattggatggtttctttttttgataataggcagctacaagctcccaaaatcaagaagagaaaaacaggctcttataaaccagcttgttgcaaatgcactgtcagatcatgcagtattggacaatgtagatctgcaatggctaccatctctggtaaaactaaacagaaatcttggatctatgccgatggttgcgggaactcgtgtacatattcttactgatacaagtgtgattatggagcagatggtatctgccattgattcagctaaaagcagtgtacacgttgagttctacatcttttcgctggatgaatttacgcagggctttttcacaagccttgaaaatgcgaccgcccgcggggtaaaggttcgggttttatatgatcacatcgcaactttgcgcgtccctggatatctgaatatgaagtctcgccttaagcgcaatgggattgaattttatccgatgcttccgattcagcccttcaagttgaaatatcagaggcctgacctgcgcaatcatcgaaaattgcttgtaattgatgatgcaattgcatttgttggatcgctaaacattattgatcctttttataacacgaggggtcgcaagaaaatgttttggcaagatgcgatgctgcgccttgaaggacccgttataagcgggataagcgcggtttttgtctctgattggtacgcagaaacaggccagctcctgagagactacagaattgtaaaaacttcatccggcgattccttcacagaaaaccgcacacaatcaaacagtgttgataggagttgcccgagtacaaataacgttttatgtcaagtagttccttctggtcctggatttgagggggaaaataacctccaattgtttctaatgctcctttatgcatcgcaaaaacgggttgcaattacatcaccgtacttcgtgccggacgaggcaatgactttagcaatcgtgtcggcgactaaaaggggggttagtgtcgaactgtttttatctgaaaaccatgaccaaaaaattgtttaccacgctcagtgttcgtactacgaacagctattgagaagcggcgtaaagatttggctataccgtgcaccaaatttcttacacagcaaatatgtaactgttgatgatgatgttgccgtttttggatcaagcaattttgatatgcgctctttcaatctgaatatggaaatgtcactgttgctctacagcaaggaatttgttgcaaaactgcaggcggttgaacaggaaaaccgagcaaatagctccctgctcaccctcgatgaatggatgcaccgcgggaaaatggaccgcttgaaagataatctagctagacttacatccgccctgcaatag

SEQ ID NO: 14303 - protein, 498 aa, Tropheryma whipplei TW08/27
MKPYLFILAALLLADLVIRIGCLFVVPRNRRPNSANAWLLTIFFLPFIGWFLFLIIGSYKLPKSRREKQALINQLVANALSDHAVLDNVDLQWLPSLVKLNRNLGSMPMVAGTRVHILTDTSVIMEQMVSAIDSAKSSVHVEFYIFSLDEFTQGFFTSLENATARGVKVRVLYDHIATLRVPGYLNMKSRLKRNGIEFYPMLPIQPFKLKYQRPDLRNHRKLLVIDDAIAFVGSLNIIDPFYNTRGRKKMFWQDAMLRLEGPVISGISAVFVSDWYAETGQLLRDYRIVKTSSGDSFTENRTQSNSVDRSCPSTNNVLCQVVPSGPGFEGENNLQLFLMLLYASQKRVAITSPYFVPDEAMTLAIVSATKRGVSVELFLSENHDQKIVYHAQCSYYEQLLRSGVKIWLYRAPNFLHSKYVTVDDDVAVFGSSNFDMRSFNLNMEMSLLLYSKEFVAKLQAVEQENRANSSLLTLDEWMHRGKMDRLKDNLARLTSALQ

SEQ ID NO: 14304 - DNA, 1629 bp, Pseudomonas syringae pv. tomato str. DC3000
  CDS (1)..(1629): transl_table=11
gtgggtcatatcgccaagtcgagccatctccagacgcggaaggtcaatttgaacaactcatgggccttgcccttttgcttgctggtggctgtgtgcgtcagtggttgcgcgcaccagcagatcgccagcgagccgagccaggccatgccgccctcggattctgcctttggccgttcgattcaggccatggcgatgccgcacgaggggcgttcgggttttcggctgttgcctgacagcagcgacgccttcaaggcccgcgccgaactgatccgtaacgccaaaaccagcctcgacctgcagtattacatcgtccacgacggccttagcacgcgcgcgctgatcgacgagctgctcaaggcggcagaccgtggcgtgcgggtgcgcatcctgctggacgacaccaccagcgatggcctcgatcaggccatcgccacgcttgctgcgcatccgaacattcagattcgcctgttcaacccgcaaaacctgggccgcgaaaccggcgtcacccgtagcctgggacgcttgatgaacctgtcgcgtcagcaccggcgcatgcacaacaagctgtggctggccgacagcagtgcggccatcgtcggcgggcgcaatctgggcgatgaatacttcgacgccgagcccaatctcaatttcaccgacatcgacatgctcagcgtcgggccggtcgccgagcagctcggccacagctttgatcagtactggaacagcacgctcagcaagcccatcgatcaattcatgtacttcctgcccgatggccaggacctggccgaggcccggcagcggctggacgattcgcttgagcaggctcatcagcagcacaaggcgctgtatgagcggttgatggcctacaagactcagccacgcatgaaaacctggctcaacgagttggtctgggcgcataaccaggcgctgtgggatgcgccgactaaagtgctggcacagggcgagcctgatccacacctgctgttgaccacgcaactggcccccgagctgctgaacactcgcaaggagctgatgctgatttctgcgtactttgtgcccggtcaggaaggcttgctgtacctgactggccgtgccgatgccggggtcaacgtcagcctgctgaccaattcgctggaagccaccgatgtgcccgccgtgcatggtggttatgcgccgtatcgcaaggcgctgctggagcacggtgtgaagctgtatgaactgcgtcgccagcccggtgagaccgaaaccatgcgcagtagcggcccgcatttgttcaggaaaagccattcactggtcagctcggaatcgagcctgcacagcaaggcgatgatctttgaccggcagaaagtgtttgtcggctcattcaacttcgacccacgctcagtgttgtggaacaccgaagtcggcgtattggtcgacagcccgcaactggcggaagaactgcgcgagctgacgctgcagggcatggccccgtcgctcacgtacgaagctcggctggaagacggcaaagtggtgtgggtgaccgaggacaacgggcagatccacacgctgcacaccgagccgggcgactggtggcggcgcttcaatgcctggatgagccgtgccatcggtcttgagagaatgctttag

SEQ ID NO: 14305 - protein, 542 aa, Pseudomonas syringae pv. tomato str. DC3000
MGHIAKSSHLQTRKVNLNNSWALPFCLLVAVCVSGCAHQQIASEPSQAMPPSDSAFGRSIQAMAMPHEGRSGFRLLPDSSDAFKARAELIRNAKTSLDLQYYIVHDGLSTRALIDELLKAADRGVRVRILLDDTTSDGLDQAIATLAAHPNIQIRLFNPQNLGRETGVTRSLGRLMNLSRQHRRMHNKLWLADSSAAIVGGRNLGDEYFDAEPNLNFTDIDMLSVGPVAEQLGHSFDQYWNSTLSKPIDQFMYFLPDGQDLAEARQRLDDSLEQAHQQHKALYERLMAYKTQPRMKTWLNELVWAHNQALWDAPTKVLAQGEPDPHLLLTTQLAPELLNTRKELMLISAYFVPGQEGLLYLTGRADAGVNVSLLTNSLEATDVPAVHGGYAPYRKALLEHGVKLYELRRQPGETETMRSSGPHLFRKSHSLVSSESSLHSKAMIFDRQKVFVGSFNFDPRSVLWNTEVGVLVDSPQLAEELRELTLQGMAPSLTYEARLEDGKVVWVTEDNGQIHTLHTEPGDWWRRFNAWMSRAIGLERML

SEQ ID NO: 14306 - DNA, 1251 bp, Pseudomonas syringae pv. tomato str. DC3000
  CDS (1)..(1251): transl_table=11
atgaacaataccaaaacgccgtggtgcgatggcaactcggtcgagctgctgatcaatggcgaagattttttcacccgagtattcgagtgcatacgcgccgcccgcaaagaagtgctgatcgaaaccttcatcatctttgaagaccggatcggcgagggcctgcagcaggcgctgctgcaggcggccgccaatggcgcgaacgtggtggtcacggtggatgactacggcacttcggatttgagttctacctttgtcagaaccatgattgacgccggcatccagattcagttgttcgacccgcgcccgcgtttcatgggcatgcgcaccaacctgttccgtcgcctgcaccgcaaggtggtggtgatcgacggcgagctgggctttatcggcggcatcaattacagcgtcgatcacatgaccgacaccggcctgaccgccaaacaggactacgccgttctggtacgcggcccgatcgttggtcgtattcatcagagtgcgatgaacatgctcagcaaggcagtgcgcgccagactgacgcccacgccgctcaagctggaccgtgccggtgacgcgcagatgctgctggccgaacgtgacaatggcgaacacaccaccgatatcgaagagcaatacctcgaggcgattcgtggtgcgacgcaacgcattaccctggccaatgcctatttcttccccagctaccgttttctgcgcgaactgcgtaacgcatcacggcgcggcgtgaaggtcacgctgattctgcagggccagccggacatgccgttcgtgcgggtctgttcgcgtctgacctacacctacttgctgcgcgacggcgtggtcatccatgagtacaagcagcgcgcactgcacggcaaggtggcgctgatcgatcaggaatggtccacggtcggctccagcaacctcgacccgctcagccttgcacttaatctggaagccaatctgttcattcgtgacaaggcgctgaatcagcacctgcaaggccacctgatggagcttgccgctgcgcacagcacacagatgagcctgaagggcgcggcacgcggtcaatggtggcgggcgccgatgatcgttttgagcttcttttttctgcgccgttttccggcgattgccggtctgttcccggttcacggcgtgcggctcaagcccttgcgtgccggcgatgtggtgcctgaagccaaagtgatcgagcagcagcagaacaatcatccgctggaccaggagaaaaccttatga

SEQ ID NO: 14307 - protein, 416 aa, Pseudomonas syringae pv. tomato str. DC3000
MNNTKTPWCDGNSVELLINGEDFFTRVFECIRAARKEVLIETFIIFEDRIGEGLQQALLQAAANGANVVVTVDDYGTSDLSSTFVRTMIDAGIQIQLFDPRPRFMGMRTNLFRRLHRKVVVIDGELGFIGGINYSVDHMTDTGLTAKQDYAVLVRGPIVGRIHQSAMNMLSKAVRARLTPTPLKLDRAGDAQMLLAERDNGEHTTDIEEQYLEAIRGATQRITLANAYFFPSYRFLRELRNASRRGVKVTLILQGQPDMPFVRVCSRLTYTYLLRDGVVIHEYKQRALHGKVALIDQEWSTVGSSNLDPLSLALNLEANLFIRDKALNQHLQGHLMELAAAHSTQMSLKGAARGQWWRAPMIVLSFFFLRRFPAIAGLFPVHGVRLKPLRAGDVVPEAKVIEQQQNNHPLDQEKTL

SEQ ID NO: 14308 - DNA, 1158 bp, Pseudomonas syringae pv. tomato str. DC3000
  CDS (1)..(1158): transl_table=11
atgaacggtgcgatttttccgtggcgtgaagacagccgctttcaattgctgattgatggcccggcttttttcccgcgcatgattgcagccatcgatcgcgcagagcagcaggtcgatctggagctgtacctggtcgaagccggggcctgcgccgatgcggtggtgcgggcgctggtcgaggcgggcaggcgcggtgtgatcgtgcgctgcctgtttgacgatttcggctcgaaagcgtttgatgccgggctgcgcaaacagctgactgacgcaggcgtcatcctgcgcttttacaacccgatccactggcggcgcggcgtgcgcaatttctaccgcgaccatcgcaagatactggtggtggacaaggcccttgccgtggtcggcggcaccggtgtaaccgacgaattctgggagcccgacaaggatgtcagccagtggcacgaggtcatggtggaaatcgccgggccgctggtgctcgactggcaagcgctgttcgaccgtcagtttcacgccaacgcccgacgctttgcctggcgcccgaaacaaaactttggtctcgatcacctgcccaaagcgcctgtcactggcgaggggctggggcgggtagcgtatgccgactcccgccagcaccgggacattctgcaatcgctggtgcgcaccctgcacagcggccagaaacgcatctggctggcgacaccgtattttctgcccacctggaaagtccgccgcgcattgcgcagcgcggcggcgcgtggtgtcgatgtacgtttgctgctgaccgggccgcgcaccgatcacccgtccgtgcgctacgccggtcaccgctactacccgcgcctgctccgcgccggggtcaaagtctttgaataccagccgtgctttctgcacctgaaaatggtcctgatcgacgactgggtaagcatcggctcgtgcaacttcgatcactggaacctgcacttcaacctggaagccaacctcgaagcccacgatccaggcctgacccgggacgtagccgccagcttcgaaaaagacttcgccctgagcaccgaaatcaccctggaagactggaaagcccggcccctgtggcgacgcgtcaaacagcgcctgtggggctggattgaccggctggtggttaacttgttggatcagcgtaattga

SEQ ID NO: 14309 - protein, 385 aa, Pseudomonas syringae pv. tomato str. DC3000
MNGAIFPWREDSRFQLLIDGPAFFPRMIAAIDRAEQQVDLELYLVEAGACADAVVRALVEAGRRGVIVRCLFDDFGSKAFDAGLRKQLTDAGVILRFYNPIHWRRGVRNFYRDHRKILVVDKALAVVGGTGVTDEFWEPDKDVSQWHEVMVEIAGPLVLDWQALFDRQFHANARRFAWRPKQNFGLDHLPKAPVTGEGLGRVAYADSRQHRDILQSLVRTLHSGQKRIWLATPYFLPTWKVRRALRSAAARGVDVRLLLTGPRTDHPSVRYAGHRYYPRLLRAGVKVFEYQPCFLHLKMVLIDDWVSIGSCNFDHWNLHFNLEANLEAHDPGLTRDVAASFEKDFALSTEITLEDWKARPLWRRVKQRLWGWIDRLVVNLLDQRN

SEQ ID NO: 14310 - DNA, 1197 bp, Bacteroides thetaiotaomicron VPI-5482
  CDS (1)..(1197): transl_table=11
atgacgcatcccagagactccatagctctgacaagtgactcccttgtattacgtttcttatcggagtcagggattcctatatccgacaataacaaggtcagattactgaaaagcggacgagaaaaattcattgatttattcagcgccatccgcgacgccaaacaccacatccatctggaatatttcaatttccgcaatgactctatagccaatgcgctgttcgacctgctggccgaaaaagtgaaagaaggcgtggaagtacgagccatgttcgatgcgttcggcaactggtcgaacaataaaccgctcaagaagagacatctcaaaaaaatacgagagcagggaatcgagattgtcaagttcgacccgttcacctttccctacatcaatcatgcggcacaccgtgatcaccgcaaaatagccgtcatcgacggtgaagtcgcctatacgggaggaatgaacatcgccgactactacatcaacggactccccaaaatcggtacatggcgtgatatgcacatgagaatagaaggcgatgccgtcaatgacctgcaagaaatatttcttaccatatggaacaaggagactaaacaaaatattggcggcgaagcatacttccccaagcacaaggagcagtcggacagcaccaatgtagtcgtcgccatcgtagaccgcacaccgaagaaaaacagccgtatgctcagtcatgcttatgccatgtcgatctattcggcacagaaaaacgtgcacatcgtcaacccgtattttgtgcccacatcctccatcaacaaggcgcttcaacgcaccatcgaacgaggtgtggatgtcacgattatggtttcttctgcctccgacatcccgtttactccggacgccgccctctacaaacttcacaaactgatgaaaaggggggccaccgtctatatgtacaatggcggtttccaccattccaaaatcatgatggtcgacgatattttctgcacggtaggcaccgcaaacctgaacagccgcagcctccggtacgactacgagacgaacgctttcatctttaacaaggaaattacaggcgaactgaacgaaatgtttcggaacgatatagaacactgtacgcagctaacaccggaattctggaaaaagcgctcaccgtggaagaagttcgtcggatggtttgccaatttattcacgccatttttgtaa

SEQ ID NO: 14311 - protein, 398 aa, Bacteroides thetaiotaomicron VPI-5482
MTHPRDSIALTSDSLVLRFLSESGIPISDNNKVRLLKSGREKFIDLFSAIRDAKHHIHLEYFNFRNDSIANALFDLLAEKVKEGVEVRAMFDAFGNWSNNKPLKKRHLKKIREQGIEIVKFDPFTFPYINHAAHRDHRKIAVIDGEVAYTGGMNIADYYINGLPKIGTWRDMHMRIEGDAVNDLQEIFLTIWNKETKQNIGGEAYFPKHKEQSDSTNVVVAIVDRTPKKNSRMLSHAYAMSIYSAQKNVHIVNPYFVPTSSINKALQRTIERGVDVTIMVSSASDIPFTPDAALYKLHKLMKRGATVYMYNGGFHHSKIMMVDDIFCTVGTANLNSRSLRYDYETNAFIFNKEITGELNEMFRNDIEHCTQLTPEFWKKRSPWKKFVGWFANLFTPFL

SEQ ID NO: 14312 - DNA, 1425 bp, Bacteroides thetaiotaomicron VPI-5482
  CDS (1)..(1425): transl_table=11
atgaggtggatatggtattgtacattgttagcgtatatcgcattcctattagggctgatttacactattataattgattacgacgacaaaaatcctgtgaagacgatctgctggattctagttgttatattcttaccattactgggtatatctgcctattatattgtaggacgtaatgtaagcaaaaagcgttcaaaatttcagttttggagagaagaattcaacaggcaccaacaatccgtttctaccaacgtggaaacagagccaatacatcccgatcattataaagaactaaaatcactcatattgaatctggaacagtcaccagtattcggaggtaacaaagtaactgtctatccgggtggtaaaagtaagttttacagtcttttcgaagatatcgactgtgccgaatcgcatattcatatcttctattatgctattggcgacgaccatatcggcaacgaattaaaagagaagattatcaataaggtaaaacaaggcatcaaagtacgactgctttacgacggactgggatgcaataaaacgaacagaaaatatttcaagcaaatgatagaagcaggcgtggaagtgaaaacgttcctcccgcttagttttccccgcttcctgcgaagtgtcaattaccgcaatcataaaaagatagtcatcatcgacggcagaatcgcctataccggtggcatcaatgtaaaagacgtatacatagacggacttctctggggaaaatggaatgacatacacttcaaggttgaaggttccggagcttcggggctgcaatctgtgtttctggcagactggtattatgcttccggacaatatctgtcttcaccggagtattatcccaatgtcgaagtcttcggagaagtaccaattcaagtagtcaacgcggaaccgttgggaatgcattccaatgtaatggaagccatgtttacagctataacgcgggcgaaaaagaatgtatatatcgagactccctacttcataccgacggaatgtctgcttcaggcaatacagaccgcatcaatgagcggaatagacgttcgccttgtcatgcctaaaagatcagacaatgattttgtgcaatatgcctctaactcatatgtggagaaactattaagaaataaagtcagagtctatcaatatgtcaatggatttacacattcaaagttgatgattgtcgatgatgaactggtggtagtcggttcagccaatatggatataagaagccttgaacttcttttcgagaccaatctgttcatttacgacaagaaagttgctcagaccgtcagagacatttatcacaccgatatgaataatagtaaagaactaaatctacgcgactggctccaacgcaaccgttcggttaaatttcgcgaagcgtgtttccggttgttttctccggtatattag

SEQ ID NO: 14313 - protein, 474 aa, Bacteroides thetaiotaomicron VPI-5482
MRWIWYCTLLAYIAFLLGLIYTIIIDYDDKNPVKTICWILVVIFLPLLGISAYYIVGRNVSKKRSKFQFWREEFNRHQQSVSTNVETEPIHPDHYKELKSLILNLEQSPVFGGNKVTVYPGGKSKFYSLFEDIDCAESHIHIFYYAIGDDHIGNELKEKIINKVKQGIKVRLLYDGLGCNKTNRKYFKQMIEAGVEVKTFLPLSFPRFLRSVNYRNHKKIVIIDGRIAYTGGINVKDVYIDGLLWGKWNDIHFKVEGSGASGLQSVFLADWYYASGQYLSSPEYYPNVEVFGEVPIQVVNAEPLGMHSNVMEAMFTAITRAKKNVYIETPYFIPTECLLQAIQTASMSGIDVRLVMPKRSDNDFVQYASNSYVEKLLRNKVRVYQYVNGFTHSKLMIVDDELVVVGSANMDIRSLELLFETNLFIYDKKVAQTVRDIYHTDMNNSKELNLRDWLQRNRSVKFREACFRLFSPVY

SEQ ID NO: 14314 - DNA, 1440 bp, Bacteroides thetaiotaomicron VPI-5482
  CDS (1)..(1440): transl_table=11
atgattgactggaacatactagttagccagatagctacggttgcttttgatatcgtttattttggagccattatcagtacgattgtcgttatcattcttgataaccggaatccggtgaagactatggcatggatactcatattacttttcctcccaattgtcggtcttgttttttatttcttctttggtcggagtcagcgtcgggaacgtatcatcggtcaaaaaagttatgaccgccttttgaagaaacctatggcggaatacatggcgcaagactgttcggatgtacctgaagaatatgcccgccttatccaacttttccagcataccaatcaagcttttccatttgagggaaaccgtattgctgtctatacggaaggctataccaaattgcaatcattgcttcgtgagctccaaaaggcgaaacaacacattcatatagaatactatatctttgaagatgatgctataggacgtttggtaagggatgtactaatcgaaaaagcatctcagggggttgaagtaagagtaatttatgatgatgtggggtgctggcatgtacctaaccgctttttcgaggaaatgcgtaatgcaggtattgaagtcaggagtttcttgaaagtacgcttccctttgtttacaagcagggtcaattatcgtaaccacagaaaaatagtcgtgatagacggacgtatcggttttgtgggaggtatgaacctggcagaacgttatatgcgtggtttctcatgggggatttggcgtgacacccatattctgatagaaggaaaggctgtgcatggtctgcaaacggcctttttgctcgactggtatttcgttgaccgtacattgattacagcttcacgttatttcccaaagatagaatcttgtggaagttcattagttcaggtggttaccagtgaacccattggcccctggaaagaaatcatgcaggggctgactatggcgatcaatggagcgaagaagtatttctatatgcaaaccccttatttcctgccgacagagcaagtacttgccgctatgcagacagctgcactggcaggagtagatgtgcgtttgatgttgccggaacgtgccgacaaccgaatcactcatttgggatcgcattcttacctggcagatgtgatgcaggcaggtgtcaaagtctatttttataagaaagggtttctgcactccaaactgatggtttctgatgatatgctctctacagtagggtctaccaatgttgacttccgtagttttgagcataattttgaagtaaatgcctttatgtatgatgtggaaacggctcttgaaatgaaggagatattccttcaggatcagcgggaaagtacacagatctttctgaaaaactgggtgaaacgttcgtggaggaggagggcagcagagtctgtcgttcgtttgttggctccgctgctttaa

SEQ ID NO: 14315 - protein, 479 aa, Bacteroides thetaiotaomicron VPI-5482
MIDWNILVSQIATVAFDIVYFGAIISTIVVIILDNRNPVKTMAWILILLFLPIVGLVFYFFFGRSQRRERIIGQKSYDRLLKKPMAEYMAQDCSDVPEEYARLIQLFQHTNQAFPFEGNRIAVYTEGYTKLQSLLRELQKAKQHIHIEYYIFEDDAIGRLVRDVLIEKASQGVEVRVIYDDVGCWHVPNRFFEEMRNAGIEVRSFLKVRFPLFTSRVNYRNHRKIVVIDGRIGFVGGMNLAERYMRGFSWGIWRDTHILIEGKAVHGLQTAFLLDWYFVDRTLITASRYFPKIESCGSSLVQVVTSEPIGPWKEIMQGLTMAINGAKKYFYMQTPYFLPTEQVLAAMQTAALAGVDVRLMLPERADNRITHLGSHSYLADVMQAGVKVYFYKKGFLHSKLMVSDDMLSTVGSTNVDFRSFEHNFEVNAFMYDVETALEMKEIFLQDQRESTQIFLKNWVKRSWRRRAAESVVRLLAPLL

SEQ ID NO: 14316 - DNA, 1446 bp, Enterococcus faecalis V583
  CDS (1)..(1446): transl_table=11
ttgattcttagcgtcttaacagttatttattttattaatgcaattattgcgggaattaccattttgttaaaacctcgagatgtagcagcaatttgggcatggctactcgtactgattgctctacccgtttttggttttttcttatatttattctttggtcgaggtttaaccgacaaaaagaaattttatttgcaacaaagtgatttacgggaattagagaatttccagaatttccaagaagaaagttttgaactttatagtcaaaagatgccgacggaggagcaacaacagtttacagactttttttcctcgttaaataggatgcctctgactaagaaaaatgatgttgaaatttttacggatggtacggaaaaattcaatgcgttgatggcggatataaaaaaagctcagcactccattcatattgaatattatgcctttgtaacggatcatatcggcaccaaaattttgaacttattagaagaaaaggcggctgaaggggttgaagtgcggttgctttacgatgcctttggctcaaagggcaccaaggttcatcatttgaatgaattgaaaaaaaacggtggttttgtccaaacgtttattacttctcaaaaagcacttttgaagtttcgtttgaattatcatgatcaccggaaaattgttgttattgacggaaaagtaggctacattggcggctttaatgttgccgatcaatatgccggaacgactaaaaagtttggctattggcgggatacacatttacggattcaagggccagcagcctcattactgcaaatgcgttttttaatggattggaacgtctcttcccccgagaaaaatcgtgtggcgtatcaattggattatttctttaaacttgaagcattggtgccagaggcaaatacatccattcagatgattgccagtggtcctaacagtgaccgtgaacaaattaaattggcctttattaaattgattacttctgccaagaaaagagtctggattcaaacgccgtatttagttcctgatgatagtgtcttggctgctttaaaggttgctgcggcttcaggagtagatgttaaaattatgattccagataagcccgaccatccgtttatttatcgagcaacacagtattacggccgcttattgatgaaagaaaatattgaaattttaatttataacggtggtttcttacatgcgaaaacaatgatcatggatgatgaagtctgcacagttggttcagccaatcaagatatccgaagttacaaattaaactttgaagcaaatgctgtgttatatgataaaaaaatcattgatcaattagaagcaattttcttagaagatcgaaaaaaatgtacaacaatgactccagaagttgttcgcgacatgtcaaaatggttgatttttaaacaacaaatttcacgattattttcaccaattctttaa

SEQ ID NO: 14317 - protein, 481 aa, Enterococcus faecalis V583
MILSVLTVIYFINAIIAGITILLKPRDVAAIWAWLLVLIALPVFGFFLYLFFGRGLTDKKKFYLQQSDLRELENFQNFQEESFELYSQKMPTEEQQQFTDFFSSLNRMPLTKKNDVEIFTDGTEKFNALMADIKKAQHSIHIEYYAFVTDHIGTKILNLLEEKAAEGVEVRLLYDAFGSKGTKVHHLNELKKNGGFVQTFITSQKALLKFRLNYHDHRKIVVIDGKVGYIGGFNVADQYAGTTKKFGYWRDTHLRIQGPAASLLQMRFLMDWNVSSPEKNRVAYQLDYFFKLEALVPEANTSIQMIASGPNSDREQIKLAFIKLITSAKKRVWIQTPYLVPDDSVLAALKVAAASGVDVKIMIPDKPDHPFIYRATQYYGRLLMKENIEILIYNGGFLHAKTMIMDDEVCTVGSANQDIRSYKLNFEANAVLYDKKIIDQLEAIFLEDRKKCTTMTPEVVRDMSKWLIFKQQISRLFSPIL

SEQ ID NO: 14318 - DNA, 1461 bp, Enterococcus faecalis V583
  CDS (1)..(1461): transl_table=11
atgaaaatttttgtttggattttgttatttttattagtaattaacgttattgctgccttaattactgtttttagaaaacctcgtagtatttccagcgttttagcatggatgatgacgttgattttcttgcctggtatcggctttattatttacttattctgtgggcgaggtatcgatggacaagaagtttttaaattgtctgatgatgaaaaacaaatggttcaacgaattaaagaaaaagtggacgttgataacaaaaaagcagggcgcgataaacgttatgatttactttatgatgcgaaagttttaaatcgttatttccggaatatggacgcatcaccgttggccaaaagaaatagtttgcaattattcacagatggccaagaaaaattccaagcattatttgaagatattcgtgcagcgaaagaaaccgttcatgtggagtattatgcgttttttaatgacacaattggcaatcaatttttagatgtattaatcgaaaagttgcatgaaggcgtggaagtttacttaatttacgatccttggggttcacccggcgcaaataaaaagttttttgctcgttacgttgacgctggaggaaaagtagctccctttattacttctcgtgatatgatccgtaaaacacgtctaaattatcacttgcatcgaaaaattgttgtcatcgatgggaaaattggctggaccggcgggttcaatgttggggatcaatatttgaatgtcaccgaaaaatttggttactggcgagatacccatattcgtttggtcgggacggccgtattttcattgcaagagatatttatcatggattggaatgcttcagtcaaatatcctgaagaacgtatgacgtatcatgaaaaatattttaaattaccagaagatcatgaagtggagcatttgtccttacaagttgtttcagatggtcctgattcagaagaagaaattttgaaaagcgggtttgttcggatgattttctctgcagaaaagagtgtctggattcaaacaccgtatttaatccctgatgatagtatgattaatgcgttgttagtggcggttcgttcaggtgtcgacgtgcgaattatgattccttgtatgcctgaccatccctttatttaccgcgcgacacaatattacgcaaattacttacacaaacgcggcattaaaatttatatttatgatagtgggtttattcatgcaaaaacaatggtgattgatgatgaattagctatggttgggacaacaaaccaagatattcgcagttattcattgaattttgaggtaagtacgtttatttacaatcccgacattgcgtggatgttagcgcaagtctttgaagaagatatagaaaaaagtgtcttactaaccgacgagataattaaaaaacaagggtactggctacgattcaagcaaaacttttcacgcttgttgtccccagtcttgtaa

SEQ ID NO: 14319 - protein, 486 aa, Enterococcus faecalis V583
MKIFVWILLFLLVINVIAALITVFRKPRSISSVLAWMMTLIFLPGIGFIIYLFCGRGIDGQEVFKLSDDEKQMVQRIKEKVDVDNKKAGRDKRYDLLYDAKVLNRYFRNMDASPLAKRNSLQLFTDGQEKFQALFEDIRAAKETVHVEYYAFFNDTIGNQFLDVLIEKLHEGVEVYLIYDPWGSPGANKKFFARYVDAGGKVAPFITSRDMIRKTRLNYHLHRKIVVIDGKIGWTGGFNVGDQYLNVTEKFGYWRDTHIRLVGTAVFSLQEIFIMDWNASVKYPEERMTYHEKYFKLPEDHEVEHLSLQVVSDGPDSEEEILKSGFVRMIFSAEKSVWIQTPYLIPDDSMINALLVAVRSGVDVRIMIPCMPDHPFIYRATQYYANYLHKRGIKIYIYDSGFIHAKTMVIDDELAMVGTTNQDIRSYSLNFEVSTFIYNPDIAWMLAQVFEEDIEKSVLLTDEIIKKQGYWLRFKQNFSRLLSPVL

SEQ ID NO: 14320 - DNA, 1176 bp, Coxiella burnetii RSA 493
  CDS (1)..(1176): transl_table=11
gtgattaaaaaaaaaggtattatggaaagtcgtccgctgccgacaaactattgcgaacgcctcttcacagacggacagaagcacttcgatgagctgctattggatatcgaagaggcgaaacattccatcgatctggaaacttacttattccacaacgatgcgttaggacaacgggtggcggttaaactcgctgaagccgccgagcgcggtgttaaagttcgaatcatggtggatggcgccggcagtcccttgtggagcaccaatttcgcccgtcttcttgaaagtgcgggcgcacgaactaaggtttttcatccctttccgtggcagctttgggattggagccgctctatcattaaattaccctttctaataaggtggatttaccttattttaaaaataaatttccgcaaccatcgaaaagtctgcattatcgataaaaagatcgcttatattggcagtcttaacattagcaaacaccatctttctaaagccgaaggaggcgacgcatggcgagatacgtcggtgcgtctttctggaattaacttggacgaacttattaaagcgtttgatgccgcttggtatcaccgtaccattaaagagcgtttacgggaaatttttcgtcaaattcgcaaagaccccttgattcgtctgaattattcacggcaccgtcgacgcattttccataaagatctgttgcgcaaaatggcgaattgccaccaccgaatttggatcaccaacgcttactttgtgccagataattttttattaaaaagacttcaagaagcggctcacgccggtattgatgtccgtattttgctgccgcgtaaatcagatgttcccataatgccttgggcctcgtcgacgttttattataatctcttaaatgccggtgtcaggatttttgaatatttacccagcatgttgcatgcaaaatcgctaattattgatgattggatgctggttggctccagtaatttaaatcatcgcagcctcattcatgatttagaagctgatgttaatattacgtctcccgaagccaaaaaaatgttggaggggcaatttctcgaagaccttaaaaattctcgggaagtttctttagacagttggcaaacgctgcgccctcgacgccaacgcattttaggtcgtttggttctttatattaagtactggatataa

SEQ ID NO: 14321 - protein, 391 aa, Coxiella burnetii RSA 493
MIKKKGIMESRPLPTNYCERLFTDGQKHFDELLLDIEEAKHSIDLETYLFHNDALGQRVAVKLAEAAERGVKVRIMVDGAGSPLWSTNFARLLESAGARTKVFHPFPWQLWDWSRSIIKLPFLIRWIYLILKINFRNHRKVCIIDKKIAYIGSLNISKHHLSKAEGGDAWRDTSVRLSGINLDELIKAFDAAWYHRTIKERLREIFRQIRKDPLIRLNYSRHRRRIFHKDLLRKMANCHHRIWITNAYFVPDNFLLKRLQEAAHAGIDVRILLPRKSDVPIMPWASSTFYYNLLNAGVRIFEYLPSMLHAKSLIIDDWMLVGSSNLNHRSLIHDLEADVNITSPEAKKMLEGQFLEDLKNSREVSLDSWQTLRPRRQRILGRLVLYIKYWI

SEQ ID NO: 14322 - DNA, 1215 bp, Streptomyces avermitilis MA-4680
  CDS (1)..(1215)
atgctcgagtcggttgcagctgaaccccggcgcgccgcggcgacggaccaggcgggcaccgaggcacgcaagcagcgtctgcgaagacgtctggagagactcatcggtatcgccgcgaccgagggcaacgagctcgtacccctgcgcaacggtgacgagatcttccccgccatgctccgagccatccgtacggccgagcacaccgtcgacatgatgacgttcgtgtactggcgcgggcagatagcgcgggacttcgcggccgcactggcggagcgtgcccgcgcgggagttcgcgtgcggctgctcctggacggcttcggtgccaagcagatcgaggagggcctcctcgagtccatgaactccgccggcgtagaggtcgcctggttccgcaaaccgctgtggctgtcccccctcaagcagaaccaccgctgccatcgcaaggtgctcgtcgtggacgagcacaccgctttcaccggcggcgtcggcatcgccgaggagtggggcggcgacgcccgcaatccctccgaatggcgcgacacccatgtgcaggtccgcggtccggccgtcgacggcatcgccgccgccttcgcccagaactgggcggagtgccacgacgagctgttcgacgagcgggaccgcttcaccgagcacgagcagtccggtcgggcaaccgtccaggtggtccggggctcggccagcttcggctggcaggacatgcagaccctcgtccgggtcatgctcgcctcggccgaggagcgcttccgcctgtccaccgcctatttcgcgccggacagctacttcgtcgacctgctgtgcgcgaccgcccgccgtggcgtacaggtgcagatcctgctgcccggcccgtatacggaccagcgggcgtgccggctcgccggtcagcactactacggcacgcttctggatgccggggtggagatccgccagtaccagccgacgatgctccacaccaagatcatgaccgtggacggggtcgccgccctgatcggctccagcaacttcaaccgccgctcgatggagcacgacgaggagatcatgctcgccgtgctggacgagaccttcacggcggccctggaccgggacttcgaggaggaccgggagcgggccgaggccatcgtcgcggcacgctggaagcaccgctcccctgtgcagcgcctcaaagaggcgatcgtcgctcccgtacgccgtttcctctag

SEQ ID NO: 14323 - protein, 404 aa, Streptomyces avermitilis MA-4680
MLESVAAEPRRAAATDQAGTEARKQRLRRRLERLIGIAATEGNELVPLRNGDEIFPAMLRAIRTAEHTVDMMTFVYWRGQIARDFAAALAERARAGVRVRLLLDGFGAKQIEEGLLESMNSAGVEVAWFRKPLWLSPLKQNHRCHRKVLVVDEHTAFTGGVGIAEEWGGDARNPSEWRDTHVQVRGPAVDGIAAAFAQNWAECHDELFDERDRFTEHEQSGRATVQVVRGSASFGWQDMQTLVRVMLASAEERFRLSTAYFAPDSYFVDLLCATARRGVQVQILLPGPYTDQRACRLAGQHYYGTLLDAGVEIRQYQPTMLHTKIMTVDGVAALIGSSNFNRRSMEHDEEIMLAVLDETFTAALDRDFEEDRERAEAIVAARWKHRSPVQRLKEAIVAPVRRFL

SEQ ID NO: 14324 - DNA, 1098 bp, Bacillus cereus ATCC 14579
  CDS (1)..(1098): transl_table=11
atgccgacagagtatgcgcctcattatagtgactttcaattatatgtagaagggaagtctttttataaacaattatttactgatataagtgaagcgaaaagctccatttacacgtatttcttcattttgtcggatgataaaagtagccatacttttttaaacttattaaaagagaaggcaaaagaaggagtaaacgtctatttatccgttgatcgcattaatgatttatcatttgaaagaaagatgaaaaatgaattgcaggaaaatggtgtgcattttacatatagtagaaaacctgaattaccattcggcttttattctcttcatcatcgtaatcatcgccgtattacgacgattgatggggagattggctatacaggcggatttaatataggagatgagtacttagggaaagataagcgatttggatattggcgtgattatcatgtacgacttaaaggagaaggagcaaaagatttagaacagcaattcgctttagactggaaacgagatacgaaagaagagataaagagaagtacgaataaagctagtaaagggaatacattacatactatgactagttacaatgggcattacgttgctgaaaaatatatagagctcataaaacaagctcagcactccattgtaattgcaacaccgtattttatagcgaaaaataaagaatctatgaatgctttaatcgcagcacaaaagcgtggtgttacagtaaaaatactttggtcatataaaccagatctacctcttataaaagaagcggcgtatccatacatacgtcaagctgttaataatgggattactgtatatgggtataaaaaaggaatgttccatggtaaattaatgcttattgataatgaattaaccgttattggtacaacaaactttacttcgcgtagcttcaatataaatgatgaaatgaatttttatatttatggtggtcctattgtaggacaagttaataaggcgttaacagaggattttcatgattcgaaagaaatgacgaaagagttttttgaaaagttatctttttgggagcgttgtaaggagaaagtggcgggattggttgacttctatttgtga

SEQ ID NO: 14325 - protein, 365 aa, Bacillus cereus ATCC 14579
MPTEYAPHYSDFQLYVEGKSFYKQLFTDISEAKSSIYTYFFILSDDKSSHTFLNLLKEKAKEGVNVYLSVDRINDLSFERKMKNELQENGVHFTYSRKPELPFGFYSLHHRNHRRITTIDGEIGYTGGFNIGDEYLGKDKRFGYWRDYHVRLKGEGAKDLEQQFALDWKRDTKEEIKRSTNKASKGNTLHTMTSYNGHYVAEKYIELIKQAQHSIVIATPYFIAKNKESMNALIAAQKRGVTVKILWSYKPDLPLIKEAAYPYIRQAVNNGITVYGYKKGMFHGKLMLIDNELTVIGTTNFTSRSFNINDEMNFYIYGGPIVGQVNKALTEDFHDSKEMTKEFFEKLSFWERCKEKVAGLVDFYL

SEQ ID NO: 14326 - DNA, 1194 bp, Bacillus cereus ATCC 14579
  CDS (1)..(1194): transl_table=11
atgctctacttatctcttttgttaatatccgttgctctttggattacaattgacctttcatacgggagacttcttcatttaaaacgagtaagctctcgcactttccctttacgtcaaagtgattttcacctttatacatacgggaaagatttgtatgacgctttatttactgatataaaacaagcacagcatcacattcatattttattcttcattgtaaaaaacgataaaatcagtcgtgaatttttaaaattgctgattgataaggctcaggaaggaattgaagtacgacttttacttgatcgatttggcagccattctttatcaaacgaagctattcgctccctgcaaaaacatggtgtatctttttcattttgtcataaggtaaaatttcctctgcctttcttttctgccaatcaacgaaatcataggaaaattacagtgattgatgggaaaaccggctatatcgggggatttaatatcggtgaagagtatctagggcataatgaatatttaggattatggcgagactaccatttacgtcttacaggagaaggggttcaagatttacaaaagcaatttttgcatgactggtttgatgatacgaaacaaaatttattagatgcttctctttattttccaaaacaaaacccaggtaccatcctgcatcaatttattccgactgatggggcttatttacagcatacttttttacatttaattaacgcggcaaaaaaagaaatctgtatcggtacaccatatttcattcctggaaaaaaaattatgaatgccttattaaaagcaagagaaagaggggttcaaatcacaattcttgttccagaaaaagctgatcaccctcttgttcgagaagccaaatttccgtactgccgaaaattaatacaggcgggttgcaatatttatgcatttcaacaaggtttttttcacgccaaaattattatagtagacgatgatatttgcgatatcggaacagcaaactttgatatgagaagtttatatattaaccatgaaataaactgcctgttatataataaacatttcattcaaacagtaaaaaagaaattccatgaagatctagataatgcatctgtactttcctatagcgatgtaaacccgccttctcttatcgatagaggaaaggaatggattggaacaatatttgctttctttttatag

SEQ ID NO: 14327 - protein, 397 aa, Bacillus cereus ATCC 14579
MLYLSLLLISVALWITIDLSYGRLLHLKRVSSRTFPLRQSDFHLYTYGKDLYDALFTDIKQAQHHIHILFFIVKNDKISREFLKLLIDKAQEGIEVRLLLDRFGSHSLSNEAIRSLQKHGVSFSFCHKVKFPLPFFSANQRNHRKITVIDGKTGYIGGFNIGEEYLGHNEYLGLWRDYHLRLTGEGVQDLQKQFLHDWFDDTKQNLLDASLYFPKQNPGTILHQFIPTDGAYLQHTFLHLINAAKKEICIGTPYFIPGKKIMNALLKARERGVQITILVPEKADHPLVREAKFPYCRKLIQAGCNIYAFQQGFFHAKIIIVDDDICDIGTANFDMRSLYINHEINCLLYNKHFIQTVKKKFHEDLDNASVLSYSDVNPPSLIDRGKEWIGTIFAFFL

SEQ ID NO: 14328 - DNA, 1242 bp, Shigella flexneri 2a str. 2457T
  CDS (1)..(1242): transl_table=11
atgaaatgtagctggcgcgaaggcaataagatccagttgctggaaaacggcgagcaatattatcccgcggtgtttaaggcgattggcgaggcacaagaacgcatcattcttgaaacgtttatctggtttgaggataacgtcggcaaacagctgcatgcggcactactggcagcagcgcaacgcggggttaaagcggaagtcttgctggatggctacggttcgccggatctcagcgatgagtttgtcaatgaactgacggcagctggcgtagtgttccgctactacgatccccgccctcgcctttttggtatgcgcaccaatgtgtttcgccggatgcatcgcaaaattgtggtgatcgacgcgcgtatcgcctttattggcgggctgaattactccgccgagcatatgtccagctacggtccagaggctaaacaggattacgcggtacgccttgaagggccgattgtcgaagatattctccagtttgagctggaaaacctgcctggacagagcgcggcacgacgctggtggcgacgtcatcacaaagcggaagagaaccgccagccgggagaagcgcaggtattgctggtctggcgcgataacgaagaacatcgcgatgatattgaacgccattatctgaaaatgctcactcaggcgcagcgggaagtgattatcgccaacgcctacttcttccccggctatcgatttttacacgccttgcgtaaagcggcacggcgcggggtgcggatcaaactgatcattcagggcgaaccggatatgccgattgtcagagtcggtgcgcgcttgctgtataactatctggttaaaggcggcgttcaggtttttgagtaccgccgccgcccgctccacggcaaagtggcattgatggacgatcactgggcgacagtagggtccagtaatctcgatccgctcagtttgtcactgaatctcgaagcaaatgtcatcatccacgatcgtcattttaaccagacgctgcgcgataatctgaacggcattattgccgcagattgtcagcaggtggatgaaaccatgctgcccaaacgcacctggtggaacctgaccaaaagcgtgctggcgttccactttttacgccacttcccggcgctggttggctggcttccggcacacacaccacgtctgacgcaggttgatccccccgcacaaccgacaatggaaacgcaggatcgggtagaaactgaaaacacgggggtaaacccctga

SEQ ID NO: 14329 - protein, 413 aa, Shigella flexneri 2a str. 2457T
MKCSWREGNKIQLLENGEQYYPAVFKAIGEAQERIILETFIWFEDNVGKQLHAALLAAAQRGVKAEVLLDGYGSPDLSDEFVNELTAAGVVFRYYDPRPRLFGMRTNVFRRMHRKIVVIDARIAFIGGLNYSAEHMSSYGPEAKQDYAVRLEGPIVEDILQFELENLPGQSAARRWWRRHHKAEENRQPGEAQVLLVWRDNEEHRDDIERHYLKMLTQAQREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRHFNQTLRDNLNGIIAADCQQVDETMLPKRTWWNLTKSVLAFHFLRHFPALVGWLPAHTPRLTQVDPPAQPTMETQDRVETENTGVNP

SEQ ID NO: 14330 - DNA, 1158 bp, Nitrosomonas europaea ATCC 19718
  CDS (1)..(1158): transl_table=11
atgagttggcccgattttgtcgaaggtaatcagataacgttattacactccggtacggagtattttccggcactggaatcggccatcgattctgccaggcaggaaatccacctcgaaacctacatttttcagtatgacgcaaccggtgcccgtattgccgctgcactcaagcgggcagcgcagcgtggagtagccgtccacctgctgatcgatgggttcggttctcacggactgtccagaatagtgattcaggagatgcttgcagcgggtgtgcaggtgctgatctaccggcaggaatttttttcgttccggttcaaacgttaccgcctgcgccgaatgcatcgcaaactggcagtaatggatgccagcgtggcgtttgtaggggggatcaacatcattgatgattgctctgagcctgatgcttcgtttccccgctttgattatgctgtccaggttgcaggcccgctgttggcagaaattcatgctgcagcaagacatctgtggatgctggctgcatgggtgtatttcaaaaaacgctggacaaactgttcacccgtcatggccagccgtctgccggcaggtcatcagcgtgcatcgctggttatcagggataatctgcgtaaccggcacagtatcgagcgttgctatctcagatcgattgcggccgcgcgcagggaaatcattcttgccaatgcctattttcttcctggcaagcatttccggcaggctcttgcccgggcagcacagcgaggtgtttcagtcatacttctgctgcagggaaaatcggaataccgcttgcagcattacgccatgcacgcgctctatggccacttgctggatgccggtatcagtatttacgaataccggcatgggtatctgcacgccaaggtggccgttattgacagtgcctggtctactgtcggttcttccaatatcgacccgttcagtctgttactggcgcgtgaggccaacgtcgttatcagtgatcaggtatttgcggtggaattgcggagcagtctgcaacaggcattggaggagtcttacccggtgtcgctgcattcctggaaaagccgctcgcgaatcaagcgttcgctgaactggatgtgttactacttcgtacgtatcctgcaggggttgttgggatatcgacgggaataa

SEQ ID NO: 14331 - protein, 385 aa, Nitrosomonas europaea ATCC 19718
MSWPDFVEGNQITLLHSGTEYFPALESAIDSARQEIHLETYIFQYDATGARIAAALKRAAQRGVAVHLLIDGFGSHGLSRIVIQEMLAAGVQVLIYRQEFFSFRFKRYRLRRMHRKLAVMDASVAFVGGINIIDDCSEPDASFPRFDYAVQVAGPLLAEIHAAARHLWMLAAWVYFKKRWTNCSPVMASRLPAGHQRASLVIRDNLRNRHSIERCYLRSIAAARREIILANAYFLPGKHFRQALARAAQRGVSVILLLQGKSEYRLQHYAMHALYGHLLDAGISIYEYRHGYLHAKVAVIDSAWSTVGSSNIDPFSLLLAREANVVISDQVFAVELRSSLQQALEESYPVSLHSWKSRSRIKRSLNWMCYYFVRILQGLLGYRRE

SEQ ID NO: 14332 - DNA, 1218 bp, Bacillus anthracis str. Ames
  CDS (1)..(1218): transl_table=11
atgaacatgattaaaaaaatattgcgagttacttctattattattgctattttcgcttttattttaatttgtatgcatattgatgttactttaggtaggaaaatggaagctgggaaaaacatgccgacagagtatgcacctcattatagtgattttcaattatatgtagaaggaaagtcattttataaacagttatttactgatataaaagaagcgaaacaatctatttacacttatttttttattttatcggatgataaaagtagccatacttttttaaatttattaaaagagaaggcaaaagaaggagtaaacgtatatttatctgtcgatttacttaacgatttatcatttgaaagaaagatgaaaaaagaattacaggaaaatggtgtgcattttacatatagtagaaaacaggaattaccattcgggttttattcccttcaccatcgtaatcatcgccgcattacaacgattgatggagagattggttatacgggtggttttaatataggggatgaatacttagggaaagataaacactttgggtactggagagactatcatgtacggataaaaggtgaaggtgcaaaagacttagaggaacaatttgctttagattggaaacgagatacgaaagaagatataaagagaagtacggataaagctagtaaagggaatacattacatactatggttagttataatgggcatcacgtcgctgaaaaatatatagatcttataaaacaagctcggcactcaattgtaattgcaacgccgtattttatagcgaaaaataaagaatccatgaatgctttaatcgcagcacaaaagcgtggtgttacagtaaaaatactttggtcatataaaccagatctacctcttataaaagaagcggcgtatccatacatacgtcaagctattaataatgggattactgtatatgggtataaaaaaggaatgttccatggcaaattaatgcttattgataatgaattaaccgttattggcacaacaaactttacttcgcgtagcttcaatataaatgatgaaatgaatttttatattcatggtggtcctattgtagggcaagttaataaggcgttaacagaggattttcgtgactcaaaagaaatgacgaaagaattttttgagaagttatctttttgggagcgttgtaaggagaaatttgcagggatggtggatttttatttataa

SEQ ID NO: 14333 - protein, 405 aa, Bacillus anthracis str. Ames
MNMIKKILRVTSIIIAIFAFILICMHIDVTLGRKMEAGKNMPTEYAPHYSDFQLYVEGKSFYKQLFTDIKEAKQSIYTYFFILSDDKSSHTFLNLLKEKAKEGVNVYLSVDLLNDLSFERKMKKELQENGVHFTYSRKQELPFGFYSLHHRNHRRITTIDGEIGYTGGFNIGDEYLGKDKHFGYWRDYHVRIKGEGAKDLEEQFALDWKRDTKEDIKRSTDKASKGNTLHTMVSYNGHHVAEKYIDLIKQARHSIVIATPYFIAKNKESMNALIAAQKRGVTVKILWSYKPDLPLIKEAAYPYIRQAINNGITVYGYKKGMFHGKLMLIDNELTVIGTTNFTSRSFNINDEMNFYIHGGPIVGQVNKALTEDFRDSKEMTKEFFEKLSFWERCKEKFAGMVDFYL

SEQ ID NO: 14334 - DNA, 1104 bp, Bacillus anthracis str. Ames
  CDS (1)..(1104): transl_table=11
atggctagtgaatatgaattaggacaagttcgattgggtgaatttcaactgtatacgaacggtgaagaattatatacgaaattatttgaggatatacgcaatgcagaaaagtacatatatatccatttttatattgtaggtaaagacgaaataagcaaagagtttttgcagttgctcgagaaaaaggcatcaggtggagtagaagtgaaattgtcagtcgatcgaataggtggatataagctgaagaaaaagataattcgtcaactaaaaagcaatggtgtccagtttacatttagtaaaaaacctaaactgaaacatatattctactcgttgcatcaacggaaccatagacgcattgttacgatagatggaaaagtatcatacgtcggcggctttaacattggaaaggaataccttggacaaaatccgaaatttggtccgtggcgtgattatcatgtacgagtcaaggggaatggtgccacggatatggaaagaaaattctctgctgactggaaagaagatactggagaaaaaatgcctgtacatgaaagtttacctgcaatagggaatgtaaagtatcaatatttattttcagaaggaaaaggtttatgggaaaaatatggagcgcttataaagcaggctaaaacgtctttaattattgctacaccatattttgtaccaagtaaagaaatgataaaagcgttaaaagatgcattaaaccgtggtgtcaatgtaaaaattctcgtaccatttaaaagtgatgcagtattgttaaaacaagctgcctatccgtatttgaaagacatgttacatgctggagcagagatttatcaatatcagaatggtttttttcatgggaaagtaacaatcattgatggggaaagtgttgatattggtaccgcaaactttgataatagaagtttttatttaaatatggaatccaattgtgttatctatgataagggagtaacagcggacgtatggagtcgattaaaagaagactttcataaatcaaaaagattttcggaagaagattttgagaaaattagtaaatgggattggtttttagcaagaatagcaaatgttatagcatcatatttatag

SEQ ID NO: 14335 - protein, 367 aa, Bacillus anthracis str. Ames
MASEYELGQVRLGEFQLYTNGEELYTKLFEDIRNAEKYIYIHFYIVGKDEISKEFLQLLEKKASGGVEVKLSVDRIGGYKLKKKIIRQLKSNGVQFTFSKKPKLKHIFYSLHQRNHRRIVTIDGKVSYVGGFNIGKEYLGQNPKFGPWRDYHVRVKGNGATDMERKFSADWKEDTGEKMPVHESLPAIGNVKYQYLFSEGKGLWEKYGALIKQAKTSLIIATPYFVPSKEMIKALKDALNRGVNVKILVPFKSDAVLLKQAAYPYLKDMLHAGAEIYQYQNGFFHGKVTIIDGESVDIGTANFDNRSFYLNMESNCVIYDKGVTADVWSRLKEDFHKSKRFSEEDFEKISKWDWFLARIANVIASYL

SEQ ID NO: 14336 - DNA, 1194 bp, Bacillus anthracis str. Ames
  CDS (1)..(1194): transl_table=11
atgttcttcttacctctcttattaataggtattgctctctggattataatcgatctttcttatgggagaattgttcatttaaggcgtgtacgttctcgttctttccctttacgtcaaagtgattttcacctttatacatacggaaaagatttgtatgacactctatttactgatataaaacaggcgaaacaccatgtgcatgttttgttcttcattgtaaaaaacgataaaatcagccgggaatttttaaagttacttattgataaggcaaaggaaggaattgaagtaagacttttactcgatagattgggaagccatcatttatcaaacgaggccattcgctccctgcaaaaacatggtgtctctttttcattttgtcacaaagtaaagtttccttttcctttcttttctgcaaatcaaagaaaccatagaaaaattacagttatcgacgggaaaattggttacattgggggatttaatattggtgaagagtatttgggacataatgaacggttaggattatggagggactatcatttacgtcttacaggcgaaggagtacaagatttacaaaagcaatttttacatgactggtttgatgatacaaaccaaaatttattggtcgcttctctttattttccgaaacagcaacccggtactatccaacatcaatttattccgactgatggtgcctatttacaacatacttttttacatttaattgaaggggcaaaaaaggaactctttatcggcacaccctatttcattcctggaaggaaaattatgaacgcattattagaagcacgaaaacgcggggttcaaatcacgattctcgttccagaaaaagcggatcatgcccttgttcgagaagcaaaattcccgtattgccgaaagttaatacaagctggatgtaatatttacgcatttcaacaaggtttttttcacgctaaagttattatagttgatgactacatttgtgatatcggaactgcaaactttgatatgagaagtttatatattaaccatgaaattaactgccttttatatgataaacattttatacaaacagtaagaaacaaattccataaggatctaggaaacgcatcattactttcctttaaagatgttagcccgcattctcttattgatagaggaaaagaatggataggaacaatactcgctttcttcctatag

SEQ ID NO: 14337 - protein, 397 aa, Bacillus anthracis str. Ames
MFFLPLLLIGIALWIIIDLSYGRIVHLRRVRSRSFPLRQSDFHLYTYGKDLYDTLFTDIKQAKHHVHVLFFIVKNDKISREFLKLLIDKAKEGIEVRLLLDRLGSHHLSNEAIRSLQKHGVSFSFCHKVKFPFPFFSANQRNHRKITVIDGKIGYIGGFNIGEEYLGHNERLGLWRDYHLRLTGEGVQDLQKQFLHDWFDDTNQNLLVASLYFPKQQPGTIQHQFIPTDGAYLQHTFLHLIEGAKKELFIGTPYFIPGRKIMNALLEARKRGVQITILVPEKADHALVREAKFPYCRKLIQAGCNIYAFQQGFFHAKVIIVDDYICDIGTANFDMRSLYINHEINCLLYDKHFIQTVRNKFHKDLGNASLLSFKDVSPHSLIDRGKEWIGTILAFFL

SEQ ID NO: 14338 - DNA, 1563 bp, Helicobacter hepaticus ATCC 51449
  CDS (1)..(1563): transl_table=11
atgcaatctatttattctgtctttttttcatcaacaaatattgctttgctttgtcttatatgtctttttatctttgctggttgttcttctattgtcgcttctaccaaagacattaaagacccacttgcacttcaatcaaatccaacacctgtttttgaccctgtgctcactgctattggtatgccttatcagaataaacttaaacaaaacccaactattacgggaggaatgctcgtaagtgatgggttagacgcatttttgcatcgcgcttatctcgctcgtatggcagaaaaaagcattgttttacaaacttatatttataaaaatgacctcgcttcacgtattcttatgcacgagatttggcttgctgcacaaagaggggtgattgttaaaatgctcattgatgataatggattagattctgatttttcagatattattgctcttaattctcacccaaatattgaagtaaaaatcttcaacccctataaaaatcgctcaaaaatcctacgttatccagaaatggtgtttgattttaatcgcattaatcatcgtatgcacaataaactctttattgtagatgatattgcccttatcattggtggacgaaatatcgcagataattattttgaccaaaatcatcatattaattttgttgataccgatgtgctttttattggtaatgtagcaatggagggcaaaaaaaatttttatgaatattggaattttcatcgctctattcctgtttcacttcttaaattcaaaacgccacttaaaaaacttaaatcctctatggaaagtcttaaagcgaatcctgagtgggcacattatgaggaaaaaatcaatacccttattaaaaaatacaaaaacaaatcttttgaggtattttggggcaacgccgtgtttattgctgataaaccagaaaaaattcaagacccacaagcgccaaaacccattgccaaagcacttgcaaagattctcaactttacatataacaatctttatatttctgccgcctattttgtgccaagcaaagagggtataaaacgttttaaaaccttgattgcttcgggtgtggatattaatattcttacaaattctcttgcctctacggattctcttgtcgtatatagtgcgtgggaacgttatcgtggcactcttattaaagagggtgcaaatatatatgaatatcaatatcaaggtagaggtaaatcaaagttacgtgataaaatatcaaagtccaaagcttctttgcatagtaaaagcattgtatttgatgattctattacttggattgggagttttaatcttgacccacgttcaactcatctcaatactgaatgcgttgttatctttgataatcctaaatttgcaaaagtctttaaggctgatttgatgacagatatggaaagtgcgtggcacgtatataataaaaatggaaaaacgctttgggagggagatgatgaaagcaagacagagatttttacctatcctcctgatacagggatttggacaaggattctaaaaacacttgcaaaaattctccctgaaagccaaatttaa

SEQ ID NO: 14339 - protein, 520 aa, Helicobacter hepaticus ATCC 51449
MQSIYSVFFSSTNIALLCLICLFIFAGCSSIVASTKDIKDPLALQSNPTPVFDPVLTAIGMPYQNKLKQNPTITGGMLVSDGLDAFLHRAYLARMAEKSIVLQTYIYKNDLASRILMHEIWLAAQRGVIVKMLIDDNGLDSDFSDIIALNSHPNIEVKIFNPYKNRSKILRYPEMVFDFNRINHRMHNKLFIVDDIALIIGGRNIADNYFDQNHHINFVDTDVLFIGNVAMEGKKNFYEYWNFHRSIPVSLLKFKTPLKKLKSSMESLKANPEWAHYEEKINTLIKKYKNKSFEVFWGNAVFIADKPEKIQDPQAPKPIAKALAKILNFTYNNLYISAAYFVPSKEGIKRFKTLIASGVDINILTNSLASTDSLVVYSAWERYRGTLIKEGANIYEYQYQGRGKSKLRDKISKSKASLHSKSIVFDDSITWIGSFNLDPRSTHLNTECVVIFDNPKFAKVFKADLMTDMESAWHVYNKNGKTLWEGDDESKTEIFTYPPDTGIWTRILKTLAKILPESQI

SEQ ID NO: 14340 - DNA, 1476 bp, Rhodopirellula baltica SH 1
  CDS (1)..(1476): transl_table=11
atgatggatctcggacaatactttcaaattcatatcgatgcggtttcgatcgggttggtcgcgcacgtcaccatagaagccatcaccatcattcgcgtgatgacgcggccccatcgcgaaccggcgtctcgtgtcgcttgggtcaccatcattgcagcggtgccgtttttaggtgtgctgctgtatgtgttgtttggcgaaaccaacatcggtcgtcgccgaatggaacgcatgaagcaagtgatcaaacgcttgccgacgatgccagagatcaatcctgaggaatctcggaacacattggccaacgtcccaatccgataccagcatttgtttcgaatgggtgaatcaatcaatggattcgaagcgatcggtggcaactccggaacgttgatgcaagattctaactccgccgtcgactccatgatcgccgacatcgatcgagcaaccgaccatgtgcatttgctcttctacatttggttgcccgacaacaacggattgaagatggtggaggcactcaaacgagcggcgaagcgaggcgttacttgccgagcgatggcggatgacttggggtcacggacaatcattcgatcgactcattggaaggagatgcaggaagccggcgttcatctttcgagaactttgccaattggcaacttgatgctacgtgcacttcgcggacgcatcgaccttcgcaatcaccgaaaaatcctggtgatcgatggatcggtcacgtactgcggaagccagaactgcgccgatcccgaattccgcgtcaaacccaagtacgctccctgggtcgacgctgtgattcgtttcgaaggaccggtggtcagacagaaccaagaactctttgtcgctgattggatggccggtaccgatgacgacctgaccgatctgctcgaccgaccgcttcccaacaccgggcctggtttttcagcgcaagtcattggaacgggaccaaccgttcgcgattctgccatgcccgaggttttcgaaacgttgttccacacggcgagacgcaaactgacaatttcaacgccgtactacgtgcccaacgaatccatgcaacaagctctctgcgccgcggcatggcgaggcgtcgaaacaaccatcatcctgcccgccaacaatgattcgcgaattgttgggggagccagccgaagctactacgcgggactgctagaagccggcgtccgaatctacgaatacaccggtgggttgttgcataccaagtctgtgactctggatgacgaagtcactctgatcggttccgccaacatggatcgccgcagctttgatctgaactacgaaaacaacattttgtttcatgacccgcaactgaccgctgatgtcttcgcgagacaacgcgtctatatcgaacgctccaacgagatcacggcacagcaggtttccgactggtcgcttccccggcgactgtggaacaacgtgctggcgacactcggcccgattctttag

SEQ ID NO: 14341 - protein, 491 aa, Rhodopirellula baltica SH 1
MMDLGQYFQIHIDAVSIGLVAHVTIEAITIIRVMTRPHREPASRVAWVTIIAAVPFLGVLLYVLFGETNIGRRRMERMKQVIKRLPTMPEINPEESRNTLANVPIRYQHLFRMGESINGFEAIGGNSGTLMQDSNSAVDSMIADIDRATDHVHLLFYIWLPDNNGLKMVEALKRAAKRGVTCRAMADDLGSRTIIRSTHWKEMQEAGVHLSRTLPIGNLMLRALRGRIDLRNHRKILVIDGSVTYCGSQNCADPEFRVKPKYAPWVDAVIRFEGPVVRQNQELFVADWMAGTDDDLTDLLDRPLPNTGPGFSAQVIGTGPTVRDSAMPEVFETLFHTARRKLTISTPYYVPNESMQQALCAAAWRGVETTIILPANNDSRIVGGASRSYYAGLLEAGVRIYEYTGGLLHTKSVTLDDEVTLIGSANMDRRSFDLNYENNILFHDPQLTADVFARQRVYIERSNEITAQQVSDWSLPRRLWNNVLATLGPIL

SEQ ID NO: 14342 - DNA, 1476 bp, Candidatus Blochmannia floridanus
  CDS (1)..(1476): transl_table=11
atgacgctaacgatttacagtatactgaattatacttttatatgtagttactggatattaaccattataataataattcgagtgttaataaaacgtcgaactgtatcatcctttatggcgtggttattaacaatctatattgtaccattcatgggaattattctatacttattatgcggagaatctaatcttggtaaaaaacgatcacttagaagtaagatagcacaatccactagcattcgtcgtatacaagaactcaaaaaccataaacatatattctcaaataaaaacagtaaaattgcttcttctttatttaaactatgtgaacttcgacaaggaataggagcattaaaaggtaaccaaatacaattattcaaaaaaatcgataatactcttgcatctttaataaaagatatagatttagccaaacacaatatcgatatggtattttatatttgggaacctggtggactagtagatcatattgtaactaaattaattatcgctgctcaacgaggtgtaaaatgccgtttaatactagattctgttggatgtataaatttttttaatagttcatatccaaaaatactaaaaaaagctggaataaacattgccgaagcactacatattaatttattacgaatattcttcaggcgtatggatttaagacagcaccgtaaaatgatattgattgacaatcatattgcttatactggtagtatgaatatggtcgatccgaaattatttaaacaaaatattggagttggtcaatggattgatatcatgattcgtatagatggccccgcaaccacagttatgagaataatttttgaatttgattgggaaatagaaacaggggaacatattgttcctgtattatctagttctcaacatttaatgcaacaaaaaactaccttaatatcaactggtcacaccattcaaattattccttcggggccaggttttccagaaggaataattcatcaagtactcattacatcattatataaagctcgtaaacaattaattatcacaacaccatatttagtacccagtgatgatttattatatgctatttgtgcagcagctcaaagaggagtaaaagtacatatcattattccaaaaaacaacgattctgtattagttaattgggcaagtcgagctttttttagtgaattattagacgctggagtattgattcatcgatttcaaaaaggattattacatgtaaaaagtatactaattgatcatcaactcagtttaataggtaccgtaaatttagatgttcgtagtatatggttaaattttgaaattactttattaatcgatagtaaactttttaataaagatttagaaaaaatacaattagactatattgcccattcaaaactaattgatgcacaaaaatggtcaaaacgaccttattggaaacgcattattgaacgtttattttatttcttcagtcctttattataa

SEQ ID NO: 14343 - protein, 491 aa, Candidatus Blochmannia floridanus
MTLTIYSILNYTFICSYWILTIIIIIRVLIKRRTVSSFMAWLLTIYIVPFMGIILYLLCGESNLGKKRSLRSKIAQSTSIRRIQELKNHKHIFSNKNSKIASSLFKLCELRQGIGALKGNQIQLFKKIDNTLASLIKDIDLAKHNIDMVFYIWEPGGLVDHIVTKLIIAAQRGVKCRLILDSVGCINFFNSSYPKILKKAGINIAEALHINLLRIFFRRMDLRQHRKMILIDNHIAYTGSMNMVDPKLFKQNIGVGQWIDIMIRIDGPATTVMRIIFEFDWEIETGEHIVPVLSSSQHLMQQKTTLISTGHTIQIIPSGPGFPEGIIHQVLITSLYKARKQLIITTPYLVPSDDLLYAICAAAQRGVKVHIIIPKNNDSVLVNWASRAFFSELLDAGVLIHRFQKGLLHVKSILIDHQLSLIGTVNLDVRSIWLNFEITLLIDSKLFNKDLEKIQLDYIAHSKLIDAQKWSKRPYWKRIIERLFYFFSPLL

SEQ ID NO: 14344 - DNA, 1206 bp, Bordetella pertussis Tohama I
  CDS (1)..(1206): transl_table=11
gtgaaggcccagatcgtcaggttgcactggaccgatggcaacgccatccgcctgctgcaaaacggcggcgatttctttcccgcgctatgcgaggccatcgacgcggcgcgcctgtcggtgcatatggagacctacatcttcctgctcgaccgcaccgggcgacagatgctcgaatgcctggagagcgctgcccgccgcggcgtcaaggtgcgcgtggtgctcgacggtttcggcagcgccggcacggccgagacgatacgcctgcgcatcacccaggccggcggccagtgccgcatcttccggcccgagccccgctggctgggccacctggcgttctcgcgcagccgcttgcgccgcctgcatcgcaaggtggccgtggtcgacgccgagctggcgttcgtcggcggcatcaatatcgtcgacgactacgacgacctcgaccccggcgacgacatccccgcgccgcgcttcgacttcgccgtggcggtgcagggccccctggtgccgcacatactctatgcccaggacctgttgtgggtacggctgaactgggcccgcctgcgccgccacccaggggactggatgcgcctgttcaagccggtgcacgccgacgcctcgccggccggcaagctgcgcgcggcattgctgctgcgcgacaacctgcgctttcggcagaccttcgagcaggcctacctttatggcatccagcatgcgcgccgcgacatcctgatcgccaacgcctatttcttccccgggcatcaattccgcaagagcctcatgcaggccgccgcgcgcggcgtgcgcgtgcggctgctactgcagggcaagcccgaataccgcatgcagtacttcgccacgcgcgcgctgtacgaccggctgctgcgcggcggcatcgagatctacgaatacatgccgggctacctgcacgccaaggtcgccgtcatcgacaacatggctaccgtcggctcgtccaatctcgatcccttcagcctgctgctggcccgcgaagccaacgtggtcgtcgacgaccagcccttcgcctgggacctgcaggaacgcctagagcgcgccattgccctgggcggccagttcatccggcccctggactaccagcggcgcggctggctgcggcgatgcgtcgacgtcgcggcctacaccatgctgcgcatcggcgtggcgctgaccgggcgcgcggggcggtactaa

SEQ ID NO: 14345 - protein, 401 aa, Bordetella pertussis Tohama I
MKAQIVRLHWTDGNAIRLLQNGGDFFPALCEAIDAARLSVHMETYIFLLDRTGRQMLECLESAARRGVKVRVVLDGFGSAGTAETIRLRITQAGGQCRIFRPEPRWLGHLAFSRSRLRRLHRKVAVVDAELAFVGGINIVDDYDDLDPGDDIPAPRFDFAVAVQGPLVPHILYAQDLLWVRLNWARLRRHPGDWMRLFKPVHADASPAGKLRAALLLRDNLRFRQTFEQAYLYGIQHARRDILIANAYFFPGHQFRKSLMQAAARGVRVRLLLQGKPEYRMQYFATRALYDRLLRGGIEIYEYMPGYLHAKVAVIDNMATVGSSNLDPFSLLLAREANVVVDDQPFAWDLQERLERAIALGGQFIRPLDYQRRGWLRRCVDVAAYTMLRIGVALTGRAGRY

SEQ ID NO: 14346 - DNA, 1458 bp, Bordetella pertussis Tohama I
  CDS (1)..(1458): transl_table=11
atggacccattggaacaattgctgcgcgactattggccgcatatcgtctttgcgatcagcgtggtcgccggcaccggcgccgccgtgcatgccgccatgaccaaacaggatgtgcgcgccgccatcgcctgggtcggggtcgccctgttctcgccgctctttggcgccctgctctatttcgtcgccggcatcaaccgcatccgccgttcgctggtgtcgcagcagcacgacgacgccatgctggcctacacgggccatcccgacgcccaggtcgaggacgtggtcccctgcagcggtccgcaattcgcctcgctgcgcgtgctgggcgaccaggtcagccgcttccgcctgctgggcggcaaccaggtgcggccgctggccggcggcgacgaggcctatcccgccatgatgcaggcgatacgcgaggcgcgcgtctcgatcgccatgcaaagctatatcttcgactgcgatccgatcggccgcgaaatggcgcaggccctggtcgaggcgcagcagcgcggcgtgcaggtgcgcgtgctcatcgatgccatcggcagcaagtactcccgtccgccgatcgttcgtacgctggtgcgcggcggcgtgcgcaccgcgcgcttcatgaccaacccgctgggcgtcatgcgcatgccctacgccaacctgcgcagccaccgcaagatcctggtggtcgacggacatgtcggcttcaccgggggcatgaacatccgcgccgccttcgtgacggccctggccggcaaggccgccaacggcgatacccacttccgcctggaaggtccggtggtggcgcaactgatggcggttttcgcgcacgactggaatttcacgacccgcgaatccctggaaggcccgacctggttcccgccggctcccgaacgcgcgccgggctcggtgccgatgcgctgcgtggcctcggggccggacagcgccctgggcagcacgcacaagatgctgctgggcgcgctggcggtggcgcagcgccatgtgcggatccaatccccctatttcctgcctgaccagacgctgatcggcgcactggggaccgccgcgcgccgcggcatcaaggtcgatatcgtgattccgggctcgaacaacctgcgcctggtcaactacgccatgagcgcacaactggaccaggtcatccgcacgggctgccgcgtatggcgctcggccggcgccttcgaccactcgaagctgctgacggtggacgatgcctggtcctatgtgggctcgtccaacatggacccgcgcagcctgcgcctgaacttcgagctggacaccgaaatctacgatcgtgagctggccggctggatcgggcagcgcatcgacgcgcagatccgccacgcgcggcaggaaacactgcaggccctgaacgcgcagccgttcatcaagcgcctgcgcaacaaggtgatctggctggctacgccatatctctag

SEQ ID NO: 14347 - protein, 485 aa, Bordetella pertussis Tohama I
MDPLEQLLRDYWPHIVFAISVVAGTGAAVHAAMTKQDVRAAIAWVGVALFSPLFGALLYFVAGINRIRRSLVSQQHDDAMLAYTGHPDAQVEDVVPCSGPQFASLRVLGDQVSRFRLLGGNQVRPLAGGDEAYPAMMQAIREARVSIAMQSYIFDCDPIGREMAQALVEAQQRGVQVRVLIDAIGSKYSRPPIVRTLVRGGVRTARFMTNPLGVMRMPYANLRSHRKILVVDGHVGFTGGMNIRAAFVTALAGKAANGDTHFRLEGPVVAQLMAVFAHDWNFTTRESLEGPTWFPPAPERAPGSVPMRCVASGPDSALGSTHKMLLGALAVAQRHVRIQSPYFLPDQTLIGALGTAARRGIKVDIVIPGSNNLRLVNYAMSAQLDQVIRTGCRVWRSAGAFDHSKLLTVDDAWSYVGSSNMDPRSLRLNFELDTEIYDRELAGWIGQRIDAQIRHARQETLQALNAQPFIKRLRNKVIWLATPYL

SEQ ID NO: 14348 - DNA, 1575 bp, Bordetella pertussis Tohama I
  CDS (1)..(1575): transl_table=11
atgcctcgtctcctctcgcgtatccgggccgcccgcgcgcgggcggccgcgctgctggcgctggccggctgcgccattctgctgggagcctgtaccttgccgccgcctgtcgaccgcaccgcctcgcacgccctggacgccacgcaggcgcgcgccacgccactgggccagggcgtcggcgagctggccgacacgcatccggggcttagcggctttcatgtgctgggcgacgcgcaggacgccttcgccgcgcgcatgctgctggcgcgcgcggccacgcgcacgctggacgtgcagtactacatctggcgcaacgacatgaccggcaccctgttgctgcaggccttgcacgcggccgccgagcgcggcgtgcgggtgcggctgctgctcgacgacaacggcatctccggcctggacgacgcgctggccgcgctggacgcgcatcccaacgccgaagtgcggctgttcaatccgtttcccacgcgctcgttcaaggcgctgggctacctgacggatttctcgcgcctgaaccggcgcatgcacaacaaatcattcaccgtcgacaaccaggccaccatcatcggcgggcgcaatatcggcgacgagtacttcggcgcgaccgacggcgtgctgttcgccgacctggacgtgctggcggtggggccggtggtgggcgatgtgtccgccgagttcgacgcctactgggccagcgagtccgcctggccggccggcccgctgctgcccgcgccgggcgcgcagacactgcgcgccctggccgagcgcgccgcgcgcatcgaacaggacccggccgccggcgactacatgagcgcgctgcgcgagttgcccttcatccgcgaattgatggccggccgcctgccgctgcaatgggcgccggcccgcatggtcagcgacgatccggccaagggcctgggcaaggcgccgccggccggcctgctgacgcagcagctcaggaacatcctgggcgagccgcgccgcacgctcgacctggtgtcgccgtatttcgtgcctgccgaggccggcacgcaggcgttcgccgcgctggcccggggcggcgcgcaggtgcgcgtgctcaccaatgcgctggaagcgaccgacgtggccgtggtgcattccggctacgccaagcgccgcaaggcgctgctgcaggcgggcgtgcggctttacgaaatgcggcgcagctacgccgggcccaagccgcagggcaggggccgattcggcagctccgggtccagcctgcacgccaagaccttcggcgtcgacggcgagcgcgtcttcataggctcgttcaacttcgatccgcgctcggccaatctcaacaccgaactgggcttcgtgatcgaaagccccgacatggcgcgccacatcgccgccacgttcgaccaggatattcccgccgccacttacgaggtgcgcctggacgacgacggcagcctgtactggctggaacagcgcgacggcgccaccgtgcggcacgacagcgagccgggcgtcagcctgtggcggcgcttcagcgtgtggctgttctcgctgctgccgctcgagccgctgctgtag

SEQ ID NO: 14349 - protein, 524 aa, Bordetella pertussis Tohama I
MPRLLSRIRAARARAAALLALAGCAILLGACTLPPPVDRTASHALDATQARATPLGQGVGELADTHPGLSGFHVLGDAQDAFAARMLLARAATRTLDVQYYIWRNDMTGTLLLQALHAAAERGVRVRLLLDDNGISGLDDALAALDAHPNAEVRLFNPFPTRSFKALGYLTDFSRLNRRMHNKSFTVDNQATIIGGRNIGDEYFGATDGVLFADLDVLAVGPVVGDVSAEFDAYWASESAWPAGPLLPAPGAQTLRALAERAARIEQDPAAGDYMSALRELPFIRELMAGRLPLQWAPARMVSDDPAKGLGKAPPAGLLTQQLRNILGEPRRTLDLVSPYFVPAEAGTQAFAALARGGAQVRVLTNALEATDVAVVHSGYAKRRKALLQAGVRLYEMRRSYAGPKPQGRGRFGSSGSSLHAKTFGVDGERVFIGSFNFDPRSANLNTELGFVIESPDMARHIAATFDQDIPAATYEVRLDDDGSLYWLEQRDGATVRHDSEPGVSLWRRFSVWLFSLLPLEPLL

SEQ ID NO: 14350 - DNA, 1263 bp, Bordetella parapertussis 12822
  CDS (1)..(1263)
atgggcgcgcctgtcggatcattcgccgctgctggccgagctcgaattgccgtgaagggccagatcgtcaggttgcactggaccgatggcaatgccatccgcctgctgcaaaacggcggcgatttctttcccgcgctatgcgaggccatcgacgcggcgcgcctgtcggtgcatctggagacctacatcttcctgctcgaccgcaccgggcggcaggtgctcgaatgcctggagagcgctgcccgccgcggcgtcaaggtgcgcgtggtgctcgacggtttcggcagcgccggcacggccgaggcgatacgcctgcgcatcacccaggccggcggccagtgccgcatcttccggcccgagccccgctggctgggccacctggcgttctcgcgcagccgcttgcgccgcctgcaccgcaaggtggccgtggtcgacgccgaactggcgttcgtcggcggcatcaatatcgtcgacgactacgacgacctcgaccccggcgacgacatccccgcgccgcgcttcgacttcgccgtagcggtgcagggccccctggtgccgcacatactctatgcccaggacctgttgtgggtacggttgaactgggcccgcctgcaccgccacccaggggactggcaccgcatgcgcctgttcaagccggtgcacgccgacgcctcgccggccggcaagctgcgcgcggcattgctgctgcgcgacaacctgcgctttcggcagaccttcgagcaagcctacctttatggcatccagcatgcgcgccgcgacatcctgatcgccaacgcctatttcttccccgggcatcaattccgcaagagcctcatgcaggccgccgcgcgtggcgtgcgcgtgcggctgctgctgcagggcaagcccgaataccgcatgcagtacttcgccacgcgcgcgctgtacgaccggctgctgcgcggcggcatcgagatctacgaatacatgccgggctacctgcacgccaaggtcgccgtcatcgacaacatggctaccgtcggctcgtccaatctcgaccccttcagcctgctgctggcccgcgaagcgaacgtggtcgtcgacgaccagcccttcgcctgggacctgcaggaacgcctggagcgcgccatcgccctgggcggccagttcatccggcccctggactaccagcggcgcggctggctgcggcgatgtatcgacgtcgcggcctacaccatgctgcgcatcggcgtggcgttgaccgggcgcgcggggcggtactga

SEQ ID NO: 14351 - protein, 420 aa, Bordetella parapertussis 12822
MGAPVGSFAAAGRARIAVKGQIVRLHWTDGNAIRLLQNGGDFFPALCEAIDAARLSVHLETYIFLLDRTGRQVLECLESAARRGVKVRVVLDGFGSAGTAEAIRLRITQAGGQCRIFRPEPRWLGHLAFSRSRLRRLHRKVAVVDAELAFVGGINIVDDYDDLDPGDDIPAPRFDFAVAVQGPLVPHILYAQDLLWVRLNWARLHRHPGDWHRMRLFKPVHADASPAGKLRAALLLRDNLRFRQTFEQAYLYGIQHARRDILIANAYFFPGHQFRKSLMQAAARGVRVRLLLQGKPEYRMQYFATRALYDRLLRGGIEIYEYMPGYLHAKVAVIDNMATVGSSNLDPFSLLLAREANVVVDDQPFAWDLQERLERAIALGGQFIRPLDYQRRGWLRRCIDVAAYTMLRIGVALTGRAGRY

SEQ ID NO: 14352 - DNA, 1431 bp, Bordetella parapertussis 12822
  CDS (1)..(1431)
atggcaaccctgaggcgcggcttcgcgtgccgcctggcgcgccaagtggccgtcatgttcatgttggcggcgttgggcgcatgcgccacggtgccgggcatgcaggggctgcgcgagcggcgcgcccaggccgggctgtccaccgactacggctggcaaagcctgcagcgcagccacacgatcgtgacggacgcgaccggcggggacggggacgatgccatggcgcgccacctggccgtcgaggcggccatcagcggcgcccccttggtggcgggcaaccaggtccgcctgctggccgacgggccggcgacctaccgcagcatgctcgacgccatcgcgcaggcccgccgctatatccacatggaaacctacatcttcgaagatgacgaggccggccagcgtttcgccgacgccctgatggcggcgcgccagcgcggcgtcgaggtggcggtgatggtcgatgcggtgggcacgctgaatacgccgcggcagtggttcgagcgtctcaagcagggcggaatcaaggtggcggtgttcaatccggtcaacccggcgcgcgccggcctgggctgggcgcccaaccagcgcaaccaccgcaagctgctggtggtcgacggtcaggtgggcttcctgggcgggctgaatatcagcagcgtctattcgtccggatcgcgctctggctcgggttcggggcgtgcggcgcaggcgcccgggccggccgcgtcccgtgccgataccgcgccgtggcgcgatacccatatcgcggtgcgcggaccggcggtggcggagatcgagcgcgtcatccaggacggctggctgcggcagaccggcgcgccgctgggcggcggcgcggtgcggctgagcgtgcccgcgccgggcgatctgcatgtgcgcatcctggccaacgagcccaacgagcgcgacggctataccgtttacctgacgctgatgtcggcgttcgaaagcgcgcggcagtcgattcacatcaccatggcctatttcgtgcccgatccggccttcgtgcgcgtgctggccgatgccgcgcggcgcggggtcgatgtggcgctggtcctgccgggattcagcgattcatcgctggtctggtacgcgggacgctcgcattaccaggccctgctcgatgccggcgtcaagctgtacgagcggcgcgatgcgctgttgcacgccaagacggcggtggtcgacggcgtgtggtccacggtcgggtcgagcaacatggattggcgcagttttgcattgaactacgagctcaacgcggtcatcgtcggggcccgcttcggcgccgagatggaggcgctgttcgaacgcgaccgcgccgccgccgtgccgatcgacccgcgcaactgggccgatcgcggcgccgacgatcgcttcatggaggcgttttcgcgcctgttcgagcgctggctgtag

SEQ ID NO: 14353 - protein, 476 aa, Bordetella parapertussis 12822
MATLRRGFACRLARQVAVMFMLAALGACATVPGMQGLRERRAQAGLSTDYGWQSLQRSHTIVTDATGGDGDDAMARHLAVEAAISGAPLVAGNQVRLLADGPATYRSMLDAIAQARRYIHMETYIFEDDEAGQRFADALMAARQRGVEVAVMVDAVGTLNTPRQWFERLKQGGIKVAVFNPVNPARAGLGWAPNQRNHRKLLVVDGQVGFLGGLNISSVYSSGSRSGSGSGRAAQAPGPAASRADTAPWRDTHIAVRGPAVAEIERVIQDGWLRQTGAPLGGGAVRLSVPAPGDLHVRILANEPNERDGYTVYLTLMSAFESARQSIHITMAYFVPDPAFVRVLADAARRGVDVALVLPGFSDSSLVWYAGRSHYQALLDAGVKLYERRDALLHAKTAVVDGVWSTVGSSNMDWRSFALNYELNAVIVGARFGAEMEALFERDRAAAVPIDPRNWADRGADDRFMEAFSRLFERWL

SEQ ID NO: 14354 - DNA, 1479 bp, Bordetella bronchiseptica RB50
  CDS (1)..(1479)
atgccgccgcccgtcgaccgcaccgcctcgcacgccctggatgcctcgcaggcgcgcgccacgccactgggccagggcatcggcgatctggccgacgcccatcccgggctcagcggtttccatgcgctgggcgatgcgcaggacgccttcgccgcgcgcatgctgctggcgcgcgcggccacccgcacgctggatgtgcagtactacatctggcgcaacgacatgaccggcaccctgttgctgcaggccctgcacgcggccgccgagcgcggcgtgcgggtgcggctgctgctcgacgacaacggcatctccggcctggacgacgcgctggccgcgctggacgcgcatcccaacgccgaagtgcggctgttcaatccgtttcccacgcgctcgttcaaggcgctgggctacctgacggatttctcgcgcctgaaccggcgcatgcacaacaaatcattcaccgtcgacaaccaggccaccatcatcggcgggcgcaatatcggcgacgagtacttcggcgcgaccgacggcgtgctgttcgccgacctggacgtgctggcggtggggccggtggtgggcgatgtgtccgccgagttcgacgcctactgggccagcgagtccgcctggccggccggcccgctgctgcccgcgccgggcgcgcagacactgcgcgccctggccgagcgcgccgcgcgcatcgaacaggacccggccgccggcgactacatgagcgcgctgcgcgagttgcccttcatccgcgaattgatggccggccgcctgccgctgcaatgggcgccggcccgcatggtcagcgacgatccggccaagggcctgggcaaggcgccgccggccggcctgctgacgcagcagctcaggaacatcctgggcgagccgcgccgcacgctcgacctggtgtcgccgtatttcgtgcctaccgaggccggcacgcaggcgttcgccgcgctggcccggggcggcgcgcaggtgcgcgtgctcaccaatgcgctggaagcgaccgacgtggccgtggtgcattccggctacgccaagcgccgcaaggcgctgctgcaggcgggcgtgcggctttacgaaatgcggcgcagctacgccgggcccaagccgcagggcaggggccgattcggcagctccgggtccagcctgcacgccaagaccttcggcgtcgacggcgagcgcgtcttcataggctcgttcaacttcgatccgcgctcggccaatctcaacaccgaactgggcttcgtgatcgaaagtcccgacatggcgcgccacatcgccgccacgttcgaccaggatattcccgccgccacttacgaggtgcgcctggacgacgacggcagcctgtactggctggaacagcgcgacggcgccaccgtgcggcacgacagcgagccgggcgtcagcctgtggcggcgcttcagcgtgtggctgttctcgctgctgccgctcgagccgctgctgtag

SEQ ID NO: 14355 - protein, 492 aa, Bordetella bronchiseptica RB50
MPPPVDRTASHALDASQARATPLGQGIGDLADAHPGLSGFHALGDAQDAFAARMLLARAATRTLDVQYYIWRNDMTGTLLLQALHAAAERGVRVRLLLDDNGISGLDDALAALDAHPNAEVRLFNPFPTRSFKALGYLTDFSRLNRRMHNKSFTVDNQATIIGGRNIGDEYFGATDGVLFADLDVLAVGPVVGDVSAEFDAYWASESAWPAGPLLPAPGAQTLRALAERAARIEQDPAAGDYMSALRELPFIRELMAGRLPLQWAPARMVSDDPAKGLGKAPPAGLLTQQLRNILGEPRRTLDLVSPYFVPTEAGTQAFAALARGGAQVRVLTNALEATDVAVVHSGYAKRRKALLQAGVRLYEMRRSYAGPKPQGRGRFGSSGSSLHAKTFGVDGERVFIGSFNFDPRSANLNTELGFVIESPDMARHIAATFDQDIPAATYEVRLDDDGSLYWLEQRDGATVRHDSEPGVSLWRRFSVWLFSLLPLEPLL

SEQ ID NO: 14356 - DNA, 1545 bp, Bordetella bronchiseptica RB50
  CDS (1)..(1545)
atgttgctatccttgcgcatccgtacccacataccggacccgccgctggcggccccggctgccacgcaagcctttctcccggacgccatggacccattggaacaattgctgcgcgactattggccgcatatcgtctttgcgatcagcgtggtcgccggcaccggcgccgccgtgcatgccgccatgaccaaacaggatgtgcgcgccgccatcgcctgggtcggggtcgccctgttctcgccgctctttggcgccctgctctatttcgtcgccggcatcaaccgcatccgccgctcgctggtgtcgcagcagcacgacgacgccatgctggcctacacgggccatcccgacgcccaggtcgaggacgtggtcccctgcagcggtccgcaattcgcctcgctgcgcgtgctgggcgaccaggtcagccgcttccgcctgctgggcggcaaccaggtgcggccgctggccggcggcgacgaggcctatcccgccatgatgcaggcgatacgcgaggcgcgcgtctcgatcgccatgcaaagctatatcttcgactgcgatccgatcggccgcgaaatggcgcaggccctggtcgaggcgcagcagcgcggcgtgcaggtgcgcgtgctcatcgatgccatcggcagcaagtactcccgtccgccgatcattcgtacgctggtgcgcggcggcgtgcgcaccgcgcgcttcatgaccaacccgctgggcgtcatgcgcatgccctacgcgaacctgcgcagccaccgcaagatcctggtggtcgacggacatgtcggcttcaccgggggcatgaacatccgcgccgccttcgtgacggccctggccggcaaggccgccaacggagatacccacttccgcctggaaggtccggtggtggcgcaactgatggcggttttcgcgcacgactggaatttcacgacccgcgaatccctggaaggcccgacctggttcccgccggctcccgaacgcgcgccgggctcggtgccgatgcgctgcgtggcctcggggccggacagcgccctgggcagcacgcacaagatgctgctgggcgcgctggcggtggcgcagcgccatgtgcggatccaatccccctatttcctgcctgaccagacgctgatcggcgcactggggaccgccgcacgccgcggcatcagggtcgatatcgtgattccgggctcgaacaacctgcgcctggtcaactacgccatgagcgcacaactggaccaggtcatccgcacggggtgccgcgtatggcgctcggccggcgccttcgaccactcgaagctgctgacggtggacgatgcctggtcctatgtgggctcgtccaacatggacccgcgcagcctgcgcctgaacttcgagctggacaccgaaatctacgatcgtgaactggccggctggatcgggcagcgcatcgacgcgcagatccgccacgcacggcaggaaacactgcaggccctgaacgcgcagccgttcatcaagcgcctgcgcaacaaggtgatctggctggccacgccatatctctag

SEQ ID NO: 14357 - protein, 514 aa, Bordetella bronchiseptica RB50
MLLSLRIRTHIPDPPLAAPAATQAFLPDAMDPLEQLLRDYWPHIVFAISVVAGTGAAVHAAMTKQDVRAAIAWVGVALFSPLFGALLYFVAGINRIRRSLVSQQHDDAMLAYTGHPDAQVEDVVPCSGPQFASLRVLGDQVSRFRLLGGNQVRPLAGGDEAYPAMMQAIREARVSIAMQSYIFDCDPIGREMAQALVEAQQRGVQVRVLIDAIGSKYSRPPIIRTLVRGGVRTARFMTNPLGVMRMPYANLRSHRKILVVDGHVGFTGGMNIRAAFVTALAGKAANGDTHFRLEGPVVAQLMAVFAHDWNFTTRESLEGPTWFPPAPERAPGSVPMRCVASGPDSALGSTHKMLLGALAVAQRHVRIQSPYFLPDQTLIGALGTAARRGIRVDIVIPGSNNLRLVNYAMSAQLDQVIRTGCRVWRSAGAFDHSKLLTVDDAWSYVGSSNMDPRSLRLNFELDTEIYDRELAGWIGQRIDAQIRHARQETLQALNAQPFIKRLRNKVIWLATPYL

SEQ ID NO: 14358 - DNA, 1518 bp, Chromobacterium violaceum ATCC 12472
  CDS (1)..(1518): transl_table=11
atgagcaaagacgagcagtcgcaacaaaccctgcaattcgtccgccagctggcggaacaggcgctttcgcgctccgccggcgcgccgctgatggccggaaaccgagtgcggctgctgtacgacagcgtggaaaactttcccgcctgggagaacgcgctctcagaatgccgggattccatctttatcgaaatgtatatattcgccaatgaccaatttggcttgaaaatccgtaatatccttatagaaaaagcaaaacaaggcatccaagtttgcctgttgtatgactggctgggcagctggcgcgcgcacttgtccggcttcctcaagccgctgcaggaagccggagccgaggtgcgcgcctaccatccccccagcctgggcggcgggctcacgctgttggggcgcaaccaccgcaagatgatcatcgtcgaccggcaagagctgttcgtttccgggctgtgcatcagccagagctggcaaggccagcctgaaaagggactggcgccatggcgcgacaccggcctggcgctgagcggcccgctgctggcgccggcgctggcggcctttgccgacagctgggccagttgcggcgagccgctggacgcgcgctggctggttccggccgacacgcagcccgccggcgaggccgccgcgaggttgatcgccaccacgccttccaccgcgcggatgatgcggctggatctgttggtggccagcttcgcccgccgcacgctgtggctgaccgacgcctacttcatggccaccagcctctatctgtcggcgttgaagcaggcggcgcgggacggcgtcgacgtgcgcctcctggtgccgcgctccagcgacatccgctggatcgccgccgtgtcccgcacccagtaccgcccgctgctggaagccggggtgcgggtgttcgagtggaacgggccgatgatccacgccaaaaccgctgtcgccgacggccgctgggcccgcatcggctccaccaacctcaatctgtccagctggctggtcaaccgcgaactggacatcgcgctggaggacgagggcctggccggagaactcgcggaacgcttcctgcaggacctggaacagtcgaccgagatcgtgctgcgccaggagcggcgcaagccggtgccgcggccggtcagcaagcaggaacggcggatgcgcggcacgcccaaggaaatggcgctcagcggcgccagcgcggcggcgcgccaggcgatgcgcatcggcgacgcgctgggctccgtggtgcgcggcagccgcatggtggaaagcagcgaggccccggccttcctcagcataggcgtcgccctgtgcctgctggcgctggccatcgcctactttccgtggctggcggccgcgccgttggtcgcgctgctggccgcgggcggcctggccgtggtgttcaaggcctgcgggctatatctggaaaaacggaagaaaaaacaacagtcgaggctggcggagtgcagcagcggaagcgacaagccgacgccggacgactctcaatga

SEQ ID NO: 14359 - protein, 505 aa, Chromobacterium violaceum ATCC 12472
MSKDEQSQQTLQFVRQLAEQALSRSAGAPLMAGNRVRLLYDSVENFPAWENALSECRDSIFIEMYIFANDQFGLKIRNILIEKAKQGIQVCLLYDWLGSWRAHLSGFLKPLQEAGAEVRAYHPPSLGGGLTLLGRNHRKMIIVDRQELFVSGLCISQSWQGQPEKGLAPWRDTGLALSGPLLAPALAAFADSWASCGEPLDARWLVPADTQPAGEAAARLIATTPSTARMMRLDLLVASFARRTLWLTDAYFMATSLYLSALKQAARDGVDVRLLVPRSSDIRWIAAVSRTQYRPLLEAGVRVFEWNGPMIHAKTAVADGRWARIGSTNLNLSSWLVNRELDIALEDEGLAGELAERFLQDLEQSTEIVLRQERRKPVPRPVSKQERRMRGTPKEMALSGASAAARQAMRIGDALGSVVRGSRMVESSEAPAFLSIGVALCLLALAIAYFPWLAAAPLVALLAAGGLAVVFKACGLYLEKRKKKQQSRLAECSSGSDKPTPDDSQ

SEQ ID NO: 14360 - DNA, 1422 bp, Porphyromonas gingivalis W83
  CDS (1)..(1422): transl_table=11
atgattgcactcttaataatcgtatacatgctgatgacggctgccgtcagtgctgtcattatcagcgagaatcgcaatccactgaaggctacttcgtggattctggtcgtctcttttgtacccgtcttggggcttattgtctatatctttttcggacaggatcagcgcagacggcgtattgtcagccgccgtatatacaagcgcatcatgctgaagcctcactatctgtccatccccgaagcacagttggaagccatgaacaatatccagctgaatcccatcatgaagctgatcaacaacaactcggacagccccgtcatgctcagctcgccgccggatatattcacggcagggaaggatatgttcgactgcttctttcgcgacatagaggctgcccgccaccatgtgcatattcagttctacgtcatagaggatgaccatctgggcagtcgcctgtccgatctgcttatacgcaaggtgcaagagggcgtgaaggtgagggtcatattcgatcatgtgggttcgtgggctacgggccgtggctactggaaacgactgcgccgagccggagtggaagcctatccttttatgccggtcttcttccccatactgtccagccgcgtaaactaccgcaatcaccggaaggtagccgttatagatggtaaaataggctatttgggcggtatgaatgtggccgatcgctattactcgggcaacaggctcggtctgtggcgcgatactcacttccgtatgatgggcaatgtggtggccggtttgcagagcagtttcctgctggactggtatgtcgtatcgcgacgagtcatcaatctctccggctactatcccgatctgccgatacccgtatccgacgagggtgtgaagatacagctcgtacgctccggccccgtggggcaatggcgtaccatcgagcaggccaccatctactgtatcgagcgtgcctgcgaacatgtctatatcgagactccttacttccttccgaccgaaggactgaataatgctctcatcacggcagctttggccggcatcgatgtacacctgctggtgcccaaacgaagcgatgcccgtctgccacaagtggcggccttctcctatgtggaggatctcttgcaggccggtgtacatgtacacctctataccaacggctttctccattccaagctgataatggtggatagtcaggtggcttcgatcggctctacgaatatggacttccgcagcttggaaaataacttcgaattcaatggtatcatctatgacgagcctactgtccaccgattggaagccatcttcttcgaggacttgttgcagagcgaaccgctcgatctcaaacgctggcgaaagagaagccggataaaaaaattcagcgaatcctttgttcgccttttctctcctctgctctaa

SEQ ID NO: 14361 - protein, 473 aa, Porphyromonas gingivalis W83
MIALLIIVYMLMTAAVSAVIISENRNPLKATSWILVVSFVPVLGLIVYIFFGQDQRRRRIVSRRIYKRIMLKPHYLSIPEAQLEAMNNIQLNPIMKLINNNSDSPVMLSSPPDIFTAGKDMFDCFFRDIEAARHHVHIQFYVIEDDHLGSRLSDLLIRKVQEGVKVRVIFDHVGSWATGRGYWKRLRRAGVEAYPFMPVFFPILSSRVNYRNHRKVAVIDGKIGYLGGMNVADRYYSGNRLGLWRDTHFRMMGNVVAGLQSSFLLDWYVVSRRVINLSGYYPDLPIPVSDEGVKIQLVRSGPVGQWRTIEQATIYCIERACEHVYIETPYFLPTEGLNNALITAALAGIDVHLLVPKRSDARLPQVAAFSYVEDLLQAGVHVHLYTNGFLHSKLIMVDSQVASIGSTNMDFRSLENNFEFNGIIYDEPTVHRLEAIFFEDLLQSEPLDLKRWRKRSRIKKFSESFVRLFSPLL

SEQ ID NO: 14362 - DNA, 1443 bp, Gloeobacter violaceus PCC 7421
  CDS (1)..(1443): transl_table=11
atgctcgctcaggaggcgacactttttagcctgctggtccttgctgtccatgggctggggattgccaacgccgcccatgccgtgatgcatgtgcgctcatctcggggggcagtggcctggagcattgggctgattacttttccgtggctcgccatcccgctgtactgggtctttgggcgcaaccgctttttgggctacgccgaggccatccgtaccgcctacgagcagcaccaccgccgcatcgacagagcctacgacggcctgctggagcatcgagcacagcttcctgcgcgcttggccccggtggaacaactgggcgaacaactcgccagtctgccgtttttgaccggcaacaccgcccggttgctcatcgacggccgcgaaacgtacgacgcgatgctctcggccattgccggggccgagcactatgtgttgttgcagtcgtacatcgtcgaggcggatcgctcgggtgaagtgttcaaacaggcgctcatcgagcgggtcggggccggagtgcgggtgtatgtgctctacgacgaaatcggcagcaaccacctgccccgttcctacatcgacgatttgcgccgccacggcgtcgaggtgagtgcctttcacagcaccaagggttggaagaaccggctgcagatcaactttcgcaaccacacgaagatcctggtggtggatggtcgggtcgcctgcgtgggcggactcaacatcggcgatgcatatcttggagagggcaaaaacccgcagctgcgcccctggcgagacacccatttgcgcctcaccggtcccgccgtccagtgtttgcagttgattttcctgcgcgactggtactgggcgacgggcgaatcgccgccggtcgaatggcgggtgcacgccgagcgggaagcgggggcggcggccctggtgctgcgcaccggtccggcggacagcttgcccgcctgcacgctgttttttgtggatctgatccagcaggcccgcgagcgcctgtggcttgccagtccttacttcgtgcccccggaaccggtgttgcttgccttgcaactggcggcgatgcggggagtcgatgtgcgcataatgctcccggagcatccggatcacctgctggtctatctgtgtgccttttcgttctacgacgacctggcccgcaccgacatcaagctctaccgctaccagaaaggtttcatgcaccagaaggtgatcctggtggaccgcgaaattgccggggtcggcaccgccaacctcgacaaccgctcgttcaccctcaacttcgaggtaatgaactacattgtggatcccgattttgtgaaaagcgtcgaagcgatgctgatggcggatctggacgtctgccgccaggtcgattaccgggaataccgccgcaaacctttgtggtttcgcctcgcggtgcgcatttcccgtctcctggcaccggtgctgtag

SEQ ID NO: 14363 - protein, 480 aa, Gloeobacter violaceus PCC 7421
MLAQEATLFSLLVLAVHGLGIANAAHAVMHVRSSRGAVAWSIGLITFPWLAIPLYWVFGRNRFLGYAEAIRTAYEQHHRRIDRAYDGLLEHRAQLPARLAPVEQLGEQLASLPFLTGNTARLLIDGRETYDAMLSAIAGAEHYVLLQSYIVEADRSGEVFKQALIERVGAGVRVYVLYDEIGSNHLPRSYIDDLRRHGVEVSAFHSTKGWKNRLQINFRNHTKILVVDGRVACVGGLNIGDAYLGEGKNPQLRPWRDTHLRLTGPAVQCLQLIFLRDWYWATGESPPVEWRVHAEREAGAAALVLRTGPADSLPACTLFFVDLIQQARERLWLASPYFVPPEPVLLALQLAAMRGVDVRIMLPEHPDHLLVYLCAFSFYDDLARTDIKLYRYQKGFMHQKVILVDREIAGVGTANLDNRSFTLNFEVMNYIVDPDFVKSVEAMLMADLDVCRQVDYREYRRKPLWFRLAVRISRLLAPVL

SEQ ID NO: 14364 - DNA, 1470 bp, Photorhabdus luminescens subsp. laumondii TTO1
  CDS (1)..(1470): transl_table=11
ttgccgaatatgacaaccttttattccgtcctaagttggcttgctattttcttttattggctgattgttgccagtatcactttacgcattctgataaaacgccggccggtcacttctgctatgacctggctgctgattatctatatcctacccttagttggaatcatcgcttacctgtcatttggtgagctgcatttgggaaaacgcagagttgaacaagcaaaagccatgtggccttcaacaaccgtatggcttgaagaattgcgcaaatctcgccatatcttcgcgacagaaaatagcgaagtcgcgacaccactattccagctttgcgaacgacggcaagggctggcgggtgttaaaggtaacaagatccaactactgaaaacctatgaccattcactaaaaaccattatcaaagatattgagaatgccaaacacagtattgatatggtgttttacatctggcaaaccggcggcttggttgagcaagtgacggatgctcttatggccgcagcacaccgaggagtcagatgccgtattatggtggattcagccggtagctggttatattgccgtagccaatacccggatatcatgcgccaggcgggaattgaatttgttgaagctttgcaagtcaatatattccgtctatttctacgccgtatggatctgcgccagcatcgtaaaattatcttgatagacgattatatctcttatgccggcagtatgaatatggtcgatccacgcttttttaaacaagatgccggtgttgggcaatggatcgatatcatggtacgaatggaaggaccggttactacaaccatgggggttatttacgcttgtgactgggaaatggaaacaggtcaacgtatctttccgccatcaccagataacaatatcatgccatttgaacaggccagtggacacacaactcaggttattgcatccggccccggattccctgaggagttgattcaacaatctttaatgacggctattttctctgcccgtaagcaactgattttaactaccccttattttgttcccagtgatgacctgacaaatgctatttgcaccgccgctttacgaggggttgaggttattattatcgttccacgcagaaataatttctttttagttcgttgggcaagccgggcattttttgctgaactattaaacgccggtgttaagatttatcaatttgaagatggattgctacatactaaaagcgttttagttgatggccaactcagcatggtgggttccgttaatctcgatatgcgtagcctgtggctaaatttcgaaattaccgtggtgattgatgatgaaaactttggtaatgatctgacgctggtgcaatacgattatatcgcccattctacattgctggaaactcatgagtgggaacaacgccctttgtggcatcggattattgagcgtatttgttacttctttagcccgctactgtga

SEQ ID NO: 14365 - protein, 489 aa, Photorhabdus luminescens subsp. laumondii TTO1
MPNMTTFYSVLSWLAIFFYWLIVASITLRILIKRRPVTSAMTWLLIIYILPLVGIIAYLSFGELHLGKRRVEQAKAMWPSTTVWLEELRKSRHIFATENSEVATPLFQLCERRQGLAGVKGNKIQLLKTYDHSLKTIIKDIENAKHSIDMVFYIWQTGGLVEQVTDALMAAAHRGVRCRIMVDSAGSWLYCRSQYPDIMRQAGIEFVEALQVNIFRLFLRRMDLRQHRKIILIDDYISYAGSMNMVDPRFFKQDAGVGQWIDIMVRMEGPVTTTMGVIYACDWEMETGQRIFPPSPDNNIMPFEQASGHTTQVIASGPGFPEELIQQSLMTAIFSARKQLILTTPYFVPSDDLTNAICTAALRGVEVIIIVPRRNNFFLVRWASRAFFAELLNAGVKIYQFEDGLLHTKSVLVDGQLSMVGSVNLDMRSLWLNFEITVVIDDENFGNDLTLVQYDYIAHSTLLETHEWEQRPLWHRIIERICYFFSPLL

SEQ ID NO: 14366 - DNA, 1455 bp, Vibrio vulnificus YJ016
  CDS (1)..(1455): transl_table=11
atggacaagttctaccattttctcaccctcgcagggatcggactttattgggtcctgattgctggtgtgacgttccgtgtcgtgttaaagcgtcgtgccgtgagcgtttcgctcgcatggctaatgatcatttacattctccctgtgctgggcgtcgcctgctattttctgtttggtgagctaaatctaggccgcaaacgagccgagcgtgccaaagagatgtttgccccctttgccacttggttctcgcaactgaatgactgccaagcccatgcgccagagtcgatgggacgccatatctatcgtattgacgaattgtgcaatactcggctgggcttacccgcactcagcggcaacacgctctctttgcaacgttcgcctgaagagattcttcattccgtcattcaagatatcgaaaacgcgcaaagtagtattcgtatggtgttttacatctggcatcctggaggcttagcggattctgtcgcttcagcgcttatccaagccgccaaacgaggtgtggatgtcaaactgttgctggattcagcggggagtccacgatttttccgtagccattggcatcagatgatggtgaacgcaggcattcacgtggtacaagcgctagaagtgagcccatggcgtatttttctacgtcgtctcgatttaagacaacaccgaaaaatcatcgttatcgacgatgagattgcctacacaggttcaatgaatttggtcgaccccgcctacttcaaacaaagcagcggcgttgggcaatgggtggatatcatggtgcgtttgactggtccaacggtgaacgtgctttccgccattcattgctgggattgggaagtagaaactggacatcgccaattacccagactgcctgaatgcccgttagactcgacgcaataccaaaaccccattcaagtggttccatcgggccccggcatgccggagaacttgatttctcaagtgttgattctcgccatcaaccaagcgaaccactcggtcacgattaccacgccttactttgtgccaagcatcaatctgctcgacacattaaaaatgacggcacagcgtggcattgatgtacaactgatcatcccacataaaaatgactccctcatggtgcaatgggcttctcgttccttttacagcgagcttatggaagcgggcgtgaagatcttcgaattttatggtggattgctgcacactaaatccgtcgtgatcgaccaagagttttgtctcgtcgggacggtcaacatcgacatgcgcagtttgtggctcaattttgaactcacactggcggtagatgatgagcagttcactcaacaaatgcaccaattgcaacaaaactacaaatcgcgcgctcatcctgttcatctgagcgaatggaacaaacgctcactttactcgcgctttttagagcgactctactacctctttaatcctttgctgtga

SEQ ID NO: 14367 - protein, 484 aa, Vibrio vulnificus YJ016
MDKFYHFLTLAGIGLYWVLIAGVTFRVVLKRRAVSVSLAWLMIIYILPVLGVACYFLFGELNLGRKRAERAKEMFAPFATWFSQLNDCQAHAPESMGRHIYRIDELCNTRLGLPALSGNTLSLQRSPEEILHSVIQDIENAQSSIRMVFYIWHPGGLADSVASALIQAAKRGVDVKLLLDSAGSPRFFRSHWHQMMVNAGIHVVQALEVSPWRIFLRRLDLRQHRKIIVIDDEIAYTGSMNLVDPAYFKQSSGVGQWVDIMVRLTGPTVNVLSAIHCWDWEVETGHRQLPRLPECPLDSTQYQNPIQVVPSGPGMPENLISQVLILAINQANHSVTITTPYFVPSINLLDTLKMTAQRGIDVQLIIPHKNDSLMVQWASRSFYSELMEAGVKIFEFYGGLLHTKSVVIDQEFCLVGTVNIDMRSLWLNFELTLAVDDEQFTQQMHQLQQNYKSRAHPVHLSEWNKRSLYSRFLERLYYLFNPLL

SEQ ID NO: 14368 - DNA, 1191 bp, Geobacter sulfurreducens PCA
  CDS (1)..(1191): transl_table=11
atgtccatcgttcgccgcaaaatgattatgggcactccccgcgccccccgctttctgagggtcttcaggcggaacgccgaggcagcccattcccggggaaacagggtgaaactgttcacctcgggggctgatttctttccggccatgctcggcgcctttgccgaggcgcgccaccatatccacgccgagttctatattgtgcgcgacgacgccacgggcgcggcctttgccgaagcactgctggccgccgctgcccgcggggtggaagtctcccttatctatgactacattggttgcttcgacacaccttccgcctatttccgccggctggaacagggcggagttcgctgcctcgccttcaatcctccccccttcaaggggggaatcgcttggttcgacaagcgggatcaccgcaagatggctgtggtcgacggggaaaccgcgttcacgggcggagtcaatgtcggcgacgagtattcggggttcggctttccccatgaacggtggagggatgtgggcatcaggatcgacggaccggcggtcatagatctgtcgcggctctttcgggggttctggcttgctgagaaggggagttcctcaccggcttggcatcaggagcgcctgcccgtggccgcggtcggtgatgccgacgtaatggtcatcagtgacggcccttaccatgcccgttcctttatccgcaatgccttccgtatcgccatggccggcgcgggcgagtcgatccggatcatgaatccttacttcgtgccgggaccgcgggtggttcggtctctgctgcgggccgtccggcggggcgtcagagtccagatcatacttcccgccaagaacgatgtgcccatcgtgcgtctcgtgagccgcagctactatacccccctcctgcgggagggaatcgaactcttcgagcgccaggggccggttctccacgccaaggtcatgctcattgacgacgcctggggggtcgtcggctcggcaaatctcgaccagcgcagttttcaccgcaactatgaggtgaataccatcgttgccagccacgagttcggcagccaggtggcggaaatgttcgccgaggaccttgccggatcgcgacgtgtggtccttgaggaacacgagcagcggggctggcatgtacgcttgctggagcgtctctgcggatcggtgagctggtttctgtag

SEQ ID NO: 14369 - protein, 396 aa, Geobacter sulfurreducens PCA
MSIVRRKMIMGTPRAPRFLRVFRRNAEAAHSRGNRVKLFTSGADFFPAMLGAFAEARHHIHAEFYIVRDDATGAAFAEALLAAAARGVEVSLIYDYIGCFDTPSAYFRRLEQGGVRCLAFNPPPFKGGIAWFDKRDHRKMAVVDGETAFTGGVNVGDEYSGFGFPHERWRDVGIRIDGPAVIDLSRLFRGFWLAEKGSSSPAWHQERLPVAAVGDADVMVISDGPYHARSFIRNAFRIAMAGAGESIRIMNPYFVPGPRVVRSLLRAVRRGVRVQIILPAKNDVPIVRLVSRSYYTPLLREGIELFERQGPVLHAKVMLIDDAWGVVGSANLDQRSFHRNYEVNTIVASHEFGSQVAEMFAEDLAGSRRVVLEEHEQRGWHVRLLERLCGSVSWFL

SEQ ID NO: 14370 - DNA, 1443 bp, Geobacter sulfurreducens PCA
  CDS (1)..(1443): transl_table=11
gtgatttcatacttggatgacgtatttttatttgtgtgcgcaggaatcgcgattgccctttcggtgggctctgccggtcatgcccttgtcatgaagcgagacccccggtcagcactcgggtggatcgttgtctgcctcacggtcccgctgttcggtcccattttctactggagcatgggggtaaaccgcatcttccgccgggcccgcaagtggcaggaaacagggcgccgtctggctgggggagagcacttccgctcagcccaggagcatgaaagtgcgccgactcctccggcgggggccgaatacctctccgagctgcgccatctggccgatcgggtggtgggagcccctctggtccagggaaaccgtataatccccctggatggtggcgaaggggcgtaccccgccatgctggaagccatcgcccatgcccgatcctcggtccacctttctacctatatcttcgattccgacagcaccggccgccggttcatcactacgctggccgccgccgcggcgcgtggtgtcatcgtgcgggtgatcgtcgacggcgtcggtgaaaagtattcatggccccgtgccaggactctcatggaggggacgggaatcagggttgagcggttcctgccgttgcgacaggggatctacatgaatctgcgcaaccaccgcaaagtcttggtggtggacggccagctggcatttacgggggggatgaatatcggggaccggcatgtggctgaaaaggcgggtgacgccgtgtcgcgggatgttcacttctcggtggcgggtccggtggtggcggggcttcagcaggtcttccttgaggattggcacttcgtcaccggcgaacttcttgatgacacccggtatttccctccgatccagccggccggtcatgccctggcccgtcccatcggcgacgggcccgacaaggaataccatacgctccattggatcatcatgggagccctgtcgtgcgccactcggacggttcagatcatgacaccgtacttcatccccgaccgctcacttgtttcggccctggtcactacggcgttgcggggggtggaggtcaccctcgttttgcctgagaagaacaatcttccctttgtccactgggccaccagggcctatctctgggagcttatccagcagggaatcagagtgttttaccagccgcccccttttgcccacaccaagcttttcatcgtcgacggcctctggagcatgatcggctcggccaacctggatccccgcagccttcggctcaacttcgagctcaatctggaggtttacgatcgggagttggccggaaccctttcccgtcacttcgccgtaaccgttgcccgctcgcgacaggtgagcctgaccgagatggacggccgcccactccctgaaaaagtgcgggacgccacggccaagctcttttctccctatctgtag

SEQ ID NO: 14371 - protein, 480 aa, Geobacter sulfurreducens PCA
MISYLDDVFLFVCAGIAIALSVGSAGHALVMKRDPRSALGWIVVCLTVPLFGPIFYWSMGVNRIFRRARKWQETGRRLAGGEHFRSAQEHESAPTPPAGAEYLSELRHLADRVVGAPLVQGNRIIPLDGGEGAYPAMLEAIAHARSSVHLSTYIFDSDSTGRRFITTLAAAAARGVIVRVIVDGVGEKYSWPRARTLMEGTGIRVERFLPLRQGIYMNLRNHRKVLVVDGQLAFTGGMNIGDRHVAEKAGDAVSRDVHFSVAGPVVAGLQQVFLEDWHFVTGELLDDTRYFPPIQPAGHALARPIGDGPDKEYHTLHWIIMGALSCATRTVQIMTPYFIPDRSLVSALVTTALRGVEVTLVLPEKNNLPFVHWATRAYLWELIQQGIRVFYQPPPFAHTKLFIVDGLWSMIGSANLDPRSLRLNFELNLEVYDRELAGTLSRHFAVTVARSRQVSLTEMDGRPLPEKVRDATAKLFSPYL

SEQ ID NO: 14372 - DNA, 1578 bp, Geobacter sulfurreducens PCA
  CDS (1)..(1578): transl_table=11
atggcaagcaggcagaggatcatgcccttcggcaacaccaagcagtcaccgcggggaaccgtatggcaactccagctcgccgtcgccgcgctgctggcccttgccgtcgcactgctcacgcccgggccgggcggagcgctgggcgctcccgatggcgtcacgcagggggcgtccctgtcccggagcatccagccgctcttggacgcccatcccgggaaaacgggccttcatgttctggagaagggggaggagtcgctgctggcccgggcgtggcttgccgaccacgccacggagaccattgatgtccagtatttcatctggagcactgacaatattggcatcctggcctcggaagccctgctgcgggcggcggagcgcggggtcagggtacgggtgctggtggacgatctgttgatcgacgccccccctgagtcactcctggccctggcccgtcacccgcggatcgatatccggatctacaatcccacaatgaccgtggggacctcgaaggttaagcgcctcggtaatgtggtgaccggcttccgctcggtaaatcagcggatgcacgacaaaaccgccctgttcgacggggtggtcggcatcacgggcgggcgcaatatggccgacgagtactacgattacgatcaggaatacaccttccgggaccgggacatcctgatgctggggccggcggtggccgaagcggaggccagcttcgccaggttctgggaaagcccccttgcggtaccggtggaaaagctcctgaaaaagggtatgaagaagatgacgccggagcggacggcccgggtttatgccgatctccacgcctatgccggcaagccggagaactttgcgtcggaggtgcgccaggcgctgcgtgacctgcccgacaggttcgacgggctgctgcgggagatggtgtgggacgaagcccgcttcatttccgatctgccgggcaagaacagcggccgcgatgggctcgggggcggcggccagagcactaccgccctggttgaagcggtgcgcagcgccaagcggcgggtcaccatccaatctccctatctcgtgatgccggcgggagggttggagctgttccgcgcgctggttgagcggggggtagaggtacggatcgtcaccaattccctggctgcaaccgacaaccttcaggcattcagcgggtaccgaaagcagcgggaaaaacttttacgggcagggatcaccatccgggaattccgtcccgacccggccgtgctaaaggaactgatcgaccgttacccgaagctgaagaaaaagccccccaccttcgctctccatgccaagaccctggtaatcgacggtgaaactctctacgtcggcaccttcaatctggacccgcgttccgccaacctgaacactgaggtcgggatcctggtcaccagtccgactctggcccggcgggtggaagagcggatcgagcgtgacatgctgccggaaaacagctggaatccagccacggacaaccccgaccggtacgcttcggcggccaagcgtagcaaaatgcgcttctggaagtccctgccgctggatccgattctgtga

SEQ ID NO: 14373 - protein, 525 aa, Geobacter sulfurreducens PCA
MASRQRIMPFGNTKQSPRGTVWQLQLAVAALLALAVALLTPGPGGALGAPDGVTQGASLSRSIQPLLDAHPGKTGLHVLEKGEESLLARAWLADHATETIDVQYFIWSTDNIGILASEALLRAAERGVRVRVLVDDLLIDAPPESLLALARHPRIDIRIYNPTMTVGTSKVKRLGNVVTGFRSVNQRMHDKTALFDGVVGITGGRNMADEYYDYDQEYTFRDRDILMLGPAVAEAEASFARFWESPLAVPVEKLLKKGMKKMTPERTARVYADLHAYAGKPENFASEVRQALRDLPDRFDGLLREMVWDEARFISDLPGKNSGRDGLGGGGQSTTALVEAVRSAKRRVTIQSPYLVMPAGGLELFRALVERGVEVRIVTNSLAATDNLQAFSGYRKQREKLLRAGITIREFRPDPAVLKELIDRYPKLKKKPPTFALHAKTLVIDGETLYVGTFNLDPRSANLNTEVGILVTSPTLARRVEERIERDMLPENSWNPATDNPDRYASAAKRSKMRFWKSLPLDPIL

SEQ ID NO: 14374 - DNA, 1470 bp, Lactobacillus johnsonii NCC 533
  CDS (1)..(1470): transl_table=11
ttgggagggatacttattttttcgaatgaattttgggcacttctttgggctgtcaacacaatcttagccttctatgttgtattccaccgaaaaagatctgtcgctacctcttgggcatggttaattattttactaatttttccaattttaggctttattttatatggttttattggacgtggattatcacaagaaaatctttttgccattaacaatcaaaaacacattggtttaaataaagtaaataagatgatcccgcgtgttcctaaatccgctgggccaacagatacttctaaagaagccaaaattttaattgattactttaactttaagcacgattcccccctttctaaaaacaacaaaatcagtttttatactgatggcgaaaagaagtttgaagctctttttaaagacatcgaacaagctcaagaaacagttaatgttgaatattattccttcatgaatgatgatttaggtaataaatttcttaatttattaattaaaaaagctcgcgaaggtgttaaggtaagacttatctatgatccttggggttctcctggagcttcaaagacttggtttaaacctttaactgatttgggcggtgaagttgtagcctttatcacagctcaaaacatgattaaaaagtatcggatgaattatcaccttcaccgtaaaattgtcgttatagacgggcgaatatcttggacgggcggctttaatgtcggagaccaatatgtcagcaaaagcaaaaaatttggctactggcgtgatactcatcttagaatcgtcggctccgcgtccctgctgttgcaggagcgttttgtaatggattggaatgcttcaattactgataaaaatcagacaatttcatttaatgaaaaactatttccaaaaattgaagaaaatcagctaacagaagatgatgttgcaactcaaattgtttcagatggtcctgatacttctacgccatatttacgtaatggcatgattagaatgatgatgatggctagaaaaacactctggattcaaacaccctatcttgttccagacgatccaatgattgccacttgggttattgcggctcattcaggcgttgacgtgcgtatcatgattccttcaatgcctgatcatccctttatttaccgcgctacacagtggtatgcaaattacctgctccatgagggaataaagatctatgtttatgataatggttttattcatgcaaaaaccgtcatggttgatgatcgcttcgctgcagctggatcaatgaatcaagactttaggtcatatagcttaaactttgagactgatgcagtcttctacgataaaaatattacccgggaattaaatcatatttttgaaaaagatttagctaaatgtacagaattgactttagaaattaccgataactggtcgcgttatcttcgatttaaacaagctttttctagattactttctcccattctataa

SEQ ID NO: 14375 - protein, 489 aa, Lactobacillus johnsonii NCC 533
MGGILIFSNEFWALLWAVNTILAFYVVFHRKRSVATSWAWLIILLIFPILGFILYGFIGRGLSQENLFAINNQKHIGLNKVNKMIPRVPKSAGPTDTSKEAKILIDYFNFKHDSPLSKNNKISFYTDGEKKFEALFKDIEQAQETVNVEYYSFMNDDLGNKFLNLLIKKAREGVKVRLIYDPWGSPGASKTWFKPLTDLGGEVVAFITAQNMIKKYRMNYHLHRKIVVIDGRISWTGGFNVGDQYVSKSKKFGYWRDTHLRIVGSASLLLQERFVMDWNASITDKNQTISFNEKLFPKIEENQLTEDDVATQIVSDGPDTSTPYLRNGMIRMMMMARKTLWIQTPYLVPDDPMIATWVIAAHSGVDVRIMIPSMPDHPFIYRATQWYANYLLHEGIKIYVYDNGFIHAKTVMVDDRFAAAGSMNQDFRSYSLNFETDAVFYDKNITRELNHIFEKDLAKCTELTLEITDNWSRYLRFKQAFSRLLSPIL

SEQ ID NO: 14376 - DNA, 1488 bp, Lactobacillus johnsonii NCC 533
  CDS (1)..(1488): transl_table=11
atgattttaacttgggatataattagaagaataatcgaaatcctttggttaattaatgtcggtctagcaatttggacagtttttcgtagtcatcgtgatattgcttctacttgggcatggctcttgattttgtctatcttgccttatgttggttttgttttatatttatttactggtcggcaattatcacatgatgatatcttttcaattgaaactgaacagaaaaaaattcgtgatcattttcttaatgaacaaaatagactattaagaatccatgacttgctaccaagtaaagcccagaatccacgcgcaagacgcttagtagaactgaatctaaataatgatgatgcccttttaacttttaataacgaagtcgagacttttatcgacggacaagctttatttccaaatcttataaaaaatattgatgaagcaaagagaaccattaatgtagaattttatacattttatgatgatcaattaggaaatcaggtcttacaatctttagaaaaagcagccagtcgaggcgttaaagttagagttttatatgatgcaagcggctctcgtggtacacgaccatctttttttaaagaacttcgtcaactaggtggagaagctcaacctttcatttcaacagctggaaaccgtctttttactactcctcgcgctaactatcatttacacagaaaactggtaatcatcgacaatgaaattggatatattggcggcttcaatattggtgatcaatatattgatcgaagtaagaaatttggacactggcgtgatacccaccttcgcgtagtaggacaagcagctttattaatggaaattcgctttgcaatggattggaatactagttgccgtaaatctcatcttccaaaatataatattgataacttaattgaaacatttgaattaaaaatagttcaatctaaagacttggtcccaatgcaaattgtttcatcgggaccagataatagtcactttggtattcggcgagcttatgaagaaataattgctcaagcacaaaattatgtctacattcaaactccctacttaatcccgggtgattcaatcctggaagctttaattattgcagcaaaaagtggagttgatgtacgaattatgatcccttctatgcccgatcatccctttgtctaccgagcaactgaatactacgcaaagtacctagttaatcaaggagttaaagtttataaatacgataatggatttattcatgcgaaaactatggttagcggttctaatattgcttcagtcggatcggcaaatcaagattttcgtagttatcaattaaactttgaagtaaatgcttttacatatagcgcagctctcaccaaggaattaaaagaaatttttgaagaagatttaaaagagtcaactttactcacaaaagagtactttgacaaacaatctcattggcgtaaatttaaacaatacttttcaagattattatcaccaattttataa

SEQ ID NO: 14377 - protein, 495 aa, Lactobacillus johnsonii NCC 533
MILTWDIIRRIIEILWLINVGLAIWTVFRSHRDIASTWAWLLILSILPYVGFVLYLFTGRQLSHDDIFSIETEQKKIRDHFLNEQNRLLRIHDLLPSKAQNPRARRLVELNLNNDDALLTFNNEVETFIDGQALFPNLIKNIDEAKRTINVEFYTFYDDQLGNQVLQSLEKAASRGVKVRVLYDASGSRGTRPSFFKELRQLGGEAQPFISTAGNRLFTTPRANYHLHRKLVIIDNEIGYIGGFNIGDQYIDRSKKFGHWRDTHLRVVGQAALLMEIRFAMDWNTSCRKSHLPKYNIDNLIETFELKIVQSKDLVPMQIVSSGPDNSHFGIRRAYEEIIAQAQNYVYIQTPYLIPGDSILEALIIAAKSGVDVRIMIPSMPDHPFVYRATEYYAKYLVNQGVKVYKYDNGFIHAKTMVSGSNIASVGSANQDFRSYQLNFEVNAFTYSAALTKELKEIFEEDLKESTLLTKEYFDKQSHWRKFKQYFSRLLSPIL

SEQ ID NO: 14378 - DNA, 1593 bp, Bdellovibrio bacteriovorus HD100
  CDS (1)..(1593): transl_table=11
ttgagccttcacgcaaaaccccgtatcctgctcgggacggggtttttctttgtgataaaaatactgcccattcccattttgcttggactttctgcagggtgtgcctcacttcctgcgaatacaaaccggccctactctgaagccctgcctcccgatcccaagaccccgttggctcaagccacagaaactcagatcaaaggtcatcctggtcagtccggcttctatcctctggcatcgggtctggaggccctggtggcgcgcatggcggctgtcgtcgtttctgatcgcagcatcgatctgcagtactatatctgggaaaatgatctgaccggacgaatgctgttgcatgaggtcttgcgggccgccgaccgcggtgtgcgggtgcgtgtcctgctcgatgacttaaatcagagccgctacgaaaagggccttgcgattctggattatcacccgaacgtcgaagtgcgcatggccaaccctttcgccggtcgcacttggaaaattctagatgccatgcgcttttccactgtcaatcgacgcatgcacaacaaagtctttgtcgtcgacaaccagaccgcgattgtcggcgggcgcaatatcggggatgaatacttcggtgccagtgaagagatgaattttggtgacttcgacctgtgggccatcggcccggtggtgcaggaactgtcgcgacattttgatacatactggaacagcgaaatcgcttatcccatatctgttctagttaagggattcaaacccacccttgaagacctgcaaaaactgaaagacgacgccgctgccgccatcactgaagccgaaaagacccagtatgccgacgccctcaaagaaaccccgatagtgaaaaagttcacccacgagccaatgaaactttactggggaaaagccgacgtggtgatggatccccccgagaaattccaccaggactccaaagaccaggtcgacaatctcgcacgacaactttatcccctgatagaaaagactgaaaaagagctgattctggtttcgccatacttcgttcccggcaagaagggtgtgaagttcttcaaacatttaaacgaccgaggcgttcaatcgctggttctgaccaattcactggcctccagcgatgtcgccacggtgttttccgggtacaagggctatcgcaaagacttgctggatcaaggtgtcagcctgtatgaactaaaacccaacagccccacgaccacacccaaaaagaatcgtgtcggttcaagtttttccagcgccggtctgcacggaaagatctttgttttcgaccgaaaaaaggtttttgtcggatccatgaatctggatccccgctcggccactttaaacagtgaaatgggggtcgtcgtggacagccccgagctggctgaaatgatcagcacgaatctaatcgcccatcttcgtagggacagctatcaggttttgctgaatgaaaaaaacaatctgatctggaaaaccaccgatgactgcgggctggaacatgtctttagcaaagatccggaaaccagctggtggaagagatttaaagccagcctcagcgcgattttcattcccgaatcctggttgtaa

SEQ ID NO: 14379 - protein, 530 aa, Bdellovibrio bacteriovorus HD100
MSLHAKPRILLGTGFFFVIKILPIPILLGLSAGCASLPANTNRPYSEALPPDPKTPLAQATETQIKGHPGQSGFYPLASGLEALVARMAAVVVSDRSIDLQYYIWENDLTGRMLLHEVLRAADRGVRVRVLLDDLNQSRYEKGLAILDYHPNVEVRMANPFAGRTWKILDAMRFSTVNRRMHNKVFVVDNQTAIVGGRNIGDEYFGASEEMNFGDFDLWAIGPVVQELSRHFDTYWNSEIAYPISVLVKGFKPTLEDLQKLKDDAAAAITEAEKTQYADALKETPIVKKFTHEPMKLYWGKADVVMDPPEKFHQDSKDQVDNLARQLYPLIEKTEKELILVSPYFVPGKKGVKFFKHLNDRGVQSLVLTNSLASSDVATVFSGYKGYRKDLLDQGVSLYELKPNSPTTTPKKNRVGSSFSSAGLHGKIFVFDRKKVFVGSMNLDPRSATLNSEMGVVVDSPELAEMISTNLIAHLRRDSYQVLLNEKNNLIWKTTDDCGLEHVFSKDPETSWWKRFKASLSAIFIPESWL

SEQ ID NO: 14380 - DNA, 1212 bp, Bacillus cereus ATCC 10987
  CDS (1)..(1212): transl_table=11
atgattaaaaaaatattgcgagttacttctattattgttgctattgttgtttttattttaatttgcatgcatatcgatgttaccttaggtagaaaaatggaagtcgggaaaaacatgccgacagagtatgcacctcattatagtgactttcaattatatgtagaagggaagtcattttataaacagttatttactgatataagagaggcgaagagatctatttatacgtacttttttattttgtcagatgataaaagtagccatacttttttaaacttattaaaagaaagggcaaaagaaggagtaaatgtctatttatcggttgatcgcattaatgatttatcatttgaaagaaagaagataaatgaattgcgggaaagtggtgtacattttacatatagtagaaaacctgaattaccattcgggttttattcacttcaccatcgtaatcatcgccgtattacgacgattgatggagtgattggttatacgggtggttttaatataggggatgagtacttaggaaaagataagcgatttggatattggcgtgactatcatgtgcgacttaaaggagagggcgcaaaagatttagaagaacaattcgctttagattggaaacgagatacgaaagaaaagataaaaagaagtacgaataaagcgagtaaagggaatacattacatacgatggctagttacaatggacatcacgtcgctgaaaaatatatagaattaataaaagaagcaaagcattcaattgtcattacaacaccttactttatagccaaaaataaagaagtaatgaatgctttaatggaagcacaaaaacgtggagttactgtaaaaatactttggtcatataaaccagatattcctcttattaaagaggcggcgtatccgtatattcgccaagctgttaataatggaattaaagtatatggttataaaaaagggatgtttcatggcaaattaatgcttattgataatgaactaactgttattggtacgacaaattttacttcgcgaagtttcaatataaatgatgaaatgaatttgtatattcatggtggttcaattgtaggacaagttaatgaggcgttaacggaggattttcataattcaaaagaaatgacgaaagaattttttgagaagttatcgttttgggagcgttgtaaggaaaagttggggggattggctgatttttatttctaa

SEQ ID NO: 14381 - protein, 403 aa, Bacillus cereus ATCC 10987
MIKKILRVTSIIVAIVVFILICMHIDVTLGRKMEVGKNMPTEYAPHYSDFQLYVEGKSFYKQLFTDIREAKRSIYTYFFILSDDKSSHTFLNLLKERAKEGVNVYLSVDRINDLSFERKKINELRESGVHFTYSRKPELPFGFYSLHHRNHRRITTIDGVIGYTGGFNIGDEYLGKDKRFGYWRDYHVRLKGEGAKDLEEQFALDWKRDTKEKIKRSTNKASKGNTLHTMASYNGHHVAEKYIELIKEAKHSIVITTPYFIAKNKEVMNALMEAQKRGVTVKILWSYKPDIPLIKEAAYPYIRQAVNNGIKVYGYKKGMFHGKLMLIDNELTVIGTTNFTSRSFNINDEMNLYIHGGSIVGQVNEALTEDFHNSKEMTKEFFEKLSFWERCKEKLGGLADFYF

SEQ ID NO: 14382 - DNA, 1446 bp, Desulfovibrio vulgaris subsp. vulgaris str. Hildenborough
  CDS (1)..(1446): transl_table=11
atgaccacgctgcactggatactgctgcccatctcctacgcgccatctgtggtcgctgcgctgcatgccctgctcaccaagcgcgacccgcgttcggccctcggctggattgccgtgagcctcacgttcccattggctggccccttcttctatttcatcttcggcatcaaccgcgtccatagccgtgcggcccagcttctggcagccacggagaacaggaggcgtcgtcagggtgagaggttgcatggagggccggaagaggacgacccgccgggtaccgtttcggatacctacatacccccacggtttcgcgccctggcacgtgtcggacgcatggtcaccggaagaccccttgcggggggcaataccgtgcgtccgctgtataatggcgaagacgcctatcccgccatggtcgaggccatcgacaaggccgaacacagtgtctttctcaccacgtacatcttcggtggccggcgcataggcgaacagttcgtggattccctcgccgatgcggctgaacgcggggtcgacgtccgggtcatcatcgacggtgtggggggactctattcgtggccgagggcgtggtcgcgcctgaagcgtcgcggagtgcgcgtcgagagattcctgccgccgcacctgttgccaccgcagctttccgtgaacctgcgcaaccaccgcaaggtgctggtctgcgacgggcatgtcggtttcacgggcggcatgaacgtgggtgaccatcacctcatggccaccgacaatccgcgccgtgtgcaggatgtgcatttcctgttcacgggccccatcgtggcacagttgcaggaggtcttcctgcgtgactggggtttcctcacgggagactatgccctgacggccccggttcacgatgaaccctgtggcgattcgctctgtcgtacggtgctcgaagggccgggcgaccgcgcagaacgtctgcacgacctgctatgcggcatcatctccagcgcctcgcgctcggtgcgcatcgtgaccccgtacttcctgccgtcgcgtgagatcatcagcgccctgcgggcagcggccctgcgcggggtcgatgtgcgcgtcatgctgcctgcccgcaacaaccttcccttcgtgcactgggccacacgacacctgctggaaagccttgtggacagcggggtgcgcgtcttctaccagccgccgcccttctcgcattccaagctgttgctggtcgacggctactatgcgcaggtcgggtcggccaacatcgacacgcgcagtctgcggctcaacttcgaattgacggtggaggtcttcgacaccagcgtcgtgcggcagttgaacaggcatttcgacacggtgcggcgcatgagcgaagaggttcaggccagtatgctggccagtagacccttcgccacgcgggtgcgggatgccctgttctggctcttctctccgtatctgtga

SEQ ID NO: 14383 - protein, 481 aa, Desulfovibrio vulgaris subsp. vulgaris str. Hildenborough
MTTLHWILLPISYAPSVVAALHALLTKRDPRSALGWIAVSLTFPLAGPFFYFIFGINRVHSRAAQLLAATENRRRRQGERLHGGPEEDDPPGTVSDTYIPPRFRALARVGRMVTGRPLAGGNTVRPLYNGEDAYPAMVEAIDKAEHSVFLTTYIFGGRRIGEQFVDSLADAAERGVDVRVIIDGVGGLYSWPRAWSRLKRRGVRVERFLPPHLLPPQLSVNLRNHRKVLVCDGHVGFTGGMNVGDHHLMATDNPRRVQDVHFLFTGPIVAQLQEVFLRDWGFLTGDYALTAPVHDEPCGDSLCRTVLEGPGDRAERLHDLLCGIISSASRSVRIVTPYFLPSREIISALRAAALRGVDVRVMLPARNNLPFVHWATRHLLESLVDSGVRVFYQPPPFSHSKLLLVDGYYAQVGSANIDTRSLRLNFELTVEVFDTSVVRQLNRHFDTVRRMSEEVQASMLASRPFATRVRDALFWLFSPYL

SEQ ID NO: 14384 - DNA, 1137 bp, Bacillus anthracis str. Sterne
  CDS (1)..(1137): transl_table=11
ttggatgaacatcgatgtggaaatggggaaaaaatggctagtgaatatgaattaggacaagttcgattgggtgaatttcaactgtatacgaacggtgaagaattatatacgaaattatttgaggatatacgcaatgcagaaaagtacatatatatccatttttatattgtaggtaaagacgaaataagcaaagagtttttgcagttgctcgagaaaaaggcatcaggtggagtagaagtgaaattgtcagtcgatcgaataggtggatataagctgaagaaaaagataattcgtcaactaaaaagcaatggtgtccagtttacatttagtaaaaaacctaaactgaaacatatattctactcgttgcatcaacggaaccatagacgcattgttacgatagatggaaaagtatcatacgtcggcggctttaacattggaaaggaataccttggacaaaatccgaaatttggtccgtggcgtgattatcatgtacgagtcaaggggaatggtgccacggatatggaaagaaaattctctgctgactggaaagaagatactggagaaaaaatgcctgtacatgaaagtttacctgcaatagggaatgtaaagtatcaatatttattttcagaaggaaaaggtttatgggaaaaatatggagcgcttataaagcaggctaaaacgtctttaattattgctacaccatattttgtaccaagtaaagaaatgataaaagcgttaaaagatgcattaaaccgtggtgtcaatgtaaaaattctcgtaccatttaaaagtgatgcagtattgttaaaacaagctgcctatccgtatttgaaagacatgttacatgctggagcagagatttatcaatatcagaatggtttttttcatgggaaagtaacaatcattgatggggaaagtgttgatattggtaccgcaaactttgataatagaagtttttatttaaatatggaatccaattgtgttatctatgataagggagtaacagcggacgtatggagtcgattaaaagaagactttcataaatcaaaaagattttcggaagaagattttgagaaaattagtaaatgggattggtttttagcaagaatagcaaatgttatagcatcatatttatag

SEQ ID NO: 14385 - protein, 378 aa, Bacillus anthracis str. Sterne
MDEHRCGNGEKMASEYELGQVRLGEFQLYTNGEELYTKLFEDIRNAEKYIYIHFYIVGKDEISKEFLQLLEKKASGGVEVKLSVDRIGGYKLKKKIIRQLKSNGVQFTFSKKPKLKHIFYSLHQRNHRRIVTIDGKVSYVGGFNIGKEYLGQNPKFGPWRDYHVRVKGNGATDMERKFSADWKEDTGEKMPVHESLPAIGNVKYQYLFSEGKGLWEKYGALIKQAKTSLIIATPYFVPSKEMIKALKDALNRGVNVKILVPFKSDAVLLKQAAYPYLKDMLHAGAEIYQYQNGFFHGKVTIIDGESVDIGTANFDNRSFYLNMESNCVIYDKGVTADVWSRLKEDFHKSKRFSEEDFEKISKWDWFLARIANVIASYL

SEQ ID NO: 14386 - DNA, 1572 bp, Bartonella quintana str. Toulouse
  CDS (1)..(1572): transl_table=11
ttgactctgctacagattgttatcagttttatcatatttttttttattgcgtctatgttagcgatctatacatatggacgttttgttaaaaatgctcggggggagtgttcttatgcattgactgttaagaaagatgaaaccaagcttgaccgtataataagtcaattggcggaggaaacggatggattgggggttgataaagatgctctttcactcatcattagcaatttggatgcattttgtgttcgtgcgataggagcagcacaggctgggcgtagtcttgatctaatgtattatatttggaatgatgacttaacagggcgcttattattaagtgaaatagtggaggcagctgatcgtggtgttcgggtgcgccttcttttagatgatattaatgctcaggcacgtgatccagcttatattgcgctggataaacatcctcgtattgaggtgagaatgtttaatccagggcgatcacgtaagggtggtttacgccgtggtttagagattatattacgggcaattactgtaacacgcagaatgcataataaagcttttattgtggatggccgagtggcttttgtaggaggacgcaatcttgcagattcttattttgacgctggtgaagaatcacattttcgagatttagatttgatgttaattggtccatcggttaaaaaggtggaaaccatctttgatgacttttggaatagcgctgtagttttaccaattcatactttggttgttcctaaaagtacaagcgaccttggttattggaaggagaaattacgaaaatttcgtgattccaaggttgcaaaggtttatctggattatgttaaggagcatattaattttgactgttttattcaaacaggaaagcgattatttttagcagataaagttgttgttctttctgatcctccggagaaagcattgcgcaaaaaagctggaaattggcttatgaaagcactttcacaggttattggagatgcccaaaaaactgttcaaattacatcaccttattttgttcctggtaaggtcggtacgcagagttttagaaatttagtttcaaaaggtgttgatgttaaaattcttacaaattccttagcggctaccgatgtggcactcgtgcatggtggttatgtaccatatcgtaaagcgcttttgaaaagtggtgttaagctctatgagttaaagccggatggaaacatgcatgggttgcgattgtttcgatcaagtaaggccattttacatactaaagcttttttggttgatcgtaaaactgcttttattggatctttaaattttgatcctcggtcagctgcgttgaatacggaaatgggcattctttttgaatgtgcaccgattacagcgaggttagatttgcttttttctgaagaaacgaccggtgaaatgagttataatctccgtcttgataataacaaccgcatttattgggattttattgaaaacgaaaagcaatacagcattgattatgagccagaaagcaacttttggcgtcgtgcctttacaagaataataagttggttgcccattgaatcacaattgtag

SEQ ID NO: 14387 - protein, 523 aa, Bartonella quintana str. Toulouse
MTLLQIVISFIIFFFIASMLAIYTYGRFVKNARGECSYALTVKKDETKLDRIISQLAEETDGLGVDKDALSLIISNLDAFCVRAIGAAQAGRSLDLMYYIWNDDLTGRLLLSEIVEAADRGVRVRLLLDDINAQARDPAYIALDKHPRIEVRMFNPGRSRKGGLRRGLEIILRAITVTRRMHNKAFIVDGRVAFVGGRNLADSYFDAGEESHFRDLDLMLIGPSVKKVETIFDDFWNSAVVLPIHTLVVPKSTSDLGYWKEKLRKFRDSKVAKVYLDYVKEHINFDCFIQTGKRLFLADKVVVLSDPPEKALRKKAGNWLMKALSQVIGDAQKTVQITSPYFVPGKVGTQSFRNLVSKGVDVKILTNSLAATDVALVHGGYVPYRKALLKSGVKLYELKPDGNMHGLRLFRSSKAILHTKAFLVDRKTAFIGSLNFDPRSAALNTEMGILFECAPITARLDLLFSEETTGEMSYNLRLDNNNRIYWDFIENEKQYSIDYEPESNFWRRAFTRIISWLPIESQL

SEQ ID NO: 14388 - DNA, 1572 bp, Bartonella henselae str. Houston-1
  CDS (1)..(1572): transl_table=11
ttgactctgttacagattgttatcagttttatcatatttttttttattgcgtctatgttagcgatttacacttatgggcgttttgttaaaaatgctcggggggagcattcttatgcgctgactgttaagaaagatgaaaccaagcttgaccgtataataagtcaattagcggagaaaaccgatgggttaggggttgataaagatgctctttcgcttatcatcagcaacttggatgcgttttgtgttcgtgcggtaggagcagcaaaggctgggcgtagtcttgatctcatgtattatatttgggacgatgatttaacaggacgcttattattaagtgaaatagtggaggctgctgatcggggtgttcgtgtgcgccttcttttagatgatattaacgctcaggcacgtgatccagcttatatggcgctagataaacatccccatattgaagtaagaatgtttaatccagggcgatcacgtaagggtggtgtacgccgtggtttagagattatattgcgggcaattactgtaacacgcagaatgcataataaggcttttattgtggatggtcgtatggcttttgtagggggacgtaatcttgcagactcttattttgacgctggtaaagaatcacattttcgagacttagatttgatgttaataggtccttcggttaaaaaggtggaaaacatctttgatgatttttggaatagcgctgtcgttttaccgattcacactttagttgttcctaaaagtgtaaatgatcttgctttttggagggaaaaattacgacaatttcgtgattccaaagctgcaaaagtttatttagattatgtcaagaagcatattagttttgactgttttattcagacaggaaagcgattatttttagcagataaagttgttgttctttctgatcctccggaaaaagtattgcgcaaaaaagcagaaaattggctcatgaaagcactctcacaggttattgaagacgcccaaaaaacggttcagattacatcaccttattttgttcctggtaaggtaggtacgcagaattttagcaatttggtttcaaaaggtgttgatgtcaaaattcttacgaattctttagcagccactgatgtggcactcgtgcatggtggttatgtaccttatcgtaagatgttattgaaaagtggtgttaagctctatgagttaaaaccaggtggaaatatgcacgggttgcgactgtttcgatcaagtaaggctagtttacataccaaagcttttttagttgatcgtaaaactgcttttattggatctttaaactttgatcctcgatcagctgcgttgaatacagaaatgggtattctttttgaatgtgcccccattacaacgcgattagatttgctttttgctgaagaaacgacgggtgaaatgagttatcatctccgtcttaatgacaacaaccgcatttattgggattttattgaaaacgaaaaacagtatagcgttaattatgagccagaaagcaatttttggcgtcgtgcgtttgcaaaaataataagttggttaccgattgaatcacaattgtaa

SEQ ID NO: 14389 - protein, 523 aa, Bartonella henselae str. Houston-1
MTLLQIVISFIIFFFIASMLAIYTYGRFVKNARGEHSYALTVKKDETKLDRIISQLAEKTDGLGVDKDALSLIISNLDAFCVRAVGAAKAGRSLDLMYYIWDDDLTGRLLLSEIVEAADRGVRVRLLLDDINAQARDPAYMALDKHPHIEVRMFNPGRSRKGGVRRGLEIILRAITVTRRMHNKAFIVDGRMAFVGGRNLADSYFDAGKESHFRDLDLMLIGPSVKKVENIFDDFWNSAVVLPIHTLVVPKSVNDLAFWREKLRQFRDSKAAKVYLDYVKKHISFDCFIQTGKRLFLADKVVVLSDPPEKVLRKKAENWLMKALSQVIEDAQKTVQITSPYFVPGKVGTQNFSNLVSKGVDVKILTNSLAATDVALVHGGYVPYRKMLLKSGVKLYELKPGGNMHGLRLFRSSKASLHTKAFLVDRKTAFIGSLNFDPRSAALNTEMGILFECAPITTRLDLLFAEETTGEMSYHLRLNDNNRIYWDFIENEKQYSVNYEPESNFWRRAFAKIISWLPIESQL

SEQ ID NO: 14390 - DNA, 1530 bp, Bacillus thuringiensis serovar konkukian str. 97-27
  CDS (1)..(1530): transl_table=11
atgaagaaacctatcatccaattactattaatatttacaattgtatctatcgttcttttcctattaaatacatcttatatttcgttatatacatttgtcggcgttctctggtccatcacaattgtaggaatttcattcgttatttttatcgaaaatagatctcctcaaagtaccttagcctggtttttagtattagcacttcttcccgttataggtgtgcttttatactctattttcgggcgtagccgttggagaagaaaaaagcatctccatcgttcagaagagcaaagaaagttattccgtgaaatattagaaggaagacgactagagttatcactcaaagtcccattaagtgaacgctctgtccatttaacagaagtcgtacaaaaatttggaggcggccctgcagcagatagaacgactaccaaacttttaacaaacggagatcaaacattctcagaaattttgcaagcgatcgagcaagcaaaacatcacatacatattcaatactatatttataaatctgatgagattggtacaaaagttcgggatgcgttaatcaaaaaggcaaaagatggtgttattgtacgcttcctttatgatggactcggaagtaatacgttgagaagacggtttttacaacctatgaaagaagctggaattgaaattgttgaatttgatcctattttttcagcttggttacttgaaaccgtcaattatcgtaaccaccgtaaaatcgtcattgtagatggagaaatcggttttactggtggactcaacgtcggtgatgaatatcttggtcgttcaaaaaaatttcccgtttggcgtgacagtcatttaaaagtagaaggaaaagcgctatataaattacaagcaatctttctagaggattggctctatgcatctagtggattgaatacttattcttgggatccatttatgaatagacaatacttccctggtaaagaaatttcaaatgcagaaggtgctgtgcaaattgtagcgagcggaccaagctcagatgataaaagcattcgcaatacattattagctgttatgggctcggcaaaaaaatctatttggattgctacaccatactttattccagatcaagaaactttaacattactacgtttaagtgcaatatctggcatagatgtacgcattttatatcctggtaaaagtgatagtattattagtgaccaagcatctcagtcctacttcactccacttttaaaagctggtgcctccatttatagttataaagatggctttatgcatgcaaaaattgtacttgttgatgataaaatcgcaacaatcggaacagcaaatatggacgtacgcagctttgaattgaattacgaaattattagcgtactgtatgaatcagaaactgttcatgatattaaacgtgattttgaagatgactttaagcattctactgaaattaaatggaacgctttccaaaagagaagtatcaaaaaacgaatattagaatcttttatgaggctcatttctcctttactataa

SEQ ID NO: 14391 - protein, 509 aa, Bacillus thuringiensis serovar konkukian str. 97-27
MKKPIIQLLLIFTIVSIVLFLLNTSYISLYTFVGVLWSITIVGISFVIFIENRSPQSTLAWFLVLALLPVIGVLLYSIFGRSRWRRKKHLHRSEEQRKLFREILEGRRLELSLKVPLSERSVHLTEVVQKFGGGPAADRTTTKLLTNGDQTFSEILQAIEQAKHHIHIQYYIYKSDEIGTKVRDALIKKAKDGVIVRFLYDGLGSNTLRRRFLQPMKEAGIEIVEFDPIFSAWLLETVNYRNHRKIVIVDGEIGFTGGLNVGDEYLGRSKKFPVWRDSHLKVEGKALYKLQAIFLEDWLYASSGLNTYSWDPFMNRQYFPGKEISNAEGAVQIVASGPSSDDKSIRNTLLAVMGSAKKSIWIATPYFIPDQETLTLLRLSAISGIDVRILYPGKSDSIISDQASQSYFTPLLKAGASIYSYKDGFMHAKIVLVDDKIATIGTANMDVRSFELNYEIISVLYESETVHDIKRDFEDDFKHSTEIKWNAFQKRSIKKRILESFMRLISPLL

SEQ ID NO: 14392 - DNA, 1218 bp, Bacillus thuringiensis serovar konkukian str. 97-27
  CDS (1)..(1218): transl_table=11
atgaacatgattaaaaaaatattgcgagttacttctattattattgctattttcgcttttattttaatttgtatgcatattgatgttactttaggtaggaaaatggaagctgggaaaaacatgccgacagagtatgcacctcattatagtgattttcaattatatgtagaaggaaagtcattttataaacagttatttactgatataaaagaagcgaaacaatctatttacacttatttttttattttatcggatgataaaagtagtcatatttttttaaacttattaaaagaaaaggcaagagaaggagtaaacgtatatttatctgtcgatttacttaacgatttatcatttgaaagaaagatgaaaaaagaattacaggaaaatggtgtacattttacatatagtagaaaacaggaattaccattcgggttttattcacttcaccatcgtaatcatcgccgcattacaacgattgatggagagattggttatacgggtggttttaatataggggatgaatacttagggaaagataaacactttgggtactggagagactatcatgtacggataaaaggtgaaggtgcaaaagacttagaggaacaatttgctttagattggaaacgagatacgaaagaagatataaagaggagtacgaataaggctagcaaagggaatacactacatactatggttagttataatgggcatcacgtcgctgaaaaatatatagatcttataaaacaagctcagcactcaattgtaattgcaacgccgtattttatagcgaaaaataaagaatccatgaatgctttaatcgcagcacaaaagcgtggtgttacagtaaaaatactttggtcatataaaccagatctacctcttataaaagaagcggcgtatccatacatacgtcaagctattaataatgggattactgtatatgggtataaaaaaggaatgttccatggcaaattcatgcttattgataatgaattaaccgttattggcacaacaaactttacttcgcgtagcttcaatataaatgatgaaatgaatttttatattcatggtggtcctattgtagggcaagttaataaggccttaacagaggattttcgtgactcaaaagaaatgacgaaagaattttttgagaagttatctttttgggagcgttgtaaggaaaagttggcagggttgatggatttttatttgtga

SEQ ID NO: 14393 - protein, 405 aa, Bacillus thuringiensis serovar konkukian str. 97-27
MNMIKKILRVTSIIIAIFAFILICMHIDVTLGRKMEAGKNMPTEYAPHYSDFQLYVEGKSFYKQLFTDIKEAKQSIYTYFFILSDDKSSHIFLNLLKEKAREGVNVYLSVDLLNDLSFERKMKKELQENGVHFTYSRKQELPFGFYSLHHRNHRRITTIDGEIGYTGGFNIGDEYLGKDKHFGYWRDYHVRIKGEGAKDLEEQFALDWKRDTKEDIKRSTNKASKGNTLHTMVSYNGHHVAEKYIDLIKQAQHSIVIATPYFIAKNKESMNALIAAQKRGVTVKILWSYKPDLPLIKEAAYPYIRQAINNGITVYGYKKGMFHGKFMLIDNELTVIGTTNFTSRSFNINDEMNFYIHGGPIVGQVNKALTEDFRDSKEMTKEFFEKLSFWERCKEKLAGLMDFYL

SEQ ID NO: 14394 - DNA, 1134 bp, Bacillus thuringiensis serovar konkukian str. 97-27
  CDS (1)..(1134): transl_table=11
atgaacatcgatgtggaaatggggaaaaaaatggctagtgaatatgaattaggacaagttcgattgggtgaatttcaactgtatacgaacggtgaagaattatatacgaaattatttgaggatatacgcaatgcagaaaagtacatatatatccatttttatattgtaggtaaagacgaaataagcaaagagtttttgcagttgctcgagaaaaaggcatctagcggagtagaagtgaaattgtcagtcgatcgaataggtggatataagctgaagaaaaagataattcgtcaactaaaaagcaatggtgtccagtttacatttagtaaaaaacctaaactgaaacatatattctactcgttgcatcaacggaaccatagacgcattgttacgatagatggaaaagtatcatacgtcggcggctttaacattggaaaggaataccttggacaaaatccgaaatttggtccgtggcgtgattatcatgtacgagtcaaggggaatggtgccacggatatggaaagaaaattctctgctgactggaaagaagatacgggagaaaaaatgcctgtacatgaaagtttacctgcaatagggaatgtaaagtatcaatatttattttcagatggaaaaggtttatgggaaaaatatggagcgcttataaagcaggctaaaacgtctttaattattgctacaccgtattttgtaccaagtaaagaaatgataaaagcgttaaaagatgcattaaaccgcggtgtcaatgtgaaaattctcgtaccatttaaaagtgatgcagtattgttaaaacaagctgcctatccgtatttgaaagacatgttacatgctggagcagagatttatcaatatcagaatggtttttttcatggaaaagtaacaatcattgatggggaaattgttgatattggtaccgcaaactttgataatagaagtttttatttaaatatggaatccaattgtattatctatgataagggagtaacagcggacgtatggagtcgattaaaagaagactttcataaatcaaaaagattttcggaagaagattttgagaaaattagtaaatgggattggtttttagcaagaatagcaaatgttatagcatcatatttatag

SEQ ID NO: 14395 - protein, 377 aa, Bacillus thuringiensis serovar konkukian str. 97-27
MNIDVEMGKKMASEYELGQVRLGEFQLYTNGEELYTKLFEDIRNAEKYIYIHFYIVGKDEISKEFLQLLEKKASSGVEVKLSVDRIGGYKLKKKIIRQLKSNGVQFTFSKKPKLKHIFYSLHQRNHRRIVTIDGKVSYVGGFNIGKEYLGQNPKFGPWRDYHVRVKGNGATDMERKFSADWKEDTGEKMPVHESLPAIGNVKYQYLFSDGKGLWEKYGALIKQAKTSLIIATPYFVPSKEMIKALKDALNRGVNVKILVPFKSDAVLLKQAAYPYLKDMLHAGAEIYQYQNGFFHGKVTIIDGEIVDIGTANFDNRSFYLNMESNCIIYDKGVTADVWSRLKEDFHKSKRFSEEDFEKISKWDWFLARIANVIASYL

SEQ ID NO: 14396 - DNA, 1482 bp, Staphylococcus aureus subsp. aureus MSSA476
  CDS (1)..(1482): transl_table=11
atgcgatatacattttcaaatgatttaggaacactttttaccattattttagccattggattcatcattaatttagtattggcttttattattatctttttagaaagaaatagacgtacagcgagttcaacttgggcatggctatttgtactttttgtcttaccattgattggttttattctttacttgttttttggtagaaccgtttcggcacgtaaattgaataaaaacaatggtaaggtgttaacggatttcgatggacttttaaaacaacaaatagaaagctttgataaaggtaattatggtactgataacaaacaagttcaaaaacatcatgatttagtacgtatgcttttgatggatcaagatggttttttaactgaaaataataaagttgatcatttcattgatggaaatgatttatatgatcaagttttacaagatattaaaaatgctaaagaatacatccatttagagtattatacattcgctctagatggcttgggccaaagaattttaaaagcgttagaagagaaattgaaacaaggtctagaagtgaaaattttatatgatgacgttggttcaaagaaagttaagatggctaattttgatcattttaaatcgttaggtggagaagttgaagcattttttgcttctaaattaccgttattgaatttcagaatgaataacagaaatcatagaaaaatcatcgtaatcgatggtcaactaggttatgtcggaggatttaacattggtgatgaatatctaggattaggtaaactagggtattggagagatacgcatttacgtatacaaggggatgcggttgatgcactgcagttgcgatttattttagactggaattcgcaagcgcaccgtccacagtttgaatatgatgttaagtatttccctaaaaagaacggaccattgggcaattcaccaattcaaatagctgcaagtggtccggctagtgactggcatcaaattgaatatggttatacaaaaatgattatgagcgctaagaagtcggtatatttgcaatcgccttatttcattccggataactcatatataaatgccattaaaattgcagctaaatcaggggtagatgttcatctaatgattccatgtaagccagatcatcctttagtttattgggcgacatattcaaatgcttcagatttactatctagtggcgtaaaaatttacacgtatgaaaatggatttatacattctaaaatgtgtttaatagatgatgaaatggtttcagtcggaactgctaatatggactttagaagttttgaattgaatttcgaagtcaatgcttttgtatatgatgaaaagcttgctaaagatttaagggtggcttatgaacatgatattacaaaatcaaaacaactaaccaaagaatcatatgccaatagaccgctgtctgttaagtttaaagaatcgttagctaaattagtttcgccaattttataa

SEQ ID NO: 14397 - protein, 493 aa, Staphylococcus aureus subsp. aureus MSSA476
MRYTFSNDLGTLFTIILAIGFIINLVLAFIIIFLERNRRTASSTWAWLFVLFVLPLIGFILYLFFGRTVSARKLNKNNGKVLTDFDGLLKQQIESFDKGNYGTDNKQVQKHHDLVRMLLMDQDGFLTENNKVDHFIDGNDLYDQVLQDIKNAKEYIHLEYYTFALDGLGQRILKALEEKLKQGLEVKILYDDVGSKKVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATYSNASDLLSSGVKIYTYENGFIHSKMCLIDDEMVSVGTANMDFRSFELNFEVNAFVYDEKLAKDLRVAYEHDITKSKQLTKESYANRPLSVKFKESLAKLVSPIL

SEQ ID NO: 14398 - DNA, 1563 bp, Acinetobacter sp. ADP1
  CDS (1)..(1563): transl_table=11
atgaacttaaaaaataatttatctcatacattaaaaatatattttagctttatcgtcttttgtctcatatgttggacacctttaaaaacttttgcatctcagggtgagaaaattttgataaatagccaatggttaaatgatccacacactgacgaaaatcttcaaaagggtttgactgcctacattcctcttgatgatgcatttattagtattgcttctcgtatttatctgattaggcatgcaaaacatcaaattgatttacaatactatatttggcataacgatttcgttggtcagttaatattaaacgaattattgaaagcagctgatcgtggcgtcaaaattcgcctattaattgacgatcagaacggaacgcgactcgattctaccttccaagcactgttacaacatcctctttttgaaattaaggtatttaacccttataaatttcgtaagcttagatttgtagattttttatttcgtcccaatcaaatcaatcaccgcatgcataacaaattgattattgcggacaacacaattgcggtgactggaggacgcaatatcagcagtgaatactttgatgccagctatcaattccagtttacagatctcgatattttgttttatggtacagccgcatctcaggcagagaaagtctttcaaactttctgggatagtccactcagtgtcactacacaaaaactcatcacgaaaggtcagccaaatgatctacttcaattgcgatctaaatataaggaaatcgaacgtgttgatacgcctacggaagataaaatcaatgaagctcaaattgaactgaatgaagctttaaaacaacgttattcggtaaaatgggctaaggcgcattttgtggcagattctcctaaaaaaatacacgggcatgctataggcaatgaacttatctataatcagatgtttagtattatgggacatccccaaaaacatctggaacttgtatcagcttactttgttcccactcaggctggtacacaatacttaagcaatttaagccaacaagacgttaagataagggttttaaccaattcttttgctgcaaatgatgtcgctattgtgcatgccttttatagtcaatatcgaaaagagcttatcaagaacggcattcaactctacgaattcaaacctatcattgatcgaaaagaacctacttggtatgaaaaaatgacaggtcgtgtgattcctgccaaaggtaagaaaagctcgagcctgcatgcaaagttttttgatgtagatggaaaagtctttattggttcttttaatttcgatccacgttctgcatatctgaataccgaagtgggattggtggttgaatctgaagatcttcaaaacgaaattaccaaagttcttgatgaatacttgcctacgattgcataccaattaaaactcgacaaaaatggcaatctcgtatggttagatcacaatgcagatggccaaaccatcgaatatcatcatgatccagaaaccaccagatttcagcgttttatgatgaaagctgtgtcatatttacccattgaatggatgatgtag

SEQ ID NO: 14399 - protein, 520 aa, Acinetobacter sp. ADP1
MNLKNNLSHTLKIYFSFIVFCLICWTPLKTFASQGEKILINSQWLNDPHTDENLQKGLTAYIPLDDAFISIASRIYLIRHAKHQIDLQYYIWHNDFVGQLILNELLKAADRGVKIRLLIDDQNGTRLDSTFQALLQHPLFEIKVFNPYKFRKLRFVDFLFRPNQINHRMHNKLIIADNTIAVTGGRNISSEYFDASYQFQFTDLDILFYGTAASQAEKVFQTFWDSPLSVTTQKLITKGQPNDLLQLRSKYKEIERVDTPTEDKINEAQIELNEALKQRYSVKWAKAHFVADSPKKIHGHAIGNELIYNQMFSIMGHPQKHLELVSAYFVPTQAGTQYLSNLSQQDVKIRVLTNSFAANDVAIVHAFYSQYRKELIKNGIQLYEFKPIIDRKEPTWYEKMTGRVIPAKGKKSSSLHAKFFDVDGKVFIGSFNFDPRSAYLNTEVGLVVESEDLQNEITKVLDEYLPTIAYQLKLDKNGNLVWLDHNADGQTIEYHHDPETTRFQRFMMKAVSYLPIEWMM

SEQ ID NO: 14400 - DNA, 1560 bp, Acinetobacter sp. ADP1
  CDS (1)..(1560): transl_table=11
atgctgacattgagtctagtcaccgtggtgggaatcaatggatgcagtacccttccaaaacatggtccagaagtaactcaatatgcgtatgatattgatacatcacagacctcactcgcacaaatcattacgccattaaaacaacaaaatctaggcttaactggataccatatgctgtatgaaccccttgaagcgctggctgctcgcctcagattaatcgataaggcagaaaaaaccctcgatctacaatattacatctgggataacgataaaattggcgcgttagcattacatgccctgatccgtgccgcagatcgtggggtaaaagtccgtctcttgatcgatgacaacaacgccaaacagatcgaaggtgtcttactcgccttgtcccagcatcagaatattgaagtcaaactgtttaatccttatcgcttccgtaaataccgtgcaatggacatgattctggatttaaaacgtatcaatcggcgtatgcataacaaaagctttattgcagacaatcaggttgcgctcattggcgggcgcaacatgaccaatcagtactacaatgttagtgataattatcagttttcagacgttgatgttttactggttggggctgctgtcgatgatatcgtcaaatcatttgatgactactggaacgatgaatatgcctattcggttcaaaacatcgtcaaccccgaacagcatcgcttacgttatcaaagtctaaagcaacagcttgatgattattatcaggaagtgaccgtacaaaattatctggatctgaccacacgctcacatgcttttgatcaatggctcaataacaatatccagcttgattgggtcaaagcgacagtggtcaaagacgctcccgataaaattcgtgccaaagccaacaaagaacaacatctcaattttcagctcatcaaacatcttgaaaagccagaagataacgtcgatctcatctctgcctattttgttccagaaaaacagggggccaaacatttgagtgatatggcacaggatggcattaaagtacgtgttctgaccaactcctttaaagccaacgatgtccctgtggtccatgcgttttatgccaaatatcgtcaggaacttctggaaaatggcgtgcaactttatgagtttttacccacacttgaaaaagaagaactggacaaatataccgatgaactggttaaaaaagccaaggtcagtattaaagggcttagccgctctagtttacatgccaagatgatggcattagatcagaaacaagtgtttattggatcctttaactttgacccacgttcggcctatctcaataccgaaataggcgtcatcctgaatagtccaccattagcgatggccgtacatcagacgatggatcaacaactgacccactatgcttataaattggtactagatgccaatcacaaaattaattggtatcggcagacatccactggtaccaaaatctataccaaagaaccccgcatgaaatggtggcaaaaagctggaattaagttgatttcatggctgcctattgaaggtttcatgtaa

SEQ ID NO: 14401 - protein, 519 aa, Acinetobacter sp. ADP1
MLTLSLVTVVGINGCSTLPKHGPEVTQYAYDIDTSQTSLAQIITPLKQQNLGLTGYHMLYEPLEALAARLRLIDKAEKTLDLQYYIWDNDKIGALALHALIRAADRGVKVRLLIDDNNAKQIEGVLLALSQHQNIEVKLFNPYRFRKYRAMDMILDLKRINRRMHNKSFIADNQVALIGGRNMTNQYYNVSDNYQFSDVDVLLVGAAVDDIVKSFDDYWNDEYAYSVQNIVNPEQHRLRYQSLKQQLDDYYQEVTVQNYLDLTTRSHAFDQWLNNNIQLDWVKATVVKDAPDKIRAKANKEQHLNFQLIKHLEKPEDNVDLISAYFVPEKQGAKHLSDMAQDGIKVRVLTNSFKANDVPVVHAFYAKYRQELLENGVQLYEFLPTLEKEELDKYTDELVKKAKVSIKGLSRSSLHAKMMALDQKQVFIGSFNFDPRSAYLNTEIGVILNSPPLAMAVHQTMDQQLTHYAYKLVLDANHKINWYRQTSTGTKIYTKEPRMKWWQKAGIKLISWLPIEGFM

SEQ ID NO: 14402 - DNA, 1461 bp, Erwinia carotovora subsp. atroseptica SCRI1043
  CDS (1)..(1461)
atgtcgacattttataccgtaataagttggttactggtttttagctactggttgctgatcgcaggtgtgaccttgcgtattctgatgaaacgtcgggcagtgccttcagcgatggcctggctactggtgatttatattctgccacttgtcggtattgtcgcttatctttcatttggcgaactccatctcggtaaacgtcgggctgaacgcgcgagcaaaatgtggccatcaacggcaaaatggctgcgcgaattaaaggaatatcgccgtattttcgcgacggaaaacagtgaagtcgccagcgcactatttcagctctgtgaacgccgacaaggggttggcggcgtcaaaggcaaccagttgcaattgatgaccacatttgatgacaccattaaggcgttattacgtgatattgaactcgcgcgtaataacatcgaaatggtgttctatatctggcaacccggtggtctggtcgagcaagtcacgtcttcccttatctcggccgcacgacgcggcgtacattgccgcatcctgctggactcggccggcagcgttcaatttttccgccaacatcatcccgaactgatgcgcaccgctggaatagaagtggtcgaagcgctgaaagtgaatctgttccgtgctttcctgcgccgcatggatttacgacagcaccgtaaaattattctgatcgacagccgcattgcttataccggcagcatgaatatggtcgatccacgtctcttcaagcaggatgctggcgttgggcaatggattgacctcatggcgcgtattgaaggcccggtagcgactaccctgggcatcatttactgctgtgactgggagatggaaacgggcaaacgcctgctcccgccgccgcctgatgttaacgtcatgccgttcgaacaggagagcggccacaccattcaggttatagcttccggccctggttacccggaagaaatgattcatcaggcgctgctgacgtccgtctattcggcgcgtaagcaattgatcatgacgaccccctacttcgtgcccagcgacgatctgctgcatgccatctgcaccgccgcccagcgcggggtcgatgtcagcattattgttccgcacaagaacgactccgtactggtcggctgggccagccgtgcgttcttcacggaactgctggccgcaggcgtaaaaatttaccaattcaaagacggactgctgcacaccaaaagtgtgctggtcgacggacagctcagcttggtcggcacggtgaatctcgatatgcgcagcctgtggctgaattttgaaattacgctggtgattgacgatgctggattcggcagcgacttagcctgcgtgcaggaagactatatcgcccgctcacgcctgttaaacgcgacgcagtggcaaaaccgtccttattggcaacgcattgtcgagcggctgttctactttttcagccccctgctatga

SEQ ID NO: 14403 - protein, 486 aa, Erwinia carotovora subsp. atroseptica SCRI1043
MSTFYTVISWLLVFSYWLLIAGVTLRILMKRRAVPSAMAWLLVIYILPLVGIVAYLSFGELHLGKRRAERASKMWPSTAKWLRELKEYRRIFATENSEVASALFQLCERRQGVGGVKGNQLQLMTTFDDTIKALLRDIELARNNIEMVFYIWQPGGLVEQVTSSLISAARRGVHCRILLDSAGSVQFFRQHHPELMRTAGIEVVEALKVNLFRAFLRRMDLRQHRKIILIDSRIAYTGSMNMVDPRLFKQDAGVGQWIDLMARIEGPVATTLGIIYCCDWEMETGKRLLPPPPDVNVMPFEQESGHTIQVIASGPGYPEEMIHQALLTSVYSARKQLIMTTPYFVPSDDLLHAICTAAQRGVDVSIIVPHKNDSVLVGWASRAFFTELLAAGVKIYQFKDGLLHTKSVLVDGQLSLVGTVNLDMRSLWLNFEITLVIDDAGFGSDLACVQEDYIARSRLLNATQWQNRPYWQRIVERLFYFFSPLL

SEQ ID NO: 14404 - DNA, 1269 bp, Propionibacterium acnes KPA171202
  CDS (1)..(1269): transl_table=11
gtgcacatgacccgggcccctcgccaaagattcactgttcgccgcgcactgcactgggtggcaggcgggatggttgccgcccagatggctacgatggccggactggtcacctacaacggcattaagcgacgaggccgtcgcccataccgtttccccactgcgccggcagagcccctcaaggtgtctggtcatcaggttgagatcttcactttcggacgcgatctttacgcggcgatgatcttcgacattaaatcagctcaacacaccgtttaccttgagaccttcatctggaaaaacgacgaagtcgggcgtcattttcggcaggcactcgtagaagccgccgcacgcggggtcaaggtctatgcgatgtgggacaccttcgccaacctcgttgtggacccacgattctttcggcagctcgaaggggtgcaggtgcgagcccaacctctcgtaaccccctcatggataccgacgctacgcaatctggggcgagaccaccgcaagctcctcatcgtcgattccaaggtcgcctacatcggtgggtacaacatcggctccctctacgccgaccgctggcgtgacacccacgctcgtattaccgggcctgccgtcggggagctcgaaaacgtctttgttgacatgtggaatcaacgccccaagggggccctcatctcccggcgcaaccagcccgtactaccttctcccggcgtccgctattgggatacgcctttcgctgtacaccgcaactccccccggatggcggtctatcccatccggaacatgtacctggaggccatcgaccgcgcgagtgagcgaatctggatgacccagggctacctcatccccgatgacgacgttgtcgcagccctccaccaagccgcatctcgcggggttgacgttaggatcgtcattccggctgaatcgaaccatgtcatcgccgactggctgagccggggctactacgaccgcctcctccaccagggtgtgcgactgttcctttaccagggagctatggtccacgcgaagacctgcactattgacggcatttggtccacgattggtacagcgaacctcgaccggttatccctccaaggtaactatgaggtaaacgtcgctatcactgactccaccgtcgcccaacgaatggctgagattttcgagatcgacatggccaactgtgtggaactgaccttagacgaatggcagtcgcgctctcacatagcgaaactcactgaagctctactgtcaccttggcgaccatttttctag

SEQ ID NO: 14405 - protein, 422 aa, Propionibacterium acnes KPA171202
MHMTRAPRQRFTVRRALHWVAGGMVAAQMATMAGLVTYNGIKRRGRRPYRFPTAPAEPLKVSGHQVEIFTFGRDLYAAMIFDIKSAQHTVYLETFIWKNDEVGRHFRQALVEAAARGVKVYAMWDTFANLVVDPRFFRQLEGVQVRAQPLVTPSWIPTLRNLGRDHRKLLIVDSKVAYIGGYNIGSLYADRWRDTHARITGPAVGELENVFVDMWNQRPKGALISRRNQPVLPSPGVRYWDTPFAVHRNSPRMAVYPIRNMYLEAIDRASERIWMTQGYLIPDDDVVAALHQAASRGVDVRIVIPAESNHVIADWLSRGYYDRLLHQGVRLFLYQGAMVHAKTCTIDGIWSTIGTANLDRLSLQGNYEVNVAITDSTVAQRMAEIFEIDMANCVELTLDEWQSRSHIAKLTEALLSPWRPFF

SEQ ID NO: 14406 - DNA, 1464 bp, Leifsonia xyli subsp. xyli str. CTCB07
  CDS (1)..(1464): transl_table=11
atgggcgacggggtcttggccacggtcatcgtggtcttcctgctcctgttcgactttgtgatccgtgttgtcgcgatcatcgtggtcccccggaatcgcaagcccacctcggcgaccgcctggctgctggccattttcctcatcccgtacatcggagtgctgttcttcctgctgatcggcagctacaagctcccgaaggcgcgccgggagaagcagaaggagatcaactccttcatcatcgacagcaccgagggcatggagcgtgtgcggcgtgaccacccctggccgccgtggctccagtcggtcgtcgaactgaaccgcaatctcggggcgatgcccctggtgggcggcaaccgggcctcgctcaatggcgactatgtgggctcgctcgcggcgatgacggaggagatcgcggccgcgcgccgctacgtccacgtcgaattctacatcctgaccctcgacaagacgacagcgccgttcttcgacgcgctggaacgtgcggtgcagcggggggtgaccgtgcgggtgctgctcgaccacatcgcgtcgctccggacgcccggctacaccgccacgatccgccggctcaccgagatgggcgtgaagtggcatctcatgcttccggtgcagccgttccggggaaagtatcagcggcccgacctccgcaaccaccggaagctgctcgtggtcgacgggcgggtcgccttcgtgggctcgcagaacgtcatcgaccgcagttacaacaagcgctccaacatcaagcgcggtctcaagtggaaagagctgatcgtccggctcgagggtccgatcgtcgccggtctgaacgcgatcttcatcacggactggtacagcgagaccgacgaactcctgcggcgggagacggagccgatcgcggtcgaactcgacgcggacgaactcgacgcgcaggtcgtgccttcgggtcccggattcgccggcgagaacaatctccgactgttcctggcgctgctctactacgcgcaggagcgcatcgtcatcacatcgccgtacttcgtccccgacgagtccatgctcaccgcgatcaccactgcgacgcagcggggtatcgcggtcgatctgttcgtctcggagatcggggaccaggcgctcgtctaccacgcccagcggtcttactacgaagccttgctgcgcgccggagtgaggatctggatgtacaaggcgccgtacatcctgcatgccaagcacttcacgatcgacgatgaggtcgcggtgatcgggtcgagcaacatggacatgcgctccttccagctgaacatggaggtctctctgatggtcaggggccgtccgttcgtgcagcagatgcgggctatcgaggacggctaccggcgggacagccgcgagctgacgctggatgagtggatgcggcagccgctgcgttcgaccgtgctggacaacctcgcgcgattgacttccgcgctgcaataa

SEQ ID NO: 14407 - protein, 487 aa, Leifsonia xyli subsp. xyli str. CTCB07
MGDGVLATVIVVFLLLFDFVIRVVAIIVVPRNRKPTSATAWLLAIFLIPYIGVLFFLLIGSYKLPKARREKQKEINSFIIDSTEGMERVRRDHPWPPWLQSVVELNRNLGAMPLVGGNRASLNGDYVGSLAAMTEEIAAARRYVHVEFYILTLDKTTAPFFDALERAVQRGVTVRVLLDHIASLRTPGYTATIRRLTEMGVKWHLMLPVQPFRGKYQRPDLRNHRKLLVVDGRVAFVGSQNVIDRSYNKRSNIKRGLKWKELIVRLEGPIVAGLNAIFITDWYSETDELLRRETEPIAVELDADELDAQVVPSGPGFAGENNLRLFLALLYYAQERIVITSPYFVPDESMLTAITTATQRGIAVDLFVSEIGDQALVYHAQRSYYEALLRAGVRIWMYKAPYILHAKHFTIDDEVAVIGSSNMDMRSFQLNMEVSLMVRGRPFVQQMRAIEDGYRRDSRELTLDEWMRQPLRSTVLDNLARLTSALQ

SEQ ID NO: 14408 - DNA, 1533 bp, Desulfotalea psychrophila LSv54
  CDS (1)..(1533): transl_table=11
atgcaaatacaagcgctgcactggacctccccactgatctcaacagtttttttcaccgcagatctcatcctgcgcattggtctctccctacgggtaatcatgtgtaaaaaaaactatggggtttcatacgcatggttggtcgttgtccttcttgtcccctttctcggcggcctgctctacctctgcttcggagaaaatcgactctccgaacggcgaatcaaaagaatactcaaggcaaaaaaatactactataagtggttgcaacaactagccgaaggcccgcaggtagactggtctgcgctcaaccctgagtttgcccccatccaactgcacacccaaaacctcgttggcatccccgccatggctggcaataacatcagcctgctccacagtcaggacaatatactggacagtattatcaaagacatagaggcatcacagtccacatgtcatctccaattttatatttgggaagctggcggccgtattaaagagataagcgaggccctgatcagagctaggaaaagaggggtcatctgccgaatactactggacgccattggcagcagaggttttttcagctccgcctcggccagacgaatggagcaggcaggaatcaaaattcaagcatcccttcccgctggcatatacagggctatttttgctcgaatggatatccgtaaccatcgaaaaattatcgtcattgatggcaaaatcgcctatacgggaagccaaaatatggttgacgcaatcttcttcaaacaagagagcggcgtaggtcactgggttgacatagtcgcacgtattcgtggccctgtggtagagacccttgccgcgacctttgccagcgactggtacctggaggcagagcaggatacatttcagcagatagacgacgtacaggagttgcgccatattggcgacatatacccacaaactgcccaaggaacaagcgccgtccaactggtaccatccggtcccggttttactcaggatgccatccacagcttactcctcaccgtcatctattccgctcgcaaagagcttattatgacaacaccatacttcatccccgatgagtctctgctcactgctctaaaagctgctgccctgcgtggggtccgggttattttaataattccccagagcaatgattcaaaactcgtcaaatatgccagccgggcaaagtacgatgacctcacctacgccggagtggaaataatgctctttaatggcggactcctccactcaaagaccatcaccgttgacggtgatctggccctctttggctcggtaaaccttgatatgcgaagtttttggcttaacttcgaggtaacactggtgatctattgcagagagacaacccaggacattcgacgggcacagatggcatacctacgacaatcagcccctcttgacctccgccattttcaccgtcgtcacttctttgagaaactcaaagaaaactgtgcactactggtttcacccactactataacgcaccccaacaactgttcagcgcaacagttatag

SEQ ID NO: 14409 - protein, 510 aa, Desulfotalea psychrophila LSv54
MQIQALHWTSPLISTVFFTADLILRIGLSLRVIMCKKNYGVSYAWLVVVLLVPFLGGLLYLCFGENRLSERRIKRILKAKKYYYKWLQQLAEGPQVDWSALNPEFAPIQLHTQNLVGIPAMAGNNISLLHSQDNILDSIIKDIEASQSTCHLQFYIWEAGGRIKEISEALIRARKRGVICRILLDAIGSRGFFSSASARRMEQAGIKIQASLPAGIYRAIFARMDIRNHRKIIVIDGKIAYTGSQNMVDAIFFKQESGVGHWVDIVARIRGPVVETLAATFASDWYLEAEQDTFQQIDDVQELRHIGDIYPQTAQGTSAVQLVPSGPGFTQDAIHSLLLTVIYSARKELIMTTPYFIPDESLLTALKAAALRGVRVILIIPQSNDSKLVKYASRAKYDDLTYAGVEIMLFNGGLLHSKTITVDGDLALFGSVNLDMRSFWLNFEVTLVIYCRETTQDIRRAQMAYLRQSAPLDLRHFHRRHFFEKLKENCALLVSPTTITHPNNCSAQQL

SEQ ID NO: 14410 - DNA, 1461 bp, Yersinia pseudotuberculosis IP 32953
  CDS (1)..(1461): transl_table=11
atgacgacattttataccgtaatcagttggctttccgtttttggctactggttactcattgccggggtaacattgcgtattctgatgaaacgcagggccgttccttctgctatggcttggttactgattatctacattctgccattggtggggataattgcttacctttcattcggtgaattgcatttgggtaagcggcgtgctgaacgagctaaagccatgtggccatcgaccgctcgctggctgagtgaactcaaggaatgccaacatatctttgctaactctaatagcgaagttgccaccccactgtttcaattatgcgaacggcgtcaaggaataaacggtgttaaaggaaatcaactacaactattaacaacaaccgatgacacactaaaagcgctagtacgagatattgaactcgcccgccacaatatagaaatggtgttttatatttggcaacctggtggtctggtcgatcaggtggctgaatcgttgatggctgcggctcgacgcggcgttcattgccggctgttactcgattcagcgggtagcaagcaatttttccgcagcccttatcccgcaatgatgcgtaatgcaggtattgaggtggttgaggcacttaaagttaatgtatttcgtatgttcttgcgccgaatggatctgcgccaacatcggaaaattgtgttaatcgacaactatgttgcttataccggcagtatgaacatggtagatccccggttcttcaaacaagatgccggggttggtcagtggattgatatgatggcgcgcatggaaggcccggtagccacaaccctaggtattgtttatgcctgtgactgggaaattgaaacaggcaaacgtattttacccccgccccccgacgcgaatattatgccattcgaagaagagactggtcatacgattcaagtcatcgcttctggccctggtttcccagaagaaatgatccaccaggcattattaacagctgtgtatgccgcacgtgaacagttaattatgactacgccatattttgtccccagtgatgacttattacatgccatctgtaccgcggcacaacgcggggttgatgtcagtattattgtcccgcgtgagaatgattcgatgatggttcgctgggccagccgagcattcttcaccgaattgctgaatgcaggcgttaaaatttatcagtttgaaggcggcctattacacagtaaaagtgttctggtcgatggacagctaagtttagtcggcactgttaatctggatatgcgcagtttgtggctgaattttgaaatcacactggtgattgatgatgatggctttggggctgatttagcacaagttcaggatgattatatcgcccgctctgccttattggatggtgaacggtggaacaagcgccctctttggcacagagtaactgagcgtttattctattttttcagcccattactgtaa

SEQ ID NO: 14411 - protein, 486 aa, Yersinia pseudotuberculosis IP 32953
MTTFYTVISWLSVFGYWLLIAGVTLRILMKRRAVPSAMAWLLIIYILPLVGIIAYLSFGELHLGKRRAERAKAMWPSTARWLSELKECQHIFANSNSEVATPLFQLCERRQGINGVKGNQLQLLTTTDDTLKALVRDIELARHNIEMVFYIWQPGGLVDQVAESLMAAARRGVHCRLLLDSAGSKQFFRSPYPAMMRNAGIEVVEALKVNVFRMFLRRMDLRQHRKIVLIDNYVAYTGSMNMVDPRFFKQDAGVGQWIDMMARMEGPVATTLGIVYACDWEIETGKRILPPPPDANIMPFEEETGHTIQVIASGPGFPEEMIHQALLTAVYAAREQLIMTTPYFVPSDDLLHAICTAAQRGVDVSIIVPRENDSMMVRWASRAFFTELLNAGVKIYQFEGGLLHSKSVLVDGQLSLVGTVNLDMRSLWLNFEITLVIDDDGFGADLAQVQDDYIARSALLDGERWNKRPLWHRVTERLFYFFSPLL

SEQ ID NO: 14412 - DNA, 1545 bp, Bacillus cereus E33L
  CDS (1)..(1545): transl_table=11
atgaaaaatacgttaaagttgattttctttgttttactattgttcgcattatttgtttcattacgtatgtttattgatgtggcattttattcggatgtaattgggataaaagatgtttcaattttaggtattattagtattttatttacggtatctgcatttttaattggctgtgttattttcttagagaaccgtcatccgtcaaaaacacttacatggctcattgtattaggtatttttcccgtatttggattcttcgcttatttattattcggacaaaacttccggaggaagagaatgttccaaaagaaggcgttgctcgatgaacaagcgtttttacaatataagggacatgaagattacgaagaacggattttgcgcaatcataagcatcaagagctattatttcgtttagcggatcgcttaggcgctttaaatatttcatttcaaactgaaacgagaacattaacaaatggagatgaaacgtttcaggccattttagatggattaaaacgagcgaaacatcacattcatatggaatattacattgtgcgtgatgataagcttggaacagaaattaaagatattttaatacaaaaatcaaaagagggcgtagttgttcgttttttatatgatgcggttggaagttttaaattatcaaaatcgtatattgaagaattaaacgatgcaggtgtcgaagtaattccgttcttccctgtgcgctttccaattttaaacgataagattaattatcgaaaccaccgaaaaatcgttattattgatggaaatgaagggtttgtaggtggattaaatattggcgatgaatatttagggaaggataagtacttcggcttttggcgagacacacatttatatttgcgtggtgaagctgtacaaagtttgcaacttattttccttcaagattggttttatatgactggtgaggctgtgctagcccctgaatatttacaagcgaaagcagttgagggagagcattggggaggcgtgcagctcgttgcaggtgggccggataataaatgggaaacaatcaaacatttatattttgctatgattgcttctgcgcggaaatccatttggattgcaacgccgtatttcattccggatgatgatattttatctgcattaaaggtagctgcgcttgctggtatcgatgttcgtttgttaatgccgagtaagcctgataagcgcactgtcttttacgcatcgagatcgtatttcccagagcttttagatgcaggggtaaagatatatgaatacgagaaaggttttctccatagtaaagttgtcattgtcgattctgatttagcttcaattgggacagcgaatatggatatgagaagttttcatttgaactttgaagtaaatgcctttttatatgatacagatagcattcgaaaacttgttcaagattttaaagacgatttagaagaatcaagtgaaattcatgtcgatcgttttcataaaaggcgtcttcatagacgaattgttgaatcaacgtaccgattattatcacctttattataa

SEQ ID NO: 14413 - protein, 514 aa, Bacillus cereus E33L
MKNTLKLIFFVLLLFALFVSLRMFIDVAFYSDVIGIKDVSILGIISILFTVSAFLIGCVIFLENRHPSKTLTWLIVLGIFPVFGFFAYLLFGQNFRRKRMFQKKALLDEQAFLQYKGHEDYEERILRNHKHQELLFRLADRLGALNISFQTETRTLTNGDETFQAILDGLKRAKHHIHMEYYIVRDDKLGTEIKDILIQKSKEGVVVRFLYDAVGSFKLSKSYIEELNDAGVEVIPFFPVRFPILNDKINYRNHRKIVIIDGNEGFVGGLNIGDEYLGKDKYFGFWRDTHLYLRGEAVQSLQLIFLQDWFYMTGEAVLAPEYLQAKAVEGEHWGGVQLVAGGPDNKWETIKHLYFAMIASARKSIWIATPYFIPDDDILSALKVAALAGIDVRLLMPSKPDKRTVFYASRSYFPELLDAGVKIYEYEKGFLHSKVVIVDSDLASIGTANMDMRSFHLNFEVNAFLYDTDSIRKLVQDFKDDLEESSEIHVDRFHKRRLHRRIVESTYRLLSPLL

SEQ ID NO: 14414 - DNA, 1212 bp, Bacillus cereus E33L
  CDS (1)..(1212): transl_table=11
atgattaaaaaaatattgggagttacttctattattattgctatcttcgcttttattttaatttgtatgcatattgatgttactttaggtaggaaaatggaagctgggaaaaacatgccgacagagtatgcacctcattatagtgattttcaattatatgtagaaggaaagtcattttataaacagttatttactgatataaaagaagcgaaacaatctatttacacttatttttttattttatcggatgataaaagtagtcatacttttttaaacttattaaaagaaaaggcaaaagaaggagtaaacgtatatttatctgtcgatttacttaacgatttatcatttgaaagaaagatgaaaaaagaattacaggaaaatggtgtacattttacatatagtagaaaacaggaattaccattcgggttttattcacttcaccatcgtaatcatcgccgcattacaacgattgatggagagattggttatacgggtggttttaatataggggatgaatacttagggaaagataaacactttgggtactggagagactatcatgtacggataaaaggtgaaggtgcaaaagacttagaggaacaatttgctttagattggaaacgagatacgaaagaagatataaagaggagtacgaataaggctagcaaagggaatacactacatactatggttagttataatgggcatcaagtggctgaaaaatatatagatcttataaaacaagctcagcactcaattgtaattgcaacgccgtattttatagcgaaaaataaagaatccatgaatgctttaatcgcagcacaaaagcgtggtgttacagtaaaaatactttggtcatataaaccagatctacctcttataaaagaagcggcgtatccatacatacgtcaagctattaataatgggattactgtatatgggtataaaaaaggaatgttccatggcaaattcatgcttattgataatgaattaaccgttattggcacaacaaactttacttcgcgtagcttcaatataaatgatgaaatgaatttttatattcatggtggtcctattgtagggcaagttaataaggcgttaacagaggattttcgtgaatcaaaagaaatgacgaaagaattttttgagaagttatctttttgggagcgttgtaaggagaaatttgcaggaatggtggatttttatttataa

SEQ ID NO: 14415 - protein, 403 aa, Bacillus cereus E33L
MIKKILGVTSIIIAIFAFILICMHIDVTLGRKMEAGKNMPTEYAPHYSDFQLYVEGKSFYKQLFTDIKEAKQSIYTYFFILSDDKSSHTFLNLLKEKAKEGVNVYLSVDLLNDLSFERKMKKELQENGVHFTYSRKQELPFGFYSLHHRNHRRITTIDGEIGYTGGFNIGDEYLGKDKHFGYWRDYHVRIKGEGAKDLEEQFALDWKRDTKEDIKRSTNKASKGNTLHTMVSYNGHQVAEKYIDLIKQAQHSIVIATPYFIAKNKESMNALIAAQKRGVTVKILWSYKPDLPLIKEAAYPYIRQAINNGITVYGYKKGMFHGKFMLIDNELTVIGTTNFTSRSFNINDEMNFYIHGGPIVGQVNKALTEDFRESKEMTKEFFEKLSFWERCKEKFAGMVDFYL

SEQ ID NO: 14416 - DNA, 1104 bp, Bacillus cereus E33L
  CDS (1)..(1104): transl_table=11
atggctagtgaatatgaagtaggacaagttagattaggtgaatttcaactgtatacgaacggtgaagagttatatacgaatttatttgaggatatacgtaatgcggagaagtacatatatatccatttttatattgtaggtaaagatgaaataagcaaagagtttttgcagttgctcgagaaaaaggcatcgggtggagtagaagtgaaattgtcagtcgatcgaataggtggatataagctgaagaaaaaggtaattcgtcaactacaaagcaatggtgtccagtttacgtttagtaaaaaacctaaattgaaacatttattctattcgttgcatcagcgaaatcatagacgaattgttacgatagacggaaaagtatcatatatcggcggctttaacatcggaaaggaataccttggacaagatccgaaatttggcccgtggcgtgattatcatgtgcgagttaaggggaatggtgccacggatatggaaagaaaatttgctgctgactggaaagaagatacgggagaaaaaatgcctgtacatgaaagtctacctgcaattgggaatgtaaaatatcaatatttattttcagatggaaaagggttatgggaaaaatatggagcgtttttaaagcaggctaaaaagtctttaattattgctacaccatattttgtaccaagtaaagaaatgatgaaagagttaaaaggtgcattaaaccgcggtgtcaatgtgaaaattctcgtaccatttaaaagtgatgcagtattgttaaaacaagctgcctatccgtatttgagagagatgaaccatgctggagcggagatttatcaatatcggaatggtttttttcatgggaaagtaacaatcattgatggagaaattgttgatataggtacagcgaattttgataatagaagtttttatttaaattgtgaatctaactgtgtcatatatgatagaacagttgttgctgacgtatgggatcgattaaaagaagacttccataaatcaaaaagattttcggaagaagattttgagaaaattagtaaatgggattggtttttagcaagaatagcaaatgttatagcatcatatttatag

SEQ ID NO: 14417 - protein, 367 aa, Bacillus cereus E33L
MASEYEVGQVRLGEFQLYTNGEELYTNLFEDIRNAEKYIYIHFYIVGKDEISKEFLQLLEKKASGGVEVKLSVDRIGGYKLKKKVIRQLQSNGVQFTFSKKPKLKHLFYSLHQRNHRRIVTIDGKVSYIGGFNIGKEYLGQDPKFGPWRDYHVRVKGNGATDMERKFAADWKEDTGEKMPVHESLPAIGNVKYQYLFSDGKGLWEKYGAFLKQAKKSLIIATPYFVPSKEMMKELKGALNRGVNVKILVPFKSDAVLLKQAAYPYLREMNHAGAEIYQYRNGFFHGKVTIIDGEIVDIGTANFDNRSFYLNCESNCVIYDRTVVADVWDRLKEDFHKSKRFSEEDFEKISKWDWFLARIANVIASYL

SEQ ID NO: 14418 - DNA, 1536 bp, Mannheimia succiniciproducens MBEL55E
  CDS (1)..(1536): transl_table=11
atgatgataaaatccctatgtttatgtataattttgaattcttgcataaagttctcaaaaagtgcggttagaatgaatattaatttagactcgattatagcatatattgtgccggtgattatgtggacattaatagtcaccatcacgttgcgccaaattatcaaacggcaatcctcctcggcaatgctctcctggttgatgattatttatattgtgccggtagtcggcatcctggcttatttggtactgggcgaaattaatttgggcaaacggcgggcaaatgcctctaaacaattattacccaaatatatgaaatggttcgccggccttaaaaaccaacaacatttactgattaacgatcaacaaccgtcgcttgccagccctttatttgctcttgcccaacgccgtttaagcattccctgtattaacggcaacgaattacatattctggacactccggaaagcattattcaaaatattattgatgacattcaccaggctcaatattctatcaatatggtattctatatttggtcaaacggcggtctggtggagcaggtacagcaagcgttgattcaagccaagcaacgcggcgtgaaaattcatattctgctggactccgtaggaagccgggcgtttttcaaaagcgaaaattaccaaaaaatgaccgcacttggtattgaaattgaagaagccctgcacgtaaatttgctgcgggttttcctgcgccgtattgatttacgtcaacatcgcaaaattattgtgatcgataatcaaatctcttataccggtagcatgaatatggttgatccgaatttctttaagcaagacagccatgtaggaaaatggatcgacattatggtacgtatcgacggcccggtttccgccgtgctgaacggtttgcattcatgggattgggaaatggaacgcgggcaaggactttatgtgccgttgccaagcccccaacatccgatggataattataatattcacgcggtacaaattctcgccaccggccccgggttgccggcggatttaatggaacaatcccttgctacggcgatttttgccgccaaggaaagtattacaatcaccacgccttattttgtgccgagtcagaatattgtagatgcgttgcaaattgccgcgctgcgaggcgtgaatgtgtcactgattttgccggtgcataacgattcccttatggttcgctgggcaagccgtacttattttgatgatctactcaccgccggtgtaaaaatttataactttacggaaggactgttgcatacaaaaagtatcctggttgataacaaaatggcactggtcggtacggtaaacatggatattcgcagtttttcgctgaatttcgaagtgaccatggtagttgaagaccaaactttcgccaatgaaatcagtttgctccatgaaaactatatgaatggtgccacgttgctggacgaacaacgctggttaaaccgcccggtgtttacacgaattattgaaaaactgtttttcttattcagcccattattatag

SEQ ID NO: 14419 - protein, 511 aa, Mannheimia succiniciproducens MBEL55E
MMIKSLCLCIILNSCIKFSKSAVRMNINLDSIIAYIVPVIMWTLIVTITLRQIIKRQSSSAMLSWLMIIYIVPVVGILAYLVLGEINLGKRRANASKQLLPKYMKWFAGLKNQQHLLINDQQPSLASPLFALAQRRLSIPCINGNELHILDTPESIIQNIIDDIHQAQYSINMVFYIWSNGGLVEQVQQALIQAKQRGVKIHILLDSVGSRAFFKSENYQKMTALGIEIEEALHVNLLRVFLRRIDLRQHRKIIVIDNQISYTGSMNMVDPNFFKQDSHVGKWIDIMVRIDGPVSAVLNGLHSWDWEMERGQGLYVPLPSPQHPMDNYNIHAVQILATGPGLPADLMEQSLATAIFAAKESITITTPYFVPSQNIVDALQIAALRGVNVSLILPVHNDSLMVRWASRTYFDDLLTAGVKIYNFTEGLLHTKSILVDNKMALVGTVNMDIRSFSLNFEVTMVVEDQTFANEISLLHENYMNGATLLDEQRWLNRPVFTRIIEKLFFLFSPLL

SEQ ID NO: 14420 - DNA, 1197 bp, Bacteroides fragilis YCH46
  CDS (1)..(1197): transl_table=11
atgcagcgggaggacaccacacaattcatccgaagcgactccctcgtgttacaatttctggaatactcgaatatccccataaccgataataataaggtgaaacttatcaaaagcggacgggaaaaatttgaggacttgttcgaagccatccgtggggcaaaacaccacattcatctggaatattttaattttcgcaatgactccatagccaatgcactgttcgacctgctgggcgaaaaagtgaaggaaggtgtcaaagtaagggcgatgttcgatgcattcggtaactggtcgaacaacaaaccactcaagaaaaggcatctgaaagcaatccgggagaaaggaatcgaaatcgtaaaattcgatccgttcaagttcccgtatatcaatcatgcggctcaccgcgaccatcggaagattgcagtcatcgacggcaaaataggatataccggcggaatgaatattgccgactattatatcaacggactccccaagataggcacctggcgcgatatgcatatccgcattgaaggcgatgcggtaaacatccttcaagaaatcttcctcgacatctggaataaaaccaccaagcaaaacatcgtgggcgaagaatattttccgaaccacccggagcgggccgacagctgcaatacggtcatttcgattgtagaccgcactccgaaacggaattcccgcatgttgagccatacgtatgccatgtccatctatgcagcgcaacatgatgtacgcatcgtgaacccgtattttgtaccgacttcatccatccgcaaggcactcaaaagggctttgaaccggggaacgaaagtggaaattatgatttcttccaaatccgacatccctttcacaccggatgcttcgctctatgccgtacagaaactgatgaaaaaaggggcaatgatctatttgtacaacggcggatttcatcactcgaaaatcatgatggtggacgacctgttctgtaccgtgggtacagccaacctgaacagccgcagcctgcgatatgattacgaaacgaatgcgttcatcttcgacaaggacattacgcagcaactgaatgacgttttcgaagccgacatgctgcactgcacccgcctgaccccggaaatgtggaaacaaaaatcagcctggaagaagtttaagtgctggtttgcgaacttattcacaccattcctgtaa

SEQ ID NO: 14421 - protein, 398 aa, Bacteroides fragilis YCH46
MQREDTTQFIRSDSLVLQFLEYSNIPITDNNKVKLIKSGREKFEDLFEAIRGAKHHIHLEYFNFRNDSIANALFDLLGEKVKEGVKVRAMFDAFGNWSNNKPLKKRHLKAIREKGIEIVKFDPFKFPYINHAAHRDHRKIAVIDGKIGYTGGMNIADYYINGLPKIGTWRDMHIRIEGDAVNILQEIFLDIWNKTTKQNIVGEEYFPNHPERADSCNTVISIVDRTPKRNSRMLSHTYAMSIYAAQHDVRIVNPYFVPTSSIRKALKRALNRGTKVEIMISSKSDIPFTPDASLYAVQKLMKKGAMIYLYNGGFHHSKIMMVDDLFCTVGTANLNSRSLRYDYETNAFIFDKDITQQLNDVFEADMLHCTRLTPEMWKQKSAWKKFKCWFANLFTPFL

SEQ ID NO: 14422 - DNA, 1440 bp, Burkholderia mallei ATCC 23344
  CDS (1)..(1440): transl_table=11
atgaccctcgactggctccatctcggcaccctcatcggcctcgcgcacgtgctcggcgtgatcgcggcctgccatgcgatcctgaacacgcgcacgtcgcaaggcgcgatcgcgtgggcggtgtcgttgacggcgatgccgtacctgacgctgatcccgtatctgttcctcggccgcagcaagttctccggctatgtcgacgcgcgccgccacgagaccgcggcgctgcgcacccgcacgcatcccgcgccgtgggacgccgaaggctcgacgctcggcgcgccgaaggaagcgctcggcgccgcgcgcgtacgcgcgctcacgcgcctggtcggcatgccgttcgtcgccggcaacgcggtgcgcacgctcgtcaacggcgacgcgacgttctccgcgatcctcgccgcgatcgacgccgcgcgcagctacgtgatcgtccagttcttcatcgtccgcgacgacgcgctcggcgcgatgctgcgcgacacgctgatcgcgcgcgcgaaggcgggcgtgcgctgctatctgctgtacgacagcatcggcagcttcgatctgccgtcgagctacgtgcacgcgctgcgcgaaggcggcgtcgaagtgcatccgttcgcgaccaacaagcagttcgtcaaccgcttccagctgaatttccgcaatcaccggaagatcgtcgtcgtcgacggcgagcgcgcgttcgtcggcgggcacaacgtcggcgtcgaatatctcggcggcaacccgcgcctgtcgccgtggcgcgacacgcacatcgaagtgcgcggcccggcggccgcgaacatccagtacgtgttcgccgaggactggcactgggcaacccagtcgctccccccgcaggcaccgccgcccgcgccggttcccgacgccgacatgcactgcctcgtcgtgccgatgggccccgccgacaagcaggagacgggctcgctcttcttcgcggaggcgatcaacgccgcgcgcgagcgcgtgtggatcacgacgccctacctcgtgcccgacgaagcggtgatttccgcgctgaagctcgcggtgatgcgcggcgtggacgtgcgggtgatgattccgagccggcgcgatcactatgtcgttttcgaagcgtcgaagctctatgcgcgcgatctcgtcgacgcgggcgtgcgaatcttccgctaccgccccggcttcctgcaccagaaggtcgtgctgatcgaccgggcggccgccgccgtcggcagcgcgaacctcgacaaccgttcgttccggctgaatttcgagatcatggtgctgaccgtcgacgcgggcttcgccgccgaagtcgaagcgatgctcgcgcgcgacttcgatcaagcgttcgaggtcgacctgagcgagtaccggcgctcgcctgcgtggcggcgcgtggcgatgcacgtcgcacggctgttcgcgccgatcctctga

SEQ ID NO: 14423 - protein, 479 aa, Burkholderia mallei ATCC 23344
MTLDWLHLGTLIGLAHVLGVIAACHAILNTRTSQGAIAWAVSLTAMPYLTLIPYLFLGRSKFSGYVDARRHETAALRTRTHPAPWDAEGSTLGAPKEALGAARVRALTRLVGMPFVAGNAVRTLVNGDATFSAILAAIDAARSYVIVQFFIVRDDALGAMLRDTLIARAKAGVRCYLLYDSIGSFDLPSSYVHALREGGVEVHPFATNKQFVNRFQLNFRNHRKIVVVDGERAFVGGHNVGVEYLGGNPRLSPWRDTHIEVRGPAAANIQYVFAEDWHWATQSLPPQAPPPAPVPDADMHCLVVPMGPADKQETGSLFFAEAINAARERVWITTPYLVPDEAVISALKLAVMRGVDVRVMIPSRRDHYVVFEASKLYARDLVDAGVRIFRYRPGFLHQKVVLIDRAAAAVGSANLDNRSFRLNFEIMVLTVDAGFAAEVEAMLARDFDQAFEVDLSEYRRSPAWRRVAMHVARLFAPIL

SEQ ID NO: 14424 - DNA, 1275 bp, Burkholderia pseudomallei K96243
  CDS (1)..(1275): transl_table=11
atgagtggcgagacccggcaccgcctcgcgcaactgcgccagatgttcctgcaggagcgcggctccgcgtcgcggctcgcgttcacgtccggcaacgcggtgcgcctctgcgacggcggcgcggcgttctttccggcgctgatcgaacggatcgacgccgcgcgcgagcgcgtcgcgctcgaaacctacatcttctgcgacgacgccgtcggccgcgcggtgtccgacgcgctcgtccgcgcggccgcgcgcggcgttcacgtgcgcgtcatcaccgatggaatcggcaccgagcgcctgccgcttttcggcacctggccggacgcgggcgtcgagcaccggatctacaatccctatctgttcggccgcttcggtttttcgcgcacgcaccgcaagctcgcggtgatcgacgacgcctgcgcgttctgcggcggcatcaacatcgtcgacgatttcgagcagaacggcgagcgcctgccgcatccgcgctgggacttcgcggtcgaactggccgggcccgccgtcgccgacgtgcgcgccgcgttcgaggtgcagtggcaccggatcgccgccggccacaagcgctacgcgcaatatctgccgcatgacgtcgatggtcccgcgttcgccgcgcgctttcgccgctggatgcgcagccaccgctgggtgaaggcgggcgcgctgcgcgtcgtgaccgagccgagcgtggcgttcgtcgcgcgcgacaatatcgtgaaccgccgggcgatcgagaaggcgtatctcgcggcgatcggccgcgcgcgccagtcgatcctgctcgctaacccttacttcatgccggggcgcaagctgcggcgcgcgctcgccggcgcggcgcgccgcggcgtcgacgtgcggatcctgctcgggcgcaacgagttcgcgtcgctcgatatggcggtgccgttcctatatcatgcattgctgcgctcgggcgtgcgcgttgccgaatacgacaagacgatgctgcacggcaaggtcgcggtgatcgacgatcattgggcgaccgtcggctcgtcgaatctggatgcgctcagcctgatgctgaacaacgaggcgaacgtcgtgctcgtgcgccaccgcgaggagacggccgcgctgcgcgacgcgatcgcggcggcgttcgccgacggccgcgagatcgacccggcgctctacgcggcgcggcccgccgccgagcggtttctgaactggttcgcgtacaacgcgtaccggagtgcgatgaagctgctgacggtcggcggatacgactaa

SEQ ID NO: 14425 - protein, 424 aa, Burkholderia pseudomallei K96243
MSGETRHRLAQLRQMFLQERGSASRLAFTSGNAVRLCDGGAAFFPALIERIDAARERVALETYIFCDDAVGRAVSDALVRAAARGVHVRVITDGIGTERLPLFGTWPDAGVEHRIYNPYLFGRFGFSRTHRKLAVIDDACAFCGGINIVDDFEQNGERLPHPRWDFAVELAGPAVADVRAAFEVQWHRIAAGHKRYAQYLPHDVDGPAFAARFRRWMRSHRWVKAGALRVVTEPSVAFVARDNIVNRRAIEKAYLAAIGRARQSILLANPYFMPGRKLRRALAGAARRGVDVRILLGRNEFASLDMAVPFLYHALLRSGVRVAEYDKTMLHGKVAVIDDHWATVGSSNLDALSLMLNNEANVVLVRHREETAALRDAIAAAFADGREIDPALYAARPAAERFLNWFAYNAYRSAMKLLTVGGYD

SEQ ID NO: 14426 - DNA, 1653 bp, Burkholderia pseudomallei K96243
  CDS (1)..(1653): transl_table=11
gtgccggatcgccccgccctccgcggtctcgcgccgcgccatccaccgcgcatcgtcaaggccgccgcgcgcgcgctcgtcctgtgcgcggcgctcgcgctctccggctgcgcgacgcatccgcccgccaccacgctcgagcgcaccgtctcccacgcgctgccgcccgacgcatcgacgccgctcgccgacgcgctcgccgtgcaggcgcgcgcgcatccgggcgaatcgggcttcgtcgtgctgccgcgcggcgacgaggcgctgcaaatgcggatcgcggtggcgcgcgcggcgacgaagacgctcgacatccagtactacatcgccgccgaggacacgacgggcaagctgctgctcggcgccgcgctgtacgcggccgaccgcggcgtgcgcgtgcgcatgctcgtcgacgcgctgaacttcaaggacatcggcaggctgatggcggcactcgacgcgcacgcgaacctcgaagtccgcgtgttcaatccgttcggcgccccgcgcctcggcatgttcgcgcgcaccgcgaacgtcttcacgcggatcgacaatttcacgcgccggatgcacaacaaggcgatgatctcggacaaccagatcgcgatcgtcggcggccgcaatctcggcgacgaatatttcaacgcgagcccgacgctgcaattccgcgacctcgacgtgctcgcggccggccccgtcacccgcgccgtctcggcgagcttcgacgcgtactggtcgagcgcgctcacgtatccgctgccggcgctgaatcgccggcgctacgacgcgaaggatctggacgcggcgcgcgacgcgctgcgcgcgcactggcgcgcgaacgcgacgccgtacaacgcgaagccgctgaacgcgacgccgctcgccgcgcagatcgcgcgcaacgagctcggcctggtatgggcgagcgcggagttcaccgccgattcgcccgagaagatcgccgcgcccgacgacagctacaagagcccgccgatgcagcggctcttcgcgctcacgcgcgacgcgcagcgcgaattcctcgtgctgtcgccgtatttcgttccgcacgatgccggcgtgaacgcgctcggccggctgaccgcgcgcggcgtgcgcgtcgcgatcctgacgaattcgctcgcggcgacggacgcgatcgccgtgcaggcgggctacgcgccgtatcgcgtgccgatgctcgagcgcggcgtcgagctgtacgaatacaagccggacccgggccgctcgcgcatcggcatgctgggttcgcgctcgcgcgcgagcctgcacgcgaaggcgtacgtgatcgaccggaagattctcgtgatcggctcgatgaacctcgatccgcgctccgcgcatctgaacacggagctcgcgctcgtgatccacagcccgcggctcgcgaacgaagtcgcgaatctgttcgacgaagtgacgaagccgacgatcagctaccgcgtgacgctcgcgcccgacacgccgggcgcggcgcagacgaccggcgcgggcgcgccggcatggccgctcgtgtggaccgaaatcgccgacggccaggtacgcacgtacagcgtcgatccgaacgcgggcttctatcgcaacctgctcacggggctctgcctgctgctgccgatcgacgatcagctttga

SEQ ID NO: 14427 - protein, 550 aa, Burkholderia pseudomallei K96243
MPDRPALRGLAPRHPPRIVKAAARALVLCAALALSGCATHPPATTLERTVSHALPPDASTPLADALAVQARAHPGESGFVVLPRGDEALQMRIAVARAATKTLDIQYYIAAEDTTGKLLLGAALYAADRGVRVRMLVDALNFKDIGRLMAALDAHANLEVRVFNPFGAPRLGMFARTANVFTRIDNFTRRMHNKAMISDNQIAIVGGRNLGDEYFNASPTLQFRDLDVLAAGPVTRAVSASFDAYWSSALTYPLPALNRRRYDAKDLDAARDALRAHWRANATPYNAKPLNATPLAAQIARNELGLVWASAEFTADSPEKIAAPDDSYKSPPMQRLFALTRDAQREFLVLSPYFVPHDAGVNALGRLTARGVRVAILTNSLAATDAIAVQAGYAPYRVPMLERGVELYEYKPDPGRSRIGMLGSRSRASLHAKAYVIDRKILVIGSMNLDPRSAHLNTELALVIHSPRLANEVANLFDEVTKPTISYRVTLAPDTPGAAQTTGAGAPAWPLVWTEIADGQVRTYSVDPNAGFYRNLLTGLCLLLPIDDQL

SEQ ID NO: 14428 - DNA, 1458 bp, Photobacterium profundum SS9
  CDS (1)..(1458): transl_table=11
atggaacagttttatcaagttttagtttgggtcggtgttttcctttactggctaattattgctggtgtaaccatgcgtgtggtattccaacgtcgtattgtcggcgtgtctcttgcttggttaatgataattttcatcattcctattggtggggtattcgcctacctactatttggcgaattgaatttaggtaagaaacgggcagagcgtgctcgcgacatgttccatccatttgcggaatggtttcagcggctcaatgattgtcctagccaccaacctcaactaatgagtcagaatgcgcgccctattagtgacttgtgtgagaaacgtcttggggtgcctggtttagtgggtaataccctctcgttacaagattctccccagcaaattctgcattcaattattgacgatattcaacaagcgaaagagtctatccatctagagttttatatttggcacgcaggcggattggcagacgctgttggcgttgcattaattcaagcggcaaaaagaggtctatccgtccggttactgcttgattctgcgggtagttcacgattcttccgttcacattggccaaagctcatgcgccaagcaggcattgaaataactcaagctctggccgtgtctccgctacgtatgttttttcgtcggttagatttacgtcaacatcgaaaaattatcgtcattgataataccatcgcatacacaggttcaatgaatttagttgacccagcgtttttcaaaacaaatgcagatgtaggtcagtgggttgacgtgatggtgcgcttaacgggaccaacagttccacttctcaattgcattcaagcatgggattgggaggtcgaaacggggcaacgtttcctacctgaattaccagcttgtggtatcgatacatcacccgataccattgataccgttcaagtgatcccatcaggcccaggcatgcctgacgaaattattcaccaagtactgttattaagtatttaccaagcacaaaaaagtgttgttattacgacgccctacttcgtaccaagcgagcatctacagcatgcactaaaaggtgccgctgaacgggggcttagcgtccatattgttgtaccagataaaaatgattcaacaatggttgagtgggcaagccgatctttttttggagagttattacaagcaggcgtgaaaattcatcgttttcatggcgggttactacacactaaatcagtggttatcgatgatactcattgcttaattggtactgttaaccttgatatgcgcagtttatggctcaactttgaagtcaccttggccgttgatagtcttgaatttacccagcaactgagttggctacagcaagaatatattaaaaattcaacgagtattgataataatgaatggacaaaacgcccaatgttaaacaaattgggtgaacgattcttttatatgtttagcccattactttaa

SEQ ID NO: 14429 - protein, 485 aa, Photobacterium profundum SS9
MEQFYQVLVWVGVFLYWLIIAGVTMRVVFQRRIVGVSLAWLMIIFIIPIGGVFAYLLFGELNLGKKRAERARDMFHPFAEWFQRLNDCPSHQPQLMSQNARPISDLCEKRLGVPGLVGNTLSLQDSPQQILHSIIDDIQQAKESIHLEFYIWHAGGLADAVGVALIQAAKRGLSVRLLLDSAGSSRFFRSHWPKLMRQAGIEITQALAVSPLRMFFRRLDLRQHRKIIVIDNTIAYTGSMNLVDPAFFKTNADVGQWVDVMVRLTGPTVPLLNCIQAWDWEVETGQRFLPELPACGIDTSPDTIDTVQVIPSGPGMPDEIIHQVLLLSIYQAQKSVVITTPYFVPSEHLQHALKGAAERGLSVHIVVPDKNDSTMVEWASRSFFGELLQAGVKIHRFHGGLLHTKSVVIDDTHCLIGTVNLDMRSLWLNFEVTLAVDSLEFTQQLSWLQQEYIKNSTSIDNNEWTKRPMLNKLGERFFYMFSPLL

SEQ ID NO: 14430 - DNA, 1533 bp, Photobacterium profundum SS9
  CDS (1)..(1533): transl_table=11
atgtctgtgttccaacgtattaatataacgatgtttttagtcgctattctcactgggtgcgcatcacttcccgaagaggttaatcatcctaatgagcctgtagccatgtcactaacgagtacattatccgaattgagtgacatttatcggcttcaacagcctacacaagaaacgagtgcggttctgctgcaagatactggctgggacgcattggctcagcggttggcattaatcgaaaccgccgaacacagcattgatatccagtattacatatggaattcagatgcgtcgggtcactacctagcaaaccgtttgatagcagctgccgatcgtggcgttaaagtccgtgtaatgttggatgatatcaatcttaatgaacgagaggatctactagtagctcttgattctcaccatcaaatagagatccgcatatttaatcctatcccaactcgtcgtggtgtcacaaagtggctaaatttcttaggtgatttttctcgtctaaaccgccgcatgcacaataaatcatttaccgttgatggtgctttttccattgttggtgggcgtaatatcggtgatgaatattttgatctttctgataaaatcaattttcgtgaccgcgatgtattggtaatgggctcggtagttaccgatatccaagctagttttggagaatactgggacagccgttggtcttacccagttgatttactgggaggtgaagcctcatcagatatgccagtgtttggtgaggtggctgctcctcgttatatgaattatcccgtcttgccagaaggaaataaaacagcaaatcgattcttaaaagagttgatgggcgagatgacttgggttcaagctcgttttgtttctgaccgaccagtaccagtcgatgaagataacaccagtgaactgaaggcgactgccagagtattggctgaattagctcgtgaatctgagcaagaaatattattggaatctgcatatctcatatttgatgatcgtcaattagaagaggtgcaggaattgaccagcaatggagttcagataaaagcattgactaattcaatggcttcgaatgacctaacgactaaccactctggctacgcaggtcgacgtcaggatatgcttgaacacggcatacagttgtttgagttgaaaccagagacgagtttatgtgaagagtctactcgagacgtatccaaatgcgcaccgacaatagcttatggccttcatgcaaagtctgctgtttttgatagacgtgtggctagtatcggctcttttaacttcaatttacgttcaacctacctcaatactgagtctattctagtcattgaaaatcaaagtgttgctgaaagtcttgctgatgatatagatcaggcgatgaacgaggataatagctggcgtttgaagttacaagaaggcgaagtccgttggtattctggtcaaaaaagttgggaaagcgaaccagagacaggtcgatgggagcgatttcaatcacgtttcttacagttactgccaatagagaagtatttgtga

SEQ ID NO: 14431 - protein, 510 aa, Photobacterium profundum SS9
MSVFQRINITMFLVAILTGCASLPEEVNHPNEPVAMSLTSTLSELSDIYRLQQPTQETSAVLLQDTGWDALAQRLALIETAEHSIDIQYYIWNSDASGHYLANRLIAAADRGVKVRVMLDDINLNEREDLLVALDSHHQIEIRIFNPIPTRRGVTKWLNFLGDFSRLNRRMHNKSFTVDGAFSIVGGRNIGDEYFDLSDKINFRDRDVLVMGSVVTDIQASFGEYWDSRWSYPVDLLGGEASSDMPVFGEVAAPRYMNYPVLPEGNKTANRFLKELMGEMTWVQARFVSDRPVPVDEDNTSELKATARVLAELARESEQEILLESAYLIFDDRQLEEVQELTSNGVQIKALTNSMASNDLTTNHSGYAGRRQDMLEHGIQLFELKPETSLCEESTRDVSKCAPTIAYGLHAKSAVFDRRVASIGSFNFNLRSTYLNTESILVIENQSVAESLADDIDQAMNEDNSWRLKLQEGEVRWYSGQKSWESEPETGRWERFQSRFLQLLPIEKYL

SEQ ID NO: 14432 - DNA, 1509 bp, Geobacillus kaustophilus HTA426
  CDS (1)..(1509): transl_table=11
ttgcgaaacacatcgagagtggcgattctcgtcgtcattgtcggcgcgttgctggcattgacgaacgggttttgggaagggaagctgcttggtcttttcagcgtattgatgtcttgttccgtcatctttattgcgctggtcatttctcttgagaatcgaaagccggcgcagacgatcgcttggctggcggtgctggggagctttccgattgtcggctttttgttttatttattgttcggacgcaactattggcaacaacggcgctataaaaagaaagccgattttgatgaggcggtgctgctcaagtttcaagagccgtcgccgattgccgtcgagcggctgccgatggcgccccatcagcgtccgcttttgcgccttgcttatcgcatcggccagcatccggtttcacttgcttcgcagacggcggtgttgacgaacggagaggagacattttcttctatttttgctgaactggaaaaagcggaacaccatattcatttagaatattatattgtccgtcatgatgaaatcggccaacagttgaagcgcgtcttgatggaaaaagcgcgtcaaggtgtgcgcgtccgttttttgtacgacgccgttggaagttggaagttgtcaaacgcctatatcgaggagctgcgcgcggctggagtcgagatgatcccgttttcaccagtgcgcctcccgtttttaagcaaccaaatcaatttccgcaatcaccgaaagatcattgtcatcgatggaggcgtcggctttgtcggcgggctgaacatcggagatgagtatttaggaaaaaacaaatatttcggattttggcgcgatacgcacttattgatccgcggtgaagccgtccggacgcttcagctcatttttttgcaagattggtattacatgacgggagaacgcttgttgacgccggactatttgtcgccgccgctcatcgtcgaggaagggcaaggcggggtgcagctcattgccggcggtccggaccaaaagtgggaagtgatcaaacagctgtattttgccatgattacgtcggccaaacggtcgatttgggttgcctcgccgtactttgtgccggatgaagacattttgacggcgctcaaagtggcggcgttaagcggcatcgatgttcgcctgctggcgccaaagcgtccggataaaaaaattgtcttttacgcttcgcgctcgtattttcccgagctgctcgaggctggggtgaaaatttacgagtatgagaaagggtttttgcacagcaaagtcatcgtcgtcgatggcgagctcgcctcgatcggcacggcgaacatggatatgcgcagtttccatttaaactttgaagtgaacgcctttttgtattataccgacagcattcataaactcgtccgcgactttttggaagattttcgccacgcttccatgatcgactacgaacagtttcaacagcgcccgttccgggtgcgtatcgctgaatcggtctcccggctgttgtcgcctctgttgtaa

SEQ ID NO: 14433 - protein, 502 aa, Geobacillus kaustophilus HTA426
MRNTSRVAILVVIVGALLALTNGFWEGKLLGLFSVLMSCSVIFIALVISLENRKPAQTIAWLAVLGSFPIVGFLFYLLFGRNYWQQRRYKKKADFDEAVLLKFQEPSPIAVERLPMAPHQRPLLRLAYRIGQHPVSLASQTAVLTNGEETFSSIFAELEKAEHHIHLEYYIVRHDEIGQQLKRVLMEKARQGVRVRFLYDAVGSWKLSNAYIEELRAAGVEMIPFSPVRLPFLSNQINFRNHRKIIVIDGGVGFVGGLNIGDEYLGKNKYFGFWRDTHLLIRGEAVRTLQLIFLQDWYYMTGERLLTPDYLSPPLIVEEGQGGVQLIAGGPDQKWEVIKQLYFAMITSAKRSIWVASPYFVPDEDILTALKVAALSGIDVRLLAPKRPDKKIVFYASRSYFPELLEAGVKIYEYEKGFLHSKVIVVDGELASIGTANMDMRSFHLNFEVNAFLYYTDSIHKLVRDFLEDFRHASMIDYEQFQQRPFRVRIAESVSRLLSPLL

SEQ ID NO: 14434 - DNA, 1242 bp, Salmonella enterica subsp. enterica serovar Paratyphi A str. ATCC
  CDS (1)..(1242): transl_table=11
atgaaatgcggctggcgtgaaggtaatcaaattcagctactggaaaacggcgaccagttctatcctgccgtgtttgaggctatcgctcaggcacagcaaaaaatcattctggaaacctttatcttgtttgaagatgaggtgggtaaaaaactccatgccgctctgctaaaagccgcacagcgcggcgtaaaagccgaagtattactcgacggctacggctctcccgatctcagcgacgcgtttgtcggcgaattaacctcggcgggcgtgattttccgctattacgacccccgcccgcgtctactgggattgcgaaccaatatcttccgccgaatgcaccgcaaaattgtggtgattgatgatcgtattgcttttgtcggcggcattaactactccgccgaacatatgtcggattacggcccgcaggcgaaacaagactacgcggtacgggtcgaagggcctgtagtggccgatatcctgcaattcgaagtcgagaatctgccggggcaaagccccgcgcgccgctggtggaagcgccatcatcaggctgaagaaaatcgccaccccggcgaagcgcaggcgctgtttgtctggcgggataatgaagagcaccgcgacgatatcgaacgtcattatctgaaaatgctgacccaggcaaagcgtgaagtgattatcgctaacgcctattttttccccggctatcgcttgctccacgcaatgcgtaaagccgcccgccgtggcgtgagcgtaaaactgattgtccagggggaaccagacatgccgatagtcaaagtcggcgcgcggttgctctataactatctggtgaagggcggcgtgcaggtttatgaataccgacgccgtccgctgcatggcaaagtggcgctgatggacgatcactgggctacggtggggtcgagtaatctcgatccgctcagcctgtcgcttaaccttgaagctaacctgatcattcacgatcgtacttttaaccagaccctgcgcgataacttacaaggcatcatcgtgaatgattgtaagcaggtcgatgagtctatgctgccgaaacgcacctggtggaacctgaccaaaagcgtgctggtgttccactttttacgccatttcccggcgctggtcggctggctaccggcgcataccccgcatctggcgcaggttcccccgcctgcccagccggaaatggaaacccaggatcgcgttgatccagaaaatacaggagtgaagccctaa

SEQ ID NO: 14435 - protein, 413 aa, Salmonella enterica subsp. enterica serovar Paratyphi A str. ATCC
MKCGWREGNQIQLLENGDQFYPAVFEAIAQAQQKIILETFILFEDEVGKKLHAALLKAAQRGVKAEVLLDGYGSPDLSDAFVGELTSAGVIFRYYDPRPRLLGLRTNIFRRMHRKIVVIDDRIAFVGGINYSAEHMSDYGPQAKQDYAVRVEGPVVADILQFEVENLPGQSPARRWWKRHHQAEENRHPGEAQALFVWRDNEEHRDDIERHYLKMLTQAKREVIIANAYFFPGYRLLHAMRKAARRGVSVKLIVQGEPDMPIVKVGARLLYNYLVKGGVQVYEYRRRPLHGKVALMDDHWATVGSSNLDPLSLSLNLEANLIIHDRTFNQTLRDNLQGIIVNDCKQVDESMLPKRTWWNLTKSVLVFHFLRHFPALVGWLPAHTPHLAQVPPPAQPEMETQDRVDPENTGVKP

SEQ ID NO: 14436 - DNA, 1395 bp, Idiomarina loihiensis L2TR
  CDS (1)..(1395): transl_table=11
atgacacctttactgcccgcgtgcccggacaatcagtttcaattgctggaaaatgctcaccgggcgctgattgaacgggtgaggttaatacgtcaggccaggcatcatattgcgttacaatactatttgtggcgtcccgacagcagtggccttaccctgcttaaggaattactggatgccgtcgagcgtggcgtgcgggtcgaccttctgctggatgatttgcacagcaaacctttagaacctttattgcgagatttatcctcccgcgctaatttcaatattaggctttttaatccgtttaagcacagacgctggcgctggctaaactggttaaccgactttaagcgcatgaatcggcgaatgcataataaatcgatgctggtcgatgcggaagtggggattgttggtgggcgaaatgttggtaacgagtattttggtacacatgcgggacaactgttttccgatcttgatgtaatagcgaaaggcaaaatcgttaagacgttacttgatgactggcggcaatactggaactgcactttatcggttgcggttaacgcaataagctcgtcggataaaccgagattgtttaacgatatttggaaaggttatcaaaaacaaccggaacttcgagatttacaccagtttgttctttctgacgaacacttgacagacactccccagagcgacgctgaaacctggtatcaggcaaccgcaacggttgtcagtgatgatcctttaaaggctctgcctgatagtaagccgagccggttggtgacgcagcagttaacgcaaactcttggcttggcaaagcaatctattgttttggtttctccttattttgtgccgacgcctacaggtgttaaagagctggagaatttgtcggagcagggagtaaaagttcgcgtgctgactaattcactggcagtgacagatgtcccggccgtacatgcgggctaccagcgacaccgacgaaggctgttgttgtcaggtgtaaaactgtttgagctgaaacgaaccgaggaaaaacctttacgcaaagatgtgcgtccttatttcagacgctcggcgtctagcctgcatgctaaaaccgtgacagtggacagtgagaaagtctttgttggatcatttaattttgacccgcgttctgcgcaaattaacacagagtcggggcttttaattgagtcagcggagatggcagagagaattaacgcgatgtttgagcacgaactaccgctgcgatcgtatgaggctcgactcaaccgtttttataaactgtattggctggataaaagtaaaataccggcgttacggctctataaagagccgggagccggtatttggcgacggttggcggtttggttaaccgccaggttgccggttgatcatttactctag

SEQ ID NO: 14437 - protein, 464 aa, Idiomarina loihiensis L2TR
MTPLLPACPDNQFQLLENAHRALIERVRLIRQARHHIALQYYLWRPDSSGLTLLKELLDAVERGVRVDLLLDDLHSKPLEPLLRDLSSRANFNIRLFNPFKHRRWRWLNWLTDFKRMNRRMHNKSMLVDAEVGIVGGRNVGNEYFGTHAGQLFSDLDVIAKGKIVKTLLDDWRQYWNCTLSVAVNAISSSDKPRLFNDIWKGYQKQPELRDLHQFVLSDEHLTDTPQSDAETWYQATATVVSDDPLKALPDSKPSRLVTQQLTQTLGLAKQSIVLVSPYFVPTPTGVKELENLSEQGVKVRVLTNSLAVTDVPAVHAGYQRHRRRLLLSGVKLFELKRTEEKPLRKDVRPYFRRSASSLHAKTVTVDSEKVFVGSFNFDPRSAQINTESGLLIESAEMAERINAMFEHELPLRSYEARLNRFYKLYWLDKSKIPALRLYKEPGAGIWRRLAVWLTARLPVDHLL

SEQ ID NO: 14438 - DNA, 1383 bp, Azoarcus sp. EbN1
  CDS (1)..(1383): transl_table=11
atgcgcttctgtgtttcaatttcccacgtgaccggcagaacgcgagcctgccgcgtcggactgtctgcatctcgccgaaagggcctttcgatgccacgaaaatggatgtccaaacgcatgctctggaccgccgcgatcacggcggtgggcaccggagtcgtggcgttggtggggatgaacttctccacgccggaaaagaagctggaacaggtgctcgcgcaccgcttccccgtcgccgcgccgcagttccggcgcgagatgtcggtgctgctcgggccgccgatcatcgcgggcaatcgcgtcactgcactgcagaacggtgatgagatattcccggcgatgttgcaggccattcgtggcgctcgcacttcgatcacgttcgagacgtacatctactggtccggcgaaatcggcagggaattctccgatgcgctggccgagcgcgcgcaggccgggattccggtccatgtcacgatcgactgggcgggcagcatcaagatggacgagcgcctgctgcggaagatggagcaggccggggtgcgggtccatcgctaccggccgttgcactggtactcgctcgaccggctcaacaaccgtacgcaccgcaagttgctggttgtcgacggacgcatcggcttcaccggcggcgtcggggtcgcggaccaatggctcggacacgcgcaggatcccgaacattggcgcgattcccattaccgcatcgagggcccggccgtcgcgcagatgcaggcggcgttcaacgacaactggatcaagacgaccggcgaagtgctcagcggtccggcctatttcccggagctgtcgccggtcggagacgtggccgcgcatctcttcctcgcgtcgccgtcgggcggcagcgagagcatgcacctgatgtacatgatggcagtgagcgccgcgaaacattcgatcgacctcgccgcatcgtacttcgtgccggacgagctgatcgtcaaggcgttgatcgccgcccgggaacgcggggtgcgcgtccgcgtgctgctgcccggcccgtacatcgattcggacgcagtgcggttcgcgtcgaaagccggatgggggccgctgctgcaggccgacatcgagatccacgaataccagccgacgatgctgcacacgaagctgctggtgatcgaccgcgaggtggtgtcggtcggatccaccaatttcgacatccgttcgttccgcctcaacgatgaggcgagcctcaatctctacgaccggccgttcgccgagaaaatgatcgcggtcttcgagtccgacctcgcgcaggcgcagcgctacacctatgaaatgtggcaacagcggccgatgaaggacaagctgatcgagaaattcgtgctgccgctgaagtcgcagctgtga

SEQ ID NO: 14439 - protein, 460 aa, Azoarcus sp. EbN1
MRFCVSISHVTGRTRACRVGLSASRRKGLSMPRKWMSKRMLWTAAITAVGTGVVALVGMNFSTPEKKLEQVLAHRFPVAAPQFRREMSVLLGPPIIAGNRVTALQNGDEIFPAMLQAIRGARTSITFETYIYWSGEIGREFSDALAERAQAGIPVHVTIDWAGSIKMDERLLRKMEQAGVRVHRYRPLHWYSLDRLNNRTHRKLLVVDGRIGFTGGVGVADQWLGHAQDPEHWRDSHYRIEGPAVAQMQAAFNDNWIKTTGEVLSGPAYFPELSPVGDVAAHLFLASPSGGSESMHLMYMMAVSAAKHSIDLAASYFVPDELIVKALIAARERGVRVRVLLPGPYIDSDAVRFASKAGWGPLLQADIEIHEYQPTMLHTKLLVIDREVVSVGSTNFDIRSFRLNDEASLNLYDRPFAEKMIAVFESDLAQAQRYTYEMWQQRPMKDKLIEKFVLPLKSQL

SEQ ID NO: 14440 - DNA, 1458 bp, Azoarcus sp. EbN1
  CDS (1)..(1458): transl_table=11
atgacatcagggtcaagccggcgtactgacagctgctttggaaacgcttcctttgacggcgggcgcgaatgcttcgacggcgcgtggtgcgtgctgctcgttccgttcgcgcttgcggcctgcgccacgagcccggccgtcgatacggtgggtctcccggtgcgtccctcgccggcctcggtcgaagttcgcgtcgagcacgcggacggggcactgcgcaccgatccgtcaccgaaagtcgtgcagcagctcgatgccgaccgtgtcgggaaggaactgctcgtacatcatctcgcccatgtcgaggacgcgctcgcgacgccgctggttctcggcaacgacgcgcacctgcttgtcgacggcccggcgacgtatcgggcgatgttcgcggcgatcgagaaagcgcggcgccgcatccatctggaaacctacatcctcgagtcgggggagcagggcgaccgcctcgcccgtctccttgcagcgaagcgccggcagggcgtggagattcgcgtcctgtacgacagtgtcggctcgctcgacacgcctccccgatatttcgaggacctcgtcgccgccggcatcgcggtatgcgaattcaatcccgtcaatccgctgaaactcgcaggtgatccgcggctgagcctcaacaaccgcgaccatcgcaagctgctcgtcatcgatggtcaaatcgcctttaccggcggcatcaacatcagcggcgtgtatcgcgccggttcgttcggcagcaagcgccgcgtgccgactcgcgacgaggggtggcgcgacacccacgtgatggtgcggggaccggtcgtgagccagttcgaagagctgttcaacgacgcatggcgcgagcagcgctgcccgtctccggtagtgcggcaggcgacccgcaccgagcgtgccgggagcatggcaatgcgcctggtcgccgccgatccagtgtcggaacgcagtgagctgtatgtcgcgctgatgtccgcgctcgaccatgcgcgcaagcgggtgtggctgacctacggatatttcgtgccggacgaacgcaccctgcagtcgctgcgcgacgcggcgcaacggggcgtcgacgtgcggctcgtgctgcccggtttcagcgatttctgggcgccgttccacgccggtcgttcgcattaccaggacttgctgagcgccggggtgcacatctacgaacggcgcgacgcgctgctgcatgcaaagaccgcagtcatcgacggggtgtggtcgagcgtcggatcgacgaacctcgactggcgcagcttcgtgcataacttcgaagccgacgtgctggtgctcgacggcgcattcgcacaagaaatggaagaactcttccgcctcgaccaatcggcttcccacgaagtgacgcccgagcagtggaaggatcgcggcgtgcgcgcccggctgctcgaatggctcgcacgacgctgggaatatctcctgtag

SEQ ID NO: 14441 - protein, 485 aa, Azoarcus sp. EbN1
MTSGSSRRTDSCFGNASFDGGRECFDGAWCVLLVPFALAACATSPAVDTVGLPVRPSPASVEVRVEHADGALRTDPSPKVVQQLDADRVGKELLVHHLAHVEDALATPLVLGNDAHLLVDGPATYRAMFAAIEKARRRIHLETYILESGEQGDRLARLLAAKRRQGVEIRVLYDSVGSLDTPPRYFEDLVAAGIAVCEFNPVNPLKLAGDPRLSLNNRDHRKLLVIDGQIAFTGGINISGVYRAGSFGSKRRVPTRDEGWRDTHVMVRGPVVSQFEELFNDAWREQRCPSPVVRQATRTERAGSMAMRLVAADPVSERSELYVALMSALDHARKRVWLTYGYFVPDERTLQSLRDAAQRGVDVRLVLPGFSDFWAPFHAGRSHYQDLLSAGVHIYERRDALLHAKTAVIDGVWSSVGSTNLDWRSFVHNFEADVLVLDGAFAQEMEELFRLDQSASHEVTPEQWKDRGVRARLLEWLARRWEYLL

SEQ ID NO: 14442 - DNA, 1419 bp, Zymomonas mobilis subsp. mobilis ZM4
  CDS (1)..(1419): transl_table=11
atgaccttaatgacgcttggaagtttttatgaagtagtcgcgtggctgatacgcttgacgatgctcgtcatcgttcccatgcgccggacaccacaagccgccagtagctggctgctgctgattttttttcaaccggctctgggcttgcttctttatttgatgattggtcaggcacgttttccgtcatggcgcgcagaacgttttgccaatctcaaatcttttctggaagaacaaaggcaaaaattacaaaattcggtagcctctctccctgcagaagcggccttggctgccgatcttgctgaaaatcttggtcatatgcccgccttatcgggtaaccggatgctttatatttctgattatcaggcgctttttgatcatctcgccgccgatattgataaagccgaacaacatgttcatctcgttatctatatttttgatagcgaccgctccggccaacagattattgccgccttgggacgcgccgcgaaaagaggcgttaattgtcagatattgattgatgccttgggatcacgccgctccggtaaacaggttatccagcaactaaaaaaccttggagttgatgcaagggaagccctgccctttcgcctgttaagagggcggacacgcggggatatgagaaatcatcgaaaattattcattatagacggcaaaattggctatgctggatcacaaaatattatcaatcgcgactggcggccgggcgttgttaatcaggaactaacagtcagggtcgaagggcccatcgtttttgaaatggaaacgctcttcgcgataaactggtatctcgaaagcggggcattacctgatagaatgagggacacacctcatttggtgccccccaaagaaggtagccatattttacagctgttacccagcggggcagattaccgtttggccggtttcgaaacgatgctggttaccggcatttacgccgcaaaaaaacagatagtgctcgttacaccctatcttattcctgatagcgatttactagcggctttaaaaacggcggccttacgcggggtcaggatagacattattgtctcgaaaattgccgaccaaatcttggttagcatggcacaaaaaagctattatcaagaattgctaagcgccggtattcatatccatcgctacagagacaagctcctccatgccaagcatatcagtgttgataacaaattggcgatggttggctccagtaatgtcgatattcgctctttcttgctcaatgaagaagtcagcctaatcatttacgataaagaagccattgcccagcttcaaaatatcgaaatggattatctaaaaaatgccgatgaagtcagtaaggcagcatggcgcctgcgcccctgctattgtaaagtcatggaaaatctggcgcgattagttagtccgctgttataa

SEQ ID NO: 14443 - protein, 472 aa, Zymomonas mobilis subsp. mobilis ZM4
MTLMTLGSFYEVVAWLIRLTMLVIVPMRRTPQAASSWLLLIFFQPALGLLLYLMIGQARFPSWRAERFANLKSFLEEQRQKLQNSVASLPAEAALAADLAENLGHMPALSGNRMLYISDYQALFDHLAADIDKAEQHVHLVIYIFDSDRSGQQIIAALGRAAKRGVNCQILIDALGSRRSGKQVIQQLKNLGVDAREALPFRLLRGRTRGDMRNHRKLFIIDGKIGYAGSQNIINRDWRPGVVNQELTVRVEGPIVFEMETLFAINWYLESGALPDRMRDTPHLVPPKEGSHILQLLPSGADYRLAGFETMLVTGIYAAKKQIVLVTPYLIPDSDLLAALKTAALRGVRIDIIVSKIADQILVSMAQKSYYQELLSAGIHIHRYRDKLLHAKHISVDNKLAMVGSSNVDIRSFLLNEEVSLIIYDKEAIAQLQNIEMDYLKNADEVSKAAWRLRPCYCKVMENLARLVSPLL

SEQ ID NO: 14444 - DNA, 1413 bp, Silicibacter pomeroyi DSS-3
  CDS (1)..(1413): transl_table=11
atgtgggccgctctactctcgctgatcgtgttctgcctttacggggcggcgatcgtctgcgcggtgcaggcggcacgcaccgcgcgcacgccgcaaggcgcggttggctgggtggtgttcctgctcaccctgccctgggcctcggtgccgctttacatgtttctggggcatcaccggtttcacggctatcgcatcgcgcgccgcgagagtgaacgggtggtcgccgggctgcgcgcccatgccgatgccaccgcccccgatcccgatcgggtcatggtcaacacccgccccttcgagaagatcgcccatatggcggtcagccggggcaatggcgcccggctgctggtcgatggcgaggccacctttgccgcgctgttcgccgccctggacgcggcgcgccactatgtgctgatccagttctatatcgtgcgcgacgacgatctggggctggaactgcgcgaccgtctgatcgcggcggcgcagcgcggggtcaaggtgcggttccttaccgacgccatcggcagctatggcctttcggacaattatatcgaggatctgcgcgccgcaggcatcgacatcgccaatccgcgcaagcagcgcgggcccaatacccgctttcaggtcaattaccgcaaccaccgcaagacggtggtggtagacggccagactgggttcatcggcggccacaatgtgggtgtcgaatatctgggtcaggatccggtgatgggccgttggcgcgacacccatgttcagatcaccggcccctctgtgctgcagctccagctggtctttgccgaggactggcactgggcgcggggcgaggatctgctcgatcttctcagctgggaaacccggctcgacccgcaggatgccgatgcgctgatcgtcgccaccggccccggcgaccgcaccgaaagcggcgccatgatgttctttgccgcgatcaccgctgccgagcgccgctgctggatcgcctcgccctatttcgtgcccgatctcgacattctggcggcgctgaaacatgccgcgctgcggggggtcgatgtgcgcctgctggtgcccgacgaggccgatcacaccatcccctggctggcggctttcgcctatttcgacgaggtgcgcgaggccggggtgcgcgtgatgcgctataccgacgggttcctgcatcaaaaggtgttcgtggtcgatgacaccatcgccgccgtgggcacaaccaatctggacaaccgctcgttccgcctgaatttcgaggcgatggcgctgttctttgatgcgacagtggccggtcaggtgacggcgatgctggagcatgattttgccagcagcaccgaactgacccgcagcctggcggcacagccggtattcatccgctacggcgcgccgctggcgcggctgtttgcgccgatcctgtga

SEQ ID NO: 14445 - protein, 470 aa, Silicibacter pomeroyi DSS-3
MWAALLSLIVFCLYGAAIVCAVQAARTARTPQGAVGWVVFLLTLPWASVPLYMFLGHHRFHGYRIARRESERVVAGLRAHADATAPDPDRVMVNTRPFEKIAHMAVSRGNGARLLVDGEATFAALFAALDAARHYVLIQFYIVRDDDLGLELRDRLIAAAQRGVKVRFLTDAIGSYGLSDNYIEDLRAAGIDIANPRKQRGPNTRFQVNYRNHRKTVVVDGQTGFIGGHNVGVEYLGQDPVMGRWRDTHVQITGPSVLQLQLVFAEDWHWARGEDLLDLLSWETRLDPQDADALIVATGPGDRTESGAMMFFAAITAAERRCWIASPYFVPDLDILAALKHAALRGVDVRLLVPDEADHTIPWLAAFAYFDEVREAGVRVMRYTDGFLHQKVFVVDDTIAAVGTTNLDNRSFRLNFEAMALFFDATVAGQVTAMLEHDFASSTELTRSLAAQPVFIRYGAPLARLFAPIL

SEQ ID NO: 14446 - DNA, 1467 bp, Bacillus clausii KSM-K16
  CDS (1)..(1467): transl_table=11
atgatgattgaatctgcatttgcaataccaacatatttgcttgtcgccctcatgatcgtcaatatcttgcttgccgccattttaatttttattgaacggaaagatgcacaggcgacttgggcatggctgcttattctattttttattccactaggcggctttattatttacattttcctcgggcaaacattaacacggaggaaaatgtttgaatgggaaggaataaaaaaagtaggactcgagcatttcattgaagaacaaaagcgtgaccttttagacacttcgttccgcttttatagccctactgttgataaaaatcgcgaattgatctatatgcatctaatgagcaacgacgcgctgctaacaaaagagaaccgtgtcgatattttcagcgacggcaaagaaaaatttgcgcaattgttaaaggacatcaaacaagccgagacgttcatccacatccagtattatattttccgttacgatgagatcggaaaaacgatcgtggatgcgctgacagaaaaagcgcgccaaggcgtaaaagtccgcttgctctatgatgacctcggttcccggtctttgcgcaaaaagtatttaaaagcgtttcgtgaagcaggcggagaaatcgggatttttttcccatctaggtttacgattgttaacttgcgtttgaacttccgcaaccaccgtaaactcgttaacatagatggcaaatgcggttatgtcggcggctttaacgttggagatgagtatttaggaaaaagcaaaaaatttggctactggcgcgatacccatttgcgtatcgtcgggcctgctgtccaagcgattcaaacacgctttatcttagattggaaccaggcttccaaacaataccatatttcctaccatgatcgttattttccagaagtgcagcctgctggcgatacgcctgtacaaattgtctcaagcggaccagactcggaatttgaacaaatcaaaaatggctatttaaaaatgatcatggatgcgcgaaagtcgattttaatccagacgccttactttattcccgaccaaacgttgcttgatgcccttcgtgtcgctgcacaaacaggcatagaagtaaaactgatgattccaaacaaaccggaccatatgtttgtttactgggcaaccacttcccatattggcgaaatgctaagagctggcgcaacggtctatcagtatgaaaatggctttattcataataaagtgttgatcgtcgatgaaacggtttgttctgtcggtaccgctaacattgatcaacggagctttaagctcaattttgaagtgaatgcctttatttatgacagtcaaatcgctggccagctaatagcggactttgagaatgatgtaaaacactctactcaaattacgccagaaatgtatgaaaacaggccaataagcgtccgctttaaagagtcaatttcacggctgttgtcgccgattttataa

SEQ ID NO: 14447 - protein, 488 aa, Bacillus clausii KSM-K16
MMIESAFAIPTYLLVALMIVNILLAAILIFIERKDAQATWAWLLILFFIPLGGFIIYIFLGQTLTRRKMFEWEGIKKVGLEHFIEEQKRDLLDTSFRFYSPTVDKNRELIYMHLMSNDALLTKENRVDIFSDGKEKFAQLLKDIKQAETFIHIQYYIFRYDEIGKTIVDALTEKARQGVKVRLLYDDLGSRSLRKKYLKAFREAGGEIGIFFPSRFTIVNLRLNFRNHRKLVNIDGKCGYVGGFNVGDEYLGKSKKFGYWRDTHLRIVGPAVQAIQTRFILDWNQASKQYHISYHDRYFPEVQPAGDTPVQIVSSGPDSEFEQIKNGYLKMIMDARKSILIQTPYFIPDQTLLDALRVAAQTGIEVKLMIPNKPDHMFVYWATTSHIGEMLRAGATVYQYENGFIHNKVLIVDETVCSVGTANIDQRSFKLNFEVNAFIYDSQIAGQLIADFENDVKHSTQITPEMYENRPISVRFKESISRLLSPIL

SEQ ID NO: 14448 - DNA, 1197 bp, Bacillus clausii KSM-K16
  CDS (1)..(1197): transl_table=11
atgaatatcctcattacgattctcgccttagtggttgtgattggcgtttggctttatttcgattacaaactgggcctcagagcacttcggaaaaaatcgcaagccacttcaacaggccctcttgcaagcaagattgaattgatcacaaatggtgaagactttatcgataggcttcttgaagacatccagaaggcaaataaacacattcacattcagttttatatttttcgcgatgattatatcggaaaacggatggtagacacattggtcgctaaggcggaggcggggatagacactcgtttgctcattgaccaatttggctgcaagctccggcgagggacaaaaaagcagttacgggctgccggcgttgatgtggcaatagcagcaaaagtgcacggcccgtggtttttcttttccttgaatcgccgcaaccaccgcaagcttgctgtcattgacggtcatacaagctacttaggcggctataacgtcggcgatgaatatttagggcgcaatcccttttttggcttttggcgcgattttcatgtccgtataacgggtgaaggcagccgtgccattcaaacacaatttttggctgactttgaagcggcgactggcaaacatattgaaagaaaatcgtttttcccagacttacaagcgggtagccaaacattgcagtttataagcacacaagggatggagtttgaacaaacactgcttaagcttattcgtagcgctaaaaacagcttaatcatcggcagcccttattttatcccgacacgggccgtaatggatgccatcattgacgtggcgcaaagaggcgtcttcgtttccttaatcctccctgaaaaagcagatcatccccttgttaagcatggggccactccttatgtaattgaagcgctacaggcaggtgtgcttgtctaccactattatcgaggattttatcatgttaaagcggtagtagccgatcaatctacatgtttagtggggacgccgaatatcgataaacgcagttttcatctaaacgatgaaatgtcatgcttaacccatgaccagacatttattgaaacagttctcgctgtgctccatgctgatatgcacgcttccatgactgttacaatcgaacagctccagaagcgcccactccttgaccgtgtgaaagaagttaccgcagcccccctttcaccattgctgtga

SEQ ID NO: 14449 - protein, 398 aa, Bacillus clausii KSM-K16
MNILITILALVVVIGVWLYFDYKLGLRALRKKSQATSTGPLASKIELITNGEDFIDRLLEDIQKANKHIHIQFYIFRDDYIGKRMVDTLVAKAEAGIDTRLLIDQFGCKLRRGTKKQLRAAGVDVAIAAKVHGPWFFFSLNRRNHRKLAVIDGHTSYLGGYNVGDEYLGRNPFFGFWRDFHVRITGEGSRAIQTQFLADFEAATGKHIERKSFFPDLQAGSQTLQFISTQGMEFEQTLLKLIRSAKNSLIIGSPYFIPTRAVMDAIIDVAQRGVFVSLILPEKADHPLVKHGATPYVIEALQAGVLVYHYYRGFYHVKAVVADQSTCLVGTPNIDKRSFHLNDEMSCLTHDQTFIETVLAVLHADMHASMTVTIEQLQKRPLLDRVKEVTAAPLSPLL

SEQ ID NO: 14450 - DNA, 1482 bp, Staphylococcus aureus subsp. aureus COL
  CDS (1)..(1482): transl_table=11
atgcgatttacattttcaaacgatttaggaacgttatttactattattttagccattggattcatcattaatttagtattggcttttattattatctttttagaaagaaataggcgtacagcgagttcaacttgggcatggctatttgtactttttgtcttaccattgattggttttattctttacttgttttttggtagaaccgtttcggcacgcaaattgaataaaaacaatggtaacgtgttaacggatttcgatggacttttaaaacaacaaatagaaagctttgataaaggtaattatggtactgataacaaacaagttcaaaaacatcatgatttagtacgtatgcttttgatggatcaagatggttttttaactgaaaataataaagttgatcatttcattgatggaaatgatttatatgatcaagttttaaaagatattaaaaatgcaaaagaatatatccatttagagtactatactttcgctttagatggtttaggtaaaagaattttacatgctttagaagaaaaattgaaacaaggtctagaagtaaaaatattatatgatgatgttggatctaaaaatgttaagatggcaaattttgatcattttaaatcgttaggtggagaagttgaagcattttttgcttcaaaattaccgttattgaatttcagaatgaataatagaaatcatagaaaaatcatcgtaatcgatggtcaactaggttatgtcggaggatttaacattggtgatgaatatctaggattaggaaaattaggatattggagagatacgcatttacgtatacaaggggatgcggttgatgcactgcagttgcgatttattttagactggaattcgcaagcgcaccgtccacaatttgaatatgatgttaagtatttccctaaaaagaacggaccattgggcaattcaccaattcaaatagctgcaagtggcccggctagtgactggcatcaaattgaatacggttatacaaaaatgattatgagtgcaaagaaatctgtatatttacaatcaccatatttcattccggataattcatatataaatgccattaaaattgctgctaaatcaggtgtagatgtacatttaatgattccatgtaagccagatcatccattagtatattgggcgacattttcaaatgcctctgacttattatcaagtggtgttaaaatttatacgtatgaaaatggatttatacattctaaaatgtgcttaattgatgatgaaatcgtatcagtgggcacagcaaatatggactttagaagttttgaattaaattttgaagtaaatgcctttgtatatgatgaaaatcttgctaaagatttaagggtggcttatgaacatgatattacaaaatcaaaacaactaaccaaagaatcatatgccaatagaccgctgtctgttaaattcaaagaatcgttagcaaaattagtttcgccaattttataa

SEQ ID NO: 14451 - protein, 493 aa, Staphylococcus aureus subsp. aureus COL
MRFTFSNDLGTLFTIILAIGFIINLVLAFIIIFLERNRRTASSTWAWLFVLFVLPLIGFILYLFFGRTVSARKLNKNNGNVLTDFDGLLKQQIESFDKGNYGTDNKQVQKHHDLVRMLLMDQDGFLTENNKVDHFIDGNDLYDQVLKDIKNAKEYIHLEYYTFALDGLGKRILHALEEKLKQGLEVKILYDDVGSKNVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATFSNASDLLSSGVKIYTYENGFIHSKMCLIDDEIVSVGTANMDFRSFELNFEVNAFVYDENLAKDLRVAYEHDITKSKQLTKESYANRPLSVKFKESLAKLVSPIL

SEQ ID NO: 14452 - DNA, 2016 bp, Xanthomonas oryzae pv. oryzae KACC10331
  CDS (1)..(2016): transl_table=11
gtgaagtgcctgttgagggttctcgtgctggcaacggtgttgctcggcaccggatgcgccagcctgtcgcaaaccgaacgcaaccgtgctgccggcgtcgccgctgcggcacgcagtaccgtggtgaattgcacccaggccaatcgttgcgcgcaaccttcgccgctgcgcgcgctgggcggcgaggcgatcaccgcctccacaccggcggcgccgcggcactacgccaccatcgtcgaccacggcgaagaatcgctggtggctcggctcaatctgatccgcagcgctacccgcagcatcgacctgcagacctatatcttcgacaaggacgacagcgcgcgcatgatcatggacgcgctgatggacgccgcgcaacgcggcgtcaaggtgcgcatcctgatcgatcagctgtcggcgatcgccgatctgcagattctcggtgcgctggccagcagccacgaaaacctgcagctgcgcatctacaaccccaccttcggcaaggtcaaactcaactacttcgactatgccggcagtgtgctgtgctgcttccgtcgcttcaatcagcgcatgcacaacaagctgttggtggtggacgacgtgctcggtgtggtcggcgggcgcaattaccaggacgactattacgagtgggacagcgagtacaactttcgcgaccgcgacgtgattctggccggtccggaagttcgtgcgatggccgctaatttcgatgcgttctggcgtgcccggcgcagtgtgccggccgagcgtttgaacgatgtcgggcgcgtgctgctggagcagggcgtaccgcagatgccgccagcgaacttccgccggcccgaccgggtggcgcgtgtggatcgcgaagcgcgcgatccgcagttcgtacgcgatgccttcgtgaccccggccatgccggtgcagcgtgtgctgtatgtggccgatctgccgcaaaagcaccgcaaggaacatgctgccaaggcggtttccacggcgccggaactggatggcctgattgccggcgcgcagcaggaagtgctgctgcagacgccgtatctggtgttgtccgacgcggcgcaggcgatctttcgcacgctgcgcacgcacccgcagccgccgcgcatcgtggtgtcgaccaatagcctggccgccaccgacaatcccatcgtgtatgcgctgtcgtacaagttcaaacgccgcaacatgcgcgagctgggcttcaacatctacgagttcaagccgttcccgctcgatgttccggtggattacgccaacctggtgccggatacactcaaccctgcttccgacatcaacgaagacagccgcaccaatcgcctgatcggcggcagtgcggccggcaatgcgatgcgcggcagcagcggtgcagacgggaacacaagcgcacgtgctggcagcgtgctacgcggcagcggtggccgcgcgccgggcggtagcgaggttgatcggcgcgtgctgcgtaccgaaacgagaccctcgttcctgggcacgcgtgcggtcaacaagccgctgccggtgacccgcgccggtgcgcgcatgggcttgcatgccaagtcgctggtggtggatcgccgcatcggcgtgatcggcacgcacaacttcgacccgcgcagcgagaactacaacaccgaagcggccgtggtgatcgacgacgcgcgctttgcgcaggcgctggccgccagcatcgaacgcgatatgtcgccggaaaacgcctggacggtggccccgcgcgaaaagccgccgatgttgagcggattgaactacagcgtgggtaaagtttccgaagccttgccggtgctggacttctggccgtggcgctacgccaccaattacgagttccagcccggcccggattgcttgttcccgctcaagcgccaggatacgcagttccgtaagtgctacgtcgcggtgggcgacttcccggaggtcaatgtcggcccgaagtggcttttggtacgcatgctcaccgccttcggcgccgggctggtgccgattctttga

SEQ ID NO: 14453 - protein, 671 aa, Xanthomonas oryzae pv. oryzae KACC10331
MKCLLRVLVLATVLLGTGCASLSQTERNRAAGVAAAARSTVVNCTQANRCAQPSPLRALGGEAITASTPAAPRHYATIVDHGEESLVARLNLIRSATRSIDLQTYIFDKDDSARMIMDALMDAAQRGVKVRILIDQLSAIADLQILGALASSHENLQLRIYNPTFGKVKLNYFDYAGSVLCCFRRFNQRMHNKLLVVDDVLGVVGGRNYQDDYYEWDSEYNFRDRDVILAGPEVRAMAANFDAFWRARRSVPAERLNDVGRVLLEQGVPQMPPANFRRPDRVARVDREARDPQFVRDAFVTPAMPVQRVLYVADLPQKHRKEHAAKAVSTAPELDGLIAGAQQEVLLQTPYLVLSDAAQAIFRTLRTHPQPPRIVVSTNSLAATDNPIVYALSYKFKRRNMRELGFNIYEFKPFPLDVPVDYANLVPDTLNPASDINEDSRTNRLIGGSAAGNAMRGSSGADGNTSARAGSVLRGSGGRAPGGSEVDRRVLRTETRPSFLGTRAVNKPLPVTRAGARMGLHAKSLVVDRRIGVIGTHNFDPRSENYNTEAAVVIDDARFAQALAASIERDMSPENAWTVAPREKPPMLSGLNYSVGKVSEALPVLDFWPWRYATNYEFQPGPDCLFPLKRQDTQFRKCYVAVGDFPEVNVGPKWLLVRMLTAFGAGLVPIL

SEQ ID NO: 14454 - DNA, 1419 bp, Xanthomonas oryzae pv. oryzae KACC10331
  CDS (1)..(1419): transl_table=11
atgctgcccgattgggtgacaggcacttggctgctggcactggactgggcgatccgtctggctgcattgctatggattcccgcccgcaccacgccggatgcggcgcgcagctggctgctgttgatcggcttcgtgccggtggtcggcctgccgctgtatctgctgttcggccacccatggttgtcgcggctgcgggtggagcggcaagccaccgcctcgcaggtgattcgcgagcagcaactgccactgcacgcgctgcgctggaccccgcaggcagacaccagcagtgccgaagtggtgccgctgatcgagcgcgaaggcgatttcatgccgacgctgggcaatgcggtggagttgctcgacgactacgcgcactccttgcaaaccctgatcgcggcgatcgacgcggccgaaaaacgcgtgcacttgttgtactacctgatgttcgacgatgcggtgggcgaggcggtggtggcggcgctggaacgcgccagtgcgcgcggcgtgcgctgccgtgtgctgctggatgcggtgggcgccaagcgcggcctgcgtcgctacagcaagcgcctgcaggacggtggcgtgcaggtgctggcggtattgcccggcggcctgccctggcgtcgcagtgggcgcatggatctgcgcaaccatcgcaagattgcggtgatcgacaaccagatggcgtttgtcggctcgcagaatctggccgaggccggcttcatcgatggcgtgcccaatcgcgaattggtggcacgcgtgcgcgggccggtggtcaatcatcttgaagcggtgttcgccagcgactggttcaccgaaaccggcgagcgcctggacgtctggccggacgcgccggtgtgcgaggccaatatcgccacgcaattgctgcccagcgggccggcgtatccgttcgacaatgcgcgcgatgcgatcaatgcgatgatccatctggcgcggcgcaaggtggtgctggtgacgccgtacttcgtgcccgacgaggccttgctgagcgcgttgcgcattgccggcgtctcgggtgtggatgtgcagttgattttgtcggagagcaacaaccagcgcctggccgcgtgggcgcaggaagcctatttcgaagaactgctgcggtgtggggtgaagattgcgctgtatcgcccgcattttctgcatgccaagcacctgagcatggacgagaacattgcgctggtcggctcgatcaatctggacatccgttcgttcgcgctcaacgccgagatcggcatgctctgctacgacactggcgtggtgcagcggctgcgcgagatcgaacaggactatttggccaatgcgcggcaattggagctggatcagtggcgccgccgcccggcctggcgtcgcagccgcgagggcattgcgcggctggccgatgcgttgatgtag

SEQ ID NO: 14455 - protein, 472 aa, Xanthomonas oryzae pv. oryzae KACC10331
MLPDWVTGTWLLALDWAIRLAALLWIPARTTPDAARSWLLLIGFVPVVGLPLYLLFGHPWLSRLRVERQATASQVIREQQLPLHALRWTPQADTSSAEVVPLIEREGDFMPTLGNAVELLDDYAHSLQTLIAAIDAAEKRVHLLYYLMFDDAVGEAVVAALERASARGVRCRVLLDAVGAKRGLRRYSKRLQDGGVQVLAVLPGGLPWRRSGRMDLRNHRKIAVIDNQMAFVGSQNLAEAGFIDGVPNRELVARVRGPVVNHLEAVFASDWFTETGERLDVWPDAPVCEANIATQLLPSGPAYPFDNARDAINAMIHLARRKVVLVTPYFVPDEALLSALRIAGVSGVDVQLILSESNNQRLAAWAQEAYFEELLRCGVKIALYRPHFLHAKHLSMDENIALVGSINLDIRSFALNAEIGMLCYDTGVVQRLREIEQDYLANARQLELDQWRRRPAWRRSREGIARLADALM

SEQ ID NO: 14456 - DNA, 1548 bp, Vibrio fischeri ES114
  CDS (1)..(1548): transl_table=11
atgtcagtgcttaaacgcattcatgtcactctattttttgtcgctattctttctggctgtggttcgcttcctaatgaaattgaacacacgaacgaatcggtatcagcaccattaagcagttcgctttctgagttaagtgcttctttccaaacagttccctcaacagcagaaaccagtgctgttttgttgcaagattcgggatgggatgcattagcgcaacgtttagcattaattgagactgcagagcacagcattgatatccaatattatatttggaactcagacgcttcaggtcattaccttgccagtcgtttattagcggcggcagatcgtggtgttaaagtgcgtgtcatgctggatgatatcaatctcaatgaacgtgaagatctacttgtggcattaaacgcgcatcctcacgttgagatacgagtatttaaccctattcccactcgccgtggcgttacaaagtgggtgaacttcttaggggatttttctcgtttaaatcgtcgtatgcacaataaatcattcaccgttgatggcgtgttctctgttgttggtggacgtaatattggtgatgagtattttgatctttctaacgagattaactttcgagaccgtgatgtgttagttcgaggttctgtcgtttatgatatacaaaccagctttatcgagtattgggacagccgttggtcttaccctgtggatttattagcaaaagaagcttcgcaagaaccactcttacaaaaacaaccagtattagatgagattgatgcacctgtttataaaaactacccagctttaccagagggaaataaaacagcgcatcaatacttaactaatctaatggataaaatgacttgggttaatgctaagttcgtatttgatcgcccagtaccgcttgataaagacaataccgatgagcctaaagagaccgcaaaagccctcggcaaattggccagtgaatccaagaaagagatcttattagaatcggcttaccttatttttgatgataaccaacttaaagggtggcaagcgcttattaatacaggtgttgagataaaagcgcttaccaactcaatggcatcgaacgatttaaccactaaccactcaggttacgcaggtcgccgtcaagatatgcttgagcacggcattcaactttatgaattaaagcctgaaacagagctatgtgaagagtcgaccaaagacgtttctaaatgtgcaccaatattaccttatggacttcacgccaagtccgcagtttttgatgacaaaatcgcaagtatcggctcttttaacttcaatttgcgttcaacgtacttgaatacagaatcgattttaattattgaaaatcaaaaaatcgcagagcaactcactcaagatattgaacacgccatggatgaagaaaatagttggcacctaaaactgcaagaaggggatgttcgttggtattctggtgataaaagttgggaaagtgaaccagaaactgggcgttgggagcgatttcaatctggattcttacagttattaccaatagaaaagtatttgtga

SEQ ID NO: 14457 - protein, 515 aa, Vibrio fischeri ES114
MSVLKRIHVTLFFVAILSGCGSLPNEIEHTNESVSAPLSSSLSELSASFQTVPSTAETSAVLLQDSGWDALAQRLALIETAEHSIDIQYYIWNSDASGHYLASRLLAAADRGVKVRVMLDDINLNEREDLLVALNAHPHVEIRVFNPIPTRRGVTKWVNFLGDFSRLNRRMHNKSFTVDGVFSVVGGRNIGDEYFDLSNEINFRDRDVLVRGSVVYDIQTSFIEYWDSRWSYPVDLLAKEASQEPLLQKQPVLDEIDAPVYKNYPALPEGNKTAHQYLTNLMDKMTWVNAKFVFDRPVPLDKDNTDEPKETAKALGKLASESKKEILLESAYLIFDDNQLKGWQALINTGVEIKALTNSMASNDLTTNHSGYAGRRQDMLEHGIQLYELKPETELCEESTKDVSKCAPILPYGLHAKSAVFDDKIASIGSFNFNLRSTYLNTESILIIENQKIAEQLTQDIEHAMDEENSWHLKLQEGDVRWYSGDKSWESEPETGRWERFQSGFLQLLPIEKYL

SEQ ID NO: 14458 - DNA, 1455 bp, Vibrio fischeri ES114
  CDS (1)..(1455): transl_table=11
atggataaattttatcaagcacttacaattgttagcttcgttttatattggcttctcgtagcaggcgtaacaattcgtgttgttttcaaaccaagacccgtaggcgtatcattagcttggcttatgattatttacattcttcctgttattggggtcatggcttattttttaattggtgagcttaacttaggtcgaactcgtggtgaacgtgcacgagctatgtttacgccttatgaacagtggtttgcacaaattcatcattgccaatatcaccaaccacattcgatttcccatcgtatctcagcgattcacaatttatgctctaatcgcctcgggatccctgcattaagtggcgatacactctcgctattaaataccccttcagaaattctcaatgcgattatttctgatatagaaaaagccgaacatgaaataaatatggagttttatatttggcatcacggtgggctggctgacagtgttgcaagcgcactaattgtagctgcaaaacgaggcgtaactgtcaatgtgctgcttgactccgcaggtagtatggatttttttaagagtcactggcctaaattactcaagcaatccggtgtcaacattgtagaagctctaagtgttagtccatttcgtatgttctttcgacgcctagatctacgcttgcatcgaaaaattgttgtgattgataaccgtatcgcttataccggctcaatgaacctagttgatccacagtacttcaaacaaaactcaggtgttggccaatggattgacgtaatggttcgccttacaggacctaatgtcgctattttaaatactattcatgcgtgggattgggaagttgaaacgggtattcgcgagctacctcatttaccggagtgccctgcctctattgacccatttaatcatacaactcaagtggttccttctggcccaggtatgccagatgacattattcagcaagtgcttattactgctatttgccaagcaagaaaatccattaccatcaccacgccgtattttgtgcctagtgagattttattgcacaccttaagaaccactgcacaccgcggtgttgaagtgaaactcatactgcctaagaaaaatgactcattaatggtgaactgggcatcaaaatctttttttgaaaccctcttaaaagccggagttcaaatacatgaatttaatggtggtttattacatacaaaatcggtcgttattgatgaaagccattgtattattggaaccgtaaacttagatatgcgcagcttctggctcaactttgaagtaagtttgatcgtcgatgatcctgagtttacaaaacaattatcatgggttttagatggctacctagagcaatcaactcaagtctgttttgatacatggcgtcatagaagttggggaaatcgctttaccgaacgattcttctctatgttcagcccattactctaa

SEQ ID NO: 14459 - protein, 484 aa, Vibrio fischeri ES114
MDKFYQALTIVSFVLYWLLVAGVTIRVVFKPRPVGVSLAWLMIIYILPVIGVMAYFLIGELNLGRTRGERARAMFTPYEQWFAQIHHCQYHQPHSISHRISAIHNLCSNRLGIPALSGDTLSLLNTPSEILNAIISDIEKAEHEINMEFYIWHHGGLADSVASALIVAAKRGVTVNVLLDSAGSMDFFKSHWPKLLKQSGVNIVEALSVSPFRMFFRRLDLRLHRKIVVIDNRIAYTGSMNLVDPQYFKQNSGVGQWIDVMVRLTGPNVAILNTIHAWDWEVETGIRELPHLPECPASIDPFNHTTQVVPSGPGMPDDIIQQVLITAICQARKSITITTPYFVPSEILLHTLRTTAHRGVEVKLILPKKNDSLMVNWASKSFFETLLKAGVQIHEFNGGLLHTKSVVIDESHCIIGTVNLDMRSFWLNFEVSLIVDDPEFTKQLSWVLDGYLEQSTQVCFDTWRHRSWGNRFTERFFSMFSPLL

SEQ ID NO: 14460 - DNA, 1578 bp, Neisseria gonorrhoeae FA 1090
  CDS (1)..(1578): transl_table=11
atgcatacagaccccaaaatacaggcaatgccgtctgaaactatatccccgatgaaaacacgcagcctcatttcccttttatgcctccttctctgttcatgttcttcatggttgcccccactggaagaacggacggaaagccgtcattttaatacttccaaacctgtcctcctggacaacatcctgcaaatccggcacacccctcataacaacgggctatccgacatctacctgctcgacgacccccacgaagcctttgccgcccgcgccgcccttatcgaatctgccgaacacagcctcgatttgcaatactacatttggcgcaacgacatttccggcaggctgctgttcaacctcatgtaccttgccgcagaacgcggcgtgcgcgtacgcctgctgttggacgacaacaacacgcgcggcttggacgatctcctgctcgccctcgacagccatcccaatatcgaagtgcgcctgttcaaccccttcgtcctacgcaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgacctggacatcctcgccaccggcagcgtcgtcggcgaagtatcgcacgacttcgaccgctactgggcaagccattccgcccacaacgccacgcgcatcatccgcagcggcaacatcggcaagggtcttcaagcactcggatacaacgacgaaacatccagacacgcgctcctgcgctaccgcgaaaccgtcgaacagtcgcccctctaccaaaaaatacagacgggacgcatcgactggcagagcgtccaaacccgcctgatcagcgacagccctgcaaaaggactcgaccgcgaccgccgcaaaccgccgattgccgggaggctgcaagacgcgctcaaacagcccgaaaaaagcgtctatctggtttcaccctatttcgtccctacaaaatccggcacagacgcactggcaaaactggtgcaggacggcatagacgttaccgtcctgaccaactcgctacaggcgaccgacgttgccgccgtccattccggctacgtcaaataccgaaaaccgctgctcaaagccggcatcaaactctacgagctgcaacccaaccatgccgtccccgccacaaaagacaaaggcctgaccggcagctccgtaaccagcctgcatgccaaaaccttcattgtggacggcaaacgcatcttcatcggctcattcaacctcgacccccgttccgcacggctcaataccgaaatgggcgtcgtcatcgaaagccccaaaatcgcagaacagatggagcgcaccctcgccgataccacacccgaatacgcctaccgcgttaccctcgacaaacacaaccgcctgcaatggcacgatcccgccacccgaaaaacctacccgaacgaacccgaagccaaactttggaaacgcatcgccgcaaaaatcctatccctgctgcccatcgaaggtttattatag

SEQ ID NO: 14461 - protein, 525 aa, Neisseria gonorrhoeae FA 1090
MHTDPKIQAMPSETISPMKTRSLISLLCLLLCSCSSWLPPLEERTESRHFNTSKPVLLDNILQIRHTPHNNGLSDIYLLDDPHEAFAARAALIESAEHSLDLQYYIWRNDISGRLLFNLMYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDSPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPEYAYRVTLDKHNRLQWHDPATRKTYPNEPEAKLWKRIAAKILSLLPIEGLL

SEQ ID NO: 14462 - DNA, 1440 bp, Bacteroides fragilis NCTC 9343
  CDS (1)..(1440): transl_table=11
atgatagattggaactacatagcaagtgtaatagctaccgttgcctttgatattatttatttcggggctattatcggtacgattgtcatcgtgattctcgacaatcgtaatccggtgaagacaatggcatggattctgatcctgatgtttcttccggttgtagggttggttttctatttcttttttgggcgtagccaaaggcgtgagaagattatcggtaagaaaagttatgaccgtttgcttaaaaaaccgatggcagagtatttggcgcagaactgctgtgaaacgccgaaggaatatgcacggctgatacagctgttccagaatacgaaccaggcttttccgtttgagggaaatcgggtcgatatttacactggcggatattctaaactacaagctctgttgagagagctgcaaaaggcgaggcttcatattcatatggaatattacatctttgaggatgatcctgtgggacgattggtacgtgatgtactgatcgagaaagcgcgggagggagtcgaggtgcgtgtgatctatgacgatgtaggatgttggcatgttcctcatcgctttttcgaagagatgagagatgcaggaattgaggtacgcagttttttgaaggtccgttttcccttgttcacgagtaaagtgaattatcgcaatcaccggaagattgtggtgattgacggacgtattggatttatcggtggaatgaatcttgccgaacgttatatgcgtggcttttcgtggggaatctggagagatacgcatatattgcttgaaggaaaagcggtacatggtcttcagactgcttttttgctcgattggtatttcgtggatcgcactctgatcactgcttcgcgctactttcctaagatagaagcttatggcaattctttggtacagattgtgacaagtgaaccgatcggtccctggaaagagattatgcaagggttgacagtagccatatccggtgctaagaaatatttctatatgcagacgccttacttcttacctaccgaacaaattttgggtgcaatgcagactgctgcattggcaggagtagatatccggttaatgttgcctgagcatgcggataatcgtgttacacatttgggctcctgttcttatctggcagatgtattgcgtgcaggagtcaaggtctatttttataaaaagggtttcctgcattctaaattaatggtttcggatgatatgctttcgacagtggggtctaccaatctcgatttccgtagttttgaacataattttgaagtaaatgcctttatgtacgatatggagacagcattgcagatgcgggagattttcttgcaggatcagcgggaaagtactcagattttcctgaagagctgggaaaaacgttcttcgcgtcagaaggcaatggagtctgtagttcgattattggctccgttgctataa

SEQ ID NO: 14463 - protein, 479 aa, Bacteroides fragilis NCTC 9343
MIDWNYIASVIATVAFDIIYFGAIIGTIVIVILDNRNPVKTMAWILILMFLPVVGLVFYFFFGRSQRREKIIGKKSYDRLLKKPMAEYLAQNCCETPKEYARLIQLFQNTNQAFPFEGNRVDIYTGGYSKLQALLRELQKARLHIHMEYYIFEDDPVGRLVRDVLIEKAREGVEVRVIYDDVGCWHVPHRFFEEMRDAGIEVRSFLKVRFPLFTSKVNYRNHRKIVVIDGRIGFIGGMNLAERYMRGFSWGIWRDTHILLEGKAVHGLQTAFLLDWYFVDRTLITASRYFPKIEAYGNSLVQIVTSEPIGPWKEIMQGLTVAISGAKKYFYMQTPYFLPTEQILGAMQTAALAGVDIRLMLPEHADNRVTHLGSCSYLADVLRAGVKVYFYKKGFLHSKLMVSDDMLSTVGSTNLDFRSFEHNFEVNAFMYDMETALQMREIFLQDQRESTQIFLKSWEKRSSRQKAMESVVRLLAPLL

SEQ ID NO: 14464 - DNA, 1275 bp, Bacteroides fragilis NCTC 9343
  CDS (1)..(1275): transl_table=11
ttgaaattatacgttttaataatagcgatcattctctctataggcactgcccgaacacagaatattgacagcctgttgatgcagcgggaggacaccacacaattcatccgaagcgactccctcgtgttacaatttctggaatactcgaatatccccataaccgataataataaggtgaaacttatcaaaagcggacgggaaaaatttgaggacttgttcgaagccatccgtggggcaaaacaccacattcatctggaatattttaattttcgcaatgactccatagccaatgcactgttcgacctgctaggcgaaaaagtgaaggaaggtgtcaaagtaagggcgatgttcgatgcattcggtaactggtcgaacaacaaaccactcaagaaaaggcatctgaaagcaatccgggagaaaggaatcgaaatcgtaaaattcgatccgttcaagttcccgtatatcaatcatgcggctcaccgcgaccatcggaagattgcagtcatcgacggcaaaataggatataccggcggaatgaatattgccgactattatatcaacggactccccaagataggcacctggcgcgatatgcatatccgcattgaaggcgatgcggtaaacatccttcaagaaatcttcctcgacatctggaataaaaccaccaagcaaaacatcgtgggcgaagaatattttccgaaccacccggagcgggccgacagctgcaatacggtcatttcgattgtagaccgcactccgaaacggaattcccgcatgttgagccatacgtatgccatgtccatctatgcagcgcaacatgatgtacgcatcgtgaacccgtatttcgtaccgacttcatccatccgcaaggcactcaaaagggctttgaaccgggggacgaaagtggaaattatgatttcttccaaatccgacatccctttcacaccggatgcttcgctctatgccgtacagaaactgatgaaaaaaggggcaatgatctatttgtacaacggcggatttcatcactcgaaaatcatgatggtggacgacctgttctgtaccgtgggtacagccaacctgaacagccgcagcctgcgatatgattacgaaacgaatgcgttcatcttcgacaaggacattacgcaacaactgaatgacgttttcgaagccgacatgctgcactgcacccgcctgaccccggaaatgtggaaacaaaaatcagcctggaagaagtttaagtgctggtttgcgaacttattcacaccattcctgtaa

SEQ ID NO: 14465 - protein, 424 aa, Bacteroides fragilis NCTC 9343
MKLYVLIIAIILSIGTARTQNIDSLLMQREDTTQFIRSDSLVLQFLEYSNIPITDNNKVKLIKSGREKFEDLFEAIRGAKHHIHLEYFNFRNDSIANALFDLLGEKVKEGVKVRAMFDAFGNWSNNKPLKKRHLKAIREKGIEIVKFDPFKFPYINHAAHRDHRKIAVIDGKIGYTGGMNIADYYINGLPKIGTWRDMHIRIEGDAVNILQEIFLDIWNKTTKQNIVGEEYFPNHPERADSCNTVISIVDRTPKRNSRMLSHTYAMSIYAAQHDVRIVNPYFVPTSSIRKALKRALNRGTKVEIMISSKSDIPFTPDASLYAVQKLMKKGAMIYLYNGGFHHSKIMMVDDLFCTVGTANLNSRSLRYDYETNAFIFDKDITQQLNDVFEADMLHCTRLTPEMWKQKSAWKKFKCWFANLFTPFL

SEQ ID NO: 14466 - DNA, 1242 bp, Salmonella enterica subsp. enterica serovar Choleraesuis str
  CDS (1)..(1242): transl_table=11
atgaaatgcggctggcgtgaaggtaatcaaattcagctactggaaaacggcgaccagttctatcctgccgtgtttgaggctatcgctcaggcacagcaaaaaatcattctggaaacctttatcttgtttgaagatgaggtgggtaaaaaactccatgccgctctgctaaaagccgcacagcgcggcgtaaaagccgaagtattactcgacggctacggctctcccgatctcagcgacgcgtttgtcggcgaactgacctcagcgggcgtgatttttcgctattacgacccccgcccgcgtctactggggttgcgaaccaatatcttccgccgaatgcaccgcaaaattgtggtgattgatgatcgtattgcctttgtcggcggcattaactactccgccgaacatatgtcggattacggcccgcaggcgaaacaagactacgcggtacgggtcgaagggcctgtcgtggccgatatcctgcaattcgaagtcgagaatctgccggggcaaagccccgcgcgccgctggtggaaacgccatcatcaggccgaagaaaaccgccaccccggcgaagcgcaggcgctgtttgtctggcgagataacgaagagcaccgcgacgatatcgaacgtcattatctgaaaatgctgacccaggcaaagcgtgaagtgattatagctaacgcctattttttccccggctatcgcttgctccacgcaatgcgtaaagccgcccgccgtggcgtgagcgtaaaactgattgtccagggggaaccagacatgccgatagtcaaagtcggcgcgcggttgctctataactatctggtgaagggcggcgtgcaggtttatgaataccgacgacgtccgctgcatagcaaagtggcgctgatggacgatcactgggccacggtagggtcgagtaatctcgatccgctcagcctgtcgcttaaccttgaagctaacctgatcattcacgatcgtacttttaaccagaccctgcgcgataacttacaaggcatcatcgtgaacgattgtaagcaggtcgatgagtctatgctgccgaaacgcacctggtggaacctgaccaaaagcgtgctggcgttccactttttacgtcatttcccggcgctggtcggctggctacctgcgcataccccgcatctggcgcaggttcccccgcctgcccagccagaaatggaaacccaggatcgcgttgatccagaaaatacaggagtgaagccctaa

SEQ ID NO: 14467 - protein, 413 aa, Salmonella enterica subsp. enterica serovar Choleraesuis str
MKCGWREGNQIQLLENGDQFYPAVFEAIAQAQQKIILETFILFEDEVGKKLHAALLKAAQRGVKAEVLLDGYGSPDLSDAFVGELTSAGVIFRYYDPRPRLLGLRTNIFRRMHRKIVVIDDRIAFVGGINYSAEHMSDYGPQAKQDYAVRVEGPVVADILQFEVENLPGQSPARRWWKRHHQAEENRHPGEAQALFVWRDNEEHRDDIERHYLKMLTQAKREVIIANAYFFPGYRLLHAMRKAARRGVSVKLIVQGEPDMPIVKVGARLLYNYLVKGGVQVYEYRRRPLHSKVALMDDHWATVGSSNLDPLSLSLNLEANLIIHDRTFNQTLRDNLQGIIVNDCKQVDESMLPKRTWWNLTKSVLAFHFLRHFPALVGWLPAHTPHLAQVPPPAQPEMETQDRVDPENTGVKP

SEQ ID NO: 14468 - DNA, 1587 bp, Salmonella enterica subsp. enterica serovar Choleraesuis str
  CDS (1)..(1587): transl_table=11
atggctatccacgcgcctaggccgctgaagtcgccgtcaggacggtttcagattttattacccgttacgctctgcctgaacaggtatactttgtctgttatgatgaagaaactgcccggctttacgcaagattacttactcagcaaggcgacgaccctgcctgataaaacacgcctggagcgtgccgttgaaccgctatgcgcgcgccatcccggagagtgcggcattctcgcgctggataacagtctggacgcttttgccgcccgctaccgcctgaccgaaacggcggcgcggacgctggatgtgcagtattatatttgggaagacgatatgtccgggcggctgctcttttcggtactgctgtcggcggcgaagcgcggcgttcatgttcgtctgctgctggatgataacaatacgcctggtctggatgatacgttgcgcttgctggatagccatcctaatatcgaagttcgtctgtttaatcctttctcttttcgtacgctacgcgcgctgggatatttgacggattttgcgcggctgaatcggcggatgcacaataaaagttacactgctgacggcgtagtgacgctggtcggtgggcgcaacatcggcgatgcctatttcggcgctggcgaggagccgctattttccgatctggacgtgatggccattggcccggtggtcaatgatgtcgccaatgattttgaacgttactggcgctgtagttcagtgtcgacattgcagcaagtattatccctttctgagcaggaactgacgcagcgtatcgaacttcccgaatcctggtataacgatgagatcacccgccgttatctgcataagctggaaaccagccagtttatggcggatctcgatcgcggaaggttgccgctgatttgggcaaaaacacgcttgcttagcgatgacccttctaaaggcgaggggaaggcgcagcgccattcgcttcttccgcagcgattatttgacgtgatggggtcgccgacggagcgtatcgacattatttccgcttactttgtccctacgcgcgcaggcgtggcgcagttgcttaatctggtcaggaaaggcgtgaagatcgccatcttaactaactctctggcggccaacgatgtggcggtcgttcacgcagggtacgcgcgctggcgcaagaaattactgcgctatggcgtggagctctacgaactgaaaccgacccgcgaacatgaaaccgccgtacatgatcgcggactcaccgggaactcaggttccagcttacatgctaaaacgttcagtattgatggtagtaaggtgtttatcgggtcgcttaattttgatccccgttcaacgcttttaaataccgaaatgggctttgtcattgaaagtgaaacgctggcgacgcttattcataagcattttacgcagagccaacgcgatgcggcctggcaactgcggctggatcgctggggacgaattaactggatcgatcgtcagcaagaagaggaaaaggtgttaaagaaagaacccgctacgcgtttctggcagcgagttctggtacggttggcggcaattttacctgtggaatggttgctgtga

SEQ ID NO: 14469 - protein, 528 aa, Salmonella enterica subsp. enterica serovar Choleraesuis str
MAIHAPRPLKSPSGRFQILLPVTLCLNRYTLSVMMKKLPGFTQDYLLSKATTLPDKTRLERAVEPLCARHPGECGILALDNSLDAFAARYRLTETAARTLDVQYYIWEDDMSGRLLFSVLLSAAKRGVHVRLLLDDNNTPGLDDTLRLLDSHPNIEVRLFNPFSFRTLRALGYLTDFARLNRRMHNKSYTADGVVTLVGGRNIGDAYFGAGEEPLFSDLDVMAIGPVVNDVANDFERYWRCSSVSTLQQVLSLSEQELTQRIELPESWYNDEITRRYLHKLETSQFMADLDRGRLPLIWAKTRLLSDDPSKGEGKAQRHSLLPQRLFDVMGSPTERIDIISAYFVPTRAGVAQLLNLVRKGVKIAILTNSLAANDVAVVHAGYARWRKKLLRYGVELYELKPTREHETAVHDRGLTGNSGSSLHAKTFSIDGSKVFIGSLNFDPRSTLLNTEMGFVIESETLATLIHKHFTQSQRDAAWQLRLDRWGRINWIDRQQEEEKVLKKEPATRFWQRVLVRLAAILPVEWLL

SEQ ID NO: 14470 - DNA, 1581 bp, Pseudomonas syringae pv. syringae B728a
  CDS (1)..(1581)
atgaataactcatgggccttgcccttttgcttgctggttgcgttgtgcgtcagcggttgcgcgcatcaacaggtcaccagtgagccaagccaggccatgccgtcttcaggttccgcgttcggccgttcgatccaggcaatggccgtgccgcatgagggacgttctggcttccgcctgctgcctgacagcagtgacgcgttcaaggctcgcgccgaactgatccgcaacgccaaaagcagccttgatctgcagtattacatcgtccacgacggcctgagtacgcgcgccctgatcgacgaactgctcaaggcggctgaccgtggcgttcgtgtgcgcatcctgctggacgacaccaccagcgacggtctggatcaggccatcgccaccctcgccgctcacccgaacatccagattcgcctgttcaatccgcaaaacctggggcgcgagaccggcatcacccgcagcctcgggcgcctgatgaacctgtcgcgccagcaccggcgcatgcacaacaagctgtggctggccgacagcagtgtggccatcgtcggcgggcgcaacctgggcgatgaatacttcgatgccgagccgaacctgaacttcaccgatatcgacatgctcagcgtggggccggtggccgagcagctcggccacagcttcgaccagtactggaacagcacgctcagcaagcctatcggtgaattcatctatttcctgcccgacggcgaggatctggccgaggcccggcgcaagctggacgattctctggagcaggcgcaccagcagcacaaggcgctgtatgagcgactgatggcctacaagacccagccgcgcatgaaaacctggctcaacgagctggtctgggcatacaaccaggcgctgtgggacgcaccgaccaaggtactggcgcagggcgagcctgacccgcatctgctgctgaccacgcaactggcgcctgaactgctgaacactcacaaggaactgatgctgatctcggcctactttgtaccgggcccggaaggcttgctgtacctcaccggccgggccgatgccggcgtcaatgtcagcctgctgaccaattccctggaagccaccgacgtgcccgccgtgcatggcggctatgcgccgtaccgcaaggcactgctggagcatggcgtgaagctgttcgagctgcgccggcagcctggcgataccgagacgatgcgcggcagcggtccgcatctgttcaagaaaagccattccctggtcagttccgaatcgagcctgcacagcaaggcgatgatcttcgatcggcagaaagtctttgtcggctcattcaacttcgacccgcgctctgtgctgtggaataccgaagtcggcgtgctggtcgacagcccgcaactggctgaagaattgcgcgaactgaccttgcagggcatggccccgtcgctcacctatgaagcgcggctggaggacggcaaagtggtgtgggtgaccgaagacaacggccagatccacactctgcataccgaaccgggcgactggtggcggcgtttcaacgcgtggatgagccgcgccatcggcctggaaagaatgctttaa

SEQ ID NO: 14471 - protein, 526 aa, Pseudomonas syringae pv. syringae B728a
MNNSWALPFCLLVALCVSGCAHQQVTSEPSQAMPSSGSAFGRSIQAMAVPHEGRSGFRLLPDSSDAFKARAELIRNAKSSLDLQYYIVHDGLSTRALIDELLKAADRGVRVRILLDDTTSDGLDQAIATLAAHPNIQIRLFNPQNLGRETGITRSLGRLMNLSRQHRRMHNKLWLADSSVAIVGGRNLGDEYFDAEPNLNFTDIDMLSVGPVAEQLGHSFDQYWNSTLSKPIGEFIYFLPDGEDLAEARRKLDDSLEQAHQQHKALYERLMAYKTQPRMKTWLNELVWAYNQALWDAPTKVLAQGEPDPHLLLTTQLAPELLNTHKELMLISAYFVPGPEGLLYLTGRADAGVNVSLLTNSLEATDVPAVHGGYAPYRKALLEHGVKLFELRRQPGDTETMRGSGPHLFKKSHSLVSSESSLHSKAMIFDRQKVFVGSFNFDPRSVLWNTEVGVLVDSPQLAEELRELTLQGMAPSLTYEARLEDGKVVWVTEDNGQIHTLHTEPGDWWRRFNAWMSRAIGLERML

SEQ ID NO: 14472 - DNA, 1251 bp, Pseudomonas syringae pv. syringae B728a
  CDS (1)..(1251)
atgagcaatacgacagggcagtggcgcgacggcaactcggtagagttgctgatcaatggcgaggatttctacgcccgcgtattcgaatgcatacgtgccgcgcgcaaagaagtgctgatcgagaccttcatcatttttgaagaccggatcggcgagagcctgcaacaggcgttgctcgaagccgccgcgaatggcgcgaaggtggtcgtcacggtggatgactatggcacctcggacctgagttcgacgtttgtcaaaaccatgatcgacgccggtatccagattcagctgttcgatccgcgcccgcggttcatgggcatgcgcaccaatctgtttcgccgtctgcaccgtaaggtggtggtgatcgatggcgaactgggctttatcggcggcatcaactacagcgttgatcatatgaccgacaccggtctgacggccaaacaggactacgccgttctggtgcgcgggccgattgttggcgacattcaccacagcgcgttgaatatgctcagcaaggtcgttcgtgacaaattgccgcccattgcactcaagctggaccgcgccggtgacgccagcatgctgctcgccgagcgcgacaatgacgagcacagcaccgatatcgaagagcagtacctggaggcgattcgcgctgctaagcaacgcatcaccctggccaatgcgtatttttaccccagctaccgctttctgcgtgagctgcgcaacgcctcacggcggggcgtcaaggtcaccctgatcctgcaaggccagcccgacatgccgttcgtgcgggtctgctcgcgactgacctacacctacctgctgcgcgatggcgtggccattcacgaatacaagcaacgtgcattgcacggcaaggtcgcgctgatcgaccaggactggtccaccgtgggttccagcaatctcgacccgctgagcctggcgctgaacctggaagccaacctgttcattcgtgatcgcaccctcaatgagcatctgcaaaatcatctgatggagcttgccgcggcgcacagcaaacagatgagcctcaagggtgcggcgcgtggccagtggtggcgtgcgccgatgatcgtcttgagtttctttttcctgcgccgtttcccggccattgccggtttgttcccggttcacggtgtgcgcctcaagcctttgcgtgccggtgatgtagtgcccgaagcgaaagtgatcgaacagcagcagaacaaccatccgatggatcaggagaaaaccctatga

SEQ ID NO: 14473 - protein, 416 aa, Pseudomonas syringae pv. syringae B728a
MSNTTGQWRDGNSVELLINGEDFYARVFECIRAARKEVLIETFIIFEDRIGESLQQALLEAAANGAKVVVTVDDYGTSDLSSTFVKTMIDAGIQIQLFDPRPRFMGMRTNLFRRLHRKVVVIDGELGFIGGINYSVDHMTDTGLTAKQDYAVLVRGPIVGDIHHSALNMLSKVVRDKLPPIALKLDRAGDASMLLAERDNDEHSTDIEEQYLEAIRAAKQRITLANAYFYPSYRFLRELRNASRRGVKVTLILQGQPDMPFVRVCSRLTYTYLLRDGVAIHEYKQRALHGKVALIDQDWSTVGSSNLDPLSLALNLEANLFIRDRTLNEHLQNHLMELAAAHSKQMSLKGAARGQWWRAPMIVLSFFFLRRFPAIAGLFPVHGVRLKPLRAGDVVPEAKVIEQQQNNHPMDQEKTL

SEQ ID NO: 14474 - DNA, 1158 bp, Pseudomonas syringae pv. syringae B728a
  CDS (1)..(1158)
atgaacggtgcgattttcccgtggcgtgaaaacaaccgctttcaattgctgatcgacggccctgcgttctttccgcgcatgatcgcagccattgatcgcgccgagcagcaggtcgatctggagttgtacctggtcgaagccggggcttgcgccgacgccatcgtgcgcgcgctggtcgaggcgggcagacgtggcgtgatcgtgcgctgcctgttcgatgacttcggttcaaaagccttcgacgccggcctgcgcaagcaactgaccgatgccggtgtgattctgcgtttctacaatccgatccactggcggcgcggcgtgcgcaacttctaccgcgaccatcgcaaactgctggtggtggacaaggccttggccgtggtgggcggcaccggcgtgaccgacgagttctgggagccggacaaggacgccagccagtggcacgaagtgatggtcgaaatcaccgggccgctggtgattgactggcaggcgctgttcaaccggcagttccacgccaacgcccggcgtttcgcctggcgtccgaaagaaaacttcggccttgatcacctgcccaaggccccgacaaccggcgaggggctgggccgcgtggcgtatgccgattcccgccagcaccgcgacattctgcaatcgctggtgcgtgcgctgcacaccgggcaaaagcggatctggctggcaaccccttactttctgcccacctggaaagtccgccgcgccttgcgccgggccgcggcgcgtggcgttgatgtgcgtttgctgctgaccgggccgcgcaccgatcacccgtccgtacgctatgccggtcaacgctactacccgcgcctgttgcgcgccggggtcaaggtgttcgaataccagccctgctttctgcacctgaaaatggtcctgatcgacgactgggtgagtctcggctcgtgcaacttcgatcactggaacctgcgcttcaacctggaagccaacctcgaagccctcgaccccggactgacccgcgacgtggtcgccagcttcgaaaaagacttcgccctgagcgccgaaaccacgttggcagactggaaggccagaccgctgtggcgacgggtcaagcagcgcttgtggggctggatcgaccggctggtggtgaacttgctggatcagcgtaactga

SEQ ID NO: 14475 - protein, 385 aa, Pseudomonas syringae pv. syringae B728a
MNGAIFPWRENNRFQLLIDGPAFFPRMIAAIDRAEQQVDLELYLVEAGACADAIVRALVEAGRRGVIVRCLFDDFGSKAFDAGLRKQLTDAGVILRFYNPIHWRRGVRNFYRDHRKLLVVDKALAVVGGTGVTDEFWEPDKDASQWHEVMVEITGPLVIDWQALFNRQFHANARRFAWRPKENFGLDHLPKAPTTGEGLGRVAYADSRQHRDILQSLVRALHTGQKRIWLATPYFLPTWKVRRALRRAAARGVDVRLLLTGPRTDHPSVRYAGQRYYPRLLRAGVKVFEYQPCFLHLKMVLIDDWVSLGSCNFDHWNLRFNLEANLEALDPGLTRDVVASFEKDFALSAETTLADWKARPLWRRVKQRLWGWIDRLVVNLLDQRN

SEQ ID NO: 14476 - DNA, 1440 bp, Pseudomonas syringae pv. syringae B728a
  CDS (1)..(1440)
atggattatcacgacccgtactttttcggttacgtcctgggtttcattcatttactcggtacaggtgccgccatccatgcattgctgacggtgcggacttcccaaggcgcaattgcctgggcgatgccgctgctgttcattccctatttcaccttgctgccttatctggtgttcggccgaagctcattcgacgcgtacatcaaggcgcgccgccaggccaaccaggaaatgcggatcgcgatcggcgacctcaactggcgcccatggatggaagaagctgtggctgcgcgtcgatcagaggcgtatgcggcgctgcgtgcaatgcccaagctgggcaacatgccggcgctggccaacaacaaggtcaagttgctgatcaatggcgaagaaaccttcggggccatttttcaggccatccgtgaagcgaaaaagaccatcctggttcagttcttcatcattcatgacgacaaacttggccgcgaactgcaatcgctgctgctggaaaaagccgccgaaggcgtggcgatctttgtactttacgaccgcatcggcagccacgctctgccaggtgcctatatcgataagctacgcgacggtggcgtgcagataaaagccttcgccacacgcggcggctggctcaatcgctttcagatcaacttccgcaaccaccgcaagatcgtcgtcgtcgatggcctgaaaggctatataggcggtcataacgtgggtgatgaatacatgggcctgaagccgccgctggccccatggcgcgatactcacgtgcaagtcatcggcccggtggtcgcctgcttgcaggagtcgtttgccgaggactggttctgggccacccgcgaactgcccccgctcagcctgcctgatgaatttcccgaagacggtgtgctttgccagttgctgaccagtggcccggctgatgctcaggaaacctgctcgctgttcttcgttgaagccatccatgctgccgaagagcgcgtgtggatcaccagcccctacttcatccctgacgaagccgtcactgctgcgctgaccctggcagtgttgcgcggcgtggacgtgcgcctgctgctgccgtcgcgccccgaccactacgtggtgtatgccgcttcaagtctgtacgcctttgatgctgtgcgtgccggagtgcgggtattccgctacgaaccgggcttcctgcatcagaaggtcgtcctggtcgacaacgagattaccgccatcggcagcgccaacctcgacaaccgctcgttccgcctcaacttcgaattgatgctgctgaccgtcgacagcgacttttccagccaggtggaatccatgctcaccgccgacttcaacctcgcccgcgaaatctccgtacaggaaagccatgaaacgcggcgtctgcatcaactgggtatgcgcgtggcgcggctgatttcaccgattctgtga

SEQ ID NO: 14477 - protein, 479 aa, Pseudomonas syringae pv. syringae B728a
MDYHDPYFFGYVLGFIHLLGTGAAIHALLTVRTSQGAIAWAMPLLFIPYFTLLPYLVFGRSSFDAYIKARRQANQEMRIAIGDLNWRPWMEEAVAARRSEAYAALRAMPKLGNMPALANNKVKLLINGEETFGAIFQAIREAKKTILVQFFIIHDDKLGRELQSLLLEKAAEGVAIFVLYDRIGSHALPGAYIDKLRDGGVQIKAFATRGGWLNRFQINFRNHRKIVVVDGLKGYIGGHNVGDEYMGLKPPLAPWRDTHVQVIGPVVACLQESFAEDWFWATRELPPLSLPDEFPEDGVLCQLLTSGPADAQETCSLFFVEAIHAAEERVWITSPYFIPDEAVTAALTLAVLRGVDVRLLLPSRPDHYVVYAASSLYAFDAVRAGVRVFRYEPGFLHQKVVLVDNEITAIGSANLDNRSFRLNFELMLLTVDSDFSSQVESMLTADFNLAREISVQESHETRRLHQLGMRVARLISPIL

SEQ ID NO: 14478 - DNA, 1512 bp, Corynebacterium jeikeium K411
  CDS (1)..(1512): transl_table=11
atgcccttccccgacctcctcggcctgtttagcgagttcaccgacgacctgcagtggtggcaggtcacgctggttgttctggactacgcgctgaaaatctttgcgttgggctgggttcctaaggaacgacgcccaacgtccgccatggcctggctgctggccatcttcctgatcccctttatcggcatcttcctattcctgctgatgggatccccagcgatcaaccgacggcgccaccgcattcagaatcaggcaaatgagctgatccgcacgatgagtgctgacgagcctgacgttcccgagggcagcgagctcagcgacgagctgcgttccttggtgcggctcaaccgggaactcactgcactgcccgccgtgaacggcaccatgcaggcattgcattcggactacgaagaatctattgccgcgatggcctgtgcagtggactcggccgaagactacgtgaacgtcgaaatttacatcatggcctgggacgatacgactaacccctttttcgaagcgctcggacgagcagcgcaacggggagtgaccgtgcgcgtgctgtgggatcacatcggcgcgcacaagtacaagggcaacaaaaagctgggcaagaagctgaaggccatgggagtggactggcaggtcatgctgcccctgcaacccttcaagtggcgcttccgccgccccgatctgcgcaaccaccgcaagctggtagtcgtcgacggccgggtggctttcatgggctcgcagaacatgattgaggccccgtaccagaaggcgaagaaccacaagatcggccgcgaatgggtagacgtaatggcggaactgaccgggccgatcgtcaccaccatcaactcagtattcgccgtggactggtacaccgaaacaaacgaggaactggacctcatcaaccccacggacgtcaaacagcgactggataccaacaacgaagacacaggtgcggacatcatgcagatcgtgccctctgggcccggcttcaccacggagccgaacctgcgcctgttcacctccattgcccaccacgccaagcacaccctcaagctgattagcccttacttcatccccgacgagtccctcatggaggccgtgaccaccgcctgctatcggggagtccgggtggagctttatgtctccgagaaatccgatcagccgatggtgggccacgcacaggcctcctactactcggaactgctgaaggctggggtgcacatgtacctgtacccctacccgaaggtcctgcactctaagttcgccattgccgacggcgaggtagcagttatgggcagctccaacatggatatgcgcagcttcggcctgaactacgagatctcgctgatggtcggcaagggcgagctattggacgccctgcgctccctgaccgacgactaccgggagcgctccgcgctgctgactgccgaacagtggagcacccggcctctgcacaagcagtacgtggataacgtggctcgtctaacgagtgcgctgcagtaa

SEQ ID NO: 14479 - protein, 503 aa, Corynebacterium jeikeium K411
MPFPDLLGLFSEFTDDLQWWQVTLVVLDYALKIFALGWVPKERRPTSAMAWLLAIFLIPFIGIFLFLLMGSPAINRRRHRIQNQANELIRTMSADEPDVPEGSELSDELRSLVRLNRELTALPAVNGTMQALHSDYEESIAAMACAVDSAEDYVNVEIYIMAWDDTTNPFFEALGRAAQRGVTVRVLWDHIGAHKYKGNKKLGKKLKAMGVDWQVMLPLQPFKWRFRRPDLRNHRKLVVVDGRVAFMGSQNMIEAPYQKAKNHKIGREWVDVMAELTGPIVTTINSVFAVDWYTETNEELDLINPTDVKQRLDTNNEDTGADIMQIVPSGPGFTTEPNLRLFTSIAHHAKHTLKLISPYFIPDESLMEAVTTACYRGVRVELYVSEKSDQPMVGHAQASYYSELLKAGVHMYLYPYPKVLHSKFAIADGEVAVMGSSNMDMRSFGLNYEISLMVGKGELLDALRSLTDDYRERSALLTAEQWSTRPLHKQYVDNVARLTSALQ

SEQ ID NO: 14480 - DNA, 1404 bp, Xylella fastidiosa Ann-1
  CDS (1)..(1404)
atggaagggacttggctgtttgcattggattgggtgatccgtttggttgcgttgctttggatcccggcacgaaccacccctagtgctgcgcgcagctggttgttactgattggtttcgtccctgtgtttggcttgccactttacttggtgtttggccatccttggctgtcacgtaagcgtgtgttgcgtcaggcgttggcttctcatgtgatccgtgagtggcagcgtgggttgagtgcattgcgctggcagcctcaggagaatggcgtcgctgcggaattggtacctttggtggagcatcagggcgattttatgccaacacgtggtaacgccttggatctattggatgattaccaagcttcgctgcatttgttgatcaatgatattgattccgcgtgcgaacgtgtgcacttgctgtattacttgatgttcgatgatgcggtgggtgatgcggttgtggctgcattacagcgtgctgcggcgcgtggcgtttcttgccgattgctgctggatgcagtcggtgctaaacgcggtctacgtgcctatcagcagtgccttcgtgcccatggtgtggaggtgcacgctatgttgcctggtgggttgcgctggcgtcgcagtgggcgtatggatttgcgcaaccaccgtaagattgctgtgatcgacaatcgggtcgcttatatcggttcgcagaatttggcatacccagattttgtgccgcatttccccaaccgtgaattggtcgcacgcgtgtgcggccctgcggtaagtcatctggaggcggtgtttctcagtgattggtttgttgaaactggtcaacgtttggggatgcgtccagatgctcccatatgtgagcaaaatgttgcggcccagctagtggccagcggtccggcttacccgcacgagaatgcgcgtgatgcggtgaatacaatgatccatttggcacggcggcgtattgtcttgacgacgccgtacttcgtgcctgatgaggccacactcagtgcgttgcgtattgcaggcacgtctggagtagacgtgcagttgatcctgtccgagagtaataaccagtttctgatggcctgggctcaggaggcgtactttgaggagctgttgcgcgcaggaatcaaaattgcgttgtatcgtccccatttcctgcatgccaagcatctgagtgtggatgatgatattgcgttgttcggatcgattaatttggacatccgctcgttcgcgcttaacgctgagattggcatgatttgttacgactcacgtattgtgactcggttacgtgaggtggagagtgattatctggccaatgcgcgccagcttaatttggttgagtggcagcaacgtcccgcttggcgtcgtagccgtgagggtattgcacgcttggcagatgctctgatgtag

SEQ ID NO: 14481 - protein, 467 aa, Xylella fastidiosa Ann-1
MEGTWLFALDWVIRLVALLWIPARTTPSAARSWLLLIGFVPVFGLPLYLVFGHPWLSRKRVLRQALASHVIREWQRGLSALRWQPQENGVAAELVPLVEHQGDFMPTRGNALDLLDDYQASLHLLINDIDSACERVHLLYYLMFDDAVGDAVVAALQRAAARGVSCRLLLDAVGAKRGLRAYQQCLRAHGVEVHAMLPGGLRWRRSGRMDLRNHRKIAVIDNRVAYIGSQNLAYPDFVPHFPNRELVARVCGPAVSHLEAVFLSDWFVETGQRLGMRPDAPICEQNVAAQLVASGPAYPHENARDAVNTMIHLARRRIVLTTPYFVPDEATLSALRIAGTSGVDVQLILSESNNQFLMAWAQEAYFEELLRAGIKIALYRPHFLHAKHLSVDDDIALFGSINLDIRSFALNAEIGMICYDSRIVTRLREVESDYLANARQLNLVEWQQRPAWRRSREGIARLADALM

SEQ ID NO: 14482 - DNA, 1488 bp, Lactobacillus gasseri
  CDS (1)..(1488)
atgattttaacctgggatatcataagacgcattattgaaatactttggttaattaatgttggcttagctatttggacagtttttcgcagccatcgtgatattgcctcaacctgggcttggcttttaattctatcgctcttaccatatattggttttattctatatttattcactggtcgtcaactatctcatgatgatattttttcaattaaagctgaacagcaaaaattccgagaccaattcttaaatgagcaaaataaattattaaaattacacgatctattacctaataaagatcaaaatccccgggcacgaagacttgttgaattaaatttaaataatgatgatgccctcctgacctttaacaatgaagtagaaacttttattgatggaaaagttttatttaaaaatcttatcaaaaatatcgaccaagcaaaaagtagtattaatattgaattttatactttttatgatgaccaattaggtaaccaagttctaaaagcactagaaaaagctgctaatcgcggtgttaaagttagagttctgtacgatgctagtggctctcgcggtacaaaaccttcttttttcaataaacttcgacaactaggtggaaacgctcaaccattcatttcaacagctggtaatcgtttctttactacccctcgtgctaactatcatttacaccgaaaactggttatcatcgacaatcaaattggttatattggtggttttaatattggagaccagtatgttgatcgaagcaaaaaattcggtcattggcgtgacacgcatttacgagtaacaggacaagctgctctcctgatggaaattaggtttgcaatggattggaatacaagttgtcgtaaatcccatcttcctacgtatagtgtcgataatttaattgaaaaattcagattaaaagttgtccaggaaaaaaatttagttccaatgcaaattgtttcttcaggtcctgacaacagtaattttggtattcgtcgagcttatgaagaaataattgcgcaagcacaaaactacgtttacattcaaacaccatatttaattccaggtgactccatcttagaggccttaattattgctgcaaagagtggtgtagacgttcgaatcatgattccatctatgccagatcatgctttcgtttatcgagcaaccgaatattacgctaagtacttagttaatcatggcgtaaaagtatataagtatgataatggcttcatccatgctaaaactattgtaagtggttctaatattgcctcagtcggttcggctaatcaagattttcggagttaccagcttaattttgaggtaaatgcttttacatacaatcctgcccttgcaactgaattaaaagaaatatttgaaaaagatctaaaagagtcaacattattaactaagcaatactttaataaacaatctcattggcgtaagtttaaacaatatttctcaagattactatcaccaattttataa

SEQ ID NO: 14483 - protein, 495 aa, Lactobacillus gasseri
MILTWDIIRRIIEILWLINVGLAIWTVFRSHRDIASTWAWLLILSLLPYIGFILYLFTGRQLSHDDIFSIKAEQQKFRDQFLNEQNKLLKLHDLLPNKDQNPRARRLVELNLNNDDALLTFNNEVETFIDGKVLFKNLIKNIDQAKSSINIEFYTFYDDQLGNQVLKALEKAANRGVKVRVLYDASGSRGTKPSFFNKLRQLGGNAQPFISTAGNRFFTTPRANYHLHRKLVIIDNQIGYIGGFNIGDQYVDRSKKFGHWRDTHLRVTGQAALLMEIRFAMDWNTSCRKSHLPTYSVDNLIEKFRLKVVQEKNLVPMQIVSSGPDNSNFGIRRAYEEIIAQAQNYVYIQTPYLIPGDSILEALIIAAKSGVDVRIMIPSMPDHAFVYRATEYYAKYLVNHGVKVYKYDNGFIHAKTIVSGSNIASVGSANQDFRSYQLNFEVNAFTYNPALATELKEIFEKDLKESTLLTKQYFNKQSHWRKFKQYFSRLLSPIL

SEQ ID NO: 14484 - DNA, 1416 bp, Leuconostoc mesenteroides subsp. mesenteroides ATCC 8293
  CDS (1)..(1416)
ttggttatcaatacaattatttcatttattgctgtttttcggcaaaaacgtgaaattgctacaatttgggcatggatgcttgtgcttttgttgttacctgttgtaggatttgccatcttctttttggctggtagtcgtatttctagtaaaaagatatttcgcctacggacccaagaacaacgtggtttagatcagattgctttaaatcaaaaaaaacagttacaagatattgagaacttacttcctattccatacagtgcaacagaattgttgaaattatttttatcatctgatcgcgcagttttgacacgtggtaataaaattacaatttttagtgatggacaaaaaaagtttgataaattattctcagatattagggctgcaaaggaacatattcatttagaatatttttctatttttgatgataaaataggacatcagctagttgacctattaactgaaaaagctggtgaaggtgttgaagttcgcgttatttacgatcagtttggttctcatggacaacatcctaaaatgtatagacaattacgtgcagctgggggtgttgctgtaccgttcttaatgcgacgctttcagctactaactttgcgcttcaacttcagaaatcaccgtaaaattgctattattgatggtaaaattggatacatcggcggatttaatgtcggtgatcaatatattggtgaatctaaaaaatttggttattggcgtgatactcatactcgaattattggggatgcagtattatcattgcaaagtcgatttttaatggattggaacgccaccgctgaaggtagagagttattgacccagacgacaaagtacttccctgaaaacttctcgttaccagggaagtctatggttcaaattgtttccagtggtcctgatgacgatatgaagcagatcaaacaaggttacatgagaatgttttcttctgcccgtgagagcataagtattcaaaccccttatttcattccggacggtcctgtgttagaaacgcttgaagttgctattttatccggggttaaggtgaaattaatgatacctaatcagcccgatcatcctttagtttatcgggcaacagaatattatgctcaagaattaattgatctcggcgcgacagtttaccgctatgatggtggttttttacatagcaaggttgtgatcattgataacgaggtagcaactgtcgggtcagctaatatggatatccgttcattttctcttaattttgaaggcaacgcatttatatatgatccggactttgcagctgatctagaagatttatttgagcaagatgtattaaagtccacaaaattaacaatggaatattttgagaaacagtctgcctggatgaagtttaagcaaaagtttagtagacttttctcaccaatactatga

SEQ ID NO: 14485 - protein, 471 aa, Leuconostoc mesenteroides subsp. mesenteroides ATCC 8293
MVINTIISFIAVFRQKREIATIWAWMLVLLLLPVVGFAIFFLAGSRISSKKIFRLRTQEQRGLDQIALNQKKQLQDIENLLPIPYSATELLKLFLSSDRAVLTRGNKITIFSDGQKKFDKLFSDIRAAKEHIHLEYFSIFDDKIGHQLVDLLTEKAGEGVEVRVIYDQFGSHGQHPKMYRQLRAAGGVAVPFLMRRFQLLTLRFNFRNHRKIAIIDGKIGYIGGFNVGDQYIGESKKFGYWRDTHTRIIGDAVLSLQSRFLMDWNATAEGRELLTQTTKYFPENFSLPGKSMVQIVSSGPDDDMKQIKQGYMRMFSSARESISIQTPYFIPDGPVLETLEVAILSGVKVKLMIPNQPDHPLVYRATEYYAQELIDLGATVYRYDGGFLHSKVVIIDNEVATVGSANMDIRSFSLNFEGNAFIYDPDFAADLEDLFEQDVLKSTKLTMEYFEKQSAWMKFKQKFSRLFSPIL

SEQ ID NO: 14486 - DNA, 1455 bp, Desulfovibrio desulfuricans G20
  CDS (1)..(1455)
atggatttcactcttctcagcggcctgctggtggtgatcaacctgtgcgtgtcgttcaccgctgcgggccatgccctgctgaacaagcgggagcccagagcctctctcgggtgggtggcggtgtgccttacctttcctctggcggggccgttgctctatttcgtgttcggcatcaaccgtgtgcgcagcaaggcagaacggttgaatgaagaaaattcggccagaggcaccgccacaaaagggcggctgcacggcggaacccatccctttctgccgcccggctccatggacgattatcttattgcgccggtctaccgcacgctgcagcgttccggtctggctgtcaccggaatgccgctggtgggcggtaacgatgtgcgcataatgcataacggcgagcaggcctacccccgcatgatcgaagcggtggaatgtgccgaagactcactgtaccttgccacatatatttttgaaaccggaccggaaggccggcgctttatcgaagctctgagctccgctgcggcacggggcgttgatgtgcgtgtgctggtggacggcgtgggcgagctgtacgcctttccccgcgcgggaaccctgctgcagcggcggggagtgcgcgtggcgcgtttccttccgcctcgtctttttcctccccagcttagtgtcaatctgcgcaaccaccgcaaggtgctggtggccgacgggcaggtaggctttaccggcggcatgaatctgggtgacaggcatatggtggacaatccggaaaacagacgccccgtggtggacattcatttcggattttccggccctgtggtggcccagctgcaggaagcttttctggatgactgggggtttgccacgggcgaatatacgctgccccgccgcgtgacggaagagccgtgcggcgatacgctgtgccgcgtggtcaaaggcggtcccgggcaggatatcgaccgtatttcggctttgatgacgggcgtcatctccagtgcgtgccgctcggtacgcatcatgactccgtattttctgccgtccggcgatctgataagcgccatgcaggcagctgccctgcgcggggtgcgggtggatgtggtgctgcccggaaaaaataatctgccggcagtgcactgggccacacgcaacatgctgtggcagctgctgcggttcggggtgcatgtctactaccagcccggcccttttgtacattccaagatcatgctcatcgacggcagttacgcgcaggtggggtctgccaatctggacccccgcagcctgcggcttaatttcgagctgaatgtggagatatttgatacgtccgtcgtgcgtccgctggtaaggcatttcgacaacgtgcggcgcaatgcgcgcagcataaccctgagcgaactggaaaaccgttccctgccggtgcgtatgcgcgatgccgcattctggctgttcaccccgtatttgtag

SEQ ID NO: 14487 - protein, 484 aa, Desulfovibrio desulfuricans G20
MDFTLLSGLLVVINLCVSFTAAGHALLNKREPRASLGWVAVCLTFPLAGPLLYFVFGINRVRSKAERLNEENSARGTATKGRLHGGTHPFLPPGSMDDYLIAPVYRTLQRSGLAVTGMPLVGGNDVRIMHNGEQAYPRMIEAVECAEDSLYLATYIFETGPEGRRFIEALSSAAARGVDVRVLVDGVGELYAFPRAGTLLQRRGVRVARFLPPRLFPPQLSVNLRNHRKVLVADGQVGFTGGMNLGDRHMVDNPENRRPVVDIHFGFSGPVVAQLQEAFLDDWGFATGEYTLPRRVTEEPCGDTLCRVVKGGPGQDIDRISALMTGVISSACRSVRIMTPYFLPSGDLISAMQAAALRGVRVDVVLPGKNNLPAVHWATRNMLWQLLRFGVHVYYQPGPFVHSKIMLIDGSYAQVGSANLDPRSLRLNFELNVEIFDTSVVRPLVRHFDNVRRNARSITLSELENRSLPVRMRDAAFWLFTPYL

SEQ ID NO: 14488 - DNA, 1434 bp, Pseudomonas aeruginosa UCBPP-PA14
  CDS (1)..(1434)
atgacctccaccacctacctcggcctgctgctggtcggcatccaggtactcggcttcgtcgccgccatccatgccgtgctcaccgtgcgcaccgcacagggcgcgatcgcctgggccacctcgctggtattcatgccgtacctgaccctgctgccgtacctggtgttcggtcgcagccgtttcgacgcctacatcgaggcgcggcgccaggccaaccgcgagatgcacctggcggccgccgagctggactggcgtccctgggtcgaggaggccctggcggcccgccaggtcagcggctacaaggggctcaaggcgctggtgcggatgacccgcacgccgaccctggcgaacaatcgggtgcgcctgctggtcaacggcgaggccagcttcgaggcgatgttcaaggcgatttccgccgcccgccaggtgatcctggtgcagttcttcatcgtccgcgacgacgccctcggccagcgcctccagcaactgctgctggaacgcgcggccaacggcgtcgaggtgttcttcctctatgacgccatcggcagccacgcgctgccgcaccgctatgtcgagcggctgcgccagggcggcgtgcagatgcatggcttcagcaccggcagcggcatgctcaaccgcttccaggtgaatttccgcaaccaccgcaaggtcgtggtggtggatggcgagtgcggtttcgtcggcgggcataacgtcggcgtcgagtacctcggcgagaagccgccgctggcgccctggcgcgacacccacatggaactgcgcgggccggcggtggcgtgcctgcaggaaagcttcgccgaggactggtactgggcgacccacagcctgccgccgctgatcctgccgccgcagtacgacagcgagggcgcgctctgccaggtggtcgccagcggcccggcggatgcccaggaaacctgctcgctgttcttcgtcgagatgatcaacgccgcccacgagcgggtctggatcacctcgccgtatttcgttcccgacgaagcggtgatggccgccctgcgcctggcggtgctgcgcggcgtcgacgtgcgcctgctgatcccctcgcgcccggaccaccgcacggtgtatgccgcgtccagcctctacgcgctggaagcgatccgtgccggggtcaaggtgttccgctaccagcccggcttcctccaccagaaggtggtgctggtggaccgcgacaccgccgccgtcggcagcgccaacctggacaaccgttcgttccggctgaatttcgaggtgatggtggtgaccgtcgacgagggcttcgccggcgaggtggaggcgatgctcgaggcggacttcgccgagtcgctcgaattcactccggaagaccgccgcagcgtgcgccgcctgcagcaactggggatgcgcgtggcgcggctggtctcgccgatcctctga

SEQ ID NO: 14489 - protein, 477 aa, Pseudomonas aeruginosa UCBPP-PA14
MTSTTYLGLLLVGIQVLGFVAAIHAVLTVRTAQGAIAWATSLVFMPYLTLLPYLVFGRSRFDAYIEARRQANREMHLAAAELDWRPWVEEALAARQVSGYKGLKALVRMTRTPTLANNRVRLLVNGEASFEAMFKAISAARQVILVQFFIVRDDALGQRLQQLLLERAANGVEVFFLYDAIGSHALPHRYVERLRQGGVQMHGFSTGSGMLNRFQVNFRNHRKVVVVDGECGFVGGHNVGVEYLGEKPPLAPWRDTHMELRGPAVACLQESFAEDWYWATHSLPPLILPPQYDSEGALCQVVASGPADAQETCSLFFVEMINAAHERVWITSPYFVPDEAVMAALRLAVLRGVDVRLLIPSRPDHRTVYAASSLYALEAIRAGVKVFRYQPGFLHQKVVLVDRDTAAVGSANLDNRSFRLNFEVMVVTVDEGFAGEVEAMLEADFAESLEFTPEDRRSVRRLQQLGMRVARLVSPIL

SEQ ID NO: 14490 - DNA, 1440 bp, Fusobacterium nucleatum subsp. vincentii ATCC 49256
  CDS (1)..(1440): transl_table=11
atgcaagatatttctaaaattttattaacatttgtacaatttttcttacagtatgtttgggtggcaaatctattttttataattgttattataatgatagagaaaaaaaatccactatatacaattttatggatatttttattaacacttatgccttatgttggtttttttatttatttattctttggtttaacttttaagaaaaaaagagttgctaataaaatttataaattaaaaaaattaaaaagtaggaaaaatgtttccaaagctgatagagaagaactgagaagatggaaagggcttataacttatcttgaaatgagcactgataactatattacttccaataatgatattgaagcttactttacagggaaggaatttttttctaatttaaaaaaagaaatagctaatgcaaaaaaatttataaatatggaatattttatctttcaatttgatgggataggaaaagaaatagctgatttattaattgaaaaagctaaggaaggaatagaagtcaatctaataatagatggagttaatttagctaatcgtaaacttaatgaatattttaaaaatacaggagttaatttacatctattttttagaacatatattccaatatttaatattagattaaattatagagatcatagaaaagttacaataatagataatagagttgcttttgttggtggaatgaatataggagatgaatatttaggtaaaggggaaataggatattggagagatacttctgtaaaaatttatggagatattgtttctagttttgaaaaagaattttatttctcattaagtatagtaaaaaataaatatttgaaagatgaaaaaccctctaatgaaatttctcttaaatatgaagaagaagatagtgtctatatgcagcttataagttctggacctaattatgaatttccagttataagagataactatattaaacttattcaagaagctagaaaatctgtatttattcaaacaccatattttgttccagatgatttattactggatactttaaagtctgctgttttatcaggtatagatgtaaaaattatgatacctaataaggcagatcatccatttatttattggataaatcaatattatgttgctgaacttttaagattaggtgcaaatatttatagatatgaaaatggttttatacattctaaaactatattagttgatgaagaagtagtttcagttggaacttgtaattttgattatagaagtttctacctaaactttgaaattaatttgaatatctacaataaagatgttgctaattcttttaaaactcaatattataaagatattgcaatatcaaaaaaattgacatttgctgattttaaaaagagaagtatttttacaaaagtaagggaatctgtatttagattactatcacctataatgtag

SEQ ID NO: 14491 - protein, 479 aa, Fusobacterium nucleatum subsp. vincentii ATCC 49256
MQDISKILLTFVQFFLQYVWVANLFFIIVIIMIEKKNPLYTILWIFLLTLMPYVGFFIYLFFGLTFKKKRVANKIYKLKKLKSRKNVSKADREELRRWKGLITYLEMSTDNYITSNNDIEAYFTGKEFFSNLKKEIANAKKFINMEYFIFQFDGIGKEIADLLIEKAKEGIEVNLIIDGVNLANRKLNEYFKNTGVNLHLFFRTYIPIFNIRLNYRDHRKVTIIDNRVAFVGGMNIGDEYLGKGEIGYWRDTSVKIYGDIVSSFEKEFYFSLSIVKNKYLKDEKPSNEISLKYEEEDSVYMQLISSGPNYEFPVIRDNYIKLIQEARKSVFIQTPYFVPDDLLLDTLKSAVLSGIDVKIMIPNKADHPFIYWINQYYVAELLRLGANIYRYENGFIHSKTILVDEEVVSVGTCNFDYRSFYLNFEINLNIYNKDVANSFKTQYYKDIAISKKLTFADFKKRSIFTKVRESVFRLLSPIM

SEQ ID NO: 14492 - DNA, 1713 bp, Psychrobacter sp. 273-4
  CDS (1)..(1713)
atgtcgatgttcagtatagaacccagcaacttatcgttgagcctgacactcggtctcaccttaggtcttagtggatgccaaagcttaccaaagcagccgcacttgcctgaaagccaagcactatcagcaagggttaatgctttataccaatcagacattagcaaacaagataacatagaaaaagacgtccaaaaagatggcgattctatagataccacgaaagataccacgaatgtcagcacagacactgtcaccccaaatacggatagccttgatttggtagccgccatcagtcaacaaagtaagattcaccctgatttgtcaggctaccatccgattgtaactggtgccaatgcttttgcctcacgcagtatattgacaggtatggccacacgcaatatcgatgcccagtactatatttggcacgatgatcaggccggtcagctgatgctcaaagacttatgggatgctgcggagcgtggcgttattgtgcgcttattgcttgatgattttaataataatgctaaatttgatcagcatttattacgttttgccagtcaccctaatgtcgctgtgcgtattattaatccactcatataccgtaaatttaaaagcttaaactttttaaccggactgccgcgtatcaatagacgcatgcataataaaagcatgatttttgataagcaaatcaccatcattggtggccgtaatatcggtgatggatacttaagtaatgataaaaacagccagttcgcagacttagatgtactactgattggtaaagtcgtggcagatattgataatagctttgccagctactggtcagcgccaatatcatttgatattcaaaccttagcgactcttgataaaggagagacgactgattttgtaaaagggctcgataagttaaaaacagatgagaagagtagtagtaatggcagtttgtcgatttataaagcagccattgaagactcctctatcgatactgatttgattaacaaacgagtgccgtttcgctggacggacatgcagtttttaagtgatgatgtcggcaagctaaccaaaaccgtgccagcagacaccaatttagtgcatcaactgcgcactttgcttggcagtccatcaaagaaactcactattatctcatcttactttgtaccgactaaagacggtgttaatacgttgaacgcattggcagaatctggtatcgaaatcaaaattctaaccaattcatttgatgccaccgatgtaacggcggtacattctggctatagccaatggcgtcctagtttgctgcgcgcgggcgtaaaaatttatgagctaaaatcaaccgcttctgaagaaaagcgcgaaaacaaactttggaaaggtcgtagtcaatcctcaactagcttacatgctaaagcttttgccgttgatgactaccaagttttcattggctcatataatgttgacccacgctcggctaatatcaataccgagatgggcgtgattatcaatgatgatgagcttgctactcagttgcatgatgcactaagcgatgacttattaaaccaagcgtatgaagtgaagttactagaaaacggtaacttacaatggcataccatggaaaaagataagaaagtcatctatgattcagagccgcgcgtcgctgtcagtgaccatgtttggctgactatcatgtcatggctacctattgattggctgttatag

SEQ ID NO: 14493 - protein, 570 aa, Psychrobacter sp. 273-4
MSMFSIEPSNLSLSLTLGLTLGLSGCQSLPKQPHLPESQALSARVNALYQSDISKQDNIEKDVQKDGDSIDTTKDTTNVSTDTVTPNTDSLDLVAAISQQSKIHPDLSGYHPIVTGANAFASRSILTGMATRNIDAQYYIWHDDQAGQLMLKDLWDAAERGVIVRLLLDDFNNNAKFDQHLLRFASHPNVAVRIINPLIYRKFKSLNFLTGLPRINRRMHNKSMIFDKQITIIGGRNIGDGYLSNDKNSQFADLDVLLIGKVVADIDNSFASYWSAPISFDIQTLATLDKGETTDFVKGLDKLKTDEKSSSNGSLSIYKAAIEDSSIDTDLINKRVPFRWTDMQFLSDDVGKLTKTVPADTNLVHQLRTLLGSPSKKLTIISSYFVPTKDGVNTLNALAESGIEIKILTNSFDATDVTAVHSGYSQWRPSLLRAGVKIYELKSTASEEKRENKLWKGRSQSSTSLHAKAFAVDDYQVFIGSYNVDPRSANINTEMGVIINDDELATQLHDALSDDLLNQAYEVKLLENGNLQWHTMEKDKKVIYDSEPRVAVSDHVWLTIMSWLPIDWLL

SEQ ID NO: 14494 - DNA, 1644 bp, Psychrobacter sp. 273-4
  CDS (1)..(1644)
ttggaggcgaaaacaatagaagctttatctactactgagcagcaagtggcagcatggtcatggacagactttgctgggcttggtctgatatttcatattattcttatgattgtgatgactttgcgtattgtctcggtacagcgcaacattggggtggcaatcgcatggatagcggtgttgttcaccttgccaatatttggcttgattgcttatgtgctcgtcggtgagccgatgattggtcgacgctatcgtcagcgtatggatcaagcgcggctattgatgaatgagatggcgcagcgcgagcacttgatatttgataaagggcaagaggtactgccaactcattatcgcggagtcagtcacattggtacgcgttggacagggtttggggtgttttcagaccatgacatgcagctgttgacgcatgtcaatattatttttaagcgtatgattgatgacatcgatgccgctcagcgcagtattttgatggagttttatattatttatcctaaggggcaagtgcttgatgtgatagatgcgttgatggcagcggctcagcgcggagttgaatgtcatattctgattgatagtgtgggtagttttagcttttttaatagtaaagcgcatcgaaaattagaaaaagcgggcgtttttgtccatcagtcattgccagtagggctgtttaaaaccttgtttaaacgctcagatttgcgcaatcatcgcaaaatcgtggtcattgatgagtatatcggctatatcggtagctttaacttggttgatcctaagttttttaagcaagataaggcggtcggtgaatggattgatgtggcgatacgcagtgtcagtgatactgacatcagtattgctaccgcgatggcaaaagtattagtaaccgatattggggcggaaaatagcgacaatctagacgcgctgcatcaacgagtcaatagctatacgcgtaagctgtatctgcgcaatccgacgattaatgatctcaatagtcgcatcaaagtattggatgacgcgatagagaatgtagaaatgccttgtattggcgcgatgtcgacagtgattccgcagctgccggtggtaaaaggcgtagtcgcacagcttattccttcagcgccacaagtaaccgctcatgtcatctataacaccttagtaacagtgttgcatcgtgctaatcaccgtatttgtatcacaacgccatattttgtaccggacgaagctttatcaggtgcgctggtaacggcggctaagcgcggcgtcgaagtcacgctgattatccctgaaaaggttgattcttttttggttcagcacgcctcgcaagcctattatcaagagttgttagaggtgggagtgaccattgccttgtttaagggtggtctactgcatgcgaagacggttgttattgacgacgattattgcctatttggtaccgtaaatatcgatatgcgcagtttttatctgaatatggaagtcagtttggcgatttatacgcctgaaatggttgcacaagttgccgcttgccaagagtcgtatttacaaagctgtcattttttgggcttggatgagtggcaacagcgtcataaggctgagcgcttgtttgataatgtgatacgattatttagtccattattgtag

SEQ ID NO: 14495 - protein, 547 aa, Psychrobacter sp. 273-4
MEAKTIEALSTTEQQVAAWSWTDFAGLGLIFHIILMIVMTLRIVSVQRNIGVAIAWIAVLFTLPIFGLIAYVLVGEPMIGRRYRQRMDQARLLMNEMAQREHLIFDKGQEVLPTHYRGVSHIGTRWTGFGVFSDHDMQLLTHVNIIFKRMIDDIDAAQRSILMEFYIIYPKGQVLDVIDALMAAAQRGVECHILIDSVGSFSFFNSKAHRKLEKAGVFVHQSLPVGLFKTLFKRSDLRNHRKIVVIDEYIGYIGSFNLVDPKFFKQDKAVGEWIDVAIRSVSDTDISIATAMAKVLVTDIGAENSDNLDALHQRVNSYTRKLYLRNPTINDLNSRIKVLDDAIENVEMPCIGAMSTVIPQLPVVKGVVAQLIPSAPQVTAHVIYNTLVTVLHRANHRICITTPYFVPDEALSGALVTAAKRGVEVTLIIPEKVDSFLVQHASQAYYQELLEVGVTIALFKGGLLHAKTVVIDDDYCLFGTVNIDMRSFYLNMEVSLAIYTPEMVAQVAACQESYLQSCHFLGLDEWQQRHKAERLFDNVIRLFSPLL

SEQ ID NO: 14496 - DNA, 1470 bp, Ralstonia eutropha JMP134
  CDS (1)..(1470)
atgccgcttccaccgttcctgtcctcgctgcccgatcctgccctgtggtggggcccgctgttcacggtgaccgaatgggcgatccgcctgacgatgctggtctacgtgccgcagcgccgtgcgccggctgccgcgcgcacgtggctgctgctggtgttcttcctgccgtggctgggcctgatactttatgcgctgttcggacgcatctactatccgaagtcacgccgcctgaaactggcccgcatcaaccaggggatcgagcagctgcgcgcgcgcatcagccatgaactgccacagggtccattgccggatgggctgtgccagacgggttcctgcctgattgaacgggtcggctcattcgcgccgatgcgcggcaacgatgtcacgctgatcgaccgctacgacgacgtgattgccgcaatggtggccgacatcgacgccgcgaagcagtcggtgcacatcctgatgtacatctacgcggacgatgcgacgggccgaaggattaccgacgccgtgctgcgcgccgcgcgccgtggcgtacgctgcagcgtgctgatggacgcgctcggtgcgcgcgacggactgaaggcctttaccggcaagctgcgctctgccggcgtgcaggtggtaccggtgctgccgatgcgctcgctgtcggcagtgctcaagggcaagagtgcgcgcttcgacctgcgcaatcaccgcaagatcgtcgtgctcgatggcagcgtcggctatatcggctcgcagaacgtcgtcgatgccgaatcgatgccgggtctgcccaatgaggaactggtggcccgcgtgaccggcccggtggtatcgcaactgcaggctgtgttcctcgcggaccgctacctcgagaccggcgacaaggacctcggcgctgccgatttcccgccgctggcgccggacgggccgtgcattgcgcagatgctcccgagcgggcctggctacggcacgcagaatgcgcagatggtgctggtgtcgatgatccacaatgccgtgcgccgcgtggtcatcaccacgccttatttcgtgcccgacgagtcgttcctgcaagcgctgcacgtcgcgtgctatcgcggcgtggaggtgcatctggtgctgtcccagcgcatcgaccagcgcttcacgcaggccgcgcaggaagcgtatttcggtgtgctgctggaatcgggcgtgaaggtccacctgtaccggcccgcgttcctgcatgccaagcatgtgaccatcgacgacacggtggcgatggtcggctcgacgaacatggacatccgctcgttcgcgctcaatgcggaatcggcgctggtgatttacgacagggatgtggtggcgaagatggtgcgcattcagcagcgctatctggctgcgagcgacaccgtggtacgcgagaaatgggccgcgcggccgttgcgcacgcggacctggcagaacctttgccggttggcggattcgttgttgtga

SEQ ID NO: 14497 - protein, 489 aa, Ralstonia eutropha JMP134
MPLPPFLSSLPDPALWWGPLFTVTEWAIRLTMLVYVPQRRAPAAARTWLLLVFFLPWLGLILYALFGRIYYPKSRRLKLARINQGIEQLRARISHELPQGPLPDGLCQTGSCLIERVGSFAPMRGNDVTLIDRYDDVIAAMVADIDAAKQSVHILMYIYADDATGRRITDAVLRAARRGVRCSVLMDALGARDGLKAFTGKLRSAGVQVVPVLPMRSLSAVLKGKSARFDLRNHRKIVVLDGSVGYIGSQNVVDAESMPGLPNEELVARVTGPVVSQLQAVFLADRYLETGDKDLGAADFPPLAPDGPCIAQMLPSGPGYGTQNAQMVLVSMIHNAVRRVVITTPYFVPDESFLQALHVACYRGVEVHLVLSQRIDQRFTQAAQEAYFGVLLESGVKVHLYRPAFLHAKHVTIDDTVAMVGSTNMDIRSFALNAESALVIYDRDVVAKMVRIQQRYLAASDTVVREKWAARPLRTRTWQNLCRLADSLL

SEQ ID NO: 14498 - DNA, 1617 bp, Ralstonia eutropha JMP134
  CDS (1)..(1617)
atgcccgccgtccaggaccgcccccgactgacgcatcgctggcagcaccgcctcacggtgctgctggccaccgcgctgctgctggccggctgtgcgagcctgccgccgcaggatgggcgcgtaggcacctacgcggtgacgccagcggacacggccagtacgctgctggcccgcaccatggcgccgatgctctcggcgcacccgggccagtccgggttctatccgctcgccagcggcccggacgcactagtggcacgcatcgcgctggccagggccgcgcaacgcacgctggacgtgcagtattacatctacgacggcgacctgaccggcaagacgctgctcgccaacatcatcgccgccgcagaccgcggcgtacgcgtgcggctgctgctcgacgacctgcacgtggccggacaggaccgcatcctgtcggcgctcgatgaccacccgaacatcgaagtccggctgttcaacccattcgcctcgcgcagcctgcgcatggccgcgatggcgctcgactacagccggctgaaccgccgcatgcacaacaagtcaatgaccgccgacaaccagctcacgatcgtcggcggccgcaatatcggcgatgcgtatttctccgccgacaagggctcggatttcaccgatctggacctgctgctggcgggccccgtggtgcccgaggtctcggcggtgttcgacgactactggaacggcgcccccgcctaccccgtcagtgcgctggtcaagccgcccgaggacgccgcggcgcagctgcaggccttgcgcgactacctcgacaagcacgtcgccgaagcgcgcggcggcgagtattcgcagaccctgctgtcctcggggctcgcgcaggcgctcgaaagcggcaagctgcccgcgtactggggccaggccacggtgattgccgacaaggccgcgaaggtcacgctgccgcccgaagacgattccagccatgcgattcccaagctcgtgaagctgcttggcagtgcgcaacaggaactggcgctggtatcgccctatttcgtgccgaaccgcaaggccgtcgaatggtttgcgcagatgacgcagcgcggcgtgacggtgcgtatcctgaccaactccttcgctgcgacggatgtcagcgccgtgcacgcaggttattcgccgtggcgcaagaacctgctcgaagcgggcgtggaactgtacgaactcaagccgtccgcctatgcggagatggcgcgcgaaggcaagcagggccaccgcagcatggtcagcaagagccgcgcgagcctgcatgccaagagctatatggtggaccggcgcctgctattcgtcggatcgctgaacctggacccgcgctccgcccggctcaatacggaaatgggcgtggtcgtcgacagcgcgccgctgtgcgtggcactcggcaaggacctggaccaggcgctgctggatgtcgcctacaaagtcatgctcgcgccggacgccgacggtagtggctcgcatctggtgtgggtcacacgcgagaacggcctgctgcgcacctatgacagcgaaccggacatgggcgcgctgcagcatctcggacagggactgctgcggatgttgccgatcgaagaggaactgtag

SEQ ID NO: 14499 - protein, 538 aa, Ralstonia eutropha JMP134
MPAVQDRPRLTHRWQHRLTVLLATALLLAGCASLPPQDGRVGTYAVTPADTASTLLARTMAPMLSAHPGQSGFYPLASGPDALVARIALARAAQRTLDVQYYIYDGDLTGKTLLANIIAAADRGVRVRLLLDDLHVAGQDRILSALDDHPNIEVRLFNPFASRSLRMAAMALDYSRLNRRMHNKSMTADNQLTIVGGRNIGDAYFSADKGSDFTDLDLLLAGPVVPEVSAVFDDYWNGAPAYPVSALVKPPEDAAAQLQALRDYLDKHVAEARGGEYSQTLLSSGLAQALESGKLPAYWGQATVIADKAAKVTLPPEDDSSHAIPKLVKLLGSAQQELALVSPYFVPNRKAVEWFAQMTQRGVTVRILTNSFAATDVSAVHAGYSPWRKNLLEAGVELYELKPSAYAEMAREGKQGHRSMVSKSRASLHAKSYMVDRRLLFVGSLNLDPRSARLNTEMGVVVDSAPLCVALGKDLDQALLDVAYKVMLAPDADGSGSHLVWVTRENGLLRTYDSEPDMGALQHLGQGLLRMLPIEEEL

SEQ ID NO: 14500 - DNA, 1809 bp, Ralstonia eutropha JMP134
  CDS (1)..(1809)
atgcacgagccctgcaatgtgagcgtgtcgtcggtgacccgtcatggccgctcacggcatgcgtggcgcgcggcctggcggcgcgcggcctcgctggtgacaacgctgttttgcgccggtgtgctggcgggttgcgcgagcctgccagcgtcggccgaacgtacgccttcgacggcgccaaccgataccagcgacacgccactcggcaaggcgctcgcgcccaggctggcgcagcatccgggcgattcgctgttctatccgctatcgtccggtcccgacgcgctggccgcacgactggccatggcgcgggcggcgcagcgcagcctggacctgcagacctatattttcgagcctaccggcaccggcgctgccgtgctcggcgacatcatcaacgccgccgaccgcggggtgcgcgtgcggctgttgctggatgacatgcataccggtggcctggacaaggtgctggccgcgatcgactcgcatcccaatatcgaggtcaggctgttcaacccgttcgcgaaccggggcgcgcgctggctggaaatgctgtggagcttcagccggctggaccgccgcatgcacaacaagtcgatgacggtggacaaccagatctcgctggttggcgggcgcaatgtgggcgatgcctatttctccgcgcgtgccgacatggacttcagcgatctggacgtgcttgtcgcgggaccggtcgtgccgcaggtgtccgcggtgttcgatgcttactggaacgatccgtcgtcctaccccgtggccgcgctgattcccgaaggcaaggatgcgcccgaagaaatgcgcgcgttgcgtaagcgcctcgaagcgcgcggcgagcaggcgcgcgccagcccctatgtgcaggaactgcttgattcgggtctggcgaaaggtatcgaaagcggccacatgcccggctacacgggcaaggccaccgtggtgtcggacagcgcgtccaaggctaccgggaagaccgagggcgatggctatgccacggtgcggctggagcacatgatcagtgcggcgaagaacgaagtggtgctggtatcgccgtacttcgtgccggacgatgacggcgaagcgtggcttgtcgcgcttgcccgtcgcggcattcacgtgcgcatcctgaccaattcgttcgcggccaacgacgtgagcgccgtgcacgccggctacatgcctcaccgcgaggcgctggtggcggccggcatcgaactgtacgagctcaagccgagtgcctacgcggaactcgcccagcgcggcaagccggccgaatcgggatcgggaacgggcgcgggaacgcgcgctggcgcggggacgggttcgggatcggggacggggacggggacggggacggggacggggacgggttcgggatccggattgggctcggggtccgggtcgagagtgacttcgggctcgagctcgggttcgcgttcatggcttgcgtcgagccgcgccagcctgcatgccaaaaactacatcgtcgaccagcatcttgtattcatcggttcgctcaacatggatcagcgttcggccaagctgaataccgagatgggcatcgtcctggatagcgcgccgctggcccagcgcatcctcaagggcatgaatgatggcttgctcgacatcgcctaccgggtcgaactgcgtgcgaacccggacgggagctcgcgccatctgacgtgggtcacgcgcgagagcggccagttgaaaacctacgacagtgagccggggatgggcccgctgcaacaccttggcatcggcttcctgcgcgtgctgccgatcaaggaagagttgtag

SEQ ID NO: 14501 - protein, 602 aa, Ralstonia eutropha JMP134
MHEPCNVSVSSVTRHGRSRHAWRAAWRRAASLVTTLFCAGVLAGCASLPASAERTPSTAPTDTSDTPLGKALAPRLAQHPGDSLFYPLSSGPDALAARLAMARAAQRSLDLQTYIFEPTGTGAAVLGDIINAADRGVRVRLLLDDMHTGGLDKVLAAIDSHPNIEVRLFNPFANRGARWLEMLWSFSRLDRRMHNKSMTVDNQISLVGGRNVGDAYFSARADMDFSDLDVLVAGPVVPQVSAVFDAYWNDPSSYPVAALIPEGKDAPEEMRALRKRLEARGEQARASPYVQELLDSGLAKGIESGHMPGYTGKATVVSDSASKATGKTEGDGYATVRLEHMISAAKNEVVLVSPYFVPDDDGEAWLVALARRGIHVRILTNSFAANDVSAVHAGYMPHREALVAAGIELYELKPSAYAELAQRGKPAESGSGTGAGTRAGAGTGSGSGTGTGTGTGTGTGSGSGLGSGSGSRVTSGSSSGSRSWLASSRASLHAKNYIVDQHLVFIGSLNMDQRSAKLNTEMGIVLDSAPLAQRILKGMNDGLLDIAYRVELRANPDGSSRHLTWVTRESGQLKTYDSEPGMGPLQHLGIGFLRVLPIKEEL

SEQ ID NO: 14502 - DNA, 1329 bp, Ralstonia eutropha JMP134
  CDS (1)..(1329)
atgtcacggatatccgacaccgacccaccgaatgccgcacgatccaacggcgcggcgcatgttgcggcgcgggatgacagcgccggtcccgcagcacgcgcggggcggcggcgtctgctgcgctgggccggacggcacggcaagccggtcggcggcaatcaggtaaggctgctgtgcggcgggcgcgacttcttcccagcgctgatcgaggcgatcgacgcggcggttctccaggtcatcattgaaacctacatctacgccgacgacgacgtcgggcgcgccgtcagcgatgcgctgatccgggccgcggcgcgtggcgtagccgtgcggctgaccgtggacggtttcggtgccggcgacatgtctgccgaactcatgcagcgcctgcgcgacgcgggcgtgcagctgcgtgtctaccgcgtgatgcgcggcttccggctggcgcgcaggcacctgcgccgcctgcaccgcaagcttgccgtggtcgaccggcgcgtagcgttcgtaggcggcatcaacatcatcgacgactacaatcacggcccgttcgagcaggagggactcggggcacgctacgacttcgccgtggaagtgcgcggcccgctggtcgaccgcattgcgctgacggcggagcgcctctggtggcggctgtcgctgcgcgccgaactgcatgacgttggtttggcgggcgcggcagcgggatacccgcttgtgaccgacctgccgccgcggcgcgatacggaaggcggcatgcgggcggcgcttctcctccgggacaacttgcgcaaccgccgcaccatcgagcgcgaatatctgcacgcgctgggtgctgcgcgcgacgacgtgattctcgccaacgcgtatttcctgccgggccacaagatgcggcgcgcgctgctggcctgccgcaagcgcggcgtgcgggtacgattgttgttgcagggtcgcgtcgaataccggctgcagcatttcgccacgcacgcgctgtacgcgagcttgcttgatgccggcatcgagatctacgagtacgcgcagagcttcctgcacgccaaggtcggtgtggtggatgaatcctgggccacggtcggatccagcaatatggatccgttcagcctgctgctcgcacgcgaggccaacgtctgcgtctatgatcctgccttcgccgccgtcctgcgcacgcagctggagcgcgccattgccgagcgcagcgtgcgcgttatgccggaggcgcatgcccggcgctcggcggtgcaccgtgtggcgaactgggccgcctacatggtgttgcgtcttggcgtcgttattgccggtgtgacggggcgctattga

SEQ ID NO: 14503 - protein, 442 aa, Ralstonia eutropha JMP134
MSRISDTDPPNAARSNGAAHVAARDDSAGPAARAGRRRLLRWAGRHGKPVGGNQVRLLCGGRDFFPALIEAIDAAVLQVIIETYIYADDDVGRAVSDALIRAAARGVAVRLTVDGFGAGDMSAELMQRLRDAGVQLRVYRVMRGFRLARRHLRRLHRKLAVVDRRVAFVGGINIIDDYNHGPFEQEGLGARYDFAVEVRGPLVDRIALTAERLWWRLSLRAELHDVGLAGAAAGYPLVTDLPPRRDTEGGMRAALLLRDNLRNRRTIEREYLHALGAARDDVILANAYFLPGHKMRRALLACRKRGVRVRLLLQGRVEYRLQHFATHALYASLLDAGIEIYEYAQSFLHAKVGVVDESWATVGSSNMDPFSLLLAREANVCVYDPAFAAVLRTQLERAIAERSVRVMPEAHARRSAVHRVANWAAYMVLRLGVVIAGVTGRY

SEQ ID NO: 14504 - DNA, 1254 bp, Ralstonia eutropha JMP134
  CDS (1)..(1254)
atggaccacggatggacgacgggcaaccggtttcgcttactggagaacggggaggaatacttccccaggctgattgcggccctgaacgccgcgcataccagtgtgctgctggaaacgttcatcctggccgaggatgacgtcggttgccggctcgccgaagcgctggccgccgcagcgcgacggggcgtgcaggtagcgctgaccgtcgatggtttcggatcggccgatctgtctgccgactatatggtgaggttgacgcaggcaggcgttgcggtgcgcatgttctcgccgggccgccggctgttgggcaaacgtgccaatctcttccgccggttgcaccgcaagctggtggccatcgacgcatccgtcgcgttcgtcggcgggatcaacctgtgcgtcgatcatcttgtccaggcaagccccatcgccaaacaggactacgcggtggaggtacaagggcccgctgcagaagccatccacaggttcatgctggaagcgattggcgccggggccaaatggccacaggccatgcgctggcggcgtccggcggcgcgcggcaacgcggcttttgacgctgacttgccaggtgccgccttgcttgtgacacgggacaaccgggcacatcggagcgacatcgagcggcactacctgatggcgatccgcgcggcgcggcgcgagatcgtcattgccaatgcgtacttcctgcccggctatcgcctgctgcaggcgatctgcgccgcggcgcagcgcggcgtcgatgtgaggctgatcttgcaaggcaggccggacatggtgtgggtcaagcgcaccgtcgacatgttgtacgcccacttgcgtgaatcgggtgtgcggattttcgagtactgcgagcgtcccaaccatagcaaggtggccgtggtggacgatgactgggccacggtgggatcgagcaatctcgatcccctgagcctgtcgctgaacctcgaagccaatctcgtgattcgcgatggcgcgttcgtcgccacgctaaaggacaccctgcgcgacctgatggtccgcagttgcacggagatatccgccgtcgagcgcggacagggcgcgtggtggcatggcatcgccacgccgctgatcttccacttcctgcgcaagtttcccgcctgggccggatggctgccggcccatacgccccggttggtgtcgccggagattccggcggccggcgttgcgccgccggcagacatggccgtgcacaacgttcaacgggatggctcatga

SEQ ID NO: 14505 - protein, 417 aa, Ralstonia eutropha JMP134
MDHGWTTGNRFRLLENGEEYFPRLIAALNAAHTSVLLETFILAEDDVGCRLAEALAAAARRGVQVALTVDGFGSADLSADYMVRLTQAGVAVRMFSPGRRLLGKRANLFRRLHRKLVAIDASVAFVGGINLCVDHLVQASPIAKQDYAVEVQGPAAEAIHRFMLEAIGAGAKWPQAMRWRRPAARGNAAFDADLPGAALLVTRDNRAHRSDIERHYLMAIRAARREIVIANAYFLPGYRLLQAICAAAQRGVDVRLILQGRPDMVWVKRTVDMLYAHLRESGVRIFEYCERPNHSKVAVVDDDWATVGSSNLDPLSLSLNLEANLVIRDGAFVATLKDTLRDLMVRSCTEISAVERGQGAWWHGIATPLIFHFLRKFPAWAGWLPAHTPRLVSPEIPAAGVAPPADMAVHNVQRDGS

SEQ ID NO: 14506 - DNA, 1551 bp, Burkholderia cepacia R18194
  CDS (1)..(1551)
atgaccatgctgcgttcgtggggtgcgattctttcgttgctggcgctcgttgcatgcgcgagcctgccgctgcaggccgatcgcgcgcagacgcacgcatacaccgatacggacaacacgcggctgggtgtcgcgttccagcagcaggccagtacgcatccggggcaggacgcgtttcatctgctgaccgatccggtcgacgcgctggatgcgcgcgtgttgctggccgatcgcgcagaccgttcgctcgaccttcagtactacatctggcacgacgacctgaccggacatgaactggccgacgcgatcattcgcgcggccgatcgcggcgtgcgcgtccgtgcgctgctcgacgacctcggcacgaacgcggacgatcgcaagctgctcgagatcagttcacatccgaacatcgagatccggctgttcaatccggtcgccacgcgccggttcaagaagatcggcacggtgttcgagttctcgcgcgtcaatcggcgcatgcacaacaaggcgatgattgcggacaaccaggcggcgatcgttggtggccgcaatatcggcgacgagtatttcggcgcatcgtcgatgctggagttcggcgatctcgacgtcgtcgttcacggcccggtcgtgaagaacatctcgaccgaattcgatacgttctggaattccccgtacgcgtacccgatcagtgcactggtcgggcatgacgcggcgcctggcgggctggaccgcgagcgcgaacggttgcgcgactacctgagggccatggaggacaatccgtacgtgctcgaggccaggcagcgactcgaccggatcgttcatgggcagggcacggaactgtcgtggggccatgcgacggtgctgtacgacgatccgtcgaagatcgcgcacgcgccgaaggacagcgatgggcacctgatgccgcagttgcgggcactcgcattgcagcccgaacacgacctgctgatcgtgtcgccgtatttcgtgccgggcaaggaagtcgtcgagcggctgcgcgcgctcacggcgcgcggcgtgcgcgtgacggtgctgaccaattcgctcgcgtcgaccgacgtggcggccgtgcatgcgggctaccggcactaccgaagcgatctcgtggccgccggcgtgcggctttacgaacggcggccgtcgggcgacaagagcatttcgaagcaggtcatcatcgggtcgtcgcgtgcgtcgctgcatgcgaagacctatgtgttcgatcacaagagcattttcatcggatcgatgaatctcgatccgcgctcgctgaacctcaatacggagatcggcgtttactgcgagagcccggcgattgcgtcgcaggtggccaacgatcttgaagcgcggctcgatcgaatcgcgtggcgcgtcgagccaaggaccgatccggcgggcaaagggccgctcaagtggattcagaccgattcggacggcaaggtcaccgtgctcgatcacgaaccggaagtgtccgccgcgcggcggatggaagtctggttccttgggctgttcccgatcgaatcgcaactgtga

SEQ ID NO: 14507 - protein, 516 aa, Burkholderia cepacia R18194
MTMLRSWGAILSLLALVACASLPLQADRAQTHAYTDTDNTRLGVAFQQQASTHPGQDAFHLLTDPVDALDARVLLADRADRSLDLQYYIWHDDLTGHELADAIIRAADRGVRVRALLDDLGTNADDRKLLEISSHPNIEIRLFNPVATRRFKKIGTVFEFSRVNRRMHNKAMIADNQAAIVGGRNIGDEYFGASSMLEFGDLDVVVHGPVVKNISTEFDTFWNSPYAYPISALVGHDAAPGGLDRERERLRDYLRAMEDNPYVLEARQRLDRIVHGQGTELSWGHATVLYDDPSKIAHAPKDSDGHLMPQLRALALQPEHDLLIVSPYFVPGKEVVERLRALTARGVRVTVLTNSLASTDVAAVHAGYRHYRSDLVAAGVRLYERRPSGDKSISKQVIIGSSRASLHAKTYVFDHKSIFIGSMNLDPRSLNLNTEIGVYCESPAIASQVANDLEARLDRIAWRVEPRTDPAGKGPLKWIQTDSDGKVTVLDHEPEVSAARRMEVWFLGLFPIESQL

SEQ ID NO: 14508 - DNA, 1275 bp, Burkholderia cepacia R18194
  CDS (1)..(1275)
atgacggcggaagcccgcaagcgcttcgcgcaattgcggcagatgttcctgcaggaacgcggttccgcgtcgcggctcgccttcacgtcgggcaataccgtgcggctgtgcgaaggcggcggcgcgttcttccgggcattgatcgagcggattgatgccgcccgcgagcaggtgatgctcgaaacctacatcttctgcgacgacgcggccggccggccggtgtcggacgcgctgatccgcgcggcgcagcgcggcgtgcgcgtgcgcgtgatcaccgacggcatcggcaccgcacgcctgccgctgttcgacacgtgggtcgcggccggcgtcgagcactgcatctacaaccgtttcctgttcggccgcttcggcttctcgcgcacgcatcgcaagcttgcggtgatcgatcacgcggtcgcattctgcggcggcatcaacatcatcgacgactatgcgcagaacggcacgacgctgccgtttccacgctgggatttcgcggtcgagatggcggggcccgcggtgtccgacgtgcgcgccgcgttcgaactgcagtggcaccggatcatgttcggccacaagccgtatgcgcaatacgcggccgggctgcatggcggcgaagcattccccgacatgttccggcgctggatgcgcagccatcggtggatcaaggccggcgcgctgcgggtcgtgacggagccgagcgtcgcgttcgtcgcgcgcgacaatgtcgtgaatcgccgcgcgatcgagaaggcgtatctcgcggcgatcggccaggcgcgccagcggatcctgctcgctaatccgtacttcatgccgggccgcaagctgcgccgcgcgctgacgggcgccgcgcgacgcggcgtcgacgtgcggatcctgatcggccgcaaggagttcgcggcactcgatacggccgtgccgttcctctatcacgcgctgctgcgcgcaggcgtgcgcgtggccgaatacgacaagacgatgctgcacggcaaggtggccgtgatcgacgacaattgggcgacggtcggttcgtcgaacctggacgcgctgagcctgatgctgaacaatgaagcgaatgtcgtgctggtgcgctacgatgctgtcacgaacgaactgcgcgacgcgatcgcggccgcattcgccgacggccgggaaatcgaccccgcccgattcgccgcgcgcccgcgtatcgagcgcatgctgaactggcttgcctatacggcgtatcgtctcgtgatgaaggcgctgacggtcggtggttacgactga

SEQ ID NO: 14509 - protein, 424 aa, Burkholderia cepacia R18194
MTAEARKRFAQLRQMFLQERGSASRLAFTSGNTVRLCEGGGAFFRALIERIDAAREQVMLETYIFCDDAAGRPVSDALIRAAQRGVRVRVITDGIGTARLPLFDTWVAAGVEHCIYNRFLFGRFGFSRTHRKLAVIDHAVAFCGGINIIDDYAQNGTTLPFPRWDFAVEMAGPAVSDVRAAFELQWHRIMFGHKPYAQYAAGLHGGEAFPDMFRRWMRSHRWIKAGALRVVTEPSVAFVARDNVVNRRAIEKAYLAAIGQARQRILLANPYFMPGRKLRRALTGAARRGVDVRILIGRKEFAALDTAVPFLYHALLRAGVRVAEYDKTMLHGKVAVIDDNWATVGSSNLDALSLMLNNEANVVLVRYDAVTNELRDAIAAAFADGREIDPARFAARPRIERMLNWLAYTAYRLVMKALTVGGYD

SEQ ID NO: 14510 - DNA, 1515 bp, Listeria monocytogenes str. 4b H7858
  CDS (1)..(1515): transl_table=11
atgcgcaaactgattcaatttctgtttatagcagtagttttatttttagtggaatactttttaatcaatcaagcagctatattattcttagtaacaagtggacttatccaattatgcggattaattattgtgattcggctactactctttgatcaacggaatactagctcaaaagtcgcctggattgcggttattttcattttacctgtacttggaacgattagttaccttgtgtttggtagaaatccagcaactagaaaattcagcacagctcaagtaatggaaaaagctaaattaattaatgcgattcacgcaattccaaacaacactaatgaaaaattaccacgactatctaaaagaattgcgcatttaacgtccatagagccaattaaggggaataaaatcgaaatattaacaaatggcgaagaaacttttccagtgctcttagacgcgcttagaaaggctgaaaaccacattcatattcaatactatattttcaaaacggatgaaatttctacagagattcgtgatattttggtagaaaaggcgaaatccggtgttgaggttaggtttatgtttgatggacttggttcaagcaaacttcataaggcatttttagcgcctctaaaagaagctggagttagtattcatgcgtttgatccaatcacatccccatggattgtaaggactgccaacttgcgaaatcaccgtaaaattgtcgtgattgatggtcaaattggctttacaggcgggcttaatattggagaagaatatcgttctaatacaccagatttccgtgtttggcgcgatacacatattaaaatcacaggccaagctgttatcgaacttcaagaatcttttctaaatgattgggtctatatggaaaaccaagcaggtgctgcagatcaatttattagtgaagctggattacaacaatatttttcaccagttgatgtgggtgacgaatgggcgcaagtgatttacggcggaccatatgataaagaaaaatgggttcgcgattcgatgcttgatttaattgattccgctaaagaatctgtttggattgtgtcgccttactttgttccagatgaggagtcgcttgcagttattcgccgggttgcgatgagcggtgttgacgtgcgagttattattccaggcaaaggtgatcgcgggatttcattccacggaagtaatgcgtatgtgaaaacaatgattgaagcaggcgcgaaaatgtatgcttatgccgatgattcttttgttcatgcgaaggcaatgctagtggacgggacgcgtgcagctataggtactgccaattttgacgtgcgtagttttagattgaatcatgaattaatggtattcttatatgatgaaagcgaggctatgcatcatttaaaacgtgattttgagaaagattttgaagatagccgactgtttacgatgaaagatatggaaaacaaaccattattgactcgtataaaagaagttctatctagtttactatcaccaattttataa

SEQ ID NO: 14511 - protein, 504 aa, Listeria monocytogenes str. 4b H7858
MRKLIQFLFIAVVLFLVEYFLINQAAILFLVTSGLIQLCGLIIVIRLLLFDQRNTSSKVAWIAVIFILPVLGTISYLVFGRNPATRKFSTAQVMEKAKLINAIHAIPNNTNEKLPRLSKRIAHLTSIEPIKGNKIEILTNGEETFPVLLDALRKAENHIHIQYYIFKTDEISTEIRDILVEKAKSGVEVRFMFDGLGSSKLHKAFLAPLKEAGVSIHAFDPITSPWIVRTANLRNHRKIVVIDGQIGFTGGLNIGEEYRSNTPDFRVWRDTHIKITGQAVIELQESFLNDWVYMENQAGAADQFISEAGLQQYFSPVDVGDEWAQVIYGGPYDKEKWVRDSMLDLIDSAKESVWIVSPYFVPDEESLAVIRRVAMSGVDVRVIIPGKGDRGISFHGSNAYVKTMIEAGAKMYAYADDSFVHAKAMLVDGTRAAIGTANFDVRSFRLNHELMVFLYDESEAMHHLKRDFEKDFEDSRLFTMKDMENKPLLTRIKEVLSSLLSPIL

SEQ ID NO: 14512 - DNA, 1212 bp, Bacillus cereus G9241
  CDS (1)..(1212): transl_table=11
atgattaaaaaaatattaagagttacttctattattattgctattttcttttttattttaatttggatgcatattgacgttaccttaggaaggaaaatggaagctggcaaaaatatgccgatagagtatgctcctcactatagtgattttcaattatatgtagaagggaagtcgttttataaacagttatttgctgatataagagaagcgaagcaatctatttatacatatttttttattttgtcggatgataaaagtagccatacttttttaaatttattaaaagagaaggcaaaagaaggagtaaacgtctatttatcagtggatcgcattaatgatttatcatttgaaagaaagatgataaatgaattgcgggaaagtggtgttcattttacgtatagtagaaaacctgaattaccattcgggttttattcacttcaccatcgtaatcatcgccgtattacgacgattgatggggagattggttatacgggtggttttaatataggagatgagtacttaggaaaagataagcgatttggatattggcgtgactatcatgtgcggcttaaaggagaaggagcaaaagatttagaggaacaatttgctttagattggaaacgagatacgaaagaggatataaagaggagcacaaataaggctagcaaagggaatacattacatactatggggagttacaatggacattacgttgctaaaaaatatatagagctaataaaacaagctcagcactcaattgtaattgcaacgccgtattttatagcgaaaaataaagaatcaatgaatgctttaattgcagcacaaaagcgtggtgttacagtaaaaatactttggtcatataaaccagatttacctcttataaaagaagcggcgtatccatatatacgtcaagctgttaataatgggattactgtatatgggtataaaaaaggaatgttccatggtaaattaatgcttattgataatgaattaaccgttattggcacaacaaactttacttcgcgtagctttaatataaatgatgaaatgaacttgtatattcatggtggaactattgtatcagaagtgaacgaagcattagcccaagattttcatgattcaaaagaaatgacgaaagagttttttgagaagttatctttttgggagcgttgtaaggagaaatttgcgggatggattgatttttatttgtga

SEQ ID NO: 14513 - protein, 403 aa, Bacillus cereus G9241
MIKKILRVTSIIIAIFFFILIWMHIDVTLGRKMEAGKNMPIEYAPHYSDFQLYVEGKSFYKQLFADIREAKQSIYTYFFILSDDKSSHTFLNLLKEKAKEGVNVYLSVDRINDLSFERKMINELRESGVHFTYSRKPELPFGFYSLHHRNHRRITTIDGEIGYTGGFNIGDEYLGKDKRFGYWRDYHVRLKGEGAKDLEEQFALDWKRDTKEDIKRSTNKASKGNTLHTMGSYNGHYVAKKYIELIKQAQHSIVIATPYFIAKNKESMNALIAAQKRGVTVKILWSYKPDLPLIKEAAYPYIRQAVNNGITVYGYKKGMFHGKLMLIDNELTVIGTTNFTSRSFNINDEMNLYIHGGTIVSEVNEALAQDFHDSKEMTKEFFEKLSFWERCKEKFAGWIDFYL

SEQ ID NO: 14514 - DNA, 1530 bp, Bacillus cereus G9241
  CDS (1)..(1530): transl_table=11
atgaagaaacctatcgtccaattactattaatatttacaattgtatctatcgttcttttcctattaaatacatcgtatatttcgttatatacatttgtcggcgttctctggtccatcacaattgtaggaatttcattcgttatttttatcgaaaatagatctcctcaaagtaccttagcgtggtttttagtattagcgcttcttcccgttataggtgtgcttttatactctattttcggacgtagccgttggagaagaaaaaagcatctccatcgttcagaagaacaaagaaaattattccgtgaaatattagaaggaagacggctagagttatcactcaaagtcccattaagtgaacgctctgcccatttaacagaagtcgtacaaaaatttggaggtgggcctgccgcagatagaacaactacaaaacttttaacaaacggagatcaaacattctcagaaattttgcaagcgatcgagcaagcaaaacatcacatacatattcaatactatatttataaatctgatgagattggtacaaaagttcgggatgcgttaataaaaaaagcaaacgctggtgttattgtacgcttcctttatgatggattaggaagtaatacgttaagaagacgctttttaaaacctatgaaagaagctgggattgaaattgttgaatttgaccctattttttctgcttggttacttgaaacagttaattatcgtaaccaccgtaaaatcgtcattgtagatggagaaatcggttttacggggggactcaatgtcggtgatgaatatcttggccgttcaaaaaaatttcccgtttggcgtgatagtcatttaaaaatagaaggaaaagcgttatataaattacaagcaatttttctagaggactggctctatgcatctagtggtttgaaaacttattcttgggatcaatttatgaatagacaatacttcccaggtaaagaaatttcaagtgcagaaggtgcggtgcaaattgtagctagcggaccaagctcagatgataaaagcattcgtaatacgttattagctattatgggctctgcaaaaaaatctatttggattgctacaccatattttattccagatcaagaaactttaacattattacgtttaagtgcaatatctggcatagatgtacgcattttatatcctggtaaaagtgatagtattattagtgatcaagcatcccagtcctacttcactccacttttaaaagctggtgcctccatttatagttataaagatggctttatgcatgcaaaaattgtaattgttgatgataaaattgcaacaatcggaacagcaaatatggatgtacgcagctttgaattgaattacgaaattattagcgtactgtatgaatcagaaactgttcatgatattaaacgtgattttgaagaagactttaaacattccactgaaattaaatggaacgctttccaaaaaagaagtatcaaaaaacgaatattagagtcttttatgaggctcatttctcctttactataa

SEQ ID NO: 14515 - protein, 509 aa, Bacillus cereus G9241
MKKPIVQLLLIFTIVSIVLFLLNTSYISLYTFVGVLWSITIVGISFVIFIENRSPQSTLAWFLVLALLPVIGVLLYSIFGRSRWRRKKHLHRSEEQRKLFREILEGRRLELSLKVPLSERSAHLTEVVQKFGGGPAADRTTTKLLTNGDQTFSEILQAIEQAKHHIHIQYYIYKSDEIGTKVRDALIKKANAGVIVRFLYDGLGSNTLRRRFLKPMKEAGIEIVEFDPIFSAWLLETVNYRNHRKIVIVDGEIGFTGGLNVGDEYLGRSKKFPVWRDSHLKIEGKALYKLQAIFLEDWLYASSGLKTYSWDQFMNRQYFPGKEISSAEGAVQIVASGPSSDDKSIRNTLLAIMGSAKKSIWIATPYFIPDQETLTLLRLSAISGIDVRILYPGKSDSIISDQASQSYFTPLLKAGASIYSYKDGFMHAKIVIVDDKIATIGTANMDVRSFELNYEIISVLYESETVHDIKRDFEEDFKHSTEIKWNAFQKRSIKKRILESFMRLISPLL

SEQ ID NO: 14516 - DNA, 1545 bp, Bacillus cereus G9241
  CDS (1)..(1545): transl_table=11
atgaaaaatacgttaaagttgattttctttgttttactattgttcgcattatttgtttcattacgtatgtttattgatgtagcattttattcggatgtaattgggataaaggatgtttcgattttaggtattattagtattttatttacagtatctgcatttttaattggctgcgttattttcttagagaaccgtcatccgtctaaaacacttacatggctcattgtgttagggatctttccggtatttggattcttcgcttatttattattcggacagaactttcggaggaagagaatgttccaaaagaaggcgttgctcgatgaacaagcgtttttacaatataaggggcatgaagattatgaagaactgattttgcgcaatcataagcatcaagagctgttatttcgtttagcggatcgcttaggcgctttaaatatttcatttcaaactgaaacgagaacattaacaaatggagatgaaacgtttcaggccattttagatggattaaaacgagcaaaacatcacattcatatggaatattacattgtgcgtgatgataagcttggaacagaaattaaagatattttaatacaaaaatcaaaagagggcgtagtcgttcgttttttatatgatgcggttggaagttttaaattatcaaaatcgtatattgaagaattaaacgatgcaggtgtcgaaatgattccgttctttcctgtgcgctttccgattttaaacgataagattaattatcgaaatcaccggaaaatcgttattattgatgggaatgaaggatttgtaggtggattaaatattggtgatgaatatttaggaaaggataagtacttcggcttttggcgagacacgcatttatatttgcgtggggaagctgtacaaagtttgcagcttattttccttcaagattggttttatatgactggtgaggctgtgctagcccctgaatatttacaagcgaaagcagttgagggggagcattggggcggcgtgcagctcgttgcaggtggaccggataataaatgggaaacaattaaacatttatattttgccatgattgcttctgcacgaaaatccatttggattgcaacgccgtatttcatcccggatgatgatattttatccgcattaaaagtagcggcacttgctggtattgatgttcggttgttaatgccgagtaagcctgataagcgaactgtcttttatgcatcgagatcgtacttcccagagcttttagatgcaggggtaaagatatatgaatacgaaaaaggttttctccatagtaaagtagttattgtcgattctgatttagcttcaattgggactgctaatatggatatgagaagttttcatttgaactttgaagtaaatgcctttttatatgatacagatagcattcgaaaacttgttcaagattttaaagatgatttagaagaatcaagtgaaattcacgtcgatcgttttcataaaaggcgtcttcatagacgaattgttgaatcaacgtaccggttattatcgcctttattataa

SEQ ID NO: 14517 - protein, 514 aa, Bacillus cereus G9241
MKNTLKLIFFVLLLFALFVSLRMFIDVAFYSDVIGIKDVSILGIISILFTVSAFLIGCVIFLENRHPSKTLTWLIVLGIFPVFGFFAYLLFGQNFRRKRMFQKKALLDEQAFLQYKGHEDYEELILRNHKHQELLFRLADRLGALNISFQTETRTLTNGDETFQAILDGLKRAKHHIHMEYYIVRDDKLGTEIKDILIQKSKEGVVVRFLYDAVGSFKLSKSYIEELNDAGVEMIPFFPVRFPILNDKINYRNHRKIVIIDGNEGFVGGLNIGDEYLGKDKYFGFWRDTHLYLRGEAVQSLQLIFLQDWFYMTGEAVLAPEYLQAKAVEGEHWGGVQLVAGGPDNKWETIKHLYFAMIASARKSIWIATPYFIPDDDILSALKVAALAGIDVRLLMPSKPDKRTVFYASRSYFPELLDAGVKIYEYEKGFLHSKVVIVDSDLASIGTANMDMRSFHLNFEVNAFLYDTDSIRKLVQDFKDDLEESSEIHVDRFHKRRLHRRIVESTYRLLSPLL

SEQ ID NO: 14518 - DNA, 1167 bp, Bacillus cereus G9241
  CDS (1)..(1167): transl_table=11
atgttcttcttatctctcttattactaggcagcactctctggattgtaattgatttttcttatgggagaattgttcatttaaagcgtgtacgttctcgttctttccctttacgtcaaagtgattttcacctttatacatatggaaaagatttgtatgacgctctatttactgatataaaacaggcgaaacaccatgtgcacgttttgttcttcattgtaaaaaacgataagatcagccgggaatttttaaagttacttattgataaggcaaaggaaggaattgaagtaagacttctactcgatcgattgggaggccatcatttatcaaacgaggccattcgctccctacaaaaacatggtgtctctttttcattttgtcacaaagtaaagtttccttttcctttcttttctgcaaatcaaagaaaccatagaaaaattacagttatcgacgggaaaattggttatattgtkggatttaatattggggaagaatatttagggcataatcaaaaattaggattatggcgcgattatcatttacgtcttacaggagaaggaatacaagatttacaaaagcaatttttacatgattggctcgacgatacggaccaaaatttattagatgcatctctttatttccctaagcaacaaccgggaagcattattcatcgttttatccctactgatggtgcttatttgcaaaatacatttgtgctggaaagcggtacaccatatttcattcctgggaaaaaaattatgaatgcattattagaagcacgaaaacgcggcgttcaaatcacgattctcgttccagaaaaagcggatcacgcccttgttcgagaagcaaaattcccgtattgccgaaagttaatacaagctggatgtaatatttacgcatttcaacaaggtttttttcacgctaaagttattatagttgatgactacatttgtgatatcggaactgcaaactttgatatgagaagtttatatattaaccatgaaatcaactgccttttatatgataaacattttatacaaaccgtaaaaaacaaattccatgaagatctaggaaacgcgtcattactttccttgaaagatgttagcccgaattctcttattgatagaggaaaagaatggataggaacaatacttgctttcttcctatag

SEQ ID NO: 14519 - protein, 388 aa, Bacillus cereus G9241
MFFLSLLLLGSTLWIVIDFSYGRIVHLKRVRSRSFPLRQSDFHLYTYGKDLYDALFTDIKQAKHHVHVLFFIVKNDKISREFLKLLIDKAKEGIEVRLLLDRLGGHHLSNEAIRSLQKHGVSFSFCHKVKFPFPFFSANQRNHRKITVIDGKIGYIVGFNIGEEYLGHNQKLGLWRDYHLRLTGEGIQDLQKQFLHDWLDDTDQNLLDASLYFPKQQPGSIIHRFIPTDGAYLQNTFVLESGTPYFIPGKKIMNALLEARKRGVQITILVPEKADHALVREAKFPYCRKLIQAGCNIYAFQQGFFHAKVIIVDDYICDIGTANFDMRSLYINHEINCLLYDKHFIQTVKNKFHEDLGNASLLSLKDVSPNSLIDRGKEWIGTILAFFL

SEQ ID NO: 14520 - DNA, 1194 bp, Bacillus cereus G9241
  CDS (1)..(1194): transl_table=11
atgttcttcttatctctcttattactaggcagcactctctggattgtaattgatttttcttatgggagaattgttcatttaaaagcgttacgttctcgttctttccctttacgtcaaagtgattttcacctttatacatatggaaaagatttgtatgacgctctatttactgatataaaacaggcgaaaacacctgtgcacgttttgttcttcattgtaaaaaacgataagatcagccgggaatttttaaagttacttattgataaggcaaaggaaggaattgaagtaagacttctactcgatcgattgggaggccatcatttatcaaacgaggccattcgctccctacaaaaacatggtgtctctttttcattttgtcacaaagtaaagtttccttttcctttcttttctgcaaatcaaagaaaccatagaaaaattacagttatcgacgggaaaattggttatattggtggatttaatattggggaagaatatttagggcataatcaaaaattaggattatggcgcgattatcatttacgtcttacaggagaaggaatacaagatttacaaaagcaatttttacatgattggctcgacgatacggaccaaaatttattagatgcatctctttatttccctaagcaacaaccgggaagcattattcatcgttttatccctactgatggtgcttatttgcaaaatacatttttatatttaatcgaaagcgcggaaaaagaactctttatcggtacaccatatttcattcctgggaaaaaaattatgaatgcattattagaagcacgaaaacgcggcgttcaaatcacgattctcgttccagaaaaagcggatcacgcccttgttcgagaagcaaaattcccgtattgccgaaagttaatacaagctggatgtaatatttacgcatttcaacaaggtttttttcacgctaaagttattatagttgatgactacatttgtgatatcggaactgcaaactttgatatgagaagtttatatattaaccatgaaatcaactgccttttatatgataaacattttatacaaaccgtaaaaaacaaattccatgaagatctaggaaacgcgtcattactttccttgaaagatgttagcccgaattctcttattgatagaggaaaagaatggataggaacaatacttgctttcttcctatag

SEQ ID NO: 14521 - protein, 397 aa, Bacillus cereus G9241
MFFLSLLLLGSTLWIVIDFSYGRIVHLKALRSRSFPLRQSDFHLYTYGKDLYDALFTDIKQAKTPVHVLFFIVKNDKISREFLKLLIDKAKEGIEVRLLLDRLGGHHLSNEAIRSLQKHGVSFSFCHKVKFPFPFFSANQRNHRKITVIDGKIGYIGGFNIGEEYLGHNQKLGLWRDYHLRLTGEGIQDLQKQFLHDWLDDTDQNLLDASLYFPKQQPGSIIHRFIPTDGAYLQNTFLYLIESAEKELFIGTPYFIPGKKIMNALLEARKRGVQITILVPEKADHALVREAKFPYCRKLIQAGCNIYAFQQGFFHAKVIIVDDYICDIGTANFDMRSLYINHEINCLLYDKHFIQTVKNKFHEDLGNASLLSLKDVSPNSLIDRGKEWIGTILAFFL

SEQ ID NO: 14522 - DNA, 1314 bp, Rubrivivax gelatinosus PM1
  CDS (1)..(1314)
atgaccgctccggccggcgccccgccgccggacgaccccgtgctgtccgaggccctggcctggtatgcccatgcccgggccgtgttcagcggcggcaacgaggtgcagttgctgcgtggcggcgatgcgctgttcccggccatgatcgagtcgatcggccacgccacgcacgaggtctggctcgccacctacatctatggcgacgacgtcgcggcgcaggccgtgtcggcggcgctcgtcgcggcggcccggcgcggcgtgcgcgtccgcgtggtggtggacggcttcggttcgctgcatgcgctggcggcgctgcgcgagcggctcgagcccgcgggcgtggcgctggccgtgttccggccgacgcagcgctggtggaactggctgcagcccggccagctgcgccgcctgcaccagaagctctgcgtggtcgacgggcaggtcggcttcgtcggcggcatcaacgtgctcgacgaccgccacgacctcaaccacggctggggcgacaccccgcggctcgactacgcggtgcgtgtgcggggcgcggtggtcgggccggtcgagcagacggcccgcgcgatgtggacgcgtgccgccttcggtcgcgactggcgtgacgaggtgcgacagatcgcgcgcagcagccagccgatggcgcgcgcgcgccgcctgctgcgacgcctgcgcatcgcggtgcggcgcggctcgccaggaggcttcggcgccggtgcgctgcagccggtgcgagtcgccttcgtggtgcgcgacaacctcagccagcgccgcagcatcgagcgcagctacatcgacgcgctgcgccgtgcgcagcagcgcatcgacatcgtgtcagcctacttctaccccggcttcgagttccgccgcgcgctgctggccgcggcgcggcgcggcgtgcgtgtgcggctgctgctccagggaaaagccgactatcgcttcgccgcgctggcggcgcaggcgttgtatgacgaactgctggcgcacggcgtggcggtgttcgagtacaccccggccttcctgcacgcgaaggtggcgctggtcgatcagcgctgggccacggtgggcagttccaacatcgacccgctgtcgctgttggtcaacctggaggcgaacgtgatcgtcgatgaccgcggcttcgcggccaccctgtcgcgcgagctggaccgcgacttcgccgtctcgcgcgagatcaccgcaccggtgccggtggccggctggcggcgctggctgcgccggggcttcgtcgcctgggtggcccggctctacctgcgcgcagccggcgccggcgggcgctactga

SEQ ID NO: 14523 - protein, 437 aa, Rubrivivax gelatinosus PM1
MTAPAGAPPPDDPVLSEALAWYAHARAVFSGGNEVQLLRGGDALFPAMIESIGHATHEVWLATYIYGDDVAAQAVSAALVAAARRGVRVRVVVDGFGSLHALAALRERLEPAGVALAVFRPTQRWWNWLQPGQLRRLHQKLCVVDGQVGFVGGINVLDDRHDLNHGWGDTPRLDYAVRVRGAVVGPVEQTARAMWTRAAFGRDWRDEVRQIARSSQPMARARRLLRRLRIAVRRGSPGGFGAGALQPVRVAFVVRDNLSQRRSIERSYIDALRRAQQRIDIVSAYFYPGFEFRRALLAAARRGVRVRLLLQGKADYRFAALAAQALYDELLAHGVAVFEYTPAFLHAKVALVDQRWATVGSSNIDPLSLLVNLEANVIVDDRGFAATLSRELDRDFAVSREITAPVPVAGWRRWLRRGFVAWVARLYLRAAGAGGRY

SEQ ID NO: 14524 - DNA, 1647 bp, Rubrivivax gelatinosus PM1
  CDS (1)..(1647)
atgggtgcggcatggcaccatcggcgcgaagccgccgccatgccctcgttcgcgtccgacctgccgaccccgcgccctcgccaccgcgttgtcccgctgacgctgtggcgggtggcgatgctgctggcctggctcgggctggcgggctgctcctcgctgccctcgcggccaccgttgcccgacgaggccgcgctgcccgcggcgaccgccggcgcgctggccgcgcaggtcgcgccgctggtgcaggcgcaccccggccgctccggcttcgtgccgctcgacagcgggctcgacgccttcgccgcacgcgtctggctggtcgaccgcgccggcagcagcctggacatccagacctacatctggcgcagcgaccgcaccggccgttggctgctgacgcgcctgcaggccgcggccgagcgcggcgtgcgggtgcgcctgctgctcgacgacggcaacggcagccccacgctcgacgggctgctgtcgcagctcgatgcccacccgggcgccgaggtgcgcttcttcaacccctatccgcaccgcggcctgggccgcgcgtgggacctggccaccgacttctcgcgcctgcaccggcgcatgcacaacaagacgttcaatgccgacggcgtggtcaccatcctcggcggacgcaatgtcggcgacgagtacttcggcgcggcggccgacatggagttcgccgacctcgatgtgctcgcggtcgggccgatcgtcggtgaggtgtcggcgtccttcgacgcctactggaacagcgcctcggcctacccgcggcggtcgctgctgttgcccggcaacgaccggccgctcacgcccgagcagcaggcggcgctcgacgaggccagcgcctacgcgaaggacctgcgcgagcgtccgcgcgtcgagcgctggcgcgagcgcgggccgcaggcgtccgacttcgtctggggccgctccacgctgttcgtcgacccgcccgacaaggtgctcaagcaggccggcgagagcgagctgatgttgccgcggctggcccgcacgctgggcaatgccgaccgcagcatcgacatcgtgtcgccctacttcgtgcccaccgacgacggcgtggccgcgttcaccgcgctgcacgaccgcggcgtgcggctgcgcgtgctgaccaactcgctggccgcgacggatgtctcggcggtgcacgccggctatgcaccatatcgcccggcgctgctcgacggcggtgtggagctctacgaactgcggccggtcccggcacccgaaggtcgcgcgcgcgggcggctgctgggcctgggttcgtcgcgcgcgagcctgcacgccaagaccttcgccgtcgacggcgagcgcgtgttcatcggctcgttcaacttcgatccgcgctcggcctggctcaacaccgagatcggcgtattgctcgagcacccaggcctcgcgcagcgcatcggacaagcgttcgacaccgaggtgccgcgccaggcctggcaggtgacgcgcgaccctgaccgcggccccgacgcgctgcgctggcgcggccagacgcccgaaggccagccgatcgagctgaccgaggagcccgaggccggctggctcacgcggctgtgggtgtggctgctgtcgtggctgccgatcgacgggctgctgtag

SEQ ID NO: 14525 - protein, 548 aa, Rubrivivax gelatinosus PM1
MGAAWHHRREAAAMPSFASDLPTPRPRHRVVPLTLWRVAMLLAWLGLAGCSSLPSRPPLPDEAALPAATAGALAAQVAPLVQAHPGRSGFVPLDSGLDAFAARVWLVDRAGSSLDIQTYIWRSDRTGRWLLTRLQAAAERGVRVRLLLDDGNGSPTLDGLLSQLDAHPGAEVRFFNPYPHRGLGRAWDLATDFSRLHRRMHNKTFNADGVVTILGGRNVGDEYFGAAADMEFADLDVLAVGPIVGEVSASFDAYWNSASAYPRRSLLLPGNDRPLTPEQQAALDEASAYAKDLRERPRVERWRERGPQASDFVWGRSTLFVDPPDKVLKQAGESELMLPRLARTLGNADRSIDIVSPYFVPTDDGVAAFTALHDRGVRLRVLTNSLAATDVSAVHAGYAPYRPALLDGGVELYELRPVPAPEGRARGRLLGLGSSRASLHAKTFAVDGERVFIGSFNFDPRSAWLNTEIGVLLEHPGLAQRIGQAFDTEVPRQAWQVTRDPDRGPDALRWRGQTPEGQPIELTEEPEAGWLTRLWVWLLSWLPIDGLL

SEQ ID NO: 14526 - DNA, 1287 bp, Pseudomonas fluorescens PfO-1
  CDS (1)..(1287)
atgagcagtgcaccgttggagaaatccgccgtggagcccgtcagcatcaccccgcccgtgcgcgagcccggcaccgtcgatgtcgagtatcgctggcagggcaacaaccggatcgagctgctggaaaacggcgaggaatattttccccgggtgttcgaagcgatgcgcgcggcgaaaagcgaaatcctgctggagaccttcatcgtcttcgaagacaaggtcggcaaggaattgcaggagattctgatcgatgctgctcggcgtggcgtgcgcaccaccgtcagcctcgacggcttcggttgcggcgaactgagcaccggctatctcgccgcgctgagtgaagccggcgtgcatctgcaaatcttcgatccggcccccaaacgcctgggcattcgcaccaactggttccgtcgtttgcatcgcaagatcgtggtggtcgacgggttgatcgcgttcatcggcgggatcaatttctccggcgatcacctggccgatttcggccccgaagcgaagcaggattactcggtggagattcagggcccggcggtgaccgacatccatcatttcgctttgctgcaaagcggccgaccgggacgggcgagattctggtggcagcgtcgccggcaacggcgtgccgagatggcgttcgacgatcacgacggtcaggtgcgcctggtgttccgcgacaacgaccggcaccacaccgatatcgaagacgtttatttgcaggtactgcgccgcgcccaacggcgggtggtgatcgccaacgcctacttctttcccggctatcgcctgctgcgcgagattcgcaacgccgcccgacgcggggtcgaggtgcggctgattctgcaggggcagccggacatgctggtggccaaactcgccgcgcgcatgacctacgactacctgctcaaggccggggtgcagattcacgaatattgcgagcggccgctgcacggcaaggtggcgctggtggacgaggaatggagcaccgtcggctcgagcaatctcgatccgctgagcctgtcgctgaacctggaagccaacgtgttgattcgcgaccgcgccttcaatcgccacctgttcgaacgtctcgaagacctcagccacaaccactgcaaagcgatggacgccgcgaagtcgccacgcgggcgaatctggcacatgaccgtgggctttctggtgtttcacttcctgcggcattttccggccatggccggctggctgccggcgcacaagccacgactcaaacccttttcccatgccgccgggagcgatcattcatga

SEQ ID NO: 14527 - protein, 428 aa, Pseudomonas fluorescens PfO-1
MSSAPLEKSAVEPVSITPPVREPGTVDVEYRWQGNNRIELLENGEEYFPRVFEAMRAAKSEILLETFIVFEDKVGKELQEILIDAARRGVRTTVSLDGFGCGELSTGYLAALSEAGVHLQIFDPAPKRLGIRTNWFRRLHRKIVVVDGLIAFIGGINFSGDHLADFGPEAKQDYSVEIQGPAVTDIHHFALLQSGRPGRARFWWQRRRQRRAEMAFDDHDGQVRLVFRDNDRHHTDIEDVYLQVLRRAQRRVVIANAYFFPGYRLLREIRNAARRGVEVRLILQGQPDMLVAKLAARMTYDYLLKAGVQIHEYCERPLHGKVALVDEEWSTVGSSNLDPLSLSLNLEANVLIRDRAFNRHLFERLEDLSHNHCKAMDAAKSPRGRIWHMTVGFLVFHFLRHFPAMAGWLPAHKPRLKPFSHAAGSDHS

SEQ ID NO: 14528 - DNA, 1158 bp, Pseudomonas fluorescens PfO-1
  CDS (1)..(1158)
atgcgcggcgcggtgtttccgtggcgtgatggcaaccgcttcgagctgttgatcgacggcccgcaattcttcccgcgcatgctcgacgagattgcccgcgcccgtgagcagatcgaactggagttgtatctggtggaagccggtgcctgtgccgaaaccatcgtgcaggcactggtgctggcggcggagcggggcgtgcgggtgcgttgcctgttcgatgattacggcagcctcgcgttcaccctcacgctgcgccggcggctgactggtgccggggtcgagctgcgtttttacaaccggctgaactggcggcgctgggtcggcaatttctatcgcgatcatcgcaagctgttgctggtcgaccagcgtctggcggtggtcggcggcaccggggtcaccgatgagttctggacgccgggccacgacaccagcgaatggcacgaggtcatggtggaaatcaccggcccgctggtgctcgactggcagttgctgttcgaccgccaatggatcgccaaccgccatcgccgggcctggcggcccaacgcgcattttgggctgccacggttgccccgtgtgccggacacgggcgagggcatgggccgtgtggcctacgccgacgcccgccagcatcgggacattctgcaatcgctgttccgcgccttgaacagtggccaaaagcgtatctggctggccacgccgtacttcctgccgacctggaaaatccgccgctccctgcgcaaggctgccgcccgtggcctcgacgtgcgtctgctgctgaccgggccgcgcaccgatcacccgtcggtgcgttatgccgggcatcgctactacccgcgcctgctcaaggccggggtgaaaatctacgaataccagccgtgtttcctgcacctgaaaatggtgctggtggacgactgggtgagcatcggctcgtgcaatttcgatcactggaatctgcgcttcaatcttgaagcgaatctggaagcgctggatccgtcattgacggcagcggtggcggcgagtttcgagaaggacttcggcctgagtcagcaggtgagtctggaggaatggcgaaaacggccactgtggcggcgggtgaagcagcggatctggggctgggtggatcgggtggtggtcaacttgctcgacagacgcggctag

SEQ ID NO: 14529 - protein, 385 aa, Pseudomonas fluorescens PfO-1
MRGAVFPWRDGNRFELLIDGPQFFPRMLDEIARAREQIELELYLVEAGACAETIVQALVLAAERGVRVRCLFDDYGSLAFTLTLRRRLTGAGVELRFYNRLNWRRWVGNFYRDHRKLLLVDQRLAVVGGTGVTDEFWTPGHDTSEWHEVMVEITGPLVLDWQLLFDRQWIANRHRRAWRPNAHFGLPRLPRVPDTGEGMGRVAYADARQHRDILQSLFRALNSGQKRIWLATPYFLPTWKIRRSLRKAAARGLDVRLLLTGPRTDHPSVRYAGHRYYPRLLKAGVKIYEYQPCFLHLKMVLVDDWVSIGSCNFDHWNLRFNLEANLEALDPSLTAAVAASFEKDFGLSQQVSLEEWRKRPLWRRVKQRIWGWVDRVVVNLLDRRG

SEQ ID NO: 14530 - DNA, 1263 bp, Burkholderia fungorum LB400
  CDS (1)..(1263)
atgctggcaattcccattaccgccttcgccacgctcgtcatcatattggtgattgccaatttatcgagcggtgagaagaagatcgaacataagatcgaacgcctctatgcgagcgacgatccgcaattccttcgctcaatgggtttgttgctcgggccgccggtcatctcgggcaatcgcttcgagatgctgctcaatggcgaccgtatttttccttccatgctggagggcatccgcagcgcgcgtcaaaccatcacgtttgaaaccttcatttactggtccggcgaaattggcgaacagattgcacaggcgctcgcggataaagcgcgcgaaggtgtcgcggtgcatgtactgctcgactgggtcggttcgtcgaaaatggacaagcgctatctgagtctgcttcgcgacgcgggcgtggaggtgattcagtatcacaagcctcactggaccggccttggccgcatgaacgaccgcacgcaccgcaaactgctggtgatagacgggcgtattggcttcacgggtggtgtgggtattgcgccggagtggaccggtcacgcggaaaatgaaaagcattggcgcgacacgcatttccgtgtggcgggtccggtggtcggccatatgcaggccgtgttcatggacaactgggtcaaggctaccggcaatgtgctgcacggtcccgcctatttccccgatatcgagccaatgggcgacgggctcgcgcatatgttcagcagttcgccttcgggcggcagcgacgatatgcaattgatgtatctgatggcgattacggcggccacgcactccattcatctggcgagcgcctatttcgttcccgacaagctcactatcaacgccattgtcgaagcggcgaagcgcggcgtgaaagtgcggatcatcacgcccggaaaacgcatcgatacacacaccgtgcgcgaagcatcgcgcgcgtgctggggcgatctgctgaaagcgggcgtggaaatgttcgaatatcagccgaccatgtttcactgcaaattgctggtggtggacgaatacctggtgtcggtcggctccaccaatttcgacagccgttcattcaagctcaacgacgaagcgaatctgaacatttatgaccgcgacttcgcgaagcagcagaccgccattttcgccgacgatttaacgaagtcgcagcaggtgacgctcgaagcatggacacatcgcccgttcactgaaaagctgatcgaaaagttcgtgccgctgctggatacgcagttataa

SEQ ID NO: 14531 - protein, 420 aa, Burkholderia fungorum LB400
MLAIPITAFATLVIILVIANLSSGEKKIEHKIERLYASDDPQFLRSMGLLLGPPVISGNRFEMLLNGDRIFPSMLEGIRSARQTITFETFIYWSGEIGEQIAQALADKAREGVAVHVLLDWVGSSKMDKRYLSLLRDAGVEVIQYHKPHWTGLGRMNDRTHRKLLVIDGRIGFTGGVGIAPEWTGHAENEKHWRDTHFRVAGPVVGHMQAVFMDNWVKATGNVLHGPAYFPDIEPMGDGLAHMFSSSPSGGSDDMQLMYLMAITAATHSIHLASAYFVPDKLTINAIVEAAKRGVKVRIITPGKRIDTHTVREASRACWGDLLKAGVEMFEYQPTMFHCKLLVVDEYLVSVGSTNFDSRSFKLNDEANLNIYDRDFAKQQTAIFADDLTKSQQVTLEAWTHRPFTEKLIEKFVPLLDTQL

SEQ ID NO: 14532 - DNA, 1554 bp, Burkholderia fungorum LB400
  CDS (1)..(1554)
atggcgacgtttcgtggcattgcggcaatcctgctgatcgcgttgctgtccgcctgcgcgagcctgccgccacaggccgggcgcagcgcgacacacgcgctgacggacaccgacagcacccggctcggcgccgcgttcgtgccgcaggagcgcaagcatcccgacagcagcgcattccatctgttgcccaacggcgtcgatgcccttctcgcccgtatcgtgctggcggatgcggccgagcgtacgctcgatctgcagtactacatctggcacgacgatctgaccggccgccacctggccgacgccgtgctcaaggcggccgatcgcggcgtcagggtgcgcgtgttgctggacgacctgggcaccggcgccgacgaccaggttctgctcgccatcagttcacactccaacatcgaaatacggctgttcaatccgattgccagccgcagcttcaagaagctcggcagcgcgctggagttcagccggatcaaccgccgcatgcacaacaaggcgctgatcgcggacaatcaggccgccatcctgggcggccgcaatatcggcgatgagtatttcggcgcatccagcgaggtcgatttcggcgatctcgacgtgctgactttcgggccggtggtccacaaggtctccaatgccttcgacgaattctggaactcggaggccgcctatccgattgccagtctgaccggccacgccgccggcccggacgcgctgccgggctatcgcgcgaagctcacggcattcgttgcgtccgaacacgattcgccgtacgtcacgcaggcacgggaaaggcttcgcgacactctggatgcgcgcgagaccgacttcgcctggggaaaagccacgctcctctacgacgatcccgccaagatcacgcgctcgccggacgatccacagggacacttgctgtcgcagttcgacgcgctgagtatccagcccgccaaggaagtgctgattatctcgccgtacttcgtgcccggtaaaaagggcgtggcgtggatgcgtgcacagacgcagcgcggcgtgcgcgtgacggtgctgacgaactcgctcgccgctacggacgttgcggcggtccacgcggggtatcagcgctatcgcaaggatctgctcgacgcgggcgtgcatctctacgaactgaagccggctcccggcgaagacaacggcgagaaaaagaaatcgattctgggttcctcgaaagcctcgctgcatgcaaagacctatgtattcgacaggacgagtgtcttcatcggctcgatgaatctcgatccccgttcgatcacgctcaatacggagatcggcgtgtactgcgaaagcgccccgctcgccgctcaggtggcggatggactcgaaccgagactggatcagatcgcgtggcggctggaaacccgcacggatggcaatggcacgagtcgcattgtgtggatcgacaccgcgccggacggcaaagtgaccgagagcgacgaacccggcgtgtctggcatcaagcgtgtaggtatctggtttctcggcctgttgccgatcgaatcggagttgtga

SEQ ID NO: 14533 - protein, 517 aa, Burkholderia fungorum LB400
MATFRGIAAILLIALLSACASLPPQAGRSATHALTDTDSTRLGAAFVPQERKHPDSSAFHLLPNGVDALLARIVLADAAERTLDLQYYIWHDDLTGRHLADAVLKAADRGVRVRVLLDDLGTGADDQVLLAISSHSNIEIRLFNPIASRSFKKLGSALEFSRINRRMHNKALIADNQAAILGGRNIGDEYFGASSEVDFGDLDVLTFGPVVHKVSNAFDEFWNSEAAYPIASLTGHAAGPDALPGYRAKLTAFVASEHDSPYVTQARERLRDTLDARETDFAWGKATLLYDDPAKITRSPDDPQGHLLSQFDALSIQPAKEVLIISPYFVPGKKGVAWMRAQTQRGVRVTVLTNSLAATDVAAVHAGYQRYRKDLLDAGVHLYELKPAPGEDNGEKKKSILGSSKASLHAKTYVFDRTSVFIGSMNLDPRSITLNTEIGVYCESAPLAAQVADGLEPRLDQIAWRLETRTDGNGTSRIVWIDTAPDGKVTESDEPGVSGIKRVGIWFLGLLPIESEL

SEQ ID NO: 14534 - DNA, 1452 bp, Burkholderia fungorum LB400
  CDS (1)..(1452)
atgcaattcgacctgcttcacatcggcacgctggtcgccctctgccacattctcggcgtggtcgcggcgtgccatgcgattctcaacacccgcacgtcgcaaggcgcgattgcgtgggccgtgtcgctggtcgcaatgccttatctgacgctggtgccgtatctgttcctcggccgcagcaagtttgccggctacgcggacgcgcgccgggtcgagaacgaactgctgcgcacgcgcgcgcatccgccggaatgggacacgcaggcttcgtcggaaaggctgcccacgcaggagctcggcggcaggctcgtgcattcgctcacgcgtctcggcggcatgccgtttctgcccggcaactcggtgcgcacgctggtcaacggcgcggcaaccttcgaggccatcttccaggcgatcgagggcgcgcgccgctacgtcatcgtgcagttcttcatcgtgcgcgacgacgcgctcggcgagatgctcaaagacgcgctgatcgcgaaagcgcagcaaggggtgcgcgtctacttcctgtacgacagcatcggcagcttcgatctgccccaccgctatgtggcggcactgcgcgcggcgggcgtggaaacgcacccgttcgccacccatcgccgcttcgtcaaccgtctgcaggtgaatttccgcaatcaccgcaagatcgtttcggtggacggcgaacgcgcgtttgtcggcggacacaacgtgggcgtggaatatctcggcggcaaaccgccactttcgccgtggcgcgatacgcatatcgaagtgcgcggcccggcggtcgccagcatccagttcgtgttcaccgaagactggcactgggccacgcagcagttgcccgaattcgacatgccgcccgctgcggccgccgaccccgcggccggccagggcatgcactgcctcgtagtgccgagcggcccggccgacaagcaggagacctgttcgctctttttcgtcgaagcgatcaatgcggcgcgcgagcggatctggatcacctcgccctacctgattcccgatgaagcggtgttctcggcgttacggctcgcggcgctgcgcggcgtggacgtgcgcattctgattccgagccggcgcgatcacctcgtcgtattcgctgcttccaaactgtatgcatatgactcgctgcgcgccgggatccggatcttccgctaccagccgggcttcctgcatcagaaggtcgtgctgatcgacagcgtggccgcggccatcggcagcgccaatctcgacaaccgctcgttccggctgaacttcgagatcatggtgctgaccgtggatcgcggctttgccaaagaggtcgaaatgatgctgctggccgacttcgccgaatcgcgcgaaatcgaccgcaatgagtaccggcaggcaggcgccctgaagcgcgtgctgatgcacgtggcgcggctcttttcgccaatcctgtag

SEQ ID NO: 14535 - protein, 483 aa, Burkholderia fungorum LB400
MQFDLLHIGTLVALCHILGVVAACHAILNTRTSQGAIAWAVSLVAMPYLTLVPYLFLGRSKFAGYADARRVENELLRTRAHPPEWDTQASSERLPTQELGGRLVHSLTRLGGMPFLPGNSVRTLVNGAATFEAIFQAIEGARRYVIVQFFIVRDDALGEMLKDALIAKAQQGVRVYFLYDSIGSFDLPHRYVAALRAAGVETHPFATHRRFVNRLQVNFRNHRKIVSVDGERAFVGGHNVGVEYLGGKPPLSPWRDTHIEVRGPAVASIQFVFTEDWHWATQQLPEFDMPPAAAADPAAGQGMHCLVVPSGPADKQETCSLFFVEAINAARERIWITSPYLIPDEAVFSALRLAALRGVDVRILIPSRRDHLVVFAASKLYAYDSLRAGIRIFRYQPGFLHQKVVLIDSVAAAIGSANLDNRSFRLNFEIMVLTVDRGFAKEVEMMLLADFAESREIDRNEYRQAGALKRVLMHVARLFSPIL

SEQ ID NO: 14536 - DNA, 1503 bp, Cytophaga hutchinsonii
  CDS (1)..(1503)
atgttatttttatgctcctgttcggaatcttccaaagaaattccggtgcaggaaaaagatttttgcgcatctattcaccgcaatgattcgctaagtcttacacatgagctggaacctttcatagattccatgaaaaataaaacaggtgtttatgtacttgaagatggcggcggctcgctgatcacacgcgcctggctgagtgagtatgcagaagaaacaatcgacattcagtattttattttttcagcagataatgtggggcttattgcctgtgattatctggtacgtgcggcagaccgtggtgtaaaagtacgcatcctgatcgatgatatattggttgaagccggcgtacatgaaatactcacgcttgactcgcatgaaaatattgaaattaaaatttataatcccggtatcaatctgggtaaaaatatatttaataagatcgggaaattcacgaccgattttcgaggcgcaaatcagcgcatgcacaacaaaacgtttattgttgatcacaaagtcgtgattacaggtggcagaaatattgccgatgaatattttgattacgaccacgaatataatttcagggacagggatgtattactgataggtaaaacagcaacggatgtacaacaatcgtttgagtcattctgggttgacgcgctgagtattccgatcacaggactggtgaaggaggatgatgtaacctataccgatacaagtcgttttgaacgcctgcatcaatatgcctgtaacccggataatttctggccgcaggtacggaagcgcatttcaaatcttaccgaaacatttcaggtaatgagagattcgggcaggttaaaatgggtagagcatgtgcagtttgtttccgatgcaccgggcaaaaatgatggcaaacagggacttggcggcggcggtgtatgcaccgacagtctgattagtcttataaaacgtgcaacaacatccattgatattcaatcaccttatttaatcacaacggaagttggccgaacgttatttaaagctgcggttgaccggggcgtacgcattcgtattttaacaaacagtcttgcttctaccgataacctcgaagcgtttaacggttatcagcgcgacagaaaaaaattacttgcaacaggggttgagatctatgaattcagacctgatgctgcggtgcgttaccagatcatgaccggagcattgcaggaaaaaatgcagtatacacccattttcggtttgcatgcaaagtcgatggtgattgatggtaccattgctgttataggtacatttaacctggatccgcgcagtgccaatctgaatacagaatgtgtaaccattatctactcaaaagaggttgcagcaggagtgcttgcaggaatggaaactgaaatcaaaccggaaaatgcctggcatacgacaactgtattcaatccggatggtgaagccggagcaaagaagcaagctaaagcgtggacacgcagagtggtgccgaaaggaattttataa

SEQ ID NO: 14537 - protein, 500 aa, Cytophaga hutchinsonii
MLFLCSCSESSKEIPVQEKDFCASIHRNDSLSLTHELEPFIDSMKNKTGVYVLEDGGGSLITRAWLSEYAEETIDIQYFIFSADNVGLIACDYLVRAADRGVKVRILIDDILVEAGVHEILTLDSHENIEIKIYNPGINLGKNIFNKIGKFTTDFRGANQRMHNKTFIVDHKVVITGGRNIADEYFDYDHEYNFRDRDVLLIGKTATDVQQSFESFWVDALSIPITGLVKEDDVTYTDTSRFERLHQYACNPDNFWPQVRKRISNLTETFQVMRDSGRLKWVEHVQFVSDAPGKNDGKQGLGGGGVCTDSLISLIKRATTSIDIQSPYLITTEVGRTLFKAAVDRGVRIRILTNSLASTDNLEAFNGYQRDRKKLLATGVEIYEFRPDAAVRYQIMTGALQEKMQYTPIFGLHAKSMVIDGTIAVIGTFNLDPRSANLNTECVTIIYSKEVAAGVLAGMETEIKPENAWHTTTVFNPDGEAGAKKQAKAWTRRVVPKGIL

SEQ ID NO: 14538 - DNA, 1434 bp, Oenococcus oeni PSU-1
  CDS (1)..(1434)
atgaatttgttgattgctgtaattttaatagtcctggtactaaacgcgaccttatcttttattacggttttttggagtaaaagggatgttagcagaatttgggcctggttagtcgttttggtttttgttcccgtaatcggtttcgttatttattggtttgccggtcgccgaatttccgataaaaaaatctttgattttacaagtcaggaaatcgtcggtcgcgagcaaatcagagataaccaaaaatattatggtcatcatttacatttgaatcaaaaagcgagtatgcttgttgaactatttgaaaataattccggatcaatactgacttatggcaatgatctggaaactttttttgatggccgggctttttttgatgatttatttgctgaaatagacaaggccaaggaccatatccatttagcctattttgcaatcagcaatgatgttatcgggaataaattagttgatctgttggccaagaaagcccgtcagggagttggggttagagttatttatgatgcatacggatctcacggaactcatttaggaatgtatcatcgtttactgaaagccggcgggaccgtttatccttttttaaccaggcgctttcaattattagccctgcgaatcaattttcgttttcacagaaaagttgttgtgattgatggaaaagttggttatattggaggattcaatataggtgatcagtatcttggcaagtcgaaaaggtttggcaattggcgtgattcccaacttaaaattattggtgattcggtactttctttacaatcgcgtttttttatcgattggaatgcaaccgctaagaaacaagacaaattgtcttttttggaagattattttccggcgactcaagttaatggaattcatccaatccaaattgtctcttcggggccggattctttaacggcgcaaattaaacagggttatttgaaaatgataactttggcgacaaaatcaattaccatccagaccccttatttgattcccgaccaaccgatttacgaaagtcttacgatagctttagcggccggcgtcaaagttaacatttttattccggatcgtcccgatcatccttttgtttaccgggcaactcagtactatgcgcaggaatttattgatttcggagcaaacgtttatcgttatgatggtggttttttgcacagcaagcttttaattattgatgatgaaatcgtcagcattggctcagccaatatggatattcgatcttttgaattaagttttgaagcaaatgctttcatttacagcagctatttcgctaaaaaaatcgagaaacaaatttcgattgacatttccaagtcaaagcttttaagcaaaaaagatttcgaaacacagggattttggatgacagtattacagaaattttctcgtctgctatcaccgatactttaa

SEQ ID NO: 14539 - protein, 477 aa, Oenococcus oeni PSU-1
MNLLIAVILIVLVLNATLSFITVFWSKRDVSRIWAWLVVLVFVPVIGFVIYWFAGRRISDKKIFDFTSQEIVGREQIRDNQKYYGHHLHLNQKASMLVELFENNSGSILTYGNDLETFFDGRAFFDDLFAEIDKAKDHIHLAYFAISNDVIGNKLVDLLAKKARQGVGVRVIYDAYGSHGTHLGMYHRLLKAGGTVYPFLTRRFQLLALRINFRFHRKVVVIDGKVGYIGGFNIGDQYLGKSKRFGNWRDSQLKIIGDSVLSLQSRFFIDWNATAKKQDKLSFLEDYFPATQVNGIHPIQIVSSGPDSLTAQIKQGYLKMITLATKSITIQTPYLIPDQPIYESLTIALAAGVKVNIFIPDRPDHPFVYRATQYYAQEFIDFGANVYRYDGGFLHSKLLIIDDEIVSIGSANMDIRSFELSFEANAFIYSSYFAKKIEKQISIDISKSKLLSKKDFETQGFWMTVLQKFSRLLSPIL

SEQ ID NO: 14540 - DNA, 1464 bp, Pediococcus pentosaceus ATCC 25745
  CDS (1)..(1464)
atgtttcaaattataaaagatattatatatattattcttattctaaatattattggtgccgtttatacagtttttagacaacgtcgagatatagctgctacttgggcctggttattggtcttatttttcttgcctggtgtaggctttgtgatatacgcctttgtgggacgaaagctaccagaaaacaaattatttccgctgaaaagtaagactcgccttcaattggatcaagttatggagcatcagcgtcgagagctaaaaaagaatgagtttactgctgccgatcaagttgttaaagattcagaacgaatggtccaattctttactaaaacggattattcttttttaaatcgaagaaatgaagttcaaatcatcacagatggaaatgaactttttgatgatatttttgctgaaattaaaaaagcgaaaaagcatattcacgttgaattttatacaatttatgatgatcaaattggcaatcagttacgcgagctattggaagaaaaagcacgtgaaggtgttgaagttaaggtgctatgggattcatggggatcgctaggtaccaaaagaagtttcttcaagaaattgaatgaactaggcggagaagcgtatccatttctaggtacacgttcagctttaactgactttcgattgaacttcagggatcaccgtaaaattgtcgtgattgatggtaagattggttatgttggtggttttaatgtgggagatcaatatttaggccgtaagaagaaatttggttattggcgagatacccatttgaaaatcatcggttctggagtttacggacttcaatcaagatttatcctggattggaatgctacagaccgtaaaaaacaaattgtcgaagagtttaaagctggatcagtttatttcccagtcgctgaagttaaaggcaataccagtcttcaaatcgttagtaatgggccagattcagatattgaaaaaattaaaatgggttatttgaaaatgattcataaagccagagaatcggtttggattcaatcaccatatttaattccagatgatagtgtcttggacgcattgcgcttagcagcaacatcgggagtagatgttcgagtaatgattccatgtatgcctgatcacgcgtttgtctatcgtgcaacccaatattatgcttggcaatgtgctaagtggggaattaaagtttattactacaacaatggtttcatccatgctaaaacgatggtagtggatggaaaaatatctacagtgggttctgcgaatatggatttccgtagtttcaaacttaattttgaagttaacgcctttatgtatgatgaaaatattgcaaaacaactgcaggaaatttatgaagaagatatcaaacattctagtctccaaaccgtagccatgtttaataaacaatccacatggctgaagttcaaacaaaccttttcacgtttgctttcaccaattttgtaa

SEQ ID NO: 14541 - protein, 487 aa, Pediococcus pentosaceus ATCC 25745
MFQIIKDIIYIILILNIIGAVYTVFRQRRDIAATWAWLLVLFFLPGVGFVIYAFVGRKLPENKLFPLKSKTRLQLDQVMEHQRRELKKNEFTAADQVVKDSERMVQFFTKTDYSFLNRRNEVQIITDGNELFDDIFAEIKKAKKHIHVEFYTIYDDQIGNQLRELLEEKAREGVEVKVLWDSWGSLGTKRSFFKKLNELGGEAYPFLGTRSALTDFRLNFRDHRKIVVIDGKIGYVGGFNVGDQYLGRKKKFGYWRDTHLKIIGSGVYGLQSRFILDWNATDRKKQIVEEFKAGSVYFPVAEVKGNTSLQIVSNGPDSDIEKIKMGYLKMIHKARESVWIQSPYLIPDDSVLDALRLAATSGVDVRVMIPCMPDHAFVYRATQYYAWQCAKWGIKVYYYNNGFIHAKTMVVDGKISTVGSANMDFRSFKLNFEVNAFMYDENIAKQLQEIYEEDIKHSSLQTVAMFNKQSTWLKFKQTFSRLLSPIL

SEQ ID NO: 14542 - DNA, 1365 bp, Pediococcus pentosaceus ATCC 25745
  CDS (1)..(1365)
atggaaaagcgagatatttctgcagcatgggcttggttatttgtaatgctattgcttcctggaattgggtttataatttatctattttttggctggaagttaaatcaaaggcaaatatttgatttgaaagctcaaaaaagactcggaattagcgatatggctgaatatcaaaagcgtaatcctaaaaacaaaccgaccctggataccaatcttgaaaatgacttggttcagatgtttttaaacacggataatgcaattttaacgactaaaaatgatttaaagatttttacagatggtcatgaaaaatttaacagcttgtttgaagatttaaaaaaggctaaacatcatatcaatatcgaatattttacaatctatgatgatcagttaggcaaaaaattacgtaaaattttggttcaaaaagcgcgtgaaggtgtccaagtaagggtgttgtacgatttatttggatcaaaaggatccaagcaaaaattttttaaagaattaattcaggctggtggcgaagtcacgccatttatgaaatctaaactaggctattatagttttagaattaattttcgaaatcatcgaaaaattgtggtgattgatggatcggttggatacattggtggttttaacattggtgaccaatatttaggacgtaataagcgctttggaaactggcgtgatacgcacttaaggttagagggttccgtggtattgcaattgcaaagtcgttttttcatggattggaatgcatctgctaagcgtcaaaaagttcaatttagcttagattattttccacaaagtaacgttcaaaataatattccaatgcagattgttagtagtggacctgagaatgatgttcaaaaaatcaaacagggttatattaaaatgattatgggggctaaacattccatttggattgaaacgccatactttatccctgatgatgccttaatggaagctttgttaatcgctattcgttcaggcatcgaagtgcggattgtaattccacaaatgcctgatcatcccttcgtctaccgggctacagagtattatgtacaacaattgttaaaagctggcgcgcgtatctattcatatcaaaatgggttcatgcatgctaagacgattgtggtcgataatatgattacaagtgtaggttcagcaaattgggatattcgttcttttaaattaaattttgaagcaaatgcatttatgtatgatcctaaagtggctgaacaaataatcgctacaattaaaaatgatttaaaggatgcgcgtgaattggatgaagaatatttcaagcaacaatcttcgtggaaaaaattccgtcaattggctagtcgtttgatttcaccaattctttaa

SEQ ID NO: 14543 - protein, 454 aa, Pediococcus pentosaceus ATCC 25745
MEKRDISAAWAWLFVMLLLPGIGFIIYLFFGWKLNQRQIFDLKAQKRLGISDMAEYQKRNPKNKPTLDTNLENDLVQMFLNTDNAILTTKNDLKIFTDGHEKFNSLFEDLKKAKHHINIEYFTIYDDQLGKKLRKILVQKAREGVQVRVLYDLFGSKGSKQKFFKELIQAGGEVTPFMKSKLGYYSFRINFRNHRKIVVIDGSVGYIGGFNIGDQYLGRNKRFGNWRDTHLRLEGSVVLQLQSRFFMDWNASAKRQKVQFSLDYFPQSNVQNNIPMQIVSSGPENDVQKIKQGYIKMIMGAKHSIWIETPYFIPDDALMEALLIAIRSGIEVRIVIPQMPDHPFVYRATEYYVQQLLKAGARIYSYQNGFMHAKTIVVDNMITSVGSANWDIRSFKLNFEANAFMYDPKVAEQIIATIKNDLKDARELDEEYFKQQSSWKKFRQLASRLISPIL

SEQ ID NO: 14544 - DNA, 1191 bp, Thiobacillus denitrificans ATCC 25259
  CDS (1)..(1191)
atgaccccgcgcggtccctggtcgcggctgttttttcgccgcgtcgacatggtttcgggcaaccacctgcggctgttgcagagcggggccgactacttccctgcgctgatcgccgcgttcgacgccgcccgcgccgaaatctatcttgaaacctatatcttcaacgccgactcgacggccgaggccgtgcgcgacgcgctcgttcgcgccgcgcagcgcggcgtgcaggtgcgcgtcctgatcgacgcgatcggttcgcgtgaactgcctgccgcgtggctggaagcactgaagacggcgggcgtcgccgtcctcaagtaccggccgctggtcaccggctggcgctcgaatccgaaaagtctgcgccgattgcaccgcaaggtcgcggtcgtcgacgcgcgcatcgcttttgtcggcggcatgaatctgctcgacgatttcgagccgattcgctttcctgtcgcgcgtttcgacttcagcgtcgaagtgcaggggccgctgatcgtggcgatccatcaaagtgtgcaccacctgtggcgtctggtcgccttgagccaactgcagccaatcgaccgcaagcattcggttcacccttcctggccgaccgacggccgcgtccgcgcggctttcgtgacgcgcgacagctttgcccatcggcgtgacatcgagcgcagctacctgacggcgcttgcgctcgcgcgcagcgacatcctgattgcgaacgcctattttctgcccggcaaccgcttccgcaagctgctgaaaaaagccgcggcgcgtggggtgcgcgtgcagctgctcgtgcaggggcataccgaccatcctttttttcaggcggcgtcgcgcgcgctctaccaggatcttctagtcgccggcgtcagcatccgcgagtatcaggcgagcgagttgcacgccaaggtcgcggtcgtcgatgaccactgggcgacggtcgggtcgagcaacatcgacccgttcagtctgatgctcgcgcgcgaggcgaacatcgtcgtcgacgacgtggggttcgccgccgacctgcgcgagcgcctgcagcgcgcggtggacgaatcggccgcgctcagtgccgccgactggaagatccgtccctggcgccagcgcctggcctcgcggcttgcctacgggctcgtgcgctttctgcttggcgtcgcgcggctcgggcgctggctgtaa

SEQ ID NO: 14545 - protein, 396 aa, Thiobacillus denitrificans ATCC 25259
MTPRGPWSRLFFRRVDMVSGNHLRLLQSGADYFPALIAAFDAARAEIYLETYIFNADSTAEAVRDALVRAAQRGVQVRVLIDAIGSRELPAAWLEALKTAGVAVLKYRPLVTGWRSNPKSLRRLHRKVAVVDARIAFVGGMNLLDDFEPIRFPVARFDFSVEVQGPLIVAIHQSVHHLWRLVALSQLQPIDRKHSVHPSWPTDGRVRAAFVTRDSFAHRRDIERSYLTALALARSDILIANAYFLPGNRFRKLLKKAAARGVRVQLLVQGHTDHPFFQAASRALYQDLLVAGVSIREYQASELHAKVAVVDDHWATVGSSNIDPFSLMLAREANIVVDDVGFAADLRERLQRAVDESAALSAADWKIRPWRQRLASRLAYGLVRFLLGVARLGRWL

SEQ ID NO: 14546 - DNA, 1443 bp, Thiobacillus denitrificans ATCC 25259
  CDS (1)..(1443)
atgccgcatccgagcccctcacccatcccgcgacgcagtcgcggcgggatcgcgggcctgacaagaatcctgatcgcttgttgcgcggcgccgctctgcgcctgcgccaccctgcccgaggcgccgcgtctcgcggcgggtccagtcgccagtccgccggtcaatttcgagtccgctcgcggcccggtttcggcacgccgcaacgcggcgatcttcgccgagctcaagcgcgacggcggcgacagcgcgatcctgctgcgccacctcgcgctcgaggaagcggtcaatcgcgacagcccgctcgtcgtcggcaaccggctgacgttgctgcaggacgggccggcgacctaccgcgcgatgttcgccgcgatccgcagcgctcgcgatcacgtcaacctgcagacctatattttcgaggcggggcagaccggcgagaccttcgcgcgcctgctgctcgagaaacaggctgccggcgtgcaggtcaacatcatctacgacagtgtcggctcgatcgacacgccgcccgctttcttccagcggctgcgcgacgccggcatgcgcgtgctcgaattcaatccggtcaacccggccaagctcaagaagaagaaatggcggctcaacaaccgcgatcaccggaagctgctcgtcgtcgacggcaagacggcttttctcggcgggatcaacatcagcgagacctattcgagcggctcgctgtcgcgcccgagcaagaaaaaagccaaggaccgtgaatcggagggatggcgcgacacgcatctgcaggtcgacggtcctgccgtcgccgaattccagaagctgtttctcgacacctgggcgcggcagaaaggcccgccgctgcccgcgcgcgcgtatttccccaagctcgcgcgccaaggcaacgaaatcgtgcgcgcgatcgcgagcgaagccgacgagggcgacagcccgatctatctgacgctgctctcggcgatcgaacacgccgagcgcagcatccgcctgaccaacgcgtatttcgtccccgacccgcaattgcgccgggcgctcgccgccgcgtcccggcgcggcgtcgacgtgcagatcatcctgccgagccggaccgactcgtgggccgtgttccacgccggacgctcgcactacgacgaactgctcgacgccggcgtgaagatctacgaacgccacggtaccgtgctgcacgccaagaccgcgtcggtcgacggcgtctggtcgacgatcggttcgaccaacctcgactggcgcagctttcttcacaacgacgagctcaacgcggtcgtgctcggaaccgacttcgcccgccagctcgacgcgatgttcgtgcgcgaccgggcggcatcggaaaagatcgacctcgagaaatggcgtcgtcgcgcgctgcacatccgcatgcaggaatggatcgcccggcgcttcgagtactggctgtag

SEQ ID NO: 14547 - protein, 480 aa, Thiobacillus denitrificans ATCC 25259
MPHPSPSPIPRRSRGGIAGLTRILIACCAAPLCACATLPEAPRLAAGPVASPPVNFESARGPVSARRNAAIFAELKRDGGDSAILLRHLALEEAVNRDSPLVVGNRLTLLQDGPATYRAMFAAIRSARDHVNLQTYIFEAGQTGETFARLLLEKQAAGVQVNIIYDSVGSIDTPPAFFQRLRDAGMRVLEFNPVNPAKLKKKKWRLNNRDHRKLLVVDGKTAFLGGINISETYSSGSLSRPSKKKAKDRESEGWRDTHLQVDGPAVAEFQKLFLDTWARQKGPPLPARAYFPKLARQGNEIVRAIASEADEGDSPIYLTLLSAIEHAERSIRLTNAYFVPDPQLRRALAAASRRGVDVQIILPSRTDSWAVFHAGRSHYDELLDAGVKIYERHGTVLHAKTASVDGVWSTIGSTNLDWRSFLHNDELNAVVLGTDFARQLDAMFVRDRAASEKIDLEKWRRRALHIRMQEWIARRFEYWL

SEQ ID NO: 14548 - DNA, 1260 bp, Thiobacillus denitrificans ATCC 25259
  CDS (1)..(1260)
atgctcgttttctggatcgtcctcggcgcggtgctggccaccgtcatcgcgctgaactttctgccgggggaaaagaaggtccagacccggatcagcgagctctatttcatccacgacccgcagttcctgcgctcgatgagccatctgctcggcccgccactcgtcccgggcaaccgcgcccaggagctcatcaacggcgacgagatctttccaccgatgctggcggcgattcgcgcggcgcgcaaaacgatcaccttcgagacctacatctactggtctggcgaaatcggcaaggaatttgccgaggcgctcgccgaacgcgcacgcgccggggtcaaggtccatgtcctcgtcgactgggcgggcagcgtcaagatggaagacgacttgctcgagctgatgaaagacggcggagtcgagatcctcaaatatcacccgctgcactggtaccacctcgcgcgcatgaacaaccgcacgcaccgcaaactcctggtcgtcgacgggcacatcggcttcacgggcggcgtcggcatcgccgacacctggctcggccatgcgcaggatgacaatcactggcgggactcgcatttccgcgtcgaaggtcccgtggtcgcccacatgcaggcggccttcctcgacaactggatgaaaaccagcggggcggtgttgcacggtgaggactattttccggcgctcgagcccgtcggcgagcactacgctcaggtcttcaagagctcctcgtcggaaggcagcgaaagcgtgcgcctgatgtatctgctgtcgatcgcggcggcgcgcgaaacggtctatatcgccaatgcttatttcgtgcctgacgacctttcggtagagaccctcacccgcgcgctgcgccgggacgtgaaagtcaggatcctcgtgcccggcaggcacaccgactcggggctcgcgcgccgcgcgtcgcgcgcccgctggggcgcgttgctcgtggcgggggccgagatatacgaatatcagcctacgatgttccactgcaagctcatgatcgtcgacgacgtctgggtgtcggtcggctcgaccaacttcgattcgcgatcgttccgcctcaacgacgaagccaatctcaacatctacgaccacgccttcgcagcgcgccagatcgcgatcttcgaggacgacctcagaaaagcccggcgggtcgactacgatgcgtggaagcgccgcccctggcgcgagaagctgctcgaacacggctccgcattgttccgctcgcaagtctga

SEQ ID NO: 14549 - protein, 419 aa, Thiobacillus denitrificans ATCC 25259
MLVFWIVLGAVLATVIALNFLPGEKKVQTRISELYFIHDPQFLRSMSHLLGPPLVPGNRAQELINGDEIFPPMLAAIRAARKTITFETYIYWSGEIGKEFAEALAERARAGVKVHVLVDWAGSVKMEDDLLELMKDGGVEILKYHPLHWYHLARMNNRTHRKLLVVDGHIGFTGGVGIADTWLGHAQDDNHWRDSHFRVEGPVVAHMQAAFLDNWMKTSGAVLHGEDYFPALEPVGEHYAQVFKSSSSEGSESVRLMYLLSIAAARETVYIANAYFVPDDLSVETLTRALRRDVKVRILVPGRHTDSGLARRASRARWGALLVAGAEIYEYQPTMFHCKLMIVDDVWVSVGSTNFDSRSFRLNDEANLNIYDHAFAARQIAIFEDDLRKARRVDYDAWKRRPWREKLLEHGSALFRSQV

SEQ ID NO: 14550 - DNA, 1959 bp, Xylella fastidiosa Ann-1
  CDS (1)..(1959)
ttgaatatattcatacgtttgttgctgctagcagctgttttgttgggcagtggttgcgctagcctgtcgcatgcccagttggattatgctgcgtcggtcgccgtggctgcgcgcccggctacgctggattgtgacaggcccaatcgttgtgcgttggattcgccgttgtacgcgcttgggagccgagcgctgagtgaatctacgcctgtgacaccacttcactatgtcaccatcctcgataaaggcgagagcgcgttggtcgcacggatcaatttgatccgcagtgctacccgcagtatcgacatgcagacttacatttttgacaaggacgatagtgcccggttgattatggatgagctattgactgctgccagacgtggtgttcgagttcgtttactgattgaccagctttcggcgatttctgatctgaatattctgggtgccttggctggtgcacacgttaatttccaactacgtatctacaacccgatttttggcaaagccaagctgaactatggcgactatgttgccagcgtgctgtgttgttttcgtcgctttaatcagcgcatgcacaataaattgttggtcattgatgaaatgatcggcgtggtcggcgggcgtaattaccaagatgactattatgattgggatcttgaatataactttcgtgaccgtgatgtgcttgtcgccggaccggcggtgctgcaaatggcagttaactttgatgcgttttgggcggctgagcgcagcgtaccggtagagcgcctcagggatgttggacgtatggtgctgcaggatggggtgccgatgctgccatcagctgtgttcaatctgttggaacgggtccagcgtgttactgctgaggccaacgatccggactatgtcaagcgcacttttgtcgatgcggccttggctgtgaacaaagtgcaatatgttgctgacctgccgcaaaagcatcgctatgagcacaacgcaaatccggtttccatcgggccacggttggatagtttgatttctaatgcgcgtcatgaggtgatcttgcagaccccatatctggtgttgtccaaaccagcgctgaacatcttccgtcgcctcaatcggactcaggacaaaccgcgcgtggttgtggtgaccaacagtttggctgctaccgataatcccatcgtctatgccttattttacaaatacaagcggcgtaacatgcgtgacctggggttcgacatttacgagtacaagccgtttccggaaaatccgccaatcgacctgacgggcgttgttccgattgaaggatggaacaatgactatcttcagaggcgacaggaccttttggctgctgccaaagtctccgatgattcagacaatgctcgtcagttagctcagcttgaaaataaaggtcaagtggataggcgtgtgttacgtactgaaacgcgtccgcccttttggcgcattcacactgtcaataaaccattacctgtgacccgtccgggcgcacgcatgggcttgcatgcaaaatcattggtggttgatcgtaaggttggagtgattggtacccacaacttcgatccgcgcagtgagagttacaatactgaagctgttgtggtgattgaggatccagcgttcgccggtctgttggcttccagtattgagggtgacatcgctccaggtaatgcgtgggtcgtggcaccgcgcaagaagttacctgggctctataagctcaattattcggtaggtaaactgtctgaggcattgcctgtgctggacctgtggccttggcgctatgcaaccaactatgaattcaaacccgggttggattgtccaataccattgccacgtcgggatccgaatttcatgcaatgttatgaacctgtcggtgactttcctgaagtcaatgttggtccaaagtggttgttggtgcggatgctgattgcattcggtgctgggctggtgcctatcttgtaa

SEQ ID NO: 14551 - protein, 652 aa, Xylella fastidiosa Ann-1
MNIFIRLLLLAAVLLGSGCASLSHAQLDYAASVAVAARPATLDCDRPNRCALDSPLYALGSRALSESTPVTPLHYVTILDKGESALVARINLIRSATRSIDMQTYIFDKDDSARLIMDELLTAARRGVRVRLLIDQLSAISDLNILGALAGAHVNFQLRIYNPIFGKAKLNYGDYVASVLCCFRRFNQRMHNKLLVIDEMIGVVGGRNYQDDYYDWDLEYNFRDRDVLVAGPAVLQMAVNFDAFWAAERSVPVERLRDVGRMVLQDGVPMLPSAVFNLLERVQRVTAEANDPDYVKRTFVDAALAVNKVQYVADLPQKHRYEHNANPVSIGPRLDSLISNARHEVILQTPYLVLSKPALNIFRRLNRTQDKPRVVVVTNSLAATDNPIVYALFYKYKRRNMRDLGFDIYEYKPFPENPPIDLTGVVPIEGWNNDYLQRRQDLLAAAKVSDDSDNARQLAQLENKGQVDRRVLRTETRPPFWRIHTVNKPLPVTRPGARMGLHAKSLVVDRKVGVIGTHNFDPRSESYNTEAVVVIEDPAFAGLLASSIEGDIAPGNAWVVAPRKKLPGLYKLNYSVGKLSEALPVLDLWPWRYATNYEFKPGLDCPIPLPRRDPNFMQCYEPVGDFPEVNVGPKWLLVRMLIAFGAGLVPIL

SEQ ID NO: 14552 - DNA, 1206 bp, Pseudomonas aeruginosa UCBPP-PA14
  CDS (1)..(1206)
atgaacttcccctggcgcgacggcaaccgcgtagaactgctgatcaacggcgaagagtactttccgcgcctgttccagtgcatcgccgaggcgcgccgggagatcctcctggaaaccttcatcatcttcgaggacgaggtcggccggcagttgcaggaagccctcagcgccgccgccgagcgcggtgtcgaggtacaggtcacggtggacggctacggcaccgcctcgctcagcacggactacctggccaggctcaccgccgccggggttcgcgtgcacctgttcgacccgcgcccgcgcctgctcggcatgcgtaccaacctgtttcgccggttgcaccgcaagctggtggtgatcgatcgccagcaggccttcgtcggcggcatcaactacggcgaggaccacctggtgcgtcgcggcaacatggccaagcaggactacgcggtgcgcgtcgagggcccggtggtgcgcgatatccgccaggcctgcctggcgctgctcgaaccggacgccgactacccgccgttgcggccgtcgggcgccgggcagccggcgcgtgtgcgcctggtgatccgcgacaacgaccagtccagcgacgacatcgagcgcgagtacctgcaagcgatccgccaggcgcggcggcgcctgctgatcgccaacgcctatttcttccccggctaccgcctgcttcgcgagctgcgcgatgcggcgcgccgcggcgtgcgcgtcgacctggtactacagggcatgccggacatgccgctggtgcgcctgtgcagccggctgctctacgactacctgctgcgcgagggcgtgcgtatccacgaatactgccagcgtccgctgcacggcaaggtcgcggtgatcgacgacgactggtcgaccatcggttcgagcaatctcgatcccctcagcctgtcgctgaacctggaggccaacctggtgatccacgacgtcgccttcaacggccagctctaccagcacctgcgcgagctggcgcgccgccactgccggcgcatcagccgccgccacgccaggcgcggctactggtggcgggcgccgctgatcttcctcggcttccacttttcccggcatttcccggccatcgccggttgggtacccgcccatctgccgcgcctgaaatcgctggagccgcgtccgtcgcggcgctggcaggaacgccagggccagcggggcaacccatga

SEQ ID NO: 14553 - protein, 401 aa, Pseudomonas aeruginosa UCBPP-PA14
MNFPWRDGNRVELLINGEEYFPRLFQCIAEARREILLETFIIFEDEVGRQLQEALSAAAERGVEVQVTVDGYGTASLSTDYLARLTAAGVRVHLFDPRPRLLGMRTNLFRRLHRKLVVIDRQQAFVGGINYGEDHLVRRGNMAKQDYAVRVEGPVVRDIRQACLALLEPDADYPPLRPSGAGQPARVRLVIRDNDQSSDDIEREYLQAIRQARRRLLIANAYFFPGYRLLRELRDAARRGVRVDLVLQGMPDMPLVRLCSRLLYDYLLREGVRIHEYCQRPLHGKVAVIDDDWSTIGSSNLDPLSLSLNLEANLVIHDVAFNGQLYQHLRELARRHCRRISRRHARRGYWWRAPLIFLGFHFSRHFPAIAGWVPAHLPRLKSLEPRPSRRWQERQGQRGNP

SEQ ID NO: 14554 - DNA, 1203 bp, Erythrobacter litoralis HTCC2594
  CDS (1)..(1203): transl_table=11
atgggggagacgagacaggtgcataccgagcccgatccggtcgaatacagctatcccgaaccgttctgcgtggaagcgggcgaccatacgctgaccttcctgcccgacggggtgcatcgcttcgacgcattgctggagcttgtccaggaagcacaggaaagcctgcacctgttctactacatgttccaggatgacgaagcgggcaatcccgtgcgcgatgcgctggtggaagccgccgagcgcggcgtgaccgtgtgcctggtggtggatcgcttcgggaccgatgcggacaaggaatttttccagccgatcgtcgatgcaggcggcagcttcgccttcttcaaccccaagaagagtcggcgctacctgatccgcaaccaccagaagatggccatagccgatcgcgaaaaagcgctggttggcgggttcaacgtgtcggagcactacttcaagccgcccgaggaaaacggctggtgcgacatgggcgtgatagtgcgagggccgctggtcgagcaattgctcgattggtatggtcagatctacgattgggcgaccacgccgtcggcgcagtaccgcgcgatccgcacgatggtgcgcgactgggagccgggggatggcaaataccagctgctggtcggcggcccgacctcgatccccagcaactgggcgcgccgggtgaagaaggatctcgcccatgccagcaaactcgatctcgtcatggcctatttctccccgccgcgcagtttccggcgcctgatccgccgggtcggggagcggggcaaggtgcggctggtgatggccgccaagtcggacaatccggcgaccgtctcggcagcacgcgcgacctatggctcaatgctgcgggcgggctgcgaggtctatgaattccagccgtgcaagctgcacatgaagctgctggtgatcgacgatgcggtctatttcggcagcgccaatttcgaccatcgctcgatccgcctcaacctggaactgatgttccgtgtcgaggacccggacctggccaagatggtgcgcgaattcgtcgacggcatgaccgaggtctcggagcagatcacctacgaatcgcacaagaagaatcgcacctggctttcgaccctgaagagctatttcgggtggttcctggtgaccacggtcgattacaccgtcagcagcacgctcaatgtcggcagcgaaggtgcgccgtaa

SEQ ID NO: 14555 - protein, 400 aa, Erythrobacter litoralis HTCC2594
MGETRQVHTEPDPVEYSYPEPFCVEAGDHTLTFLPDGVHRFDALLELVQEAQESLHLFYYMFQDDEAGNPVRDALVEAAERGVTVCLVVDRFGTDADKEFFQPIVDAGGSFAFFNPKKSRRYLIRNHQKMAIADREKALVGGFNVSEHYFKPPEENGWCDMGVIVRGPLVEQLLDWYGQIYDWATTPSAQYRAIRTMVRDWEPGDGKYQLLVGGPTSIPSNWARRVKKDLAHASKLDLVMAYFSPPRSFRRLIRRVGERGKVRLVMAAKSDNPATVSAARATYGSMLRAGCEVYEFQPCKLHMKLLVIDDAVYFGSANFDHRSIRLNLELMFRVEDPDLAKMVREFVDGMTEVSEQITYESHKKNRTWLSTLKSYFGWFLVTTVDYTVSSTLNVGSEGAP

SEQ ID NO: 14556 - DNA, 1497 bp, Brevibacterium linens BL2
  CDS (1)..(1497)
atgaccagattggagaactatcttttcttctcaatcgatcaggcgtggccgaactggctgattgtcacacttctggcgatcgacatgatcatccgcatcgttgcgctgggctggattccgcacaaccgcagaccatctgtcgcgctcggctggctgctcgcaatcttcctcatcccctacgtcggaattctcgcgttcctgctgctcggctcggcgaagctgccgaagaggcggcgggacaaacaggtgctcgtcaacgacatcttccgggaccagaccgatgatcgggcgatcatcggcgactccgcccacatgcccgaaccgctgagcaccgcggcgcagctcaacttcgaactgggcgcgctgccgatgacgcacggcaacgccttcgatctgcagatcgacaaccacgcctgcatggaggcgatggccgacgagatcgatgcggccactcggttcgtccacttcgagttctacatcgtcgccatcgatgacacgacgaggcggctcttcgaatcgctgctggccgcgcacgagcgcggggttcgggtgagaatcctcatcgaccatctgggttcactgggatatcccggctactcggacctggtcaagcggctcaactcatcgggagtggcgtggcgccgagccctgccgatccgtccctggaagggcgaataccagcgacccgacctgcgcaaccaccggaagatcctcgtcgtcgacggcgaggtcgccttcaccgggtcgcagaacatcatcgaccggtcctacaacaagcgacgcaacttgcggaagggcttccaatggatggacctgtcgctgaagtgcagcggcccagtcgtcgatgaactcgatgcggtcttcatcacggactggtattcggagacgggggaactcttagacgaagcctcgcaaggggaactccgggcaccgcagaacggcggcatccaggcgcaggtggtgccgtctggaccagggttcgaagacgagaacaatctgcgtctgttcaatcacctcatctacaacgcgaaccgcagcgtcgtcgtctgctcaccgtacttcgtgcccgacgagtcgctcatgcacgcgctcacgacagaggcccggtccggagtcgacgtgcgcctgtatgtgggggagacgagcgaccattgggtgacgcaacgggcccagcagtcctattacgccgatctggtgcgggccggagtccggatcttcctgtaccacgccccgaccgtgctgcattcgaagtttctcatgatcgacgatgaagtctcgatcatcggatcctcgaacatggatgagcgatcgttcgcgatgaacatggaggtcaccatgttcatcgtcgacaaggagttcacccagcggatgtacgacctcgaagcgcagcggtacgcgccgaactccgtcgagctcgacgccgaacgctggaacgatcggccgctgctgcacaagtatgtggagaacgtcgccaggctcacgagctcgctgctctga

SEQ ID NO: 14557 - protein, 498 aa, Brevibacterium linens BL2
MTRLENYLFFSIDQAWPNWLIVTLLAIDMIIRIVALGWIPHNRRPSVALGWLLAIFLIPYVGILAFLLLGSAKLPKRRRDKQVLVNDIFRDQTDDRAIIGDSAHMPEPLSTAAQLNFELGALPMTHGNAFDLQIDNHACMEAMADEIDAATRFVHFEFYIVAIDDTTRRLFESLLAAHERGVRVRILIDHLGSLGYPGYSDLVKRLNSSGVAWRRALPIRPWKGEYQRPDLRNHRKILVVDGEVAFTGSQNIIDRSYNKRRNLRKGFQWMDLSLKCSGPVVDELDAVFITDWYSETGELLDEASQGELRAPQNGGIQAQVVPSGPGFEDENNLRLFNHLIYNANRSVVVCSPYFVPDESLMHALTTEARSGVDVRLYVGETSDHWVTQRAQQSYYADLVRAGVRIFLYHAPTVLHSKFLMIDDEVSIIGSSNMDERSFAMNMEVTMFIVDKEFTQRMYDLEAQRYAPNSVELDAERWNDRPLLHKYVENVARLTSSLL

SEQ ID NO: 14558 - DNA, 1446 bp, Lactococcus lactis subsp. cremoris SK11
  CDS (1)..(1446)
atgagttttattgcactttttgagctggcacttttttttcttaatgttattttatcctttgtcattatttttagggaaagaaaatcaacagcagcaacttggtcatggctctttgtagttaatttattgccgattataggctttattttatatttactcattggtcgtggaatttcacattatcgtatttttaaagaccgtaaaaggtttcaacttggctttgaaaaacaacttgaacatgcggagaaatcatatacagatagattgtttattgaaaaaatgagaaaaaatcatgtgattggtcaactaattcacatgctttatgttgaagaaaaatcgattatttcaacaaatactggtgtcaaaatttttaatgatggacgccagaaatttaacgctttgatagaagatataaatcaagccaagcatcatgtccatatggaatattatatttttagaatggatcgaacgggtcatgaaatctacgatgccttactggcagccgcaaaacgtggagtagaggtgaaacttttaattgacgcttggggttcaaataagactaaaatgtccagctttaaagagcttcaagaagctggtggacatgtggctcaatttttccccttgattatgcccttagttaatccccgaacaaattaccgtttgcaccgtaaaatcgttgtgattgatggtgtagttggctatacaggtggattcaatgtcggtgatgaatatgtttcaattacgaaaaaatttggatattggcgtgacaatcatttgagattgactggtgatattgtttatagcttacagcatcgttttatcttagactggaattcacaacatcattttgaagtgactgagggagaaccttattttccagattctattgttgaaggacatgtagcgactcaacttgtgacttctggtccagatgaggataaagagcaaatcaaattgacttacatgaagatgatttctggtgctgaacgagaaattatcattcaaacgccctattatattccttctgatgccttgcatgagtcaataaaattggcccttttatcaggtgtacaagttaaaatgttaattcctaacaagccagaccatccgctggtttactgggcgacatatttccatgccgctgatttagttaaatatggtgccaaggtttatacttatgaaaatggatttgttcattctaaaacgttaattattgatggagagtatgcctcagttggttcggcaaatttggattatcgaagcttacaattatgttttgaagcaaatgttgttatttatgattatgatatttcacaaaaattgcgaaatgattttatgaaagacttgaagttaagccgtccattgactttagagcgttatgaagaaagatcaaagatgattcgttttaaagaaggactggctcgcttaattgcaccaatgctttga

SEQ ID NO: 14559 - protein, 481 aa, Lactococcus lactis subsp. cremoris SK11
MSFIALFELALFFLNVILSFVIIFRERKSTAATWSWLFVVNLLPIIGFILYLLIGRGISHYRIFKDRKRFQLGFEKQLEHAEKSYTDRLFIEKMRKNHVIGQLIHMLYVEEKSIISTNTGVKIFNDGRQKFNALIEDINQAKHHVHMEYYIFRMDRTGHEIYDALLAAAKRGVEVKLLIDAWGSNKTKMSSFKELQEAGGHVAQFFPLIMPLVNPRTNYRLHRKIVVIDGVVGYTGGFNVGDEYVSITKKFGYWRDNHLRLTGDIVYSLQHRFILDWNSQHHFEVTEGEPYFPDSIVEGHVATQLVTSGPDEDKEQIKLTYMKMISGAEREIIIQTPYYIPSDALHESIKLALLSGVQVKMLIPNKPDHPLVYWATYFHAADLVKYGAKVYTYENGFVHSKTLIIDGEYASVGSANLDYRSLQLCFEANVVIYDYDISQKLRNDFMKDLKLSRPLTLERYEERSKMIRFKEGLARLIAPML

SEQ ID NO: 14560 - DNA, 1470 bp, Lactobacillus casei ATCC 334
  CDS (1)..(1470)
atgtcgctgattacctggcttattcttattattttggttttaaacaccttcggggcaatcttcacggttctacgcgaggtccgagatatctcaacgacttgggcgtggttgctagtgcttatttttttaccgatcgtcgggtttggtttttatttatttgctggccgcggcttatcaacgaaaaaattgcaacggattcaacacgaatatgagtctggcgtaaaagcatttgtctcactacaaaagcacgaaaacgcccggaataagttattgccaccgactgattacacgccagcggccaaggctttaaccgccttttttctgaataccgcgcaagcaccggtccttgcccataaccaagtgcaactttacacggatggcgagaaaaagtttgcggcgttattccgcgatattgaggccgctaaagattatatctatgttgagtactacaccatttacaatgatgaattaggcaatcaattccagcaactgctgatcaagaaagctaaggaaggcgttgttgtaaaggtcctatatgacgcttggggttccatgggcgctacagcaaagtggtggcgccggctgaccgacgttggcgggcaagccgaaagttactttagttccaagcatcccatcactgactttcgtttgaactatcgtgatcatcgcaagatcgttgtcattgacgaccacgtcgggtatatcggcgggtttaatgttggtgaccaatacgtctcccgcaaacctaagttcggttattggcgcgacacacatttgcgcattatcggcaatacgatttacgctttaaaaattcgcttcaccatggattggaatgcaacagtcagcaaaaaagacgaaattgcttatagtgttgaacaagatagtgccgatagtgtcactgccgacagtttgacagccggtgcaacgcctatccagatcgttgcttccggacctgaccgcccaacgcaacaaattaagttgggatacaccaagttaatcaccagtgccaccaaatctgtttggattcaaagtccttatttggtgccagatgatactgtgatcgacgctttagtatccgctgccatgtcagggattgatgttcgcatcatgattcctgacatgcctgatcacccgttcattttccgcgcgacacaatactatgcgaattatctgactcgcgctggcgtgaaaatctaccattacgaacacggctttatgcatgcgaaaacggtggttgtcgacaatgccatcgccagcgttggctcggcaaatttcgatatccgtagttttaagctgaattttgaaattaatgcgtttatttatgatcgtaaagtggccagtagcttgggccagattttcgaggctgatatggcgcgcagttacttactgacgcctgagctaatcgccaaacaaagcagttggcttcggtttaaacaagacttctcgcggttattatcacctattctttaa

SEQ ID NO: 14561 - protein, 489 aa, Lactobacillus casei ATCC 334
MSLITWLILIILVLNTFGAIFTVLREVRDISTTWAWLLVLIFLPIVGFGFYLFAGRGLSTKKLQRIQHEYESGVKAFVSLQKHENARNKLLPPTDYTPAAKALTAFFLNTAQAPVLAHNQVQLYTDGEKKFAALFRDIEAAKDYIYVEYYTIYNDELGNQFQQLLIKKAKEGVVVKVLYDAWGSMGATAKWWRRLTDVGGQAESYFSSKHPITDFRLNYRDHRKIVVIDDHVGYIGGFNVGDQYVSRKPKFGYWRDTHLRIIGNTIYALKIRFTMDWNATVSKKDEIAYSVEQDSADSVTADSLTAGATPIQIVASGPDRPTQQIKLGYTKLITSATKSVWIQSPYLVPDDTVIDALVSAAMSGIDVRIMIPDMPDHPFIFRATQYYANYLTRAGVKIYHYEHGFMHAKTVVVDNAIASVGSANFDIRSFKLNFEINAFIYDRKVASSLGQIFEADMARSYLLTPELIAKQSSWLRFKQDFSRLLSPIL

SEQ ID NO: 14562 - DNA, 1212 bp, Bacillus anthracis str. A2012
  CDS (1)..(1212)
atgattaaaaaaatattgcgagttacttctattattattgctattttcgcttttattttaatttgtatgcatattgatgttactttaggtaggaaaatggaagctgggaaaaacatgccgacagagtatgcacctcattatagtgattttcaattatatgtagaaggaaagtcattttataaacagttatttactgatataaaagaagcgaaacaatctatttacacttatttttttattttatcggatgataaaagtagccatacttttttaaatttattaaaagagaaggcaaaagaaggagtaaacgtatatttatctgtcgatttacttaacgatttatcatttgaaagaaagatgaaaaaagaattacaggaaaatggtgtgcattttacatatagtagaaaacaggaattaccattcgggttttattcccttcaccatcgtaatcatcgccgcattacaacgattgatggagagattggttatacgggtggttttaatataggggatgaatacttagggaaagataaacactttgggtactggagagactatcatgtacggataaaaggtgaaggtgcaaaagacttagaggaacaatttgctttagattggaaacgagatacgaaagaagatataaagagaagtacggataaagctagtaaagggaatacattacatactatggttagttataatgggcatcacgtcgctgaaaaatatatagatcttataaaacaagctcggcactcaattgtaattgcaacgccgtattttatagcgaaaaataaagaatccatgaatgctttaatcgcagcacaaaagcgtggtgttacagtaaaaatactttggtcatataaaccagatctacctcttataaaagaagcggcgtatccatacatacgtcaagctattaataatgggattactgtatatgggtataaaaaaggaatgttccatggcaaattaatgcttattgataatgaattaaccgttattggcacaacaaactttacttcgcgtagcttcaatataaatgatgaaatgaatttttatattcatggtggtcctattgtagggcaagttaataaggcgttaacagaggattttcgtgactcaaaagaaatgacgaaagaattttttgagaagttatctttttgggagcgttgtaaggagaaatttgcagggatggtggatttttatttataa

SEQ ID NO: 14563 - protein, 403 aa, Bacillus anthracis str. A2012
MIKKILRVTSIIIAIFAFILICMHIDVTLGRKMEAGKNMPTEYAPHYSDFQLYVEGKSFYKQLFTDIKEAKQSIYTYFFILSDDKSSHTFLNLLKEKAKEGVNVYLSVDLLNDLSFERKMKKELQENGVHFTYSRKQELPFGFYSLHHRNHRRITTIDGEIGYTGGFNIGDEYLGKDKHFGYWRDYHVRIKGEGAKDLEEQFALDWKRDTKEDIKRSTDKASKGNTLHTMVSYNGHHVAEKYIDLIKQARHSIVIATPYFIAKNKESMNALIAAQKRGVTVKILWSYKPDLPLIKEAAYPYIRQAINNGITVYGYKKGMFHGKLMLIDNELTVIGTTNFTSRSFNINDEMNFYIHGGPIVGQVNKALTEDFRDSKEMTKEFFEKLSFWERCKEKFAGMVDFYL

SEQ ID NO: 14564 - DNA, 2703 bp, Anaeromyxobacter dehalogenans 2CP-C
  CDS (1)..(2703): transl_table=11
atgaggtaccgccgcgtgctcgcgctggtggagcagggcgccgacgccggcccggcgctcggggccgtccgcgcgctcgcgccggaggcggagtcgctgggcgtggtggcgtgcccgccgctgcggccgcgcccgtggctgccgggggcggccgcgccggcgccggccggcgtcgcggaggccgggtggctcgagcgcttgcggcaggacgcggcgccgctcgcgccgcggctggcgatcggcgcggtgcccgatctcgatcccgccgcgctcgcggcgctcgcggacgaccgcgaggtggacctggtcgtcgcggggccgctcccggcggcgggcggcgccgccctgtccgcgctgcgccgcctccggccggtcgcggtcgcctggatcccgccggcggccgctgcggccgccgcgcgggccggcgggccggcgcgggagctgctctgcgtcgcgcccggcgagcgcgcccgcgcggcgctggcgggcttcctgcgcgaccacggggatccgggccagcgcgtcaccctcctgtcgctcgcggcgccgtcgcggggcgaggtcgccgtcgcgctggaggtcgccggcatccgcgcaccggtcgagctggccggcggcttcggcgcggggacgtggcgcacgctcgaggccgtcgcgcgggagcgccggctggacctggtggtcctctcgcgctgccccggggcgctgctgcgcggcgcgccctggccggcgccgctgctggtgctgccgccggccgtgccgacccggtcggtgctccgccggccgctggacgtgccggacctcctggacggcggcggccccgtccggctgcgcgtcggctacgcctacggcatcgggcgcaacccgcccgtcgaggaccaggagctggcgctcgtggcggacggccgcgtggtcgcgcgcgtgcgcacgcgcggcggcgaggcggagctgcccgcggggctggccgccggctcgctcggcgtgttccgcgcgcgcgacgccgggggcctcgaccccgtcgccgcggtggagcgccaggtcgcggtgatccgcccgggcgcgctgccgctgctgcccttcgacgccgagctcggcccggaggacctcgcggtcctcgccggcctggacggcgccgagccgctcgcggtgcggctgcgcccgacccggagctgccacctcgtgcgcgagcggctgtgcgccgccggcctcgcgccgcgcgtggtggacgcgagcgccgtcctcgacgagggcgaggcggccgacgtgggcgaggcgcacgacgcggtgcgcctggcgcgggtgggcggccgcctgcgggcggccggcttcccggtcgcggcgatcgtgcaccgcggcccgcacccccccgccgcgatcgggttcgacgcgctggaggcgcaccagctcgccgggcgcgcctggcgcgcgccgccgcccgcgccgcggcccgcctcgctcgacgcgcggctcgacgcggcgacggccgcgcccgcgatcgaggggaaccgcgtcgagctcgagctcgagaacgccaccgcccgccgctggctgctcgaggcgatccgcggcgcgcgccggacgctccacctccaggtgtacctcgccaccgacgacggcgtcggccggcgggtcgaggccgcgctcgccggcgccgggcgccgcggcgtgacggtgcgggtgctggtggactcgctgcacggcctgcacggctccttcggcctgcagaacccgctgctctcgcgcctcgcggcccgccccggcgtcgaggtgcgggtctcgcgcccggtggcggcggtgccgagcgtcgaggacctgaagcagcgcgaccaccgcaagctggtggtggccgacggcgaggtcgcgctggtgggcgggcggaacctcgcgcacgagtactacaccgggttcgacgaggtccgggtcgggccgcggacgccgtggcgcgaggtgccgtggctggacggcggggcgcgggtgcgcgggccggcggtcgccgcggtggagcgcgccttcctggaggcgtggaccggcgcgggcggcgcgcccttcgacgtgacggagcccggcgcggccggcgcgcagcgggtgcgggtggtggtgcaccgggggctgcgggacgcgagcacgctggaggcgtacctggcgctggtcgagagcgcgcggcaccgcctgctcgcggtgaacgggttcccgctgctcctcgagctggagcacgcgctcgcgcgcgcgctgcgccgcggcgtccgggtgcaggtgctgttcggagaggtcacgcccacgcacggcggcgagccgttcgaggggccctgggcgacggcgcgcaccgcggccacctggctggtccactcgcgcatcgacgcgctggtggcggcgggggccgaggcgtggctgctcgccgtccgcgacgtgccgggctggtcgccggagctcgggctggtgcgcccccacgtgcacgcgaaggcgatgatcgccgacgggcgcgcctgcgcggtggggagcgccaacctggacgtcaccgcgagctactgggaggacgagctgctgctcgtcgtcgaggacgaggccgccgccggcgcgttcgaggcgcgcgtccaggcgctcctcgccggctcgacgcgcgtggaccgcgccgaccccgcctggcagcggcgcgtgcgcgcgcgcgactgggcgcggcactggccggggatcctgtcgatctga

SEQ ID NO: 14565 - protein, 900 aa, Anaeromyxobacter dehalogenans 2CP-C
MRYRRVLALVEQGADAGPALGAVRALAPEAESLGVVACPPLRPRPWLPGAAAPAPAGVAEAGWLERLRQDAAPLAPRLAIGAVPDLDPAALAALADDREVDLVVAGPLPAAGGAALSALRRLRPVAVAWIPPAAAAAAARAGGPARELLCVAPGERARAALAGFLRDHGDPGQRVTLLSLAAPSRGEVAVALEVAGIRAPVELAGGFGAGTWRTLEAVARERRLDLVVLSRCPGALLRGAPWPAPLLVLPPAVPTRSVLRRPLDVPDLLDGGGPVRLRVGYAYGIGRNPPVEDQELALVADGRVVARVRTRGGEAELPAGLAAGSLGVFRARDAGGLDPVAAVERQVAVIRPGALPLLPFDAELGPEDLAVLAGLDGAEPLAVRLRPTRSCHLVRERLCAAGLAPRVVDASAVLDEGEAADVGEAHDAVRLARVGGRLRAAGFPVAAIVHRGPHPPAAIGFDALEAHQLAGRAWRAPPPAPRPASLDARLDAATAAPAIEGNRVELELENATARRWLLEAIRGARRTLHLQVYLATDDGVGRRVEAALAGAGRRGVTVRVLVDSLHGLHGSFGLQNPLLSRLAARPGVEVRVSRPVAAVPSVEDLKQRDHRKLVVADGEVALVGGRNLAHEYYTGFDEVRVGPRTPWREVPWLDGGARVRGPAVAAVERAFLEAWTGAGGAPFDVTEPGAAGAQRVRVVVHRGLRDASTLEAYLALVESARHRLLAVNGFPLLLELEHALARALRRGVRVQVLFGEVTPTHGGEPFEGPWATARTAATWLVHSRIDALVAAGAEAWLLAVRDVPGWSPELGLVRPHVHAKAMIADGRACAVGSANLDVTASYWEDELLLVVEDEAAAGAFEARVQALLAGSTRVDRADPAWQRRVRARDWARHWPGILSI

SEQ ID NO: 14566 - DNA, 1461 bp, Anaeromyxobacter dehalogenans 2CP-C
  CDS (1)..(1461): transl_table=11
atgtggacccccgacctcgcgctcctcgacgcgctgccctcgccgggcgtgctcggggtcctcgaggcggcctgggtgctcgcggcgagctgctggatcctgctggagcggcgctcccccaccgcgacgctggcctggatcctggcgctcgccgccatgccggtggtgggcgtggcggtgtacctcgtggtcgggccccggcggctcgaccgcaagaagctgcgcctgaacgtgctgaagcgcgcccgcggcgcgtacctggaggcgtgggaccgggccaccgcgcgcgacctctccagcatggggcagctcgcccggctcgcgatccggctccaggcgccgccgcccgagacggcgcgatcggtcgccctcttcgccgagggcgacgactacttcgcggcggtggagcgcgacctcgcggcggcccggcaccacgtccacgtggagatgtacatcttcgagcgcgaccggaccggcgcccgcgtgctggccgccctcgccgccgcggccgcgcgcggcgtgcaggtgcggctgctggtggacgacgcgggctcgccgcggctcggcgcggcgctgctcgcgccgctgcgccaggccggcggcgaggtggagcgcttcaaccccatgctcgcctcgcggctgcgcggcggctcggccaacttccgcacccaccgcaagatcgtggtgtgcgacgggcgggtcggcttcaccggcgggatgaacgtgtcggacgaccagagcgccgccgtggcgggcccggccgcctggcgggacaccaccgtccgcatcgagggggccgcggtccacggactgcagctcaccttcctcgagaactgggccttcgccaccggcaagaccggctcgccgctgccgcccggtgggctgcggccgtacttcccggacgaggcgcccgggtcgcacgaggtccaggtcgtgccgtccggaccggaccaggagacgtccgccgtcggccacctccacgtcgccgcgatcggcggcgcgcgcgagcgcgtctggatcaccaccccgtacttcgtgcccgacgaggcgatgctcgcggcgctgaccagcgccgcgctgcgcggcgtggacgtgcggctgctgctgccgcgccggaccgactcgcgggtggtggacgccgcgtcgcgcacgtaccacgacgcgctgctcgccgccggcgcgaggatctggctctacgggccgcgcatgctccacgccaagacctgcctggtggatcaggacgtcgggatggtcggcaccgccaacctcgacaaccggagcctgcggctcaacttcgaggtcaccgccgtgctctacggcgcccccgcggcgcaggcgctcgccacgatgttcgagcgcgacctcgaggtggcgcggcccaagaccacgcgggaggcggacgcgccgttcctgtcgcggctcggcgccagcgccgcgcgcctgctggcaccgcaactatga

SEQ ID NO: 14567 - protein, 486 aa, Anaeromyxobacter dehalogenans 2CP-C
MWTPDLALLDALPSPGVLGVLEAAWVLAASCWILLERRSPTATLAWILALAAMPVVGVAVYLVVGPRRLDRKKLRLNVLKRARGAYLEAWDRATARDLSSMGQLARLAIRLQAPPPETARSVALFAEGDDYFAAVERDLAAARHHVHVEMYIFERDRTGARVLAALAAAAARGVQVRLLVDDAGSPRLGAALLAPLRQAGGEVERFNPMLASRLRGGSANFRTHRKIVVCDGRVGFTGGMNVSDDQSAAVAGPAAWRDTTVRIEGAAVHGLQLTFLENWAFATGKTGSPLPPGGLRPYFPDEAPGSHEVQVVPSGPDQETSAVGHLHVAAIGGARERVWITTPYFVPDEAMLAALTSAALRGVDVRLLLPRRTDSRVVDAASRTYHDALLAAGARIWLYGPRMLHAKTCLVDQDVGMVGTANLDNRSLRLNFEVTAVLYGAPAAQALATMFERDLEVARPKTTREADAPFLSRLGASAARLLAPQL

SEQ ID NO: 14568 - DNA, 1509 bp, Anaeromyxobacter dehalogenans 2CP-C
  CDS (1)..(1509): transl_table=11
atgagcgacggagtcgaagggccggagtcgaaggcccgcgcgatccggcacctcgacggcccgtccgttcgatgcttcactgatccggtgttccgggacgcgtggagcgccgcggtgctggtggtcgcgacgggcctgtcgctcgtcgcgacgggccacgccgtgctgcacaagcgcgacgtccgcgcggcgctgggctgggtggggctcatctggctcgcgcccatcgccggcgcgctcgcgtacctcctgttcggcgtgaaccgcatccgccggcgggcccaggccatcggcctgccggaggtgcggagccgcgccgaggaccggccgccgccgccgcggctgccgtccgacgccgagcacctcgcgccgctggtggcgctcgccgacgcggtggtgcgccgcccgctcgtcgccgggaacgccatcacgctcctgcccggcggcggcctcgcctacccggccatgctcgaggccatcgacgcggcccaccactcggtcaccttctgcacgtacatcttcgacaccgggctggccggcgacgccttcgccgacgcgctggcccgggcgcacgagcgcggcgtgaaggtgcgggtgctggtggacgccatcggcgtccgctaccgctggccgcccatccaccgccgcctgcgccggctgggcgtgcggaccgagctgttcctgccgcgcctcaccccggcctggctgccgttcgtgaacctgcgcaaccaccgcaagatcctggtggtggacggccggatcggcttcaccggcgggatgaacgtgcgcgacgagttcctgccccgccccggcggcccgccgccgttcatggacctgcaggtgcgcatcgaggggccggtggtggcgcacctccagtcggcgttcgcggaggactggctgttcaccaccggcgagccgctcgacggcaacgcgttcttcccgccgctcgcggcggccgggtcggtgctggcgcgcggcgtggccgacgggccggacgaggacttcgaggccatccgctggctgctgctcggcgcgctctcggcggcgcgccgccgggtgcgcgtggtcacgccctacttcctccccgacccgccgctcatcaccgcgctcaacgtggccgccatgcgcggggtcgaggtggacgtggtgctgccggagcgcgggaacctgccgctcgtgcagtgggcgcagaccgcgcagctctggcaggtgctcgaccgcggctgccgggtgtggtgcacgccgccgccgttcgatcacaccaaggccatggtggtggacggcgcgtggtcgctcctcggctcggcgaactgggacccgcgcagcctgcggctcaacttcgagctggacgtggaggcgtacgacccggagctggcggcgcgggtggaccggctggtcgaggaccggctcgcggcggcgcgcccgctcacgctcgccgaggtggaccggcgtccgctcccggtgaagctgcgcgacggcgtggtgcggctgctctcgccgtacctgtga

SEQ ID NO: 14569 - protein, 502 aa, Anaeromyxobacter dehalogenans 2CP-C
MSDGVEGPESKARAIRHLDGPSVRCFTDPVFRDAWSAAVLVVATGLSLVATGHAVLHKRDVRAALGWVGLIWLAPIAGALAYLLFGVNRIRRRAQAIGLPEVRSRAEDRPPPPRLPSDAEHLAPLVALADAVVRRPLVAGNAITLLPGGGLAYPAMLEAIDAAHHSVTFCTYIFDTGLAGDAFADALARAHERGVKVRVLVDAIGVRYRWPPIHRRLRRLGVRTELFLPRLTPAWLPFVNLRNHRKILVVDGRIGFTGGMNVRDEFLPRPGGPPPFMDLQVRIEGPVVAHLQSAFAEDWLFTTGEPLDGNAFFPPLAAAGSVLARGVADGPDEDFEAIRWLLLGALSAARRRVRVVTPYFLPDPPLITALNVAAMRGVEVDVVLPERGNLPLVQWAQTAQLWQVLDRGCRVWCTPPPFDHTKAMVVDGAWSLLGSANWDPRSLRLNFELDVEAYDPELAARVDRLVEDRLAAARPLTLAEVDRRPLPVKLRDGVVRLLSPYL

SEQ ID NO: 14570 - DNA, 1533 bp, Arthrobacter sp. FB24
  CDS (1)..(1533): transl_table=11
gtgctggatgcctctccggaaccggtccggcgggcgagtaaccgtgggagtctgtctgtgttgtggccgtttccgctggtgggcaccgcgccttactggctcgtgctcgcgctgagcattgttgacctggtgatccgggtgctggcgttgggaatcattccggggaaccgccgtcccaccacggccatggcctggctgctgggaatcttctttgtgcccgccctcggcctgatcctgttcctgctttttggaaacttcaaactctcccggaagcgccgtgcacagcaggatgccgtgaacaagcgggtccgcgccggcacctcccagctggccgccgtcgaaagcgaatacgacggcccggaatgggtagcgtcggcggcagaactgaacaagacccttggttcgctgcccatggtggacggcaacagcgtggagctactgcccggttaccccgactcgatcaaagccatggccgccgccgtgcgcggggcgaagaacttcgtcaacgccgagttctacatcatgagcacggaccacatcaccgatgacctgttcaccgcactggaagaggccgcggagcgcggcgtccaggtccgagtgctgttcgaccacctcggcaccctgcgcatcaagggctaccgcaagctcatcgcgcgcctgaaggccagccagatccagtggcggcccatgttgccactgaaccccgtccacggccagtggcgccgtccggacctgcgcaaccaccgcaagatcatggtgatcgacggcgaaatcgccttcacgggctcgcagaacctgatcgaaccgtcctacaacaatccccggcaccgcaaggtggggcgcgagtgggtggagctcatggcatgcatgcgcgggccgatcgtcaccacgctcaacgtggtatttgccaccgactggctcagtgagacggacgagtccctggaggaccagctggcctaccagcccgagacggcagcgggcgccgtgaccgcccaggccgtgcccagcggccccggcttcatcaccgagaacaacctgcgcctcttcaacaccctcatctactccgcgcagcacaagatctccatctgcagcccatacttcgtccccgatgattcgctgctctacgcggtgacgacggcggcgcaacgcggcgtcgacgtcgaacttttcgtctcggaaaagggggaccagttcctggtccaccacgcgcagcagtcctactacgaggcgctgctggaagcgggcgtgcggatctacctgtacaaggcgccgttcgtgctgcatgcgaagcatttcaccatcgacgacgaagtagcggtgctggggtccagcaacatggacatgaggtccttctcgctgaacctggaggtttcggtgatgctccttggcgccgacatcgtggccaagatgcgcgccgtggaggacacctaccggggcatctcccgtgaactgacgctcgaggactggatggaacggcccatggcggtcaagtacgtggacaacgtcgcccggctcacggccacgctgcagtag

SEQ ID NO: 14571 - protein, 510 aa, Arthrobacter sp. FB24
MLDASPEPVRRASNRGSLSVLWPFPLVGTAPYWLVLALSIVDLVIRVLALGIIPGNRRPTTAMAWLLGIFFVPALGLILFLLFGNFKLSRKRRAQQDAVNKRVRAGTSQLAAVESEYDGPEWVASAAELNKTLGSLPMVDGNSVELLPGYPDSIKAMAAAVRGAKNFVNAEFYIMSTDHITDDLFTALEEAAERGVQVRVLFDHLGTLRIKGYRKLIARLKASQIQWRPMLPLNPVHGQWRRPDLRNHRKIMVIDGEIAFTGSQNLIEPSYNNPRHRKVGREWVELMACMRGPIVTTLNVVFATDWLSETDESLEDQLAYQPETAAGAVTAQAVPSGPGFITENNLRLFNTLIYSAQHKISICSPYFVPDDSLLYAVTTAAQRGVDVELFVSEKGDQFLVHHAQQSYYEALLEAGVRIYLYKAPFVLHAKHFTIDDEVAVLGSSNMDMRSFSLNLEVSVMLLGADIVAKMRAVEDTYRGISRELTLEDWMERPMAVKYVDNVARLTATLQ

SEQ ID NO: 14572 - DNA, 1161 bp, Azotobacter vinelandii AvOP
  CDS (1)..(1161): transl_table=11
atgcagagcggtgcggtctttccctggcggggcggcaatcgcttcagcctgctggtcgatggcgatgccttctttccgcgcatgctggaggccatcgccggggccagatggcgggtcgatctcgaactgtatctggtcgaggatggccgctgcgccggcctgctggtggatgcgctggtcgccgcggcccggcgcggcgtgcaggtgcgttgcctgttcgatggcttcggggcgctcggtttcggtgccgccctgcgcgtccgcctgaccggggcgggtgtcgccttggtgttgttcaatcctctgcgctggcatttcggcttgcacaatctgcatcgcgatcatcgcaagatgctactggtggacgatcgcctgggctatgtcggcggtacgggcgccaccgacgagttctgggacccgcaaaataccagcggcctgtggcatgaggtcatggtggaaatcgccgggccgctgctggccgactggcggacgctgttcgatcatcagtggatgctctgccacgagtggggccgctggcgctcgcagcggccgccgaagcccccgcgcatcccgccgagtcctttgcgtcgcgagggttcgggccggctcgcctatgccgaggcgcatcagcaccgcgatgtcctgcaatcgctgatccgcagtctgcaccgcgcgaaccggcgtatctggctggccactccctatttcctgccgacctggaaggtacgccgcgccctgctcaaggcggcccggcgcggcgtggaggtgcgcctgctgctggccggacgcaataccgaccatccgccggtgcgctatgccggccagcgctattatcgccgcctgctgcaggccggcgtacgcatcttcgaataccagccgcgcttcctgcacctgaagatggtgctggtcgacgactgggtcagcgtcggctcctgcaatttcgatcactggaacctgcgcctgaatctggaggccaatctcgaaacgcgcgatccgcgcttcatcgccgaggccgtcgaatgcttcctcgccgacttccaggtcagccatgaggtcgaccggcgacagtggcaggcccgtccctggtatcgccggctgcgtcagcggctgtggggctggctggaccggctggtggtcgatctgctggatcgcggcggttga

SEQ ID NO: 14573 - protein, 386 aa, Azotobacter vinelandii AvOP
MQSGAVFPWRGGNRFSLLVDGDAFFPRMLEAIAGARWRVDLELYLVEDGRCAGLLVDALVAAARRGVQVRCLFDGFGALGFGAALRVRLTGAGVALVLFNPLRWHFGLHNLHRDHRKMLLVDDRLGYVGGTGATDEFWDPQNTSGLWHEVMVEIAGPLLADWRTLFDHQWMLCHEWGRWRSQRPPKPPRIPPSPLRREGSGRLAYAEAHQHRDVLQSLIRSLHRANRRIWLATPYFLPTWKVRRALLKAARRGVEVRLLLAGRNTDHPPVRYAGQRYYRRLLQAGVRIFEYQPRFLHLKMVLVDDWVSVGSCNFDHWNLRLNLEANLETRDPRFIAEAVECFLADFQVSHEVDRRQWQARPWYRRLRQRLWGWLDRLVVDLLDRGG

SEQ ID NO: 14574 - DNA, 1446 bp, Azotobacter vinelandii AvOP
  CDS (1)..(1446): transl_table=11
atggaacagggcgctttgcagctcttgggctacctgctggtgctgatccaggcgctgggggtggctgcggccgtccacgcggtgttcaccgtgcggaccgcgcagggagccatcgcctgggccatctccctgctgttcatgccctatctcaccctgctgccctatctggtgttcggtcgcagccgtttcgacgcctatatccgggcgcggcgccaggccgaccggcagatgcgccgggcgatggccgagcaggactggcgtccctgggtcgaggaggccaaggcggcccatggcagcatggcttcgcaggatctcaaggtgctggcgcgcctcggccgccagccgccactgggcaacaaccgggtgcgcctgctgatcgacggcgaggccgccttcgcggcgattttcgaggccgtcgcccaggcgcgccaggtgatcctgctgcagttcttcatcgtccgcgacgaccgcctcggccggcgtctgcagagcctgctgctggagcgggccgccagcggcgtgcaggtgttcttcctctacgaccgcgtcggctgccacgccctgccgcgtcactatgtgcagcgtctgcgcgcgggaggggtggcgatgcgggccttttcggcctccgcgcgcagcgggctgctcaaccgcttccagttgaacttccgcaaccaccgcaagctggtgctggtcgacggccagcgcggctttctcggcgggatgaacgtcggcgacgactacctgggaaacaatccgcggctctcgccctggcgcgatacccaggtggagctgagcgggcccgtgctggcctgcctgcaggagtccttcgccgaggactggttctggaccacccggcaactgccgccgctgctgctgccggagcgctatcccgccggcggggtgctctgccaactggtcggcagcggccctgccgatccccaggaaaccggctcgctgcagttcgtcgcggcgatcaacgcggcgcgtcggcggatctggctggccagtccctacttcgtgcccgacgagtcggtgttcgccgccttgcgcctggcggcgctgcgcgggctggaggtgcgcctgctgctgccggcgcgggccgatcaccgggtggtctacgccgcttccagcctgtatgccttcgaggcgctcgaagcgggcatccgggtatttcgctatctgccgggcttcatgcaccagaaggtgctgctgatcgacgacgataccgcggcggtgggcagcgccaatctggacaaccgctcgttccggctgaatttcgaactgaccctgttcgtcctcgataccgccttcgccgctgaggtggaatgcatgctgcaaagggatttcagccgttcccgcgagctggacaggggggagagccgccgggcgcaccgcctgaaacgcctgggcatgcgggtggcgcggctgatttcgccgatcctctga

SEQ ID NO: 14575 - protein, 481 aa, Azotobacter vinelandii AvOP
MEQGALQLLGYLLVLIQALGVAAAVHAVFTVRTAQGAIAWAISLLFMPYLTLLPYLVFGRSRFDAYIRARRQADRQMRRAMAEQDWRPWVEEAKAAHGSMASQDLKVLARLGRQPPLGNNRVRLLIDGEAAFAAIFEAVAQARQVILLQFFIVRDDRLGRRLQSLLLERAASGVQVFFLYDRVGCHALPRHYVQRLRAGGVAMRAFSASARSGLLNRFQLNFRNHRKLVLVDGQRGFLGGMNVGDDYLGNNPRLSPWRDTQVELSGPVLACLQESFAEDWFWTTRQLPPLLLPERYPAGGVLCQLVGSGPADPQETGSLQFVAAINAARRRIWLASPYFVPDESVFAALRLAALRGLEVRLLLPARADHRVVYAASSLYAFEALEAGIRVFRYLPGFMHQKVLLIDDDTAAVGSANLDNRSFRLNFELTLFVLDTAFAAEVECMLQRDFSRSRELDRGESRRAHRLKRLGMRVARLISPIL

SEQ ID NO: 14576 - DNA, 1623 bp, Burkholderia vietnamiensis G4
  CDS (1)..(1623): transl_table=11
gtgctcacgtctttgatccggcacgcgccggccgcgccgtgttggcgcgccgtgtgccgcctggcccgcgcgctggtcgtctgcgcgctgctgccacttgtcgcgtgcgcgacgcacccgcctgcgacgtcgctcgagcgctccgtgtcccacgcgctgccggccgatgccgcgacgccgctgcgcacggcgctggccgcaccggaagccgcacatcccgggcagtcgggcttccgcctgctcgccgacggcgccaccgcgctgcagatgcgcatcgcgctcgcgcgggcggccacgaagacgctcgacatgcagtactacatcgcgaccgaggacacgaccggcaagctgctgctcgccgcggcgctgtacgcggccgatcgcggcgtgcgcgtgcggatgctggtcgacgacctgaacttccgcgacatcgaccgcgtgatggccgcgctcaatacgcacgggaacatcgagatccgcgtgttcaacccgttcggcgcgtcgcagtacgggatggtcgagcgcacggccaatttcttcacgcggctcgacagcttcacgcgccgcatgcacaacaaggcgatgatcgcggacaaccagctcgcgatcgtcggcggccgcaatctcggcgacgaatacttcagtgcgagcccgacgctgcagttccgcgatctcgacgtgctcgcggccggcccggtgacgaacgatatctcgaagagcttcgacgactactgggcgagcgcgagcagctatccgttgcgcgtgctgaaccaccagcgcttcgatccgaaggatctcgacgcggtgcgcgacgagctgcgcgagcactggcgcaacaacgccgacccgtacaacgcgaagccgttgaacgccacgccgctggcgcgccagatcgcgcgcgacgagctggaactcgtgtgggcgccggccgagttcaaggtcgatgcgccggacaagatcgcgcagccgaccgacacctacgtgagcccgccgatgcagcgcctggccgacctcacgcgcggcgcgcgcacggaatttctcgcgttttcgccgtacttcgtgccgcacgacgccggcgtgaagatcctcggcgatacggccgcgcgcggcgtgcgcgtcgcgatcgtcacgaattcgctcgcggccaccgacgcggtcgcggtgcaggccggctacgcgccgtaccgcgtgccgttgctacagcgcggcgtcgagttgtacgaattcaagtcgcagcccgaacagccgcctgcgcggctgttcggctcgcgttcgcgtgcgagcctgcatgcgaaggcgtacgtgatcgaccggcagatcgtcgtgatcggctcgctgaacctcgacccgcgttccgcacacctgaacaccgaactggcgctcgtgatccacagcccgcagctcgcgcagcaggcggtggcgatcttcgcgcacgtgacgcagcccgaccagagctaccgcgtgacgctcgcgccgcagccgggcggcggcccgcccgcgctcgaatggacgggcaccgatggcgggcaaaccaccacctatcacgtcgacccgcatgccgggctgctgcgcaacgtgatgaccggcgtcttcatgctgctgccggtcgacgatcagttgtaa

SEQ ID NO: 14577 - protein, 540 aa, Burkholderia vietnamiensis G4
MLTSLIRHAPAAPCWRAVCRLARALVVCALLPLVACATHPPATSLERSVSHALPADAATPLRTALAAPEAAHPGQSGFRLLADGATALQMRIALARAATKTLDMQYYIATEDTTGKLLLAAALYAADRGVRVRMLVDDLNFRDIDRVMAALNTHGNIEIRVFNPFGASQYGMVERTANFFTRLDSFTRRMHNKAMIADNQLAIVGGRNLGDEYFSASPTLQFRDLDVLAAGPVTNDISKSFDDYWASASSYPLRVLNHQRFDPKDLDAVRDELREHWRNNADPYNAKPLNATPLARQIARDELELVWAPAEFKVDAPDKIAQPTDTYVSPPMQRLADLTRGARTEFLAFSPYFVPHDAGVKILGDTAARGVRVAIVTNSLAATDAVAVQAGYAPYRVPLLQRGVELYEFKSQPEQPPARLFGSRSRASLHAKAYVIDRQIVVIGSLNLDPRSAHLNTELALVIHSPQLAQQAVAIFAHVTQPDQSYRVTLAPQPGGGPPALEWTGTDGGQTTTYHVDPHAGLLRNVMTGVFMLLPVDDQL

SEQ ID NO: 14578 - DNA, 1452 bp, Burkholderia vietnamiensis G4
  CDS (1)..(1452): transl_table=11
atgaccttcgactggcttcatgactggcttcacctcggcaccctgctcctggccatccatgtgctcggaatcgtcgcggcgtgccacgcgatcatgaacacgcgcacgtcgcaaggcgcggtcgcgtgggccgtgtcgctcgtcgcgatgccgtacctgacgctcgtcccgtacctgttcctcggccgcagcaagttctccggctacgtcgacgcgcgccgccaggagttgcgggcgctgcgcacgcatacgcagcgcgtaccgtggctcgatacgcacggcgccgacgggccggcagccgctgcgatcggccaggccgccgtgctcgcgctcacgcgcctcggcgggatgccgttcgtcggcggcaacacggtgcgcacgctggtcaacggcgacgcgaccttcgcggcgatcctcgcggcgatcgacgccgcgcgcgactacgtgatcgtccagttcttcatcgtgcgcgacgacgcgctcggccggatgctcagcgatgcactgctcgcgcgcgccgcagccggcgtgcgctgctatctgctgtacgacagcatcggcagcttcgatctgccgcgcagctacgtcgacacgctgcgccgcggtggcgtcgacgtgcatccgttcgcgacccgccgcaagttcgtcaaccgcttccagctgaacttccgcaaccatcgcaagatcgtcgtcgtcgacggcgaccgtgcgttcgtcggcggccacaacgtcggcgtcgaatatctcggcgcgaacccgcgcctgtcgccgtggcgcgatacccatatcgagatccgcggcccggtggtcgcgagcatccagtacgtgttcgccgaagactggcactgggccacccagacgctgccggcgctcgccgcgccgccggccgccctgcccggcgacacgatgcactgcctggccgtgccgatggggccggccgacaaacaggaaaccggctcgctgttcttcgtcgaggcgatcaacgccgcgcgcgaacgggtgtggatcacgacgccgtatctcgtgcccgacgaagcggtgctcgccgcgctgaagctcgcggtgatgcgcggcgtcgacgtgcgcatcctgataccgagccggcgcgaccactacgtcgtgttcgaggcgtcgaagctctatgcgcgcgacctcgtcgacgccggcgtcaaggtgttccgctaccgcagcggcttcctccaccagaaggtcgtgctgatcgatcgcgtcgcggccgcggtcggcagcgcgaacctcgacaaccgttcgttccggctcaacttcgagatcatggtgctgaccgtcgacgcggcgttcgcagcggacgtcgcgacgatgctcgatgccgacttcgcgctggcggacgaggtcgacgccaccgagtatcggcgctcgcctgcatggcggcgcatcgcgatgcacgtcgcccgcctgttcgcgccgattctgtag

SEQ ID NO: 14579 - protein, 483 aa, Burkholderia vietnamiensis G4
MTFDWLHDWLHLGTLLLAIHVLGIVAACHAIMNTRTSQGAVAWAVSLVAMPYLTLVPYLFLGRSKFSGYVDARRQELRALRTHTQRVPWLDTHGADGPAAAAIGQAAVLALTRLGGMPFVGGNTVRTLVNGDATFAAILAAIDAARDYVIVQFFIVRDDALGRMLSDALLARAAAGVRCYLLYDSIGSFDLPRSYVDTLRRGGVDVHPFATRRKFVNRFQLNFRNHRKIVVVDGDRAFVGGHNVGVEYLGANPRLSPWRDTHIEIRGPVVASIQYVFAEDWHWATQTLPALAAPPAALPGDTMHCLAVPMGPADKQETGSLFFVEAINAARERVWITTPYLVPDEAVLAALKLAVMRGVDVRILIPSRRDHYVVFEASKLYARDLVDAGVKVFRYRSGFLHQKVVLIDRVAAAVGSANLDNRSFRLNFEIMVLTVDAAFAADVATMLDADFALADEVDATEYRRSPAWRRIAMHVARLFAPIL

SEQ ID NO: 14580 - DNA, 1275 bp, Burkholderia mallei 10229
  CDS (1)..(1275)
atgagtggcgagacccggcaccgcctcgcgcaactgcgccagatgttcctgcaggagcgcggctccgcgtcgcggctcgcgttcacgtccggcaacgcggtgcgcctctgcgacggcggcgcggcgttctttccggcgctgatcgaacggatcgacgccgcgcgcgagcgcgtcgcgctcgaaacctacatcttctgcgacgacgccgtcggccgcgcggtgtccgacgcgctcgtccgcgcggccgcgcgcggcgttcacgtgcgcgtcatcaccgatggaatcggcaccgagcgcctgccgcttttcggcacctggccggacgcgggcgtcgagcaccggatctacaatccctatctgttcggccgcttcggtttttcgcgcacgcaccgcaagctcgcggtgatcgacgacgcctgcgcgttctgcggcggcatcaacatcgtcgacgatttcgagcagaacggcgagcgcctgccgcatccgcgttgggacttcgcggtcgaactggccgggcccgccgtcgccgacgtgcgcgccgcgttcgaggtgcagtggcaccggatcgccgccggccacaagcgctacgcgcaatatctgccgtatgacgtcgatggtcccgcgttcgccgcgcgctttcgccgctggatgcgcagccaccgctgggtgaaggcgggcgcgctgcgcgtcgtgaccgagccgagcgtggcgttcgtcgcgcgcgacaatatcgtgaaccgccgggcgatcgagaaggcgtatctcgcggcgatcggccgcgcgcgccagtcgatcctgctcgctaacccttacttcatgccggggcgcaagctgcggcgcgcgctcgccggcgcggcgcgccgcggcgtcgacgtgcggatcctgctcgggcgcaacgagttcgcgtcgctcgatatggcggtgccgttcctatatcatgcattgctgcgctcgggcgtgcgcgttgccgaatacgacaagacgatgctgcacggcaaggtcgcggtgatcgacgatcattgggcgaccgtcggctcgtcgaatctggatgcgctcagcctgatgctgaacaacgaggcgaacgtcgtgctcgtgcgccaccgcgaggagacggccgcgctgcgcgacgcgatcgcggcggcgttcgccgacggccgcgagatcgacccggcgctctacgcggcgcggcccgccgccgagcggtttctgaactggttcgcgtacaacgcgtaccggagtgcgatgaagctgctgacggtcggcggatacgactaa

SEQ ID NO: 14581 - protein, 424 aa, Burkholderia mallei 10229
MSGETRHRLAQLRQMFLQERGSASRLAFTSGNAVRLCDGGAAFFPALIERIDAARERVALETYIFCDDAVGRAVSDALVRAAARGVHVRVITDGIGTERLPLFGTWPDAGVEHRIYNPYLFGRFGFSRTHRKLAVIDDACAFCGGINIVDDFEQNGERLPHPRWDFAVELAGPAVADVRAAFEVQWHRIAAGHKRYAQYLPYDVDGPAFAARFRRWMRSHRWVKAGALRVVTEPSVAFVARDNIVNRRAIEKAYLAAIGRARQSILLANPYFMPGRKLRRALAGAARRGVDVRILLGRNEFASLDMAVPFLYHALLRSGVRVAEYDKTMLHGKVAVIDDHWATVGSSNLDALSLMLNNEANVVLVRHREETAALRDAIAAAFADGREIDPALYAARPAAERFLNWFAYNAYRSAMKLLTVGGYD

SEQ ID NO: 14582 - DNA, 1275 bp, Burkholderia mallei 10399
  CDS (1)..(1275)
atgagtggcgagacccggcaccgcctcgcgcaactgcgccagatgttcctgcaggagcgcggctccgcgtcgcggctcgcgttcacgtccggcaacgaggtgcgcctctgcgacggcggcgcggcgttctttccggcgctgatcgaacggatcgacgccgcgcgcgagcgcgtcgcgctcgaaacctacatcttctgcgacgacgccgtcggccgcgcggtgtccgacgcgctcgtccgcgcggccgcgcgcggcgttcacgtgcgcgtcatcaccgatggaatcggcaccgagcgcctgccgcttttcggcacctggccggacgcgggcgtcgagcaccggatctacaatccctatctgttcggccgcttcggtttttcgcgcacgcaccgcaagctcgcggtgatcgacgacgcctgcgcgttctgcggcggcatcaacatcgtcgacgatttcgagcagaacggcgagcgcctgccgcatccgcgttgggacttcgcggtcgaactggccgggcccgccgtcgccgacgtgcgcgccgcgttcgaggtgcagtggcaccggatcgccgccggccacaagcgctacgcgcaatatctgccgcatgacgtcgatggtcccgcgttcgccgcgcgctttcgccgctggatgcgcagccaccgctgggtgaaggcgggcgcgctgcgcgtcgtgaccgagccgagcgtggcgttcgtcgcgcgcgacaatatcgtgaaccgccgggcgatcgagaaggcgtatctcgcggcgatcggccgcgcgcgccagtcgatcctgctcgctaacccttacttcatgccggggcgcaagctgcggcgcgcgctcgccggcgcggcgcgccgcggcgtcgacgtgcggatcctgctcgggcgcaacgagttcgcgtcgctcgatatggcggtgccgttcctatatcatgcattgctgcgctcgggcgtgcgcgttgccgaatacgacaagacgatgctgcacggcaaggtcgcggtgatcgacgatcattgggcgaccgtcggctcgtcgaatctggatgcgctcagcctgatgctgaacaacgaggcgaacgtcgtgctcgtgcgccaccgcgaggagacggccgcgctgcgcgacgcgatcgcggcggcgttcgccgacggccgcgagatcgacccggcgctctacgcggcgcggcccgccgccgagcggtttctgaactggttcgcgtacaacgcgtaccggagtgcgatgaagctgctgacggtcggcggatacgactaa

SEQ ID NO: 14583 - protein, 424 aa, Burkholderia mallei 10399
MSGETRHRLAQLRQMFLQERGSASRLAFTSGNEVRLCDGGAAFFPALIERIDAARERVALETYIFCDDAVGRAVSDALVRAAARGVHVRVITDGIGTERLPLFGTWPDAGVEHRIYNPYLFGRFGFSRTHRKLAVIDDACAFCGGINIVDDFEQNGERLPHPRWDFAVELAGPAVADVRAAFEVQWHRIAAGHKRYAQYLPHDVDGPAFAARFRRWMRSHRWVKAGALRVVTEPSVAFVARDNIVNRRAIEKAYLAAIGRARQSILLANPYFMPGRKLRRALAGAARRGVDVRILLGRNEFASLDMAVPFLYHALLRSGVRVAEYDKTMLHGKVAVIDDHWATVGSSNLDALSLMLNNEANVVLVRHREETAALRDAIAAAFADGREIDPALYAARPAAERFLNWFAYNAYRSAMKLLTVGGYD

SEQ ID NO: 14584 - DNA, 15 bp, Artificial sequence
  (1)..(15): no sequence is available, n in all positions is no nucleotide
nnnnnnnnnnnnnnn

SEQ ID NO: 14585 - DNA, 9043 bp, Unknown
  DNA sequence
actttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaagcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagt

SEQ ID NO: 14586 - DNA, 9041 bp, Unknown
  DNA sequence
actttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaagcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattccagctgaccacccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagt

SEQ ID NO: 14587 - DNA, 4458 bp, Unknown
  DNA sequence
acaggaaacagctatgaccatgattacgccaagctatcgtttaaaccttaaggcgatcgcgctgaggcggaccgcacgtggaattagcttggcgcgccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcgggctcggcgtccgcggatcattgacgcgtaggagcgacccgggcgtaccttggtgaactaccgatgatcgtaagagcttacagacggtgccttatataggcagagcgtcggaaggggggtggtgtcacacacgcactgcgatccttgcttacaagctaagcaaaggcatcgtggcagacaaggaataaagtggcacaggtgccaaaagaaagtggacagcacacttgtccgaaaagcacacaataatacaactcagtggagcatccactgaatgggcccagtactctccgctgcggtcatccctgacgtcaatgcctcctcaatcgtcattgcttacgtcttggagatctagcacatcttctgcggctactggcgacatagcccttggtgtggcctggtattcctcgaactcctgctcttctatcttcagcttggtgacttccttcataagttcctcctccattgtttgcacgccaccggtcttcagaacttcaagattcttgagaaattcatcaattctgtcttgaatgtgttcttcaatgagatctgcccagtaccagcaatggcatttgttcattgcgcacttgaagaatttccttcctgggttggcagatgttctggacactaactgaattgcaggcttcctgcatgcacagagtagaactggttcctctgttagcataaaagcttgctctgttctttcgaacatgtccttcttgaatgtggggaatggatccagaattttgtttccccattctctgagttgctcagtgtatggatgatctggataaggaattacttcccttatggcttgtgtaagcaggatcatctcttccgttggttcattctgagctaatttggctttgagcctggacaagatgtcagctaaaccattgctcttcccttttatgtgttcaatgactatctctggtcctgcaccagtgatgtagtccatgaacctgatccatctgatctcagaaggcttgtgttcagcactcttgttgtagaacctttcgattgcactactgtcagttctgactgtgatctctcttttgtccaagtagaacaatctcatcttttctaagccattcataaccccatagatttctgcatcacaggttccttttggcttatcaaattttccactggcatacctacagatttgctctgtatttcttgggtctgccttgtttttcttccacttgcatactgctccccatccagttgcacatgcatctgtttcaatgataatgtatgcatcttctggtggaatagtgagatttggaagcgttctcaccattgtcttgatcctattgatcagcttccaatcttctgaattgagccttcgctcacctttctctgaggtctttggatataatgggccaagaagcttgcccatatctttgatgtggtttctggcatagttcagtgttgctagccaggattaattaaaggcctgttaacagcgctgggcccgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcac

SEQ ID NO: 14588 - DNA, 11449 bp, Unknown
  DNA sequence
gtttacccgccaatatatcctgtcaaacactgatagtttgtggaattcgagctcggtacccggggatcctctagagtcgacctgcaggcatgcaagctttgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacccccggggatccactagttctagaaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgatccccgcaagggcgccgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgcggcctccggctacgcgcgctcctcgggccgcgtcggcgtctgcatcgccacctccggccccggcgccaccaaccttgtctccgcgctcgccgacgcgctgctcgattccgtccccatggtcgccatcacgggacaggtgccgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccggggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcccggcgccctgttctttatgttggcggtggctgcgcagcatctggtgaggagttgcgacgctttgtggagctgactggaatcccggtcacaactactcttatgggcctcggcaacttccccagcgacgacccactgtctctgcgcatgctaggtatgcatggcacggtgtatgcaaattatgcagtggataaggccgatctgttgcttgcacttggtgtgcggtttgatgatcgtgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggccaacccaggtgttactgttgttgacatcgatggagatggtagctttctcatgaacgttcaggagctagctatgatccgaattgagaacctcccggtgaaggtctttgtgctaaacaaccagcacctggggatggtggtgcagtgggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctaatggtggggctttcaaggatatgatcctggatggtgatggcaggactgtgtactgatctaaaatccagcaagcaactgatctaaaatccagcaagcaccgcctccctgctagtacaagggtgatatgtttttatctgtgtgatgttctcctgtattctatctttttttgtaggccgtcagctatctgttatggtaatcctatgtagcttccgaccttgtaattgtgtagtctgttgttttccttctggcatgtgtcataagagatcatttaagtgccttttgctacatataaataagataataagcactgctatgcagtggttctgaattggcttctgttgccaaatttaagtgtccaactggtccttgcttttgttttcgctatttttttccttttttagttattattatattggtaatttcaactcaacatatgatgtatggaataatgctagggctgcaatttcaaactattttacaaaccagaatggcattttcgtggtttgaggggagtgaaaaaaaatgaggcatttgactgaattagttacctgatccattttcgtggtttggatcattggaattaaattccattctaataatagtaattttggcatatatcaattaagttaattcggttttatgcaaaatatatttgtatactattattatcaagatgtcggagatatttatatgctacatttttactatacaggagtgagatgaagagtgtcatgtaagttacacagtagaaacaaattctattaatgcataaaatcatttccatcatccaccctatgaatttgagatagacctatatctaaactttgaaaagtggttgaatatcaaattccaaattaaataagttattttattgagtgaattctaatttctctaaaacgaagggatctaaacgccctctaaagctaatttggaaactcaaactttcttagcattggaggggattgagaaaaaatattaattcattttcatctcaatcattcaatctccaaagagatttgagttccttattagtctgttccatgcatcaaatcggctcaatgtgtcattatttgccatgacgattgacgagttgttctggggcctagcgctttccacgccgatgtgctggggcctggtcctggagaagacagcttgatatttaaagctatcaattgtttcaattgattcccacttcatttttctaaatgtagaaaacggtgacgtataagaaaaagaatgaattaggacttttattccgtacactaatctagagcggccccttaaggcgctgcgatcgcgttaacagcttgctgaggaggcctcggaccgttaattaacacgtgggcgcgccactagtcaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcagggggggggggggggggggacttccattgttcattccacggacaaaaacagagaaaggaaacgacagaggccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgtacggaatgccaagcactcccgaggggaaccctgtggttggcatgcacatacaaatggacgaacggataaaccttttcacgcccttttaaatatccgttattctaataaacgctcttttctcttag

SEQ ID NO: 14589 - DNA, 419 bp, Unknown
  CDS: 166-275;353-419
gcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctct

SEQ ID NO: 14590 - protein, 62 aa, Acetabularia mediterranea
MASIMMNKSVVLSKECAKPLATPKVTLNKRGFATTIATKNREMMVWQPFNNKMFETFSFLPP

SEQ ID NO: 14591 - protein, 85 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQIDI

SEQ ID NO: 14592 - protein, 54 aa, Arabidopsis thaliana
MKSSMLSSTAWTSPAQATMVAPFTGLKSSASFPVTRKANNDITSITSNGGRVSC

SEQ ID NO: 14593 - protein, 91 aa, Arabidopsis thaliana
MAASGTSATFRASVSSAPSSSSQLTHLKSPFKAVKYTPLPSSRSKSSSFSVSCTIAKDPPVLMAAGSDPALWQRPDSFGRFGKFGGKYVPE

SEQ ID NO: 14594 - protein, 80 aa, Brassica campestris
MSTTFCSSVCMQATSLAATTRISFQKPALVSTTNLSFNLRRSIPTRFSISCAAKPETVEKVSKIVKKQLSLKDDQKVVAE

SEQ ID NO: 14595 - protein, 51 aa, Brassica napus
MATTFSASVSMQATSLATTTRISFQKPVLVSNHGRTNLSFNLSRTRLSISC

SEQ ID NO: 14596 - protein, 44 aa, Chlamydomonas reinhardtii
MQALSSRVNIAAKPQRAQRLVVRAEEVKAAPKKEVGPKRGSLVK

SEQ ID NO: 14597 - protein, 51 aa, Cucurbita moschata
MAELIQDKESAQSAATAAAASSGYERRNEPAHSRKFLEVRSEEELLSCIKK

SEQ ID NO: 14598 - protein, 62 aa, Spinacea oleracea
MSTINGCLTSISPSRTQLKNTSTLRPTFIANSRVNPSSSVPPSLIRNQPVFAAPAPIITPTL

SEQ ID NO: 14599 - protein, 75 aa, Spinacea oleracea
MTTAVTAAVSFPSTKTTSLSARCSSVISPDKISYKKVPLYYRNVSATGKMGPIRAQIASDVEAPPPAPAKVEKMS

SEQ ID NO: 14600 - protein, 55 aa, Spinacea oleracea
MTTAVTAAVSFPSTKTTSLSARSSSVISPDKISYKKVPLYYRNVSATGKMGPIRA

SEQ ID NO: 14601 - protein, 90 aa, Arabidopsis thaliana
MAASLQSTATFLQSAKIATAPSRGSSHLRSTQAVGKSFGLETSSARLTCSFQSDFKDFTGKCSDAVKIAGFALATSALVVSGASAEGAPK

SEQ ID NO: 14602 - protein, 96 aa, Arabidopsis thaliana
MAQVSRICNGVQNPSLICNLSKSSQRKSPLSVSLKTQQHPRAYPISSSWGLKKSGMTLIGSELRPLKVMSSVSTAEKASEIVLQPIREISGLIKLP

SEQ ID NO: 14603 - protein, 100 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGA

SEQ ID NO: 14604 - protein, 46 aa, Arabidopsis thaliana
MITSSLTCSLQALKLSSPFAHGSTPLSSLSKPNSFPNHRMPALVPV

SEQ ID NO: 14605 - protein, 93 aa, Arabidopsis thaliana
MASLLGTSSSAIWASPSLSSPSSKPSSSPICFRPGKLFGSKLNAGIQIRPKKNRSRYHVSVMNVATEINSTEQVVGKFDSKKSARPVYPFAAI

SEQ ID NO: 14606 - protein, 52 aa, Arabidopsis thaliana
MASTALSSAIVGTSFIRRSPAPISLRSLPSANTQSLFGLKSGTARGGRVVAM

SEQ ID NO: 14607 - protein, 39 aa, Arabidopsis thaliana
MAASTMALSSPAFAGKAVNLSPAASEVLGSGRVTNRKTV

SEQ ID NO: 14608 - protein, 92 aa, Arabidopsis thaliana
MAAITSATVTIPSFTGLKLAVSSKPKTLSTISRSSSATRAPPKLALKSSLKDFGVIAVATAASIVLAGNAMAMEVLLGSDDGSLAFVPSEFT

SEQ ID NO: 14609 - DNA, 10 bp, Primer
ttgctcttcc

SEQ ID NO: 14610 - DNA, 10 bp, Primer
ttgctcttcg

SEQ ID NO: 14611 - DNA, 27 bp, Primer
atagaattcagaggcgatctgggccct

SEQ ID NO: 14612 - DNA, 34 bp, Primer
ataccatggaagagcaagaggcgatctgggccct

SEQ ID NO: 14613 - DNA, 34 bp, Primer
atagaattcgcataaacttatcttcatagttgcc

SEQ ID NO: 14614 - DNA, 36 bp, Primer
atagtttaaacgcataaacttatcttcatagttgcc

SEQ ID NO: 14615 - DNA, 19 bp, Primer
ggaattccagctgaccacc

SEQ ID NO: 14616 - DNA, 20 bp, Primer
gatccccgggaattgccatg

SEQ ID NO: 14617 - DNA, 30 bp, Primer
atacccgggcaccggatccttccgccgttg

SEQ ID NO: 14618 - DNA, 30 bp, Primer
atacccgggatggcgcccaccgtgatgatg

SEQ ID NO: 14619 - DNA, 16 bp, Primer
gggtcgctcctacgcg

SEQ ID NO: 14620 - DNA, 16 bp, Primer
ctcgggctcggcgtcc

SEQ ID NO: 14621 - DNA, 1275 bp, Burkholderia cenocepacia AU 1054
  CDS (1)..(1275): transl_table=11
atgaatgcggagacccgcaagcgcttcgcgcaattgcggcagatgttcctgcaggagcgcggctccgcgtcgcggctcgcgtttacggccggcaacacggtgcggctgtgcgaaaccggcggcgaattcttccacgcgctgatcgagcggatcgacgccgcccgcgagcaggtgatgctcgaaacctacatcttctgcgacgacgcggccggccgcccggtgtcggacgcgctgatccgcgcggcgcagcgcggcgtgcgcgtgcgggtgatcaccgacggcatcggcaccgcgcgcctgccgctgttcgacacatggggcgaagccggcgtcgagcactgcatctacaatcgcttcctgttcggccgcttcggcttctcgcgcacgcaccgcaagcttgcggtgatcgatcagacgaccgcgttctgcggcggcatcaacatcgtcgacgactacacgcagggcagcgcgacgctgccgtttccgcgctgggatttcgcggtcgagatggccgggcccgcggtgtccgacgtgcgcgccgcgttcgagctgcagtggcaccggatccagttcggccacaagccgtatgcgcagtacgcggccgggctgcacggcggcgaagcgttccccgacatgttccggcgctggatgcgcagccatcgatggatcaaggccggcgcgctgcgggtcgtgacggagccgagcgtcgcgttcgtcgcgcgcgacaacgtcgtgaaccgccgcgcgatcgagaaggcctatctcgcggcgatcggccaggcgcgccagcgcatcctgctcgcgaatccgtatttcatgccgggccgcaagctgcgccgcgcgctgacgggcgcggcacggcgcggcgtcgacgtgcaggtgctgatcggccgcaaggagttcacggcgctcgatacggccgtgccgttcctgtatcactcgctgttgcgcgcgggcgtgcgcgtggccgaatacgacaagacgatcctgcacggcaaggtcgccgtgatcgacgacaactgggcgacggtcggctcgtcgaatctggacgcgctgagcctgatgctgaacaatgaagcgaacgtcgtgctggtgcgctacgatgcagtgacgaatcagttgcgcgacgcgatcgccaccgcgttcgccgaagggcgggagatcgacgccgcgcactatgccgcccgcccgcgcatcgaacggctgctgaactggctggcgtacaccacgtaccgcctcgtgatgaaggcgctgacggtcggcggttacgactga

SEQ ID NO: 14622 - protein, 424 aa, Burkholderia cenocepacia AU 1054
MNAETRKRFAQLRQMFLQERGSASRLAFTAGNTVRLCETGGEFFHALIERIDAAREQVMLETYIFCDDAAGRPVSDALIRAAQRGVRVRVITDGIGTARLPLFDTWGEAGVEHCIYNRFLFGRFGFSRTHRKLAVIDQTTAFCGGINIVDDYTQGSATLPFPRWDFAVEMAGPAVSDVRAAFELQWHRIQFGHKPYAQYAAGLHGGEAFPDMFRRWMRSHRWIKAGALRVVTEPSVAFVARDNVVNRRAIEKAYLAAIGQARQRILLANPYFMPGRKLRRALTGAARRGVDVQVLIGRKEFTALDTAVPFLYHSLLRAGVRVAEYDKTILHGKVAVIDDNWATVGSSNLDALSLMLNNEANVVLVRYDAVTNQLRDAIATAFAEGREIDAAHYAARPRIERLLNWLAYTTYRLVMKALTVGGYD

SEQ ID NO: 14623 - DNA, 1623 bp, Burkholderia cenocepacia AU 1054
  CDS (1)..(1623): transl_table=11
gtgctcacatccttgatccggcgcgcgccggccgcgctgtcgtggcgcgccgcatgccgccaggcccgcgcgctggtcgtctgcgcgctgctgccgctcgccgcatgcgcgacgcatccgcccgccacctcgctcgatcgccccgtctcccatgcgttgtcggcggaaaccgccacgccgctgcgcgatgcgctggccgcgccggaagccgcgcatcccgggcagtcgggcttccggctgctggccgacggcgccaccgcattgcagatgcgcatcgcgcttgcgcgtgcggcgacgaagacgctcgacatgcagtactacatcgcgaccgaggacacgaccggcaagctgctgctgggcgcggcgctgtacgcggccgatcgcggcgtgcgcgtgcggatgctggtcgacgacctgaacttccacgatatcgaccgcgtgatggccgcgctgaatacgcaccagaacatcgagatccgcgtgttcaacccgttcggcgcgtcgcagcgcggcatgatggagcgcacggccaacttcttcacgcggatcgacagcttcacgcgccggatgcacaacaaggcgatgatcgcggataaccagctcgcgatcgtcggcggccgcaatctcggcgacgaatacttcagtgcgagcccgacgctgcagttccgcgatctcgacgtgctggcggccggccccgtgacgagcgacatctcgaagagcttcgacgactactgggcgagcgcgagcagctacccgttgcgcgtgctgaatcatcagacgttcgatccgaaggatctcgacgcgatgcgcgacgagctgcgcgatcactggcgcaagaacgccgatccgtacaacgcgaaaccgctgaacgcgacgccgctcgcccggcagatcgcgcgcgacgaactcgaactcgtgtgggcaccggccgaattcaaggtcgatgcgccggacaaggtcgcgcggccgaccggcacgtacgtgagcccgccgatgcagcgcctggccgagctgacgcgcggcgcgcagaaggaattcctggcgttttcgccgtacttcgtgccgcacgacgccggcgtgaagatcctcggcgacacggtcgcgcgcggcgtgcgcgtcgcgatcgtgacgaactcgctcgcggcgaccgacgcggtcgcggtgcagtcgggctatgcgccgtatcgcgtgccgctgctgcagcgcggcgtcgagctgtacgaattcaagtcgcagccggaccagcagcccgcgcggctgttcggttcgcgctcgcgtgcgagcctgcatgcgaaggcgtacgtgatcgaccggcaaatcctcgtgatcggctcgctgaacctcgacccgcgctccgcgcacctgaacaccgagctcgcgctcgtgatccacagcccggtgctcgcgcagcaggccgcggcgatcttcgcgcgcgtgacgcagccggacgaaagctaccgcgtcacgctcgcgaagcggaccgacggcggtccgcccgcgctcgaatggacgggcaccgaaggcggtcagaccgccacctatcacgtcgacccgcatgcggggctgctgcgcaacgtgatgacgggcatcttcacgctgctgccggtcgacgaccagctgtaa

SEQ ID NO: 14624 - protein, 540 aa, Burkholderia cenocepacia AU 1054
MLTSLIRRAPAALSWRAACRQARALVVCALLPLAACATHPPATSLDRPVSHALSAETATPLRDALAAPEAAHPGQSGFRLLADGATALQMRIALARAATKTLDMQYYIATEDTTGKLLLGAALYAADRGVRVRMLVDDLNFHDIDRVMAALNTHQNIEIRVFNPFGASQRGMMERTANFFTRIDSFTRRMHNKAMIADNQLAIVGGRNLGDEYFSASPTLQFRDLDVLAAGPVTSDISKSFDDYWASASSYPLRVLNHQTFDPKDLDAMRDELRDHWRKNADPYNAKPLNATPLARQIARDELELVWAPAEFKVDAPDKVARPTGTYVSPPMQRLAELTRGAQKEFLAFSPYFVPHDAGVKILGDTVARGVRVAIVTNSLAATDAVAVQSGYAPYRVPLLQRGVELYEFKSQPDQQPARLFGSRSRASLHAKAYVIDRQILVIGSLNLDPRSAHLNTELALVIHSPVLAQQAAAIFARVTQPDESYRVTLAKRTDGGPPALEWTGTEGGQTATYHVDPHAGLLRNVMTGIFTLLPVDDQL

SEQ ID NO: 14625 - DNA, 1440 bp, Burkholderia cenocepacia AU 1054
  CDS (1)..(1440): transl_table=11
atgaccctcgactggctacatctcggcaccctgatcctgaccatccatgtgctcgggatcgtcgcggcgtgccacgcaatcatgaacacgcgcacgtcgcaaggcgcgatcgcgtgggccgtctcgctcacggccatgccgtacctgacgctcgttccatacctgttcctcggccgtagcaaattctccggctacgtcgacgcccggcgccacgagctggaaatgttgcgcacacacacaccgcgtgcgccgtggcgcgcgaccgatgcgaccgacgggccggccgccgacgcgctggggcaggctgccgtgctcgcgctcacgcggctcggcggcatgccgttcctcggcggcaattcggtacgcacgctggtcaacggcgacgcgacattctccgccatcctgtcggcgatcgacgacgcgcgcgactacgtgctcgtccagttcttcatcgtgcgcgacgatgcgctcggccggatgctgcgcgacgcgctgctcgcgcgcgcggccgccggcgtacgctgctgcctactgtacgacagcatcggcagcttcgacctgccgcacagctacgtcgacgcattgcgccgcggtggcgtcgaggtccatccgttcgcgaccaaccggaaattcgtcaatcgcttccagttgaacttccgcaaccatcgcaagatcgtcgtcgtcgacggcaatcgcgcgttcgtcggcggccacaacgtcggtgtcgaatatctcggcgcgaagccgcgcctgtcgccatggcgcgacacccacatcgagatccgcggccccgtggtggcgagcatccagtacgtgttcgccgaagactggcactgggcgacgcagaaactgccgcccatcgcgctgccgccgcccgcgcagcccggcgacggcatgcattgcctcgcggtgccgatggggccggccgacaagcaggaaaccggctcgctgttcttcgtcgaatcgatcaatgccgcccgcgagcgggtctggatcaccacgccgtacctcgttcccgacgaagccgtggtctccgcgctaaaactcgccgtgatgcgcggcgtcgacgtacgcatcctgatcccgagccggcgcgatcactacgtcgtgttcgaggcgtccaagctttatgcgcgcgacctcgtcgatgcgggcgtgaaagtgttccgctaccggcccggcttcctgcaccagaaggtcgtgctgatcgaccgcatcgcggcggcggtcggcagcgcgaatctcgataaccgttcgttccgcctcaatttcgaggtcatggtcatgaccgtcgatcgcgcgttcgccggcgaagtcgagacgatgctcgatgccgacttcgcgcaggcgtacgaggtcgatgcggacgaataccggcagtcgcctgcctggcggcgcatcgcgatgcacgtcgcgcggttgttcgcgccgatcctgtaa

SEQ ID NO: 14626 - protein, 479 aa, Burkholderia cenocepacia AU 1054
MTLDWLHLGTLILTIHVLGIVAACHAIMNTRTSQGAIAWAVSLTAMPYLTLVPYLFLGRSKFSGYVDARRHELEMLRTHTPRAPWRATDATDGPAADALGQAAVLALTRLGGMPFLGGNSVRTLVNGDATFSAILSAIDDARDYVLVQFFIVRDDALGRMLRDALLARAAAGVRCCLLYDSIGSFDLPHSYVDALRRGGVEVHPFATNRKFVNRFQLNFRNHRKIVVVDGNRAFVGGHNVGVEYLGAKPRLSPWRDTHIEIRGPVVASIQYVFAEDWHWATQKLPPIALPPPAQPGDGMHCLAVPMGPADKQETGSLFFVESINAARERVWITTPYLVPDEAVVSALKLAVMRGVDVRILIPSRRDHYVVFEASKLYARDLVDAGVKVFRYRPGFLHQKVVLIDRIAAAVGSANLDNRSFRLNFEVMVMTVDRAFAGEVETMLDADFAQAYEVDADEYRQSPAWRRIAMHVARLFAPIL

SEQ ID NO: 14627 - DNA, 1077 bp, Burkholderia cenocepacia HI2424
  CDS (1)..(1077): transl_table=11
atgaatgcggagacccgcaagcgcttcgcgcaattgcggcagatgttcctgcaggagcgcggctccgcgtcgcggctcgcgtttacggccggcaacacggtgcggctgtgcgaaaccggcggcgaattcttccacgcgctgatcgagcggatcgacgccgcccgcgagcaggtgatgctcgaaacctacatcttctgcgacgacgcggccggccgcccggtgtcggacgcgctgatccgcgcggcgcagcgcggcgtgcgcgtgcgggtgatcaccgacggcatcggcaccgcgcgcctgccgctgttcgacacatggggcgaagccggcgtcgagcactgcatctacaatcgcttcctgttcggccgcttcggcttctcgcgcacgcaccgcaagcttgcggtgatcgatcagacgaccgcgttctgcggcggcatcaacatcgtcgacgactacacgcagggcagcgcgacgctgccgtttccgcgctgggatttcgcggtcgagatggccgggcccgcggtgtccgacgtgcgcgccgcgttcgagctgcagtggcaccggatccagttcggccacaagccgtatgcgcagtacgcggccgggctgcacggcggcgaagcgttccccgacatgttccggcgctggatgcgcagccatcgatggatcaaggccggcgcgctgcgggtcgtgacggagccgagcgtcgcgttcgtcgcgcgcgacaacgtcgtgaaccgccgcgcgatcgagaaggcctatctcgcggcgatcggccaggcgcgccagcgcatcctgctcgcgaatccgtatttcatgccgggccgcaagctgcgccgcgcgctgacgggcgcggcacggcgcggcgtcgacgtgcaggtgctgatcggccgcaaggagttcacggcgctcgatacggccgtgccgttcctgtatcactcgctgttgcgcgcgggcgtgcgcgtggccgaatacgacaagacgatcctgcacggcaaggtcgccgtgatcgacgacaactgggcgacggtcggctcgtcgaatctggacgcgctgagccctgatgctgaacaatga

SEQ ID NO: 14628 - protein, 358 aa, Burkholderia cenocepacia HI2424
MNAETRKRFAQLRQMFLQERGSASRLAFTAGNTVRLCETGGEFFHALIERIDAAREQVMLETYIFCDDAAGRPVSDALIRAAQRGVRVRVITDGIGTARLPLFDTWGEAGVEHCIYNRFLFGRFGFSRTHRKLAVIDQTTAFCGGINIVDDYTQGSATLPFPRWDFAVEMAGPAVSDVRAAFELQWHRIQFGHKPYAQYAAGLHGGEAFPDMFRRWMRSHRWIKAGALRVVTEPSVAFVARDNVVNRRAIEKAYLAAIGQARQRILLANPYFMPGRKLRRALTGAARRGVDVQVLIGRKEFTALDTAVPFLYHSLLRAGVRVAEYDKTILHGKVAVIDDNWATVGSSNLDALSPDAEQ

SEQ ID NO: 14629 - DNA, 1551 bp, Burkholderia cenocepacia HI2424
  CDS (1)..(1551): transl_table=11
atgatcaggctgcgttcgtggggtgcgattctgtcgttgctgatgcttgccgcgtgcgcgagcctgccgccgcaggccgaccgcgcgccgacgcatgcattcaccgataccgacgatacgcgcctcggcgtggcatttcgccagcaggctgccgcccatccggggcaggacgcatttcatttgctgaccgatccggtcgacgcactggacgcgcgcgtgctgctcgccgaccgcgccgagcgttcgctggaccttcagtactacatctggcacgacgacctgaccggccacgaactggccgacgccgtcatgcgtgcggccgaccgcggcgtgcgcgtgcgcgcgctgctcgacgatctcggcaccaacgccgacgaccgcaagctgctcgagatcagcgcgcatccgaacatcgagatccggctgttcaatccggtggcgtcgcgccggttcaagaagctcggcaccctgttcgagttctcgcgcgtcaaccggcgcatgcacaacaaggcgatgatcgcggacaaccaggcggcgatcgtcggcgggcgcaatatcggcgacgaatacttcggcgcatcgtcgatgctggagtttggcgatctcgatgtcgtcgttcacgggccggtcgtgaaagacatctcgacggaattcgatacgttctggaattcgccgtacgcgtatccggtcgatacgctggtcgggcacgatgcggcgccgggcggcctcgagcgcgagcgagaacggttgcgcgactacctgagggccatggaggacaatccgtacgtgctcgaggcccgccagcggctcgaccggatcgtccacgggcagggcacggagctgtcgtgggggcatgcgacggtgctgtacgacgatccgtcgaagatcgcgcatccgccgaaggaccgcgacggccacctgatgccgcagttgcgtgcgcttgcgttgcagccccggcacgacctgctgatcgtgtcgccgtatttcgtgcccggcaaggaagtggtcgagcggctgcgcgcgctcacggcgcgcggcgtgcgcgtgacggtgctgaccaattcgctcgcatcgaccgatgtggcggccgtgcatgccggctaccgccgctatcgaagcgatctggtgaatgccggcgtgcggctttacgagcgccggccctcgggcgacaagagcatttcgaagcaggtgatcatcggctcgtcgcgcgcatcgctgcatgcgaagacctacgtattcgatcacacgagcatcttcatcgggtcgatgaatctcgatccgcgctcgctgaacctcaatacggagatcggcgtttactgcgagagcccggcgattgcatcgcaggtggccgacgatctggaggcgcggctcgaccagatcgcgtggcgtgtcgaggcgagaaccgatccggccggcagcgggcgcctcaagtgggttcagacggatgcagacgggaaggtcaccgagatcgatcacgaaccggaagtgtcggcgccgcggcggatggaagtgtggtttctcgggctgtttccgatcgaatcgcaactgtga

SEQ ID NO: 14630 - protein, 516 aa, Burkholderia cenocepacia HI2424
MIRLRSWGAILSLLMLAACASLPPQADRAPTHAFTDTDDTRLGVAFRQQAAAHPGQDAFHLLTDPVDALDARVLLADRAERSLDLQYYIWHDDLTGHELADAVMRAADRGVRVRALLDDLGTNADDRKLLEISAHPNIEIRLFNPVASRRFKKLGTLFEFSRVNRRMHNKAMIADNQAAIVGGRNIGDEYFGASSMLEFGDLDVVVHGPVVKDISTEFDTFWNSPYAYPVDTLVGHDAAPGGLERERERLRDYLRAMEDNPYVLEARQRLDRIVHGQGTELSWGHATVLYDDPSKIAHPPKDRDGHLMPQLRALALQPRHDLLIVSPYFVPGKEVVERLRALTARGVRVTVLTNSLASTDVAAVHAGYRRYRSDLVNAGVRLYERRPSGDKSISKQVIIGSSRASLHAKTYVFDHTSIFIGSMNLDPRSLNLNTEIGVYCESPAIASQVADDLEARLDQIAWRVEARTDPAGSGRLKWVQTDADGKVTEIDHEPEVSAPRRMEVWFLGLFPIESQL

SEQ ID NO: 14631 - DNA, 1425 bp, Chromohalobacter salexigens DSM 3043
  CDS (1)..(1425): transl_table=11
atgacatccggggtaattggcatcctgatcgttgtcatccatgtgctgggtgtgctgtccgcgctcatggcgctgatgtcgagccgtacctcgcagggcgccgtggcctggatcgtcacgttgctgacgttcccttatctggcggtgcccatctactggattttcggccgcccccgtttctacggttacacctctgcgcgcggtgagcgtgacagcgtattgcgtcaggtgctgttacgcttccggccgcgtctggagccttatttctcgcgtccctcgcatgatgtcgcccgcatccaggcagtggagcgtctggcgatgatgcccatgagtaccggcaatcgggcggaattgctcatcgacggtgaagcgaccttcaagagcctgttggcagggatcgattcggcgcgagagtacatcctcgtccagttcttcatcttccgcgccgatgaaatcggcacgctgttcaagcagcatttgatccagcaagccgagcgcggcgttcgcgtctgcctgctttacgatgaaatcggcagccgcagcctgtccggaggctacctgcgcgaactgtcggaagcgggcgtcgaggtcacggccttcaactcctcgcgtggatggcgtcatcgcttccagatcaatttccgcaaccaccgcaagatcctggtcgtcgatggacgggaaggatggacgggcggcttcaacgtggccgacgagtacctggggcgcgtcccgcgatacggaccctggcgcgatacgcatctcaagctgaccggcccgagcgtgatggggttgcaggaagccttctgggaggactggtactgggcgaccggcgacattctgtcgctggagtgggagccctcggtcacctgtaacgaatgccagcatgtggtcatcgtcccctcgggccccgcggaccgctgcgagacagccagcctgttgatccagcacgtgatccacggggcgcacgagcgcctttgggtgaccagcccctatttcgtccccgaccagggggtgcaggacgcactgaagctggcggcgttgcgcggcgtcgacgtgagagtgatgatcccggagcgtcccgatcatctgctggtctttctctcggccttttctttcttgccggagatgatccgtcatggcgtacggatctttcgctaccagccgggcttcttgcatcagaaagcggtgctggtcgacgaccataccgcgctgctgggatcggtcaatctcgacaatcgctcgtttcggctcaatttcgagatcactgcctatattcccgacgcggccttcgcacacgatgtcgagaccatgctgctgcacgatttcgaatcatgtcgcgaggtcacgctgcaggaactcgacgacaggcctgcatggcgcaagctggtctcgcgcgccgcctatttgctggctccgatacaatga

SEQ ID NO: 14632 - protein, 474 aa, Chromohalobacter salexigens DSM 3043
MTSGVIGILIVVIHVLGVLSALMALMSSRTSQGAVAWIVTLLTFPYLAVPIYWIFGRPRFYGYTSARGERDSVLRQVLLRFRPRLEPYFSRPSHDVARIQAVERLAMMPMSTGNRAELLIDGEATFKSLLAGIDSAREYILVQFFIFRADEIGTLFKQHLIQQAERGVRVCLLYDEIGSRSLSGGYLRELSEAGVEVTAFNSSRGWRHRFQINFRNHRKILVVDGREGWTGGFNVADEYLGRVPRYGPWRDTHLKLTGPSVMGLQEAFWEDWYWATGDILSLEWEPSVTCNECQHVVIVPSGPADRCETASLLIQHVIHGAHERLWVTSPYFVPDQGVQDALKLAALRGVDVRVMIPERPDHLLVFLSAFSFLPEMIRHGVRIFRYQPGFLHQKAVLVDDHTALLGSVNLDNRSFRLNFEITAYIPDAAFAHDVETMLLHDFESCREVTLQELDDRPAWRKLVSRAAYLLAPIQ

SEQ ID NO: 14633 - DNA, 1440 bp, Burkholderia pseudomallei 668
  CDS (1)..(1440)
atgaccctcgactggccccatctcggcaccctcatcggcctcgcgcacgtgctcggcgtgatcgcggcctgccatgcgatcctgaacacgcgcacgtcgcaaggcgcgatcgcgtgggcggtgtcgttgacggcgatgccgtacctgacgctgatcccgtatctgttcctcggccgcagcaagttctccggctatgtcgacgcgcgccgccacgagaccgcggcgctgcgcacccgcacgcatcccgcgccgtgggacgccgaaggctcgacgctcggcgcgccgaaggaagcgctcggcgccgcgcgcgtacgcgcgctcacgcgcctggtcggcatgccgttcgtcgccggcaacgcggtgcgcacgctcgtcaacggcgacgcgacgttctccgcgatcctcgccgcgatcgacgccgcgcgcagctacgtgatcgtccagttcttcatcgtccgcgacgacgcgctcggcgcgatgctgcgcgacacgctgatcgcgcgcgcgaaggcgggcgtgcgctgctatctgctgtacgacagcatcggcagcttcgatctgccgtcgagctacgtgcacgcgctgcgcgaaggcggcgtcgaagtgcatccgttcgcgaccaacaagcagttcgtcaaccgcttccagctcaatttccgcaatcaccggaagatcgtcgtcgtcgacggcgagcgcgcgttcgtcggcgggcacaacgtcggcgtcgaatatctcggcggcaacccgcgcctgtcgccgtggcgcgacacgcacatcgaagtgcgcggcccggcggccgcgaacatccagtacgtgttcgccgaggactggcactgggcaacccagtcgctgcccccgcaggcaccgccgcccgcgccggttcccgacgccgacatgcactgcctcgtcgtgccgatgggccccgccgacaagcaggagacgggctcgctcttcttcgcggaggcgatcaacgccgcgcgcgagcgcgtgtggatcacgacgccctacctcgtgcccgacgaagcggtgatttccgcgctgaagctcgcggtgatgcgcggcgtggacgtgcgggtgatgattccgagccggcgcgatcactatgtcgttttcgaagcgtcgaagctctatgcgcgcgatctcgtcgacgcgggcgtgcggatcttccgctaccgccccggcttcctgcaccagaaggtcgtgctgatcgaccgggcggccgccgccgtcggcagcgcgaacctcgacaaccgttcgttccggctgaatttcgagatcatggtgctgaccgtcgacgcgggcttcgccgccgaagtcgaggcgatgctcgcgcgcgacttcgatcaagcgttcgaggtcgacctgagcgagtaccggcgctcgcccgcgtggcggcgcgtggcgatgcacgtcgcacggctgttcgcgccgatcctctga

SEQ ID NO: 14634 - protein, 479 aa, Burkholderia pseudomallei 668
MTLDWPHLGTLIGLAHVLGVIAACHAILNTRTSQGAIAWAVSLTAMPYLTLIPYLFLGRSKFSGYVDARRHETAALRTRTHPAPWDAEGSTLGAPKEALGAARVRALTRLVGMPFVAGNAVRTLVNGDATFSAILAAIDAARSYVIVQFFIVRDDALGAMLRDTLIARAKAGVRCYLLYDSIGSFDLPSSYVHALREGGVEVHPFATNKQFVNRFQLNFRNHRKIVVVDGERAFVGGHNVGVEYLGGNPRLSPWRDTHIEVRGPAAANIQYVFAEDWHWATQSLPPQAPPPAPVPDADMHCLVVPMGPADKQETGSLFFAEAINAARERVWITTPYLVPDEAVISALKLAVMRGVDVRVMIPSRRDHYVVFEASKLYARDLVDAGVRIFRYRPGFLHQKVVLIDRAAAAVGSANLDNRSFRLNFEIMVLTVDAGFAAEVEAMLARDFDQAFEVDLSEYRRSPAWRRVAMHVARLFAPIL

SEQ ID NO: 14635 - DNA, 1719 bp, Polaromonas sp. JS666
  CDS (1)..(1719): transl_table=11
atgaggtgtttgttcaggccaacggccaggccgcaagaaccttccccgcgcgcttgcccctgctgcggctggaccgcatctatgtgcgcaatgccatcggccacgcgccggtcgtcctgcccagccggccctggtcgcacctgtcggaccacgcgcccctggcggcggagattgaattgtagatatggcccccacgcttgtcacttcgtgtactgcgctgccccccaagggggcgctgcgcctgcggcccggcaaagccggttccgcggcccctgctggaatagtcttggcccccacgcttgtcgcttcgtgtgccttcggcgttgcgctgcccctttcacgaggaaacggggcggaacttgctcggggcggcccttcgctgcgttcgatggcacctgtgggaggcttatgagcccctggatcagcggcaaccagttccgcctgcttgaaaacggcgaggagtatttcccgcgcgtctttgcctgcattgccgccgctgaacgcgaggtcgtgctggaaaccttcatcctgtttgacgacaaggtcggccaggcgctgcatgccgccctgctgcaggcggccacccgcggcgtgcagattgacatcaccgttgacggctatggctcacccgacctgtcgcacgaattcatttctgcactgacccaggccggggtgcgggttcatgtgtttgaccccggccccaggctctggggctggcgtaccaacctgtttcgccgcatgcaccgcaagatcgtcgtgattgatggccagcgcgcctttgtcggtggcctcaattactcggccgatcacctggccgatttcggccccgccgccaaacaggactatgcggtcgaaattgagggccccatcgtcaccttcatccacgcctttgtgcaccgggcactggcggcgggccagcgcaatgcgcaggacagtctggccggccggctgcgtgagcgcctgtccagccgcgcccattcgctggcccgaagctgggggctcgccccgccaagccaggccgcggccgctcccgccggtgaagcggcggccatcttcgtgacgcgcgacaaccgcgaacacaccaacgacatcgaacgccactaccgcatcgccatccgcgtggcccgccagcgcatcgtgatcgccaatgcctacttcttccccggctaccgcctgctcaaggagatgcgcaaggcggcgcggcgcggtgtcgacgtgcggctcatcctgcagggcgcgcccgacatgcccttcgtcaaaaccgccgccagcatgctctaccaccacctgctggaggccggcgtgcagatttacgagtattgcgagcggccgctgcacggcaaggtcgccgtggccgacgacgaatgggccaccgtgggctccagcaaccttgacccgctgagcctgtcgctgaacctggaggccaacgtggtcatccgcgaccgcgccttcaaccaggtgctcagcgcacggctggaccacctgatgcaacacggctgcaagcagatcggccccggcgacctgcaggagtcgagcggctggcgcatcgtgcgcagctttttcctgtttcacctgctgcgccgttacccggcctgggcgggctggctgcccgcgcatgcgccgcgcctcacgcctgcgctggcacccgccgacccgacggcgcacatcagcaccgcgcaggcagacgccgtccaccgcgcggacccgaccaccccgtga

SEQ ID NO: 14636 - protein, 572 aa, Polaromonas sp. JS666
MRCLFRPTARPQEPSPRACPCCGWTASMCAMPSATRRSSCPAGPGRTCRTTRPWRRRLNCRYGPHACHFVYCAAPQGGAAPAARQSRFRGPCWNSLGPHACRFVCLRRCAAPFTRKRGGTCSGRPFAAFDGTCGRLMSPWISGNQFRLLENGEEYFPRVFACIAAAEREVVLETFILFDDKVGQALHAALLQAATRGVQIDITVDGYGSPDLSHEFISALTQAGVRVHVFDPGPRLWGWRTNLFRRMHRKIVVIDGQRAFVGGLNYSADHLADFGPAAKQDYAVEIEGPIVTFIHAFVHRALAAGQRNAQDSLAGRLRERLSSRAHSLARSWGLAPPSQAAAAPAGEAAAIFVTRDNREHTNDIERHYRIAIRVARQRIVIANAYFFPGYRLLKEMRKAARRGVDVRLILQGAPDMPFVKTAASMLYHHLLEAGVQIYEYCERPLHGKVAVADDEWATVGSSNLDPLSLSLNLEANVVIRDRAFNQVLSARLDHLMQHGCKQIGPGDLQESSGWRIVRSFFLFHLLRRYPAWAGWLPAHAPRLTPALAPADPTAHISTAQADAVHRADPTTP

SEQ ID NO: 14637 - DNA, 1284 bp, Solibacter usitatus Ellin6076
  CDS (1)..(1284): transl_table=11
gtggtgcctctgtacctcctcataccggcctgcctcggaattgtggttcttcttattgttgttttcgatgcattttttgaaccctccctggactaccgtctcgccgactctgaccctctgccgctggactcgaaggaattcattcgcatcctcggcgttctggctgacaccgagtcgcatacggatacacgcgtcgaggtcctcaccaatggcccgtgcttctacccggcacaattggccgccattcgtgctgcccgccactccgtttgtctcgaggcttacatctttcagaagggcgtgatcgggaatgattatatccaggccctcacggaacgcgcgcgcgccggcgtcgaagtgcgcgttgtgctcgatgccatcggcagcatgagcacctggcgaagtaccttccgcgacctgattgcggccggcggccgcgtgcactggtacattccctttcgctggtataacctcccgcgattgaacaatcgaacccaccgcgaactgctcatcgtggacggtgaaatcggtttccttggcggcgccggcgtgtccgaccagtggtttcactcccaaggacggaagcacccgtgctggcgcgacacaatgttccgcgtggaaggccgcgccgtcgccgggatggtggctaccttcgccgagaactggctggaatcctccggcgagttgctctgcgggcctaagtatttccccgagtgcccggaccagggcggcatcgccgccatgatcatcaacagtacgccttccaacggacgcggcacccgcgcgcgcatgctgtatcagatcctcatggccgccgcctgccgcagcattcacatcaccacaccctacttcctgccggatcaaggcgtgcgccgcgaactggttcgcgctatgcgggagcgcggcgtcgaagtgaaaatcgtggtgccgggcaagcatagcgatcacctcctcacccgccgctccagccgccggctttacggcgacctgctgcgcaacggagcacagatcttcgaataccagcccaccatgatccacgctaaaatcatggtcgtcgacggcatgtggagcgttgttggttccaccaacttcgatcaccgctccttcggcatcaacgatgaagtgaatctcgcagccttagacgaatcgctcgccgcgcgcatcgaacaggatttccagcgcgatgtcgcggcatcgcaccgggtaacctttgacgaatggagcagtcgctcgcccttggagcgcttcaacgaatgggtgggatggattctcgaacgtcaggaatag

SEQ ID NO: 14638 - protein, 427 aa, Solibacter usitatus Ellin6076
MVPLYLLIPACLGIVVLLIVVFDAFFEPSLDYRLADSDPLPLDSKEFIRILGVLADTESHTDTRVEVLTNGPCFYPAQLAAIRAARHSVCLEAYIFQKGVIGNDYIQALTERARAGVEVRVVLDAIGSMSTWRSTFRDLIAAGGRVHWYIPFRWYNLPRLNNRTHRELLIVDGEIGFLGGAGVSDQWFHSQGRKHPCWRDTMFRVEGRAVAGMVATFAENWLESSGELLCGPKYFPECPDQGGIAAMIINSTPSNGRGTRARMLYQILMAAACRSIHITTPYFLPDQGVRRELVRAMRERGVEVKIVVPGKHSDHLLTRRSSRRLYGDLLRNGAQIFEYQPTMIHAKIMVVDGMWSVVGSTNFDHRSFGINDEVNLAALDESLAARIEQDFQRDVAASHRVTFDEWSSRSPLERFNEWVGWILERQE

SEQ ID NO: 14639 - DNA, 1191 bp, Geobacter metallireducens GS-15
  CDS (1)..(1191): transl_table=11
atgtccatcgtgagacgaaaaaagataatcggtacccaccgtgccccccgtttcctccgcatcttccggagaaatgccgaggcgtcccattcccgggggaacagggtgaagctctacgattccggtgcggagttcttcccggccatgctgtcggctctggccgaggcccgtcaccacatccacgccgagttctacatcgtgcgcgacgacgccaccggatccgcctttgcggaggcgcttctggccgccgcttcccgcagggtcgacgtttccctcatctacgattacatcggctgtttcgatactccctcctcctatttccggcgcctggagcaggggggagtccggtgcctcgccttcaatcctcccccattccggcggggactcgcctggttcgacaagcgggaccaccggaagatggcggtcatcgacggagaaaccgccttcaccggcggaatcaacatcggcgacgagtactcggggttcgggaggggaaccgaccgctggcgggacgtgggggtgagaatcgacgggcccgccgtcacggacctcgtgcggctcttccgcgagttctggctggaggaaaaggggagcccttctccggcctggtttgcggagcatattcccgtggcaggcatgggagatgccgacgtgatgatcgtgagcgacggcccccaccacgcccgttccttcattcgcaacgccttccgcatcgccatggccggagcgggagaatcgatccggatcatgaacccctacttcgtgccgggtccgcgggtggtccgctctctgctgcgggccgtgcggcgtggggtaaacgttcaattgatcctccccgccaagagtgacgtccccatcgtccggctcgtggggcgcggttactacgcccccctccttcgggccggcgtcgagatctacgagcgccagggggagtttctccatgccaaggtcatgctcatcgacgacacctggggggtggtcggctcggcaaatctcgaccagcgcagcttccatcgcaactacgaagtcaacaccattgttgccagccgcgagttcggccggcagatggcggagatgttcgccgacgacctcagggggtcccgccgtatcgttctagaggagcatgagcgccggggctcgctggtgcggcttctggagcggatttgcaattcggtgagctggtttctgtga

SEQ ID NO: 14640 - protein, 396 aa, Geobacter metallireducens GS-15
MSIVRRKKIIGTHRAPRFLRIFRRNAEASHSRGNRVKLYDSGAEFFPAMLSALAEARHHIHAEFYIVRDDATGSAFAEALLAAASRRVDVSLIYDYIGCFDTPSSYFRRLEQGGVRCLAFNPPPFRRGLAWFDKRDHRKMAVIDGETAFTGGINIGDEYSGFGRGTDRWRDVGVRIDGPAVTDLVRLFREFWLEEKGSPSPAWFAEHIPVAGMGDADVMIVSDGPHHARSFIRNAFRIAMAGAGESIRIMNPYFVPGPRVVRSLLRAVRRGVNVQLILPAKSDVPIVRLVGRGYYAPLLRAGVEIYERQGEFLHAKVMLIDDTWGVVGSANLDQRSFHRNYEVNTIVASREFGRQMAEMFADDLRGSRRIVLEEHERRGSLVRLLERICNSVSWFL

SEQ ID NO: 14641 - DNA, 1509 bp, Geobacter metallireducens GS-15
  CDS (1)..(1509): transl_table=11
atgatccgacctctgctccttatcaccctgtcactccttctcatactcaccgccgttcccggcgcacgcctgtcagccgccgaaaccaccccggtaacgcttcccctggcccggagcatccagcccctgctgtctgcccaccccggcaagaccggcctctatgtcttggaaaagggggaagagtcgctcctggcccgggcgtggctcgcggaccacgccacgaagagcatcgacgtccagtatttcatctggagcagcgacaacatcggcatcctggcctcggaggcgttgctgcgggcggcggagcgggggatacgggtgcgggtgctggtggatgacctcctcatcgacgcgccgccggaatcgctcctggccctggcccgtcaccccaacatcgacatccggatctacaacccgaagatgacggtgggaacctcgaaggtgaagcggttcgccaacgttgtgaccggcttccgttccgtgaaccagcggatgcacgacaagaccgccctcttcgacggcatggtggggatcaccggcggccgcaacatggccgacgagtactacgatttcgaccaggagtacaccttccgggaccgggacatgctgatgctcggcccgactgtggccgaggcggaggcgagcttcgcccgtttctgggagagccccctggctgtgccggtggagaagctgctgaaaaagcccatgaagaagatgacgccggagcggaccggccaggtctatgccggcctccacgcctatgccgggaagccggaaaacttcgccccggaggtccgccaggcgctccagaacctcccccgcaggttcgacgggctgctgcgggagatggtctgggacgaggcccgcttcatctcggacctgccgggaaagaacagcggccgggagggactggggggcggcggccggagcacggcggccctggtggacgcggtgagccgggccaagcggcgggtcaccatccagtccccctacctggtcatgcccgaggggggcgtggagctgttccggaagctgatccggcgcggggtggaggtgcggatcgtcaccaactccctggccgccaccgacaacctccaggccttcagcggctaccggaagcagcgcaaccggctcctgaaggcggggatcaccatccgggaattccgcccggacccggccgtgcggcaggagctgatcgaccgctacccgaagctgaaggagaagccccccaccttcgccctccatgcaaagaccatggtgatcgacggcgtgactctgttcgtcggcaccttcaacctggacccccgttccgccaacctgaacaccgaggtgggggtgatggtccgcaaccccgccctggcccgccaggtggaggagcggatcgagcgggacatgcgcccggagaacagctggaatccggccacggacaacccggaccgccgcgcctcggcggccaagcggaacaggctgcgcctctggaagtcgctgccgctgacccccatcctctga

SEQ ID NO: 14642 - protein, 502 aa, Geobacter metallireducens GS-15
MIRPLLLITLSLLLILTAVPGARLSAAETTPVTLPLARSIQPLLSAHPGKTGLYVLEKGEESLLARAWLADHATKSIDVQYFIWSSDNIGILASEALLRAAERGIRVRVLVDDLLIDAPPESLLALARHPNIDIRIYNPKMTVGTSKVKRFANVVTGFRSVNQRMHDKTALFDGMVGITGGRNMADEYYDFDQEYTFRDRDMLMLGPTVAEAEASFARFWESPLAVPVEKLLKKPMKKMTPERTGQVYAGLHAYAGKPENFAPEVRQALQNLPRRFDGLLREMVWDEARFISDLPGKNSGREGLGGGGRSTAALVDAVSRAKRRVTIQSPYLVMPEGGVELFRKLIRRGVEVRIVTNSLAATDNLQAFSGYRKQRNRLLKAGITIREFRPDPAVRQELIDRYPKLKEKPPTFALHAKTMVIDGVTLFVGTFNLDPRSANLNTEVGVMVRNPALARQVEERIERDMRPENSWNPATDNPDRRASAAKRNRLRLWKSLPLTPIL

SEQ ID NO: 14643 - DNA, 1524 bp, Exiguobacterium sp. 255-15
  CDS (1)..(1524): transl_table=11
gtgcgcaatcggattttacagttcgcgctcgtgtttttagtcgcaggcggaatcatttggggactataccaattgggctacctgttttatgttttgacgatttccgcgaccgtcgtacccttggccgtcatcatgatcatcttcatcgaaaaccggacggcggaatcgacgattgcctggtttttagttttgatcttcttaccgattctcggtgtcatcatctggatgatgttcgggcgcaatccgcgccgccgtcgccggaaccggcggtcgcacgatgaacggatgttgctgaaacaggcaatccgtcccgtccggtcgctcgcggtcagtgagttgccgccgaaccacctgaagcttgccaatacgatccgcaactttggtggcggtggggtcgacgtccatacagccagtcaaatcctgacgaacggcaacgagacgttcccggaaattctccggatgatccgctccgccaagcatcatgttcacatccagtattacatttaccggaacgacgagaccgggcaggcaatccgcgaagcattgattgaccggttgaatgacggggtcgaagtccggttcatgtttgacggtcttggcagttacatgctcggcgaaggatttttgaaaccgctccgggaagccggggcaaagattgccgcctatgatcccatctccagtccgttgttcatctttacggcgaacttccgcaatcaccggaaaatcgttgtcgtcgatggcaaaatcggttttaccggtggactgaacgtcggcgacgagtatgacggtaaaagtaagaagttcggcttttggcgcgatacccaccttcggctcgaaggacgggccgtcaaggaactgcaggcaacgttcctcgacgattggctctatgcccatttagaaggcagtgatacgtgggagacgtttgccggcgaaggggcaatcgatcaatacttcccgaaacacgatgtcgagaccgacggcgcggtccagctcgtgacgagtggaccgacgtcaaaagatccggcgatccggaacgcgttgattgccgccatcatctcggcccagcgctcgatctggatttcgacgccgtatctgattccggataacgagacgatgacactgctccgtcttgcggcccgtgccggactggacgtccggattctgacaccgggtaagggagacagttttacctcctactatggaacccggtcctatttcggacctttgttaaaagatggagtcaaaatttatacgtataaccggcacttcatccatgccaaactgttcctcgtcgatggaaagattgccgtcgtcggaacggcgaacatggatatccggagcttcgttttgaactacgaactgatggcctttatgtatgattccgagagtgcggcccggctcgaacgcgatttcatcgatgatttcgacgtctcgattcagttgtcctcggcggattatgtcaaacggccgatgcggttccggatttttgaatcgttctcccgtttgatttcaccattgttatga

SEQ ID NO: 14644 - protein, 507 aa, Exiguobacterium sp. 255-15
MRNRILQFALVFLVAGGIIWGLYQLGYLFYVLTISATVVPLAVIMIIFIENRTAESTIAWFLVLIFLPILGVIIWMMFGRNPRRRRRNRRSHDERMLLKQAIRPVRSLAVSELPPNHLKLANTIRNFGGGGVDVHTASQILTNGNETFPEILRMIRSAKHHVHIQYYIYRNDETGQAIREALIDRLNDGVEVRFMFDGLGSYMLGEGFLKPLREAGAKIAAYDPISSPLFIFTANFRNHRKIVVVDGKIGFTGGLNVGDEYDGKSKKFGFWRDTHLRLEGRAVKELQATFLDDWLYAHLEGSDTWETFAGEGAIDQYFPKHDVETDGAVQLVTSGPTSKDPAIRNALIAAIISAQRSIWISTPYLIPDNETMTLLRLAARAGLDVRILTPGKGDSFTSYYGTRSYFGPLLKDGVKIYTYNRHFIHAKLFLVDGKIAVVGTANMDIRSFVLNYELMAFMYDSESAARLERDFIDDFDVSIQLSSADYVKRPMRFRIFESFSRLISPLL

SEQ ID NO: 14645 - DNA, 1440 bp, Exiguobacterium sp. 255-15
  CDS (1)..(1440): transl_table=11
atggactataccctaatcctgaagattttgctctatgtcgtgttgattgccaactttgcagcagcaatcgccatcctgttttttgagcggcgcgatgtcagtgcaacctgggcctggctgatgatcctcttgttcctgccggtcatcggctttttgatttacttgttgttcggccgctccttgaaacaggattcgttttatcatgtgccggaagatcgccggttggcgcgcgaacaagaccttaccgaacaggcagctgaagcgattccccccaatacaccactttatccgtaccggaagctgattcaggcgaatcgttcatcaggtgccctgttgacggaggcgacggtcgtccggagcctgttcgacggtcatcagaaattcgatacgttacttgctgacattaaaagcgcgcaagtcgaaatcaatatccagtattttatcttaaaacgtgatccgctcggcgaccgtctgctgaacgctttgttcgaacaggccaagcgcggcgtcaaagtccggattctgtatgacgccgtcggttcgtggaaactgaaagccaaggatttcgcgtcgttcaaacaggacggcggcgaggtccgctcgttcttctcgtcgccgctcggtatcttcaacctgcgcatcaacaaccggaatcaccggaaactctgtacgatcgaccggcaaatcggctatatcggcggctttaacgtcggatcggaatacctcggggaagacgaacagttcggctactggcgggatacccatctgcgggttcttggtccggtcgtcgaagaactcgaatttcatttcgaacaggactgggacgctgcgagcaacgagcggaccgactggtcgaccgcaccgattccgccgcatgctgcagcgacggatcatgtaccggttcaaatcgtgacgtccggtccgacatccgagacggagtatttgaaaaatatgctgattcagatgattcattctgccgaaaaatcggtttacatccagtcgccctacttcattccggatgccagtttcatggacgcctgccagattgccctggcttccggcgtttcgctcaaaatcatgattccgaatcaaccggaccatccctttgtctactgggcgacgtacgcggcagtcggcgaattgattcaacacggggccgaagtctacacgtacgaaatcggcttcatgcatgcgaagacgattgtcgtcgacgggaaaatcgcttcggtcgggacgacgaatatcgatgcccggagcttccggctgaactttgaaatgaatgcgattttgtacgatgcggcgattgcagaagaactggagctgctcttcttatcggacgtcgccgacagtgccttgctgacacgagaaaaatacgccgcccgtccgcggatgatccgctttaaagaaagtatctcgcgtctgttgtcaccgattttgtga

SEQ ID NO: 14646 - protein, 479 aa, Exiguobacterium sp. 255-15
MDYTLILKILLYVVLIANFAAAIAILFFERRDVSATWAWLMILLFLPVIGFLIYLLFGRSLKQDSFYHVPEDRRLAREQDLTEQAAEAIPPNTPLYPYRKLIQANRSSGALLTEATVVRSLFDGHQKFDTLLADIKSAQVEINIQYFILKRDPLGDRLLNALFEQAKRGVKVRILYDAVGSWKLKAKDFASFKQDGGEVRSFFSSPLGIFNLRINNRNHRKLCTIDRQIGYIGGFNVGSEYLGEDEQFGYWRDTHLRVLGPVVEELEFHFEQDWDAASNERTDWSTAPIPPHAAATDHVPVQIVTSGPTSETEYLKNMLIQMIHSAEKSVYIQSPYFIPDASFMDACQIALASGVSLKIMIPNQPDHPFVYWATYAAVGELIQHGAEVYTYEIGFMHAKTIVVDGKIASVGTTNIDARSFRLNFEMNAILYDAAIAEELELLFLSDVADSALLTREKYAARPRMIRFKESISRLLSPIL

SEQ ID NO: 14647 - DNA, 1512 bp, Exiguobacterium sp. 255-15
  CDS (1)..(1512): transl_table=11
atgttaaggcgtgtccaattacttatgacgctactgttaaccgtcagtctgatcggctttctttcctattactggagtgtgtacatggtaggatggctctcaatcgtcatcattcttgtcgtactgagtgtttttgtcatcatcctacttgagaatcggaacccggaacgaacgcttgtctgggcgcttgtcatgatggcgcttcccgttgtcggtgttttcgtatatttcacctttggtcaaaattatagacgaaaaaaaatgtttcgtctgaaagcgatgctcgatgaagagtcttacattaaatatcgtacccagtttgatcatggaatacacaatcaagtgttccaacatggacattatacgaaagttgttaaactcatcgactccatcagtcgcctgccgatttcgtataatagtcacacgaaagtattaacgaatggacaagaaaaatttccgctgttattagccgagattcgtcaagcggaacaccacatccatttggaatactatatcgtccgcgatgacgaactggcgctagagttgcaggaagcattaattgaacgggcgaaagccggagtggagatccgtttcttgtatgatgctgtcggttgtttctcgacggataagtcttactttaaaaagatggagctggcgggaatcgaagtccgtccatttttcccggtcgttctgcctttcatctcgagtaaatccaattatcggaatcaccggaaaatcgttgttattgacggtactgtggctttcacgggtggaattaacgttggggacgagtacatgggaaaagataagatgtttggattttggcgggacacgcatttgctcgtcaggggagaggccgtctcggagcttcagttgatttttcttcaggattggtactatatgacgggggaacggttgtttacaccgtattatatgaaaccgctcgaagtcatggaggaatcgacaggaggcgtccaaatcattgcgagcgggccggatgaaccccatgaaacgatgaagtctctctacttcggtttaattacggaagcccggagttctgtttacattgcttctccctatttgattccggacgaggatctgatgactgctttaaagacggcagcgatgtcgggaatcgatgtccggatcttactgccgagttttccggatcataaagtcgttttttatgccagtcgctcttattttgatgacttgttattagcgggtgtaaagatttacgaatacaacaaaggattcatgcactcaaaagtcatcgtggtcgatgatgcgattgcgacgattggcacggcgaatatggacttaagaagttttcacttgaactttgaagtaaatgcctttttgtacgggacaaattccgtccacgaattaacacgtgacttttatgaagacttttccaattcttcacaagttgagcgtcaagtctttattcaaaggagtttcggtcaacgtttgatcgagtccatttcgcggttattttcaccgttactctaa

SEQ ID NO: 14648 - protein, 503 aa, Exiguobacterium sp. 255-15
MLRRVQLLMTLLLTVSLIGFLSYYWSVYMVGWLSIVIILVVLSVFVIILLENRNPERTLVWALVMMALPVVGVFVYFTFGQNYRRKKMFRLKAMLDEESYIKYRTQFDHGIHNQVFQHGHYTKVVKLIDSISRLPISYNSHTKVLTNGQEKFPLLLAEIRQAEHHIHLEYYIVRDDELALELQEALIERAKAGVEIRFLYDAVGCFSTDKSYFKKMELAGIEVRPFFPVVLPFISSKSNYRNHRKIVVIDGTVAFTGGINVGDEYMGKDKMFGFWRDTHLLVRGEAVSELQLIFLQDWYYMTGERLFTPYYMKPLEVMEESTGGVQIIASGPDEPHETMKSLYFGLITEARSSVYIASPYLIPDEDLMTALKTAAMSGIDVRILLPSFPDHKVVFYASRSYFDDLLLAGVKIYEYNKGFMHSKVIVVDDAIATIGTANMDLRSFHLNFEVNAFLYGTNSVHELTRDFYEDFSNSSQVERQVFIQRSFGQRLIESISRLFSPLL

SEQ ID NO: 14649 - DNA, 1467 bp, Desulfuromonas acetoxidans DSM 684
  CDS (1)..(1467): transl_table=11
atgcagagatttcttttttttctttttttcctttttgttgctgcttccactgtatccgccaatgaccttcaagacctgctgccaccattactgtccgcccatcccaaccagagcggtgcttatgtcctcgacaaaggggaagagtccctgctggcgcgcgcctggctggtggatcatgcggcggaaaccatcgacgtgcagtatttcatctggagcgatgacaatatcggcaccctggccaccgagagcctgttgcgtgcggcgcagcgtggtgtgaaggtgcgggtgattgttgatgatcttttgatccaagccccagaggattttctgctggcgctggccgcgcatcccaatatttccatccgggtgtataatccgcagcacaaaaccggcgtttccactcagcagcggctgtggaatattttcagcaatttccgtgcggccaatcagcgcatgcatgataagacatttattgtcgatcagcaggtagccatcaccggcgggcgcaacatggctgatgaatattatgattttgaccagagctacaattttcgtgatcgcgacattctgctgcttggcccggtggcacagaccatgaccggcagttttgacgcgttctggaacagtgatctggccaagccgattgaaagcttgcttaatgccaagcttgccccggatgcacaacggcgagaagccatctatgccgatctgcatgcttacgcgcaaaacccggaaaattttgccccggaagtgaaacaggcgttggacgatctgccactcaagtttcgcgggttgatggataatctggcgtggggcccggtgtgctttgtcagtgatgaaccgggcaaaaatcccggagacaacgggctgggcggtggtggccgtaccaccagtcagctggccgcagctctggcgcgggcacagaaaagcgtgactatccagtcgccctatctggtgatgccggacggcggtctggaattgtttgccgggctgatcaaaaaaggggtcaaggtgcgcatcagtaccaattcgctgttgtccacggataacctgcaggcgttcagcggttacagcaatcaacgtgaagatcttcttgatgcgggtattgaggtgtttgagtttcagccctatccacgcattcaacagcagttgatggagcgctatccgaagctaaaagagaagtcgccggtgtttgccctgcacgccaaaaccctggtgatcgacggcaaacagttgtttgtcggcacctttaatctcgatccgcgttccgccaatctcaacaccgaagtgggcgtgattattgataatccgcatttggctcagcaggtggagctggagatcgagcgtgacatggcccccggcaacagctggaacagcgccgaggataacccggaccgcttcgcgccctggggtaaacggctgaaaatgacgttctggaagtggatgccgatggaagatattctgtga

SEQ ID NO: 14650 - protein, 488 aa, Desulfuromonas acetoxidans DSM 684
MQRFLFFLFFLFVAASTVSANDLQDLLPPLLSAHPNQSGAYVLDKGEESLLARAWLVDHAAETIDVQYFIWSDDNIGTLATESLLRAAQRGVKVRVIVDDLLIQAPEDFLLALAAHPNISIRVYNPQHKTGVSTQQRLWNIFSNFRAANQRMHDKTFIVDQQVAITGGRNMADEYYDFDQSYNFRDRDILLLGPVAQTMTGSFDAFWNSDLAKPIESLLNAKLAPDAQRREAIYADLHAYAQNPENFAPEVKQALDDLPLKFRGLMDNLAWGPVCFVSDEPGKNPGDNGLGGGGRTTSQLAAALARAQKSVTIQSPYLVMPDGGLELFAGLIKKGVKVRISTNSLLSTDNLQAFSGYSNQREDLLDAGIEVFEFQPYPRIQQQLMERYPKLKEKSPVFALHAKTLVIDGKQLFVGTFNLDPRSANLNTEVGVIIDNPHLAQQVELEIERDMAPGNSWNSAEDNPDRFAPWGKRLKMTFWKWMPMEDIL

SEQ ID NO: 14651 - DNA, 1443 bp, Desulfuromonas acetoxidans DSM 684
  CDS (1)..(1443): transl_table=11
atgaacggattttctgtgggcatcgtgatcgtgaacctgctgtcattcgtggttgcggttcacgccttgctcaacaagcgcgatccgcgtgcggcgctggcctggatcattgtctgtctggcgctgcccggagtcggtgtggtgctctactggctgatgggggtcaatcgcatccgcacgcgggcattgcgctggcagcggcgtggcgaagggatctatgttgccgaagaggaagcgccgtgcgagaagagtgttgtgctgcgcaccccgtttcatacccagaactatcagttgcaacgccacctggccgatgctgtaacgcggcgcccgcttgttggcggcaaccgggtggtgccgctatacaacggcgagcaggcctacccggttatgctcaaatcgattcgtgccgccgagcgcagtatcgatctgtccagctatatttttgacacccaattttgtgggcgtgagtttgtccaggcgctgattgaacgagcggaagcgggcgttgccgtgcgggtcctggtggatggcctcggcgagtgttattcctggccacgggtgcatactctgtttgacaagaccccggtgcaggtggtgcgctttctgccgttgtcactgtttcgacgcggaatgcaccttaatttgcgcaatcaccgtaaattgctgattgttgatggcagggtcggctttgccggcggcatgaacatcagccaacggcatctggtacagaaaaaacgccatgatgtacgaccacgtgagcgggttgtcgatattcactttaaagtggaaggcccggtggttcggcagatgctggaagtgtttcaggaggactggcagtttgccggtggcaggccgtttgagctcgaccccactccaccctgtcttggcggcccggacagcttgtgtcgagggatcagcgccggaccgaacgaagactatgaaaagctggtgtggattgttgttggtgcgctaaattgtgcgcgcaagcgggtttcgatcatgacgccctactttattcccgatcgttccatggtcaccgccatgaacagcgccgccttgcgtggcgtcaatgtcgagattgtcctgccggtaagaaataacctgccttatgtccactgggcgagtcgcggtgccttctgggaactgctcgaatacggcgttaagatttattaccagccacctccatttgcccacagtaaattgctgttgatggacgatcactatgccctgatcggctcagccaatatggatccgcgcagtcagcgcctcaattttgaattcaaccttgaagtgtacgataaaagtttcaatgccgagatgcgtcaccatttcgacaccactgtggccaaatcccaagccatcagcctcgacgagatggatgggcgtccggtctggcaaaaaatgcgcgacaactttttccgcctgtttactccgttcctttag

SEQ ID NO: 14652 - protein, 480 aa, Desulfuromonas acetoxidans DSM 684
MNGFSVGIVIVNLLSFVVAVHALLNKRDPRAALAWIIVCLALPGVGVVLYWLMGVNRIRTRALRWQRRGEGIYVAEEEAPCEKSVVLRTPFHTQNYQLQRHLADAVTRRPLVGGNRVVPLYNGEQAYPVMLKSIRAAERSIDLSSYIFDTQFCGREFVQALIERAEAGVAVRVLVDGLGECYSWPRVHTLFDKTPVQVVRFLPLSLFRRGMHLNLRNHRKLLIVDGRVGFAGGMNISQRHLVQKKRHDVRPRERVVDIHFKVEGPVVRQMLEVFQEDWQFAGGRPFELDPTPPCLGGPDSLCRGISAGPNEDYEKLVWIVVGALNCARKRVSIMTPYFIPDRSMVTAMNSAALRGVNVEIVLPVRNNLPYVHWASRGAFWELLEYGVKIYYQPPPFAHSKLLLMDDHYALIGSANMDPRSQRLNFEFNLEVYDKSFNAEMRHHFDTTVAKSQAISLDEMDGRPVWQKMRDNFFRLFTPFL

SEQ ID NO: 14653 - DNA, 1437 bp, Desulfitobacterium hafniense DCB-2
  CDS (1)..(1437): transl_table=11
gtgattaaattgataaaacttatgatcggttcagccctgttagccctttcactggcgctgcttataatttgcttagaaaagaagaatccggaaaagaccgccgcctggctgtcttttctggccctcaatcctctgctggggatgatgatctacctggttttcggctgcaccccgcttaaaaaaagcttattccgatccaaacatatgcccggggagcaattgcccgctttagcgcatcagcaaaagcaggccttctctgaaaatgagatctatatccaggagtccatagacgctaaaggtctgtcaaggcttttattaggaaaggcttttgcgcctttatcccggaataattcccttacccttctccacaacggagacgcaaaatttgcggctctgcttgaggatttagaaaaagctcaggatcatattcatatggaatattatatttttcatgacgatgccattggcaggagggttcagcagatcctgatccgcaaagccggtgagggtataaagatacgtttgatgtttgacgggctgggcagccgcagcctcgctaagaattttctcagggagctgagagctgccggaatagagctgcagtggtttttgcccctgcgttttccccgggccttcttgaccctgaactatcgcaatcatcgcaaactggtggttattgacggcaggattggctatctgggcggcatcaatattggggatgaatacttgtcccgaagcgctaagtacggattttggcgggacacccatctgcgcctggaagggaccagtgtgcacaccattcaggagacttttttcaatgattggtattatctcacaggggaaatccatagggaccctcgttattttcccaaggagcgggaggatggggaaatgctggtccaaattattggcgggggaccggattcccactatgaatccatcaaggaactcttcttcacgatgttaagcacagcgcaaaaggagatcgtggtgacgaccccttactttataccggatgaaagtatgatcatggccctgaaaaccgcggcctccagaggggtagccgtcaaaatcatccttcagggaaaacctgatcataagcttccttatctggcctcatcctcctatttccgcgatttgatcccgtcgggtgtggagatctatcgctaccaaaaggggatcctgcacagcaaggtattaacagttgatcaagagataggtgtggtgggctccgccaattttgacatacggagttttcaaatagacttcgaactaagtgcggtgatcttcggctctgattttgcagagaagctggttcgcgaccaagagcaggatcttcaggacagcctgcagataacccagcaggatctgcaaagcagaactccgctgttgtctttgcaaatcgctttagcccgtcttctttcacctttgctctag

SEQ ID NO: 14654 - protein, 478 aa, Desulfitobacterium hafniense DCB-2
MIKLIKLMIGSALLALSLALLIICLEKKNPEKTAAWLSFLALNPLLGMMIYLVFGCTPLKKSLFRSKHMPGEQLPALAHQQKQAFSENEIYIQESIDAKGLSRLLLGKAFAPLSRNNSLTLLHNGDAKFAALLEDLEKAQDHIHMEYYIFHDDAIGRRVQQILIRKAGEGIKIRLMFDGLGSRSLAKNFLRELRAAGIELQWFLPLRFPRAFLTLNYRNHRKLVVIDGRIGYLGGINIGDEYLSRSAKYGFWRDTHLRLEGTSVHTIQETFFNDWYYLTGEIHRDPRYFPKEREDGEMLVQIIGGGPDSHYESIKELFFTMLSTAQKEIVVTTPYFIPDESMIMALKTAASRGVAVKIILQGKPDHKLPYLASSSYFRDLIPSGVEIYRYQKGILHSKVLTVDQEIGVVGSANFDIRSFQIDFELSAVIFGSDFAEKLVRDQEQDLQDSLQITQQDLQSRTPLLSLQIALARLLSPLL

SEQ ID NO: 14655 - DNA, 1608 bp, Methylobacillus flagellatus KT
  CDS (1)..(1608): transl_table=11
atgatggctttatttatcaggtgggtgcacaggaggggctctctacctattggagtccgctggttacatcgcacgctgatgttgatgctggttgcgcctctgtttgcatgtgggctgccgcatgttcgggacagcgacaagccttcttctgcagcatttccgatcgatgaggttgcggagactaagttgggccagaccatgcagccgctcaaggctgcccatcctggcgagtctggcattatgccgttactggatgcgtatagcgcttttgcagctcggatgttgttgacgcattccgcagaaaaaagcctggatgtccaatattacatctggcgcaatgacaataccggcatcctgttcctcgaagcattacgcaaagcggcggagcgtggtgtcagggtacgcctgctgctggacgataatggcatcagggggcgcgaaatggacgccagattggccgcgctcaacaagcatcccaatatcgaaatccgcctgttcaacccttttcctttacgtacattcaagtcattgggttttctgacagacttttcacgtctcaaccggcgcatgcacaacaaatcattcacggccgataacatggtgaccatcattggcgggcgcaatgtcggggatgagtatttcggagcggcggatggtgtgctgttcgcagacctggatgtcatggcaattggtacggtggtggatgatacgtcacgagattttgaccgctattgggccagtccggctgcctatccattgcgtctgctgatccctgaccctagcgaccgggaattgcaggcgctgagcatggcggcggagaaagcggaaaaaaccgtcactggccaaggttatctcaaagcgctgaaggaaagccaattcatccacgatttcatcaaggggttgcgcgcattcgactgggccaaggtggagttgatcagtgatagcccgggcaagattactggtcatgcggaaaaagatgagctgatggtcttcagtttggctaagatcctgcgcaaccccagggagagcgtggatttggtgtctccttatttcgtgcctacccagacaggcgtggatggtttttccgcgctggctagacgcggtatccatatccgcatcctgaccaatgcactcgagtccaccgacgtggccgctgtgcatgcgggctatgcaaagtggcgaaaacccctgttgcaggccggtatccaattatatgaaatgcgccgccaggtagctgaaaacggcatggcaaagtacctgggtcctctgggcagctcggggtccagtttgcatgccaagacatttaccattgatcgttcacgcgtatttatcgggtcattcaattttgacccgcgctcagcccagctgaatacggaactgggatttatcatcgaaagtcaaaaattagcccaacaggtagaggaggcattcaaggcggatgtgccccaaagtgcttatgaagtcaggctggatgaacatgaccgtttgtattggcttttctaccaagacggtgtcgagcagcgattcgatgtggatccgggtaccaacatgctgcaacgattttttgtgaaaatattgtcggtgttaccgatcgactggttgttatag

SEQ ID NO: 14656 - protein, 535 aa, Methylobacillus flagellatus KT
MMALFIRWVHRRGSLPIGVRWLHRTLMLMLVAPLFACGLPHVRDSDKPSSAAFPIDEVAETKLGQTMQPLKAAHPGESGIMPLLDAYSAFAARMLLTHSAEKSLDVQYYIWRNDNTGILFLEALRKAAERGVRVRLLLDDNGIRGREMDARLAALNKHPNIEIRLFNPFPLRTFKSLGFLTDFSRLNRRMHNKSFTADNMVTIIGGRNVGDEYFGAADGVLFADLDVMAIGTVVDDTSRDFDRYWASPAAYPLRLLIPDPSDRELQALSMAAEKAEKTVTGQGYLKALKESQFIHDFIKGLRAFDWAKVELISDSPGKITGHAEKDELMVFSLAKILRNPRESVDLVSPYFVPTQTGVDGFSALARRGIHIRILTNALESTDVAAVHAGYAKWRKPLLQAGIQLYEMRRQVAENGMAKYLGPLGSSGSSLHAKTFTIDRSRVFIGSFNFDPRSAQLNTELGFIIESQKLAQQVEEAFKADVPQSAYEVRLDEHDRLYWLFYQDGVEQRFDVDPGTNMLQRFFVKILSVLPIDWLL

SEQ ID NO: 14657 - DNA, 1152 bp, Methylobacillus flagellatus KT
  CDS (1)..(1152): transl_table=11
atgcgctgggaatccggcaaccgcatcaccctgctccgcaacggtaccgagttcttcccggcactggcggcttccatcgaggctgcgcagcatgaaatccatctccagacctatatttacgaactggatgccaccggtgccatgataggcgagaaactcaaggcggccgctgcgcgtggcgtggccgtccatctcctgctggacggcttcggcagccgcaagctgccgccggaatacgtgctcgagatggaagccttcggcgtcaaggtcatgttctaccgcccgaagatttcaccgtggtcattcaagcgtaatcgcttgcgtcgcctgcatcgcaaggtctcggtgttcgacgggcagcatgcctatgtcggcggcatcaacatcatcgacgacatgaacgtgccgagcaaccttgatgcaccccgcgtcgattatgccgttcgcgtcgacgggccattggtgctgagcatccatgccagcgtgcgcaacctgtggcggcgactggcctggatgcacttgcgcgaagtttcggcctatcccaacctgcctgcgccgccattcatcacgaacgggatgcgtgcggccttcgtcgtgcgcgataacgtgctgcatcgccgggatatcgagcgcgcctacctcaaggccattggcaaggcgcgggtcgatatcatcattgccagcgcctatttcgtgccgggcaagaagtttcgccaggcgctgatcgaagctgccaagcgcggcgtgcgcgtacgcctgctgttgcagggacgcatggaatactggctcatgttcgcgacacacgaagtttatggcctgttcctgcgccatggcattgagatttacgagtatcgcgccagcttcatgcacagtaaggtggcggtagtggatagtcgttgggccaccgtgggttcctccaaccttgacccatttagcctgatgctggcccgcgaggccaacatcatggtgcaggacaaacgcttcaatgccgagctgaaggcggacttggaaaaggcgattgcggaaaagtccgtgcaggtgcgtccggaagactggtctcggcgacatgtcttcaagtgtgcattctcatggatcgtgtatgtcgtcgtgaggctcatgattggcttggtcggctccaaggagaaacattga

SEQ ID NO: 14658 - protein, 383 aa, Methylobacillus flagellatus KT
MRWESGNRITLLRNGTEFFPALAASIEAAQHEIHLQTYIYELDATGAMIGEKLKAAAARGVAVHLLLDGFGSRKLPPEYVLEMEAFGVKVMFYRPKISPWSFKRNRLRRLHRKVSVFDGQHAYVGGINIIDDMNVPSNLDAPRVDYAVRVDGPLVLSIHASVRNLWRRLAWMHLREVSAYPNLPAPPFITNGMRAAFVVRDNVLHRRDIERAYLKAIGKARVDIIIASAYFVPGKKFRQALIEAAKRGVRVRLLLQGRMEYWLMFATHEVYGLFLRHGIEIYEYRASFMHSKVAVVDSRWATVGSSNLDPFSLMLAREANIMVQDKRFNAELKADLEKAIAEKSVQVRPEDWSRRHVFKCAFSWIVYVVVRLMIGLVGSKEKH

SEQ ID NO: 14659 - DNA, 1173 bp, Sphingopyxis alaskensis RB2256
  CDS (1)..(1173): transl_table=11
atggatttgccgcctcatctggccagtcttgcgcgtctcgggcgagacgtgtcaggcaaagaactgttgcccggaaatcgctgcacccccctttttgggggcacagaggcctacccgcaaatgcttcaggcgatttgcgaagcgaagcattctatcgcccttgcctcgtacattttcgagggcaaggggatcggggcgcttttcgtcgataccctcgcgcaagcgcggtcgcgcggagtgagcgtcaaggtcctgatcgatgatgcctatgccaggttatccaactcggacgcctacggagcattgcggcttcacggtattgatgtcgccctgttcaatccccctgtgataccggcacgcctgcacgggttgcatctgcgcaaccatcgcaaactgctcatcgttgacgggtaccggggctttaccggcggcatgaacatccataggccctattggtgtcccaaggccccggaaagcgctttccgcgatctgcaccttgaggtttcgggtccggtcgtcgggcaaatgcgggaaaccttcgagcgggactggtacgatagcaaggaagaagagctggacgaaagcttctggactggcaaatcgggcggtccgatcaccgacggatttagccttgcgcgcgggatcgaatccggacctgacgaaacgctggaccggatgcggtggattttcataggcgcaatcaatgccgctcagaaaaagatttccatccgcacaccttatttcctgcctgaccagcctactattgccgcgctgggcgcagccgctttgcgaggggttcgggtcgagatcgtggtcccgcgaaacagcgaccatctgttcgtgcaatgggcatctaaggcgcattactggcagataatcgaacacggtgtctgcatttatgagcgccccggcccgttcgatcatggcaagctgatgataattgacgatgcctgggtgtgtgtcggctccgccaactgggatgcgcgtagcctgcgcctgaacttcgaattcaacctggaaatttacgatcgcaggctggcgctggagcttggtgacgatttcgcccgaatcaggtctgcgtcgaagaaagtgaggccgaccgacctgtctgacatgccgtatttcgtgaaactgcgaaatggctttgcgcggctgttttcgccgatcctttga

SEQ ID NO: 14660 - protein, 390 aa, Sphingopyxis alaskensis RB2256
MDLPPHLASLARLGRDVSGKELLPGNRCTPLFGGTEAYPQMLQAICEAKHSIALASYIFEGKGIGALFVDTLAQARSRGVSVKVLIDDAYARLSNSDAYGALRLHGIDVALFNPPVIPARLHGLHLRNHRKLLIVDGYRGFTGGMNIHRPYWCPKAPESAFRDLHLEVSGPVVGQMRETFERDWYDSKEEELDESFWTGKSGGPITDGFSLARGIESGPDETLDRMRWIFIGAINAAQKKISIRTPYFLPDQPTIAALGAAALRGVRVEIVVPRNSDHLFVQWASKAHYWQIIEHGVCIYERPGPFDHGKLMIIDDAWVCVGSANWDARSLRLNFEFNLEIYDRRLALELGDDFARIRSASKKVRPTDLSDMPYFVKLRNGFARLFSPIL

SEQ ID NO: 14661 - DNA, 1140 bp, Sphingopyxis alaskensis RB2256
  CDS (1)..(1140): transl_table=11
gtggcggatcatcggatcgagttgatcttcgacggcggcgagcggatgacgcgcctgctccgactgatcgatcgggcggcgcacagcatcgacctcatcatctatatatttgaaggcgacgccgcaggactcagcgtcctgcgcgcgctgaccgccgcggcgcggcgcggcgtgcgcgtgcgcgtgttgatcgacagcttcgggtcgggcgacacgcccgacgcgctgttcgcgccgctgcgcgaagcgggcggcggcgccacctttttctcgcgccgctggcgttcgtcctatctcatccgcaatcaccagaagctgatcctgatcgacaatgcggttgccatgacggggggcttcaacatcgccgacgattatctgagcgcgccgcgcagcgatggctggctcgacatcggcatgatcgtcgaggggccgagcgtcgcgcgcgcggccgactggtttgccgaaatccatgattatacggtcagcaacgacggtaagctcctgatattgcggcggctgatccgcgaatggccggtcgatggcggcgcagtgtcatggcttgtcggcgggccgacgcagcggctttcgccctgggcacgcgccgtgcgcgccgacctgaacgatgcgcgtcaactcgacatggcaatggcctatttttcacccggccagggcctgctccgccgcctcggccgcgtcgcgcagcgcggtcgcgcgcgcttcatcatggcgggcaagtccgacaatggcgccacgatcggggcctcgcgccttctctatggctatctgcttcgcaagggcgccgacgtgtgggaatatcggcggtgcaagctgcacatgaagctgatcgtcgtcgacgatgtggtctatatcggctcggccaatttcgacgtgcgcagcctgttcgtcaatgtcgagctgatggtgcggatcgccgatgccggctttgcggcgcagatgcggcgctttgtggcgggcctccagcccgattgcgacatcatcaccgccgaggcgcacaaggcacgcgcaagctggtggacgcggctgcgctggacactcgcctggttcgtcgtcggcgtcgccgattatacggtgtcgcgcaaactcaacttcggcctcggtgaccccgatcccgatgtctag

SEQ ID NO: 14662 - protein, 379 aa, Sphingopyxis alaskensis RB2256
MADHRIELIFDGGERMTRLLRLIDRAAHSIDLIIYIFEGDAAGLSVLRALTAAARRGVRVRVLIDSFGSGDTPDALFAPLREAGGGATFFSRRWRSSYLIRNHQKLILIDNAVAMTGGFNIADDYLSAPRSDGWLDIGMIVEGPSVARAADWFAEIHDYTVSNDGKLLILRRLIREWPVDGGAVSWLVGGPTQRLSPWARAVRADLNDARQLDMAMAYFSPGQGLLRRLGRVAQRGRARFIMAGKSDNGATIGASRLLYGYLLRKGADVWEYRRCKLHMKLIVVDDVVYIGSANFDVRSLFVNVELMVRIADAGFAAQMRRFVAGLQPDCDIITAEAHKARASWWTRLRWTLAWFVVGVADYTVSRKLNFGLGDPDPDV

SEQ ID NO: 14663 - DNA, 1527 bp, Shewanella amazonensis SB2B
  CDS (1)..(1527): transl_table=11
atgcccccacgtgtttcctggcgttcattttggctgatgatcctcggatgtatctcactcgggggttgcagtagtctgcctgaacttaaagatgcaccgcggagttacaagctgacatcggcgccggatagcctgatagccggatacctggcagagccactggccggtcacccggggcaaagtggcgtgttgcccctgtttgaggggctggatgccatggtggccaggttggcgctgataaagtccgccgaaaccagcatcgatttgcaatattacatctttcgcaacgatgacactgggcgacttctggcctggcagctgctggatgcagcagaccgaggcgtacgggtacgtttgctgctggacgatactgccagcgtcaatattgaccggcagttggcggtcatggcgagccacccgaatgtctccgtcaggctctacaatccatcgtctcatcgcaccctcagggccttgtcgtttgtcaccgatttcggtcgcatgaatcatcgcatgcacaacaaatcactgacggtggataatcgcctcagcgtggtgggcgggcgcaatatcggcaacgaatatttctccaatgacgaagatgtagagtttggcgatctcgacgtgttgttgaccggaccggtggtagagcaggtctctgaccaatttgatgcctattggaatggcagcaacacctatccggtcgagcttctgaccgagcatcccgtacagtccgatgagctcgcagccatgtatgaccagattgccaaccagaagcgccagcttgaggagcatccctatatacagcgcctcaccaagtcgccgctgctcagacacatggcggacaatcgtctggaatggttttggggggaggcgaaagttcttgccgatcctcatgataagcgagaagggcaagcggaagcctggatgatcacgcccttgctagatgagtttcagcaaacccgggagcgcctggttatcatttcgccttactttgttcccacaacagagggcgtcagattgcttaccgggcttgccaagcgcggtgtcgcggtaaccgtgatcaccaatagcctggctgccaccgacgtgctggcggttcattccggttacaagggatatcgtgaggcactccttcgcgcgggagtttccctgtatgaagtgaaagcgaccggcaagcgcccgagtcattcctggaaaggcagctcccgctccagtttgcatgccaagagctttttgtttgacgatgacaggctctttgtcggctcctttaattttgatccgcgttcggcctggcttaatactgaaatgggggtcatggttaatcagggggagctgaatcagaaaattcatgcctggctgccccagtttttaaccaacaaaacttaccaggtgaagcttggcagcgatggcctctactggcatgaactcagttcgggaaaagatatttatgccgagccccaggccggattttggcgccgctttatggccgatgtgctggcgctgtttccactggaatcccagctttaa

SEQ ID NO: 14664 - protein, 508 aa, Shewanella amazonensis SB2B
MPPRVSWRSFWLMILGCISLGGCSSLPELKDAPRSYKLTSAPDSLIAGYLAEPLAGHPGQSGVLPLFEGLDAMVARLALIKSAETSIDLQYYIFRNDDTGRLLAWQLLDAADRGVRVRLLLDDTASVNIDRQLAVMASHPNVSVRLYNPSSHRTLRALSFVTDFGRMNHRMHNKSLTVDNRLSVVGGRNIGNEYFSNDEDVEFGDLDVLLTGPVVEQVSDQFDAYWNGSNTYPVELLTEHPVQSDELAAMYDQIANQKRQLEEHPYIQRLTKSPLLRHMADNRLEWFWGEAKVLADPHDKREGQAEAWMITPLLDEFQQTRERLVIISPYFVPTTEGVRLLTGLAKRGVAVTVITNSLAATDVLAVHSGYKGYREALLRAGVSLYEVKATGKRPSHSWKGSSRSSLHAKSFLFDDDRLFVGSFNFDPRSAWLNTEMGVMVNQGELNQKIHAWLPQFLTNKTYQVKLGSDGLYWHELSSGKDIYAEPQAGFWRRFMADVLALFPLESQL

SEQ ID NO: 14665 - DNA, 1518 bp, Ralstonia metallidurans CH34
  CDS (1)..(1518): transl_table=11
atggattcgggtgcgaggcttggggatgttggaagtgatgtgctgtgccagaatagcgtccatcccgtccggccccggctgcctatgttgacccctagtgtgattgcagcgatcgtcgtgtctcttcacgtgctgggcgtgattgcggcgctgcacgccgtcatgaccgtacgcactgcgcccggggccatagcctgggctggatcgctggtcatgatgccgtacttctcgctgatcccctatctgatctttggacgaagccgcttcgcgggatacgtcaatgcgcggcgcttcaacaatcaccgtctgcgcgagatccgccagaacatgagtacccaggagctggattcgctcagcgcctgcctggtgatgaaccccgaccaggaatgcatgcgcgcattgccgcgtctgactggcatgccatgcctgggtaataacgacgtgcggctgctggtcaacggcgaggcgaccttccaggcgatcttcgccgcgatcgatgccgccacgcaggtcgtggtggtccagttcttcatcgttcatgatgatgagcttggactcgaactgcaacgccgcctgtgcgcgcgtgccaaggcgggggtcagggtctatttcctatacgacagcatcggctgtcacgcgctaggccgggcctacctgcgtgcgctggaggaagccggcgtccacgtgcgctcattcgccacgcatcccggctttgtcaatcgcttccagctcaacttccgcaatcaccgcaagctggtcatcgtcgatggcgagcgcgcctttgtcgggggtcataacgtcggcaacgagtacctcggtcgccggccaccactcgcgccctggcgggatacccatatcgagattcgcggcgcggtggtgctcgagctgcagatgacgttcgccgaggactggtactgggccgcgcacgaggtgccctacctgttgctgccaccgccgaggcgtttcggcgacatggtgtgccagatcgtgccatccgggccggcggacgcgcaggagacatgctcgctgttcttcgtcgaggcgatccaggccgcgcgcaagcggatctggattacgtcgccatacttcgtgcccgacgaagccgtttccgcgatgctacggctggcagtgctgcgtggtgtggacgtgcgcatcctgataccggcccggccggaccattacgtggtctatggggcgtcgacgatctatgcccaccaggccgtctgcgccggcgtgaaggtgttccgctaccagccgggcttcctgcaccagaaggtcatcctggtcgacgacgacgcggcggctgtcggcaccgcgaatctggacaatcgctcgttccggctcaacttcgagatgatggtcatgacggctcacccggcattcgcggccagcgtggccgagatgctggaagccgatttcgcgcaggcccgtcagatcgaccgcgaggacttccttggcgcgcccgcgatcctgcgcgtggcgatgcacgtggccaagctcttcgctcccatcctttag

SEQ ID NO: 14666 - protein, 505 aa, Ralstonia metallidurans CH34
MDSGARLGDVGSDVLCQNSVHPVRPRLPMLTPSVIAAIVVSLHVLGVIAALHAVMTVRTAPGAIAWAGSLVMMPYFSLIPYLIFGRSRFAGYVNARRFNNHRLREIRQNMSTQELDSLSACLVMNPDQECMRALPRLTGMPCLGNNDVRLLVNGEATFQAIFAAIDAATQVVVVQFFIVHDDELGLELQRRLCARAKAGVRVYFLYDSIGCHALGRAYLRALEEAGVHVRSFATHPGFVNRFQLNFRNHRKLVIVDGERAFVGGHNVGNEYLGRRPPLAPWRDTHIEIRGAVVLELQMTFAEDWYWAAHEVPYLLLPPPRRFGDMVCQIVPSGPADAQETCSLFFVEAIQAARKRIWITSPYFVPDEAVSAMLRLAVLRGVDVRILIPARPDHYVVYGASTIYAHQAVCAGVKVFRYQPGFLHQKVILVDDDAAAVGTANLDNRSFRLNFEMMVMTAHPAFAASVAEMLEADFAQARQIDREDFLGAPAILRVAMHVAKLFAPIL

SEQ ID NO: 14667 - DNA, 1605 bp, Ralstonia metallidurans CH34
  CDS (1)..(1605): transl_table=11
atggcgcaggcgttgcaacaacggagtgcgagcgttggcccccgatttctgctggcctgtctgtcggcctgcatcctggtactggcagggtgcgccagtttgccagcgcatcctgaccgcacgccgagctacgcgtcgaccgataccagcgatacgttgctggccagttccctggcaccacggctggcgcggaatccgggtcaatcgatcttctatccgctgggttctgggcccgatgcgctggcggtccgcatggcgttggcgcgcgcggcgcgcaagacgctcgatctccagtactacttatttgatgcagataccacgggcagcgccctgcttggcgagttgatcgatgccgccgaccgtggcgtgcgggtgcgtctgctgatcgacgacctgcattccaccaatcaggacaagctctgggcggcgctcgacgcccatccgaacatcgagacccggttgttcaacccgtttgccaaccgctccgcgcgctgggccgagatgatggtcgatttcggccgcctggaccggcgcatgcacaacaagctgatggtggcggacaacctcgtgggcgtggtcggtggccgcaatatcggagacgcgtatttctcggcccgacccgacgtcgatttcagcgacctggatgtgatggtcgccgggcccgtcgtgcaggccgccagcaaggtgttcgaccagtactggaacagcgagagcgcgtatccggtggccgcgctggtgcccgagggcaaggaggcacctgaggaactgcgacgctttcgcaaggaagtcgaggcaaagggggacgtggctcgtgccagtcccttcgtgcaggaactgctggactcggggctggcgcgcggcatcgaagtgggtcatctgccgggtcacgtcggcagcgcgcgcgtgattgccgactcgcctgacaagatcgagaacgatcccgacgatgcgtcgacacacgcaattccccgcctgcgggcgctgatggaggcggcgcagaccgaactggtgctgatctcgccgtactttgtgccagacgatgacaccgagaaatggttggccgccatcgccaaacgtggcgtcaaggtgcgggtgctgaccaactcgtttgcggccacggatgtttccgcagtccatgcgggctacgcgccacgccgtctggcgctgctccacgccggcatcgaactgtacgaactcaagcccaccgccagtaccggattgacgcaagatcgtggcagacacgctcgcaccttcgcatcgagccgcgcaaccctccatgccaaggcctatgtcgtcgaccggcggttcctgttcgtgggctccccgaacctggacccgcgatcgagccggctcaataccgagatgggggtcgtgctcgacagccccacgctggctgcctggttcgtgtccgacgtggacaagcggctgcccgagatcgcgtggcgcattggggtgcgtaccgatgcggcgggtcaggaaggcctgacgtggacaacgatggagcagggcaaggaagtcaccaccgacaaggagcccggcatgagcgtgtggcagcacatcggcatcgactttctgggactcctgccgctggaggatgagctgtag

SEQ ID NO: 14668 - protein, 534 aa, Ralstonia metallidurans CH34
MAQALQQRSASVGPRFLLACLSACILVLAGCASLPAHPDRTPSYASTDTSDTLLASSLAPRLARNPGQSIFYPLGSGPDALAVRMALARAARKTLDLQYYLFDADTTGSALLGELIDAADRGVRVRLLIDDLHSTNQDKLWAALDAHPNIETRLFNPFANRSARWAEMMVDFGRLDRRMHNKLMVADNLVGVVGGRNIGDAYFSARPDVDFSDLDVMVAGPVVQAASKVFDQYWNSESAYPVAALVPEGKEAPEELRRFRKEVEAKGDVARASPFVQELLDSGLARGIEVGHLPGHVGSARVIADSPDKIENDPDDASTHAIPRLRALMEAAQTELVLISPYFVPDDDTEKWLAAIAKRGVKVRVLTNSFAATDVSAVHAGYAPRRLALLHAGIELYELKPTASTGLTQDRGRHARTFASSRATLHAKAYVVDRRFLFVGSPNLDPRSSRLNTEMGVVLDSPTLAAWFVSDVDKRLPEIAWRIGVRTDAAGQEGLTWTTMEQGKEVTTDKEPGMSVWQHIGIDFLGLLPLEDEL

SEQ ID NO: 14669 - DNA, 1599 bp, Ralstonia metallidurans CH34
  CDS (1)..(1599): transl_table=11
atgggagacacgcgtcgattggcgggtctgtttggtcgtttcctggttgtcatgatcgcggcgttcctgacggcctgcgcgggcttgccgcagcggccggaactgcagcccgaagtggcgctgcgcgataccagcgatacggcgatagccagagaactggcgccacaactggccgcccatccgggcgagtccgtgttctatccgctggccgcaggtacggatgcgtttgccatgcgtatcgcactggctcgcgtggcgcagcgctcgctcgatatccagtactacatttacgaaacggacgataccggcctgacgctgctggccgccatcatggccgcggcagatcgtggcgtgcgggtgcggctgctgcttgatgacattcatctggccgggcaggacaagatgctgcaggtgatcgacgcgcatccgaacatcgaggtgcgggtgttcaatccgttcgccagccgaaatgtgcgcctgctcgagtacgtcaccgctttcagccggatcaaccggcggatgcacaacaagtcgatgactgccgacaaccagctcaccatcgtcggcggacgcaacgtcggcgacgagtactacggcgcggcgcaaaccgatttcagcgacctggatcttctggcggccggtccggtggtgccagaggtgtcggccgtgttcgacgattactggaacaacgaagccgcttatccgatctcgaccctggacaagccgctcacgggcaaggaggccgccgagcagcaggagaaactgcgcaacgccgtcgacgatcgcgctatcgccgtgagtgcgacgccgtatggcaaatccgtgctggagtccggggtcgtgcatgcgcttcaccagggcacgctgccgtccttctggggccgagcgacggttatcgccgacaaggcggccaagatccagttgccgcccgacgacgattccacgcacgccatcccgcagctaggcaagattctcgacagcgccaagcatgacctgacgctgatatccccgtacttcgtgccgcccgacgacgccatggactggctgaccgggatgcagaagcggggtgtccaggttcgtatcctgaccaattcgtatggcgcgacggacgtgacggcggtgcacgcgggctatgcgccgaggcgcgaggccctgctgagggcaggggtgatcctgtacgaactgaagccatcggcctacgccgaactggccaaggaaagaaagtcccaccgcagcggcccgggcggcagcagccgcgccagcctgcacgccaagacctacatggtggatcgacaccagttgtttatcggatccctgaacctggatccgcgttcggcacggctcaataccgaaatgggtatcgtggtcgacagcgcgccgctatgcgagatgttcggcaaagtgatcgacgccgcgttgctcgacgtcgcctaccaggtcgtgctcgagaccgatcccgcgaccggcaaggagcagatggtgtgggtgacccaggaggacggcgtcctgcgcacgtatcgcagcgagcccgacatgaacgcctgggaccatatcaaacagggcgtgttgcggatgttgccggtggaatcgcagttgtag

SEQ ID NO: 14670 - protein, 532 aa, Ralstonia metallidurans CH34
MGDTRRLAGLFGRFLVVMIAAFLTACAGLPQRPELQPEVALRDTSDTAIARELAPQLAAHPGESVFYPLAAGTDAFAMRIALARVAQRSLDIQYYIYETDDTGLTLLAAIMAAADRGVRVRLLLDDIHLAGQDKMLQVIDAHPNIEVRVFNPFASRNVRLLEYVTAFSRINRRMHNKSMTADNQLTIVGGRNVGDEYYGAAQTDFSDLDLLAAGPVVPEVSAVFDDYWNNEAAYPISTLDKPLTGKEAAEQQEKLRNAVDDRAIAVSATPYGKSVLESGVVHALHQGTLPSFWGRATVIADKAAKIQLPPDDDSTHAIPQLGKILDSAKHDLTLISPYFVPPDDAMDWLTGMQKRGVQVRILTNSYGATDVTAVHAGYAPRREALLRAGVILYELKPSAYAELAKERKSHRSGPGGSSRASLHAKTYMVDRHQLFIGSLNLDPRSARLNTEMGIVVDSAPLCEMFGKVIDAALLDVAYQVVLETDPATGKEQMVWVTQEDGVLRTYRSEPDMNAWDHIKQGVLRMLPVESQL

SEQ ID NO: 14671 - DNA, 1281 bp, Rubrobacter xylanophilus DSM 9941
  CDS (1)..(1281): transl_table=11
atgttctctttcgcgcggcgcgccatctcgaagacgcgggcggtcgtctcccgtctacggaggctagggatccggctcttcctcgccctgaccgcgctgcaggcggcgctggtcggggtgcttgtggcgatggccgagctcaggaagcgccgccgggggccgggagagggcttcccgtgggaggacatgcccgaggtggagctcgaggacggcaacggcgcgctcaggctctacgcctacggcgtcccgctctacagggacatgctgcgcgagatagagggggccagggagcgcatcctgctggagaccttcatctggaagggggacgaggtcgggcggcgcttcgtggaggccctggcgcgcaaggcccggcggggggtggaggtgtacgcgatcttcgacggcttcgccaacctggtcgtcccggccgacttcaagcgcttccccaaggagataaacaccctccactttcgcccgttcgaccacccggcgcgggccctcgacccgcggggcatcttccgggaccaccgcaagatactcgccgtcgacgggcgggtggcctttctcggaggttacaacataggctcgctctacgagcggagctggcgggacacccacctcaggatccggggcagcgaggtgcgcgaggtcgagaacgcctttatagacttctggaacgcccaccggacgccggacctgccgcccatagagcccaagggggagcgggcctggaacgccaacctcgtgctgcaccgcaacgacccctacctgaggatcttccccatccgggggatgtacctggaggccatagaccgcgccacgaagcgcatctacctcacccatgcctacttcgtccccgaccgggcgctgcgcgccgggctcgccgaggccgcccgccgcggggtcgacgtgcaggtgctgctgcccgagggctccaaccacgtcaccgccgactggctctcgcgccggcacttccacgagctgctctcggcgggggtcaggatcttccgctacaaacacatcatgatccactccaagaccgccaccatcgacggggtctggtccaccgtggggacggcgaacatagaccgcctgagcctgctgggcaactacgaggtcaacctggaggtctacagcaggcgcttcgccgcccagatggagcgcatgttcgagctggacaagaccaacgccgaggagctgacgctcgaggagtgggagcggcggccgctgcccgccaagctcgcggagcgcgccctctccaccctgagcccgctggtgtag

SEQ ID NO: 14672 - protein, 426 aa, Rubrobacter xylanophilus DSM 9941
MFSFARRAISKTRAVVSRLRRLGIRLFLALTALQAALVGVLVAMAELRKRRRGPGEGFPWEDMPEVELEDGNGALRLYAYGVPLYRDMLREIEGARERILLETFIWKGDEVGRRFVEALARKARRGVEVYAIFDGFANLVVPADFKRFPKEINTLHFRPFDHPARALDPRGIFRDHRKILAVDGRVAFLGGYNIGSLYERSWRDTHLRIRGSEVREVENAFIDFWNAHRTPDLPPIEPKGERAWNANLVLHRNDPYLRIFPIRGMYLEAIDRATKRIYLTHAYFVPDRALRAGLAEAARRGVDVQVLLPEGSNHVTADWLSRRHFHELLSAGVRIFRYKHIMIHSKTATIDGVWSTVGTANIDRLSLLGNYEVNLEVYSRRFAAQMERMFELDKTNAEELTLEEWERRPLPAKLAERALSTLSPLV

SEQ ID NO: 14673 - DNA, 1437 bp, Mesorhizobium sp. BNC1
  CDS (1)..(1437): transl_table=11
atggcgtttactgggaacgaaacctgggcgattgcctacctcgcgatggaatggacaatccgcattgtgatggttgttgtcgtgcccttgcggcgtacgcccgacgctgcacgcagctggctcctactggtattcttcctgcccattcccgcacttgcggtctatcttgctatcggcagaccgacctacccacgctggcgccgggaacgcttcgccagattgccggaggtcctcgccgcggcgtcgaaagagattgcccattcccacttctgccgccagccagaattgccgggcccgctggcggggccagcactgctgatcgaaacgctcgggcgattccctgcgctgtccggcaacgatgtcgaacttctttccagttacgacggcgttatcgaccgtatggtcgccgacattgatcatgcagaacgaactgtccatctcctgttctacatattcgcggacgacgatacgggccggcgcgtaatagaagccctggaacgggcggcccggcgaggtgtcgcatgcagggtgctgattgatgccatcggttcgcggcaatggcggcgacaggtggcgaggctgctcgcccaggcgggtgtggatgttcgattcgctctgaaggtagggatctttcggcggagatcggcgcgtgccgacctacgcaatcaccggaagatcgccgttgtcgacagtcgcgtcggctatgtcggctctcaaaacataacgaatgccctgtccgcctccgatatagcaaatgaagagttggtcgcacgggttgtcggcccaatcacgacagagctccaagccgtctttgtcggcgactggttcatggaaacggaggaggagctggcagtatccgccctgttcccgcaccatcatcccgaggccggggtcgttgcacaggtcctaccaagtggtcccgattatcccgacgccggcatcgggtatctagtagcggctctggttcacggcgcaagcaagcgtgtcgtgatcacgacaccttatttcgtcccggacgagccgctccttcaggcactcaaaaccgcagtactgcgcggggtggaagtgcgtttgctggtcccgcgtctcacggaccacatcctggtgaagttggcgcagcaatcctactactccgagctactccaagccggtgttcaagtgcacctctatgagggggggttcctgcacgccaagcatgtcacgtttgatgacgagatctcgctgctgggttccagcaatgtcgacatccgctcttttgtcctgaacgccgaagtaagtctcatcgcttttgataagggtgtcacggtgcagttgcgaagcgagcagatgcgctgcctcgacaagagcgagatgctcacctccgaaggttgggaagagcgcccgatgatccacaagattggcgagaatctggcgcggctagcgagtcctctcctgtga

SEQ ID NO: 14674 - protein, 478 aa, Mesorhizobium sp. BNC1
MAFTGNETWAIAYLAMEWTIRIVMVVVVPLRRTPDAARSWLLLVFFLPIPALAVYLAIGRPTYPRWRRERFARLPEVLAAASKEIAHSHFCRQPELPGPLAGPALLIETLGRFPALSGNDVELLSSYDGVIDRMVADIDHAERTVHLLFYIFADDDTGRRVIEALERAARRGVACRVLIDAIGSRQWRRQVARLLAQAGVDVRFALKVGIFRRRSARADLRNHRKIAVVDSRVGYVGSQNITNALSASDIANEELVARVVGPITTELQAVFVGDWFMETEEELAVSALFPHHHPEAGVVAQVLPSGPDYPDAGIGYLVAALVHGASKRVVITTPYFVPDEPLLQALKTAVLRGVEVRLLVPRLTDHILVKLAQQSYYSELLQAGVQVHLYEGGFLHAKHVTFDDEISLLGSSNVDIRSFVLNAEVSLIAFDKGVTVQLRSEQMRCLDKSEMLTSEGWEERPMIHKIGENLARLASPLL

SEQ ID NO: 14675 - DNA, 1404 bp, Kineococcus radiotolerans SRS30216
  CDS (1)..(1404): transl_table=11
gtgaaggcctgggccgtcggcagcgtgccggagaaccggcgccccgggtcgtcgtcggcgtggctgctgctcatcctcttcctgcccgtcgtgggcctgccgctgttcttcctgctgggcagcccctacgtgaccggccgccgccaccgggtgcaggaggcggcgaaccgggccatcgccgagcgggtcgaggaactgccggacctgccgccggggttcgtggccgacgagcacctggcctcggtgctggagctgaaccggcggctcaccgccctgccgtgcgtctcgggtgaccaccggcggctgctgcccgacggggagttcgtcgccgccctctgcgccgccgtggcagcggcggagcgcaccgtggacgtcgagttctacatcgccgccctcgacgcgacgacggaaccgttcttcgacgccctgcgcgacgccgtcgcccgcggggtgcgggtccgcttcctctacgaccacctcggcgcgcgccggtaccccggccacgcggccatgaaccggcgcctcaccgccgacggcgtcgagtggcaccggatgatgccgatcgacccgctgcgccggcggtggcgccgcccggacctgcgcaaccaccgcaagctcgtcgtcgtggacggccggacgggtttcgtcgggtcgcagaacctcatcgaccccgggtacctcgtccgcaagaacgtccgcgcgggccggcgctgggtcgacctcaacgtggaactcaccggttccgtcgtgcagtcgctggaggccgtgttcgccaccgactggtacgccgagacgggggaggtcctcgacgaggtcgccaccccgaccgcgcacacggtgccgggcggctcgaccggcgccttccaggtcgtcccctccgggccggggttccccaccgaaccgaacctgcggatgttcaccgccctgatccacgccgcgacccgccgggtctcgatcgtcagcccctacttcgtccccgacgagagcctggagcaggccatcaccaccgcggcctaccgcggggtcgaggtcgagctgttcgtctccgagcgcgccgaccagttcatggtccaccacgcccagtgctcctactacgcgaccctgctgcgggccggggtccgcatccaccggctcccgtacccggcggtgctgcacagcaaggtcctcgtcgtggacggcgcccgggcggtcatcggttccagcaacatggacatgcgctccttcaacctcgactacgaggtgtcgctgctggggctggaaccggacttcgtgcgccagctgagcgaggtcgtcgacggctaccgcgcccgctcgcgggaactcacgccggaggcgtggtcgcagcggccgtaccggcggcgctacctggacaacgtcatgcggctcaccgccgccctccagtag

SEQ ID NO: 14676 - protein, 467 aa, Kineococcus radiotolerans SRS30216
MKAWAVGSVPENRRPGSSSAWLLLILFLPVVGLPLFFLLGSPYVTGRRHRVQEAANRAIAERVEELPDLPPGFVADEHLASVLELNRRLTALPCVSGDHRRLLPDGEFVAALCAAVAAAERTVDVEFYIAALDATTEPFFDALRDAVARGVRVRFLYDHLGARRYPGHAAMNRRLTADGVEWHRMMPIDPLRRRWRRPDLRNHRKLVVVDGRTGFVGSQNLIDPGYLVRKNVRAGRRWVDLNVELTGSVVQSLEAVFATDWYAETGEVLDEVATPTAHTVPGGSTGAFQVVPSGPGFPTEPNLRMFTALIHAATRRVSIVSPYFVPDESLEQAITTAAYRGVEVELFVSERADQFMVHHAQCSYYATLLRAGVRIHRLPYPAVLHSKVLVVDGARAVIGSSNMDMRSFNLDYEVSLLGLEPDFVRQLSEVVDGYRARSRELTPEAWSQRPYRRRYLDNVMRLTAALQ

SEQ ID NO: 14677 - DNA, 1476 bp, Kineococcus radiotolerans SRS30216
  CDS (1)..(1476): transl_table=11
atggactggctgccggactgggctccctcgatcacggcgccggccctcgccctcctcgtcgtggacctcgtggtgcgcctcaccgcgatcgcggtggtcccggtgaaccgccgccccagctccgccctcgcctggctgctggccatcttcttcatcccctacctgggggtgctggcgttcctgctcatcggcaaccccaagctgccccgcgcccggcggcgcaagcagcgggagatcaacgagctcatcctgtcctccaccaagggcatggacctcgtctcctccgaccacccgtggccgccgtggctcagcggggtcgtggagctcaaccgcaccctcgggtcgatgccgctggtcggggggaaccaggcccgcctcgagggcgagtacgacgaggcgatccgcgcgatggcccgcaccgtcgacggcgcccgcgagtacgtccacgtcgagttctacatcatgacccgggaccccacgagcgaaccgttcttcgccgccctcgaacgggccgtcgagcgcggggtgaaggtccggctgctgctggaccacctggggtccctgcgctaccccggctaccggcgcacgatccgctccctcgacgacatgggcgtggagtggcacccgatgctgcccgtgcagctgcaccggctgaagtaccagcggccggacctgcgcaaccaccgcaagctcctcgtcgtcgacggggaggtcgcctggctggggtcgcagaacgtgctggaccgcagctacaacaagcgctccaacgtgcggcgcgggctgcagtggcaggacctcatggtgcgcctggaggggccggtcgtcgccggcgtcgaggccatgttcatcaccgactggtactccgagaccgacgagctgctgcagaccgaacgccccgaggtctccccggtcggctccccgggacggctggagtgccaggtcgtgcccagcggccccgggttcgacggggagaacaacctcaagctgttcaactccctgctgtacgccgcccagcggcgcatctccatcaccagcccctacttcgtgcccgacgagtcgatgctgtcggccatcacgacggccgccgagcgcggggtcgacgtcgagctcttcgtctccgagtacggcgaccagttcttcgtgcactacgccgagtgctcctactacgaggacctgctgcgggccggcgtgcggatccaccgctaccccgcgccgtacgtcctgcacgccaagcacatgacgatcgacgacgaggtcgccgtcatcgggtcctccaacatggacatgcgctcgttcctgctggacctggagctgacgctcatggtgtgcgggcgcgagttcgccgacgacctgcgccgggtcgaggacgagtaccgcgcgaagtgcaccgagctcaccctggagcagtggctggcccgcccccggtggcaggtcatcaaggagaacctctcccgcctcacctccgcgctgcagtag

SEQ ID NO: 14678 - protein, 491 aa, Kineococcus radiotolerans SRS30216
MDWLPDWAPSITAPALALLVVDLVVRLTAIAVVPVNRRPSSALAWLLAIFFIPYLGVLAFLLIGNPKLPRARRRKQREINELILSSTKGMDLVSSDHPWPPWLSGVVELNRTLGSMPLVGGNQARLEGEYDEAIRAMARTVDGAREYVHVEFYIMTRDPTSEPFFAALERAVERGVKVRLLLDHLGSLRYPGYRRTIRSLDDMGVEWHPMLPVQLHRLKYQRPDLRNHRKLLVVDGEVAWLGSQNVLDRSYNKRSNVRRGLQWQDLMVRLEGPVVAGVEAMFITDWYSETDELLQTERPEVSPVGSPGRLECQVVPSGPGFDGENNLKLFNSLLYAAQRRISITSPYFVPDESMLSAITTAAERGVDVELFVSEYGDQFFVHYAECSYYEDLLRAGVRIHRYPAPYVLHAKHMTIDDEVAVIGSSNMDMRSFLLDLELTLMVCGREFADDLRRVEDEYRAKCTELTLEQWLARPRWQVIKENLSRLTSALQ

SEQ ID NO: 14679 - DNA, 1551 bp, Silicibacter sp. TM1040
  CDS (1)..(1551): transl_table=11
atgatgcggttcttaaaaacactggctttgattggccttacgcttgcggcatttgtgatgctcgcacggcttctttttcctttgcccgacatttccaatcgcgagatcagctcggcccttccggcgagcgatcagacttcgatcggggcgacagttgcagatctgaacgcggcgcatgtcggccagtcagggatcatcccgctgcgcagcgggacggatgcgcttgcaagccgggtcgaactgatccgtcgcgccgaagcctcgatcgacgcgcaatactacatttggcacgacgacacctccggggttctcctgctagaggaattgcgcaacgcggcgctgcggggcgtgcgggtccgacttctgctggacgataacggcgtgcctgggcttgacgcaacaatggctacgctcaacgcgcaacccaatttcgaaatccgactgttcaacccctcaacgatccggcgcccaaagctcttgggctacagctttgatttctttcggatgaaccggagaatgcacaacaagtcccttatcgtggacggggcggtcgcgatcattggcgggcgcaacattggtgacgagtatttcgacgtgcagcgggatgcattttatatcgacatggatgcgctggctgcgggcaaagtggtgccggaaacggccaccgtctttgatgactactggaacagcgcctccgtttttgcgctcgagacgattgtatcatccgatgggaacctgattacctttgatcaacgcgtatcagaggtgatggccacaccagaggctcaacgcctgatgggcgatctgcaaagcagtgcagataaattcgcgcgtggtgagatgccgatggagtggacaaatgttcgcgtggtggccgatgaccctgtgaaaggtcagggcagcgcgacatcagaccagttgatgatctctcgtctgggcgagatcctcggccaggtcgagacccgcttggatctagtttcggcctattttgtacccgggcagcgaggaacggagtacctcacggatttggcggctgctggcgtggatgtgcgtgtgttgaccaatgcgatgaacaccacggatgtcttgatggtgcattctggctacacgcggtaccgtcgcgcgctgctggaagcagatgtttcgctctacgagttgaaactgcgcgctcagatgtcggctgacgccaaccggcaactcaaaccctttggtctttcgggggcgagcctgcacgccaagacctttgccgtcgacggtgatcgcgtttttatcggctctttcaactttgatccgcgctcggccaccctaaattgcgagatggggtttctcatcgaaagtccgacgctcgccgggcaggtcagcgcaggctttgacggcccactcctgacggtgtcctatcaaccggcgctgacacccaaaggcaagatgatatggcgcgagccaatcgaagatggcgagacattgatctaccaagaagagcccggcgccacctggttccagcagattgcaatcgcggtgattggcgtgctgccggttgaatggcttttgtga

SEQ ID NO: 14680 - protein, 516 aa, Silicibacter sp. TM1040
MMRFLKTLALIGLTLAAFVMLARLLFPLPDISNREISSALPASDQTSIGATVADLNAAHVGQSGIIPLRSGTDALASRVELIRRAEASIDAQYYIWHDDTSGVLLLEELRNAALRGVRVRLLLDDNGVPGLDATMATLNAQPNFEIRLFNPSTIRRPKLLGYSFDFFRMNRRMHNKSLIVDGAVAIIGGRNIGDEYFDVQRDAFYIDMDALAAGKVVPETATVFDDYWNSASVFALETIVSSDGNLITFDQRVSEVMATPEAQRLMGDLQSSADKFARGEMPMEWTNVRVVADDPVKGQGSATSDQLMISRLGEILGQVETRLDLVSAYFVPGQRGTEYLTDLAAAGVDVRVLTNAMNTTDVLMVHSGYTRYRRALLEADVSLYELKLRAQMSADANRQLKPFGLSGASLHAKTFAVDGDRVFIGSFNFDPRSATLNCEMGFLIESPTLAGQVSAGFDGPLLTVSYQPALTPKGKMIWREPIEDGETLIYQEEPGATWFQQIAIAVIGVLPVEWLL

SEQ ID NO: 14681 - DNA, 1554 bp, Nitrobacter hamburgensis X14
  CDS (1)..(1554): transl_table=11
atgcagcttttgtcgatcatcgctgttgttgtggccttgtttgcgctggcatcgctcgccgcggtttattcctatggccgcttcgccaggcaggcgcgcggcgagccctcctcggcactgccgattgccgagcgcgacacgttgctcgacaggatcgtctcgccgaagctgaaggagtatccggacaagagcggtctgttgcttgtgacgagcaatcttcaggctttcgccatcagggcgctcgccgcgcgcagcgccgagcggagcctggaccttcaatattactactggaaggacgacctgacgggcggtctgctggcacgcgagttgatcgccgccgccgatcgtggcgttcgggtgcgggtgcttctcgacgacatcaatacgaagggcgacgattccacctatctggccctcgacaaccatcccaacgtcgaaatccggctgttcaatccttcccgcagccgcaccagtgcgctgcggcgcggcatcgagatggcgcttcgcgccttcagcgtgacgcggcgtatgcataacaaggcgtggattgccgatggccgcatggcgatcgtcggcggccgcaacatcggggacgcctatttcgacgcggccgaaatgtcgaattttcacgacatggacctcgtgctgatcggacctgccgtgcagcaggccgagaccgtattcgatgactactggaacagcagcgttgtgcttccgatcagctcgctttggcgttttcgaaagggcgacctgagaaagaaaagggcgtatctcgaagccttggtgtcgagtgatggcgcccggccttatctgcgacggctgcaagcggagaacagcaccggatcgctgctgagcgggaagcaaaccattcactggaccgccggcgcgaggatcgtttccgaccctgctgaaaaggccgttagtgcagcaagcgagaactggcttttgaacaccatcttcccggtgatcaatgcggcgacgagcgaactgcacatcatctccccttatttcatcccgggagctcagggggtcgttgctctgcaaaagctggcggctgccggcacggaggtatccgtgctaacgaattcgctcgcggcgacggatgtcgtggccgtgcacggcgcttatgcgaattatcggctggcgctgctggccgccggtgttagtctctacgaactgcgtccggaaatcatccgtcaaggtgtctccctgttcggatcgagcggcgccagcctgcataccaaagccttcaccgtcgacggcaagtcgggcttcatcggctcgttcaatttcgattcgcgttcgatatcgctcaacaccgagatgggcgtgctgttcgatgatccgggcctgacaaccgaggtgaacggggtgttcgctgatcagatctcgcccgaaagcagctacagggtcatgccgagaacgggaaacgttgtctggcaggatggaaccggagcgagcgcgaggatccttgattccgagcctgcggcaagcatctggcgacgcatcaccgctgtcgttatcggcctgttgccgatcgagtctcagttgtaa

SEQ ID NO: 14682 - protein, 517 aa, Nitrobacter hamburgensis X14
MQLLSIIAVVVALFALASLAAVYSYGRFARQARGEPSSALPIAERDTLLDRIVSPKLKEYPDKSGLLLVTSNLQAFAIRALAARSAERSLDLQYYYWKDDLTGGLLARELIAAADRGVRVRVLLDDINTKGDDSTYLALDNHPNVEIRLFNPSRSRTSALRRGIEMALRAFSVTRRMHNKAWIADGRMAIVGGRNIGDAYFDAAEMSNFHDMDLVLIGPAVQQAETVFDDYWNSSVVLPISSLWRFRKGDLRKKRAYLEALVSSDGARPYLRRLQAENSTGSLLSGKQTIHWTAGARIVSDPAEKAVSAASENWLLNTIFPVINAATSELHIISPYFIPGAQGVVALQKLAAAGTEVSVLTNSLAATDVVAVHGAYANYRLALLAAGVSLYELRPEIIRQGVSLFGSSGASLHTKAFTVDGKSGFIGSFNFDSRSISLNTEMGVLFDDPGLTTEVNGVFADQISPESSYRVMPRTGNVVWQDGTGASARILDSEPAASIWRRITAVVIGLLPIESQL

SEQ ID NO: 14683 - DNA, 1428 bp, Paracoccus denitrificans PD1222
  CDS (1)..(1428): transl_table=11
atgtggaccgaagcgcttgtgttcatgcattacgcagccgcgctggccgtttcggcccgcgtgctgctgcgtccgcggcttgagccgacggttcgcctgtcctggatcctggtgatcgagctggtgccgctggtcggcatcctggcctatgtgctgttcggcgagatccgcatgcgcggcgccgaggtcgagaccatggccaatgtccgctcgcgcctgtccggcctgtggcagcccagccccgaagagctgaagatgctgccggatttcgccgcgcccgtcatcaaggcgaatcacgccacgaccggctttgccgccgttgccggcaaccgcgccgcgctgctgcccgaggacgacagcgccatcactgccctggccgaggccatcgacggcgcgaccgagcacgtccacatgctgttctatatctggctggacgatgcctcgggccgcgccgtggccgatgccgcgatccgtgccgccgggcgcggcgtcaaggtgcgggcgatcatcgacgccttcggctcgcgcgccttcggccgctcggaaccctgggcgcggatgaaggcggcaggcgtggaatgcgtcgaggcgctgccgctgagcatcccggtgatcggcgggcttttccagcgcatggacctgcgcaatcaccgcaagatcgtcgtgatcgaccatgtgctgggctttaccggcagccgcaactgctcggaccgcgcctttgcgatcaagccgcgctatgcgccctggatcgacgtcttcctggccatcgaggggccggtggtgcgccagatgcaggcggtcttcctgcaggactggatgagctatacgggtgaggatctgggcgagatgctgcgcatgacccgtcccgtcaccgccccgggcgaggtggcgcaggtcgtcgccaccggcccggacgaacgcctgggctcgctgtcggattgcatggcgacgatgatccatgcggcgcgcgagcggctggtcatcaccacgccctattacgtccccgacgcctcgcttgattcggcgatccgcacggcggcgcggcggggcgtggacgtgaccgtgatcctgccccagcgcaacgattcgctggtggtgcaggccacctccgaggggttctattacgggttggtctcggccggggtgaagctgatgctgttcaaggacggcctgctgcattccaagatcatcaccgtggacgggcgcatggcgatgctgggcagcgccaacatggaccgccgcagcttcgagctgaactacgagatgaacatgctgtttctgggcggcgacgtcaccgagcggctggacgaacgccagcagggctatatcggccgcgcccgcccgatccatctggacgagatccggggctggtcggtcctgcggcggctgcgcaacaaccttctggcgctggcggcgccgatcctgtga

SEQ ID NO: 14684 - protein, 475 aa, Paracoccus denitrificans PD1222
MWTEALVFMHYAAALAVSARVLLRPRLEPTVRLSWILVIELVPLVGILAYVLFGEIRMRGAEVETMANVRSRLSGLWQPSPEELKMLPDFAAPVIKANHATTGFAAVAGNRAALLPEDDSAITALAEAIDGATEHVHMLFYIWLDDASGRAVADAAIRAAGRGVKVRAIIDAFGSRAFGRSEPWARMKAAGVECVEALPLSIPVIGGLFQRMDLRNHRKIVVIDHVLGFTGSRNCSDRAFAIKPRYAPWIDVFLAIEGPVVRQMQAVFLQDWMSYTGEDLGEMLRMTRPVTAPGEVAQVVATGPDERLGSLSDCMATMIHAARERLVITTPYYVPDASLDSAIRTAARRGVDVTVILPQRNDSLVVQATSEGFYYGLVSAGVKLMLFKDGLLHSKIITVDGRMAMLGSANMDRRSFELNYEMNMLFLGGDVTERLDERQQGYIGRARPIHLDEIRGWSVLRRLRNNLLALAAPIL

SEQ ID NO: 14685 - DNA, 1569 bp, Pseudomonas fluorescens
  CDS (1)..(1569): transl_table=11
ttgaaccctatacaggccttcacctggcttctgctgctgagcctcgggctgggcggctgcgctacccgcgaggtcccgtaccaacccagccaggccctgcccgcccgtgattcgggctttgcccagtcgatccgggcccaggccgcgccctaccaggggcgttccggctttcgccttctacccaacagcaccgaagcgttcatggcccgtgccgagctgatccgcaacgcgcaaagcagcctcgacctgcagtactacatcgtccacgacggcatcagcacccgcatgctggtggacgagctgctcaaggccgccgatcgtggcgtgcgggtacgcatcctgctggacgacaccaccagcgacggcctggaccagatcatcgccaccctggccgcccatccgcagatccagatccgcctgttcaaccctctgcacctgggccgcagcactggcctgacccgggccatgggccgcctgttcaacctgtcgcagcagcataggcggatgcacaacaagctctggctggcagacaacagcgtggccatcgtcggcgggcgcaacctgggggatgaatacttcgacgcccagcccaacctgaacttcaccgacatcgacatgttcagcgtggggccggtggccgagcaactgggccacagcttcgaccagtactggaacagcgccctgagccgccccatcggcgagttcctgtccagcacaccttccgccaaggcgctggacaacacccggctgcgcctcgaggaatccttgcaggacagccgccggcagaaccaggcgctgtaccggcaactgatgacctaccagacccagccgcgcatggacatctggcgcaaggaactgatctgggcctggaaccaggccctgtgggacgctccggccaaggtcctggccaagggtgaccccgacccgcacctgctgctcaccacccagctggcaccggaactgagcggggtcggcaaggagctgatcatgatctcggcctacttcgttccggggcagcccgggctggtgtacctgaccgggcgcgcggacgccggggtctcggtgagcctgttgaccaactccctggaagccaccgacgtgccagtggtgcatggcggctatgcgccctatcgcaaggcattgctggaacatggagtgaagctctacgaactgcgccgacaacccggcgagcgcggtggcagcgggccgcacctgttccacagcggctcctacaagggctccgactccagcctgcacagcaaggcgatgatcttcgaccgacgaaagagcttcatcggctcgttcaacttcgacccccgttcggtgctgtggaacaccgaggtcggggtgctggtggacagccccgagctggctgaacatgtccgcgccctggccctgcaggggatggcgccggccctgagctaccaggtcaagctgctggacggcaagctggtctgggtgaccgaggaccagggccagttgcacagcctgggccatgaacccggcaactggtggcgccgcttcaatgcctggctgagcacccgcatcggcctggaacgcatgctctga

SEQ ID NO: 14686 - protein, 522 aa, Pseudomonas fluorescens
MNPIQAFTWLLLLSLGLGGCATREVPYQPSQALPARDSGFAQSIRAQAAPYQGRSGFRLLPNSTEAFMARAELIRNAQSSLDLQYYIVHDGISTRMLVDELLKAADRGVRVRILLDDTTSDGLDQIIATLAAHPQIQIRLFNPLHLGRSTGLTRAMGRLFNLSQQHRRMHNKLWLADNSVAIVGGRNLGDEYFDAQPNLNFTDIDMFSVGPVAEQLGHSFDQYWNSALSRPIGEFLSSTPSAKALDNTRLRLEESLQDSRRQNQALYRQLMTYQTQPRMDIWRKELIWAWNQALWDAPAKVLAKGDPDPHLLLTTQLAPELSGVGKELIMISAYFVPGQPGLVYLTGRADAGVSVSLLTNSLEATDVPVVHGGYAPYRKALLEHGVKLYELRRQPGERGGSGPHLFHSGSYKGSDSSLHSKAMIFDRRKSFIGSFNFDPRSVLWNTEVGVLVDSPELAEHVRALALQGMAPALSYQVKLLDGKLVWVTEDQGQLHSLGHEPGNWWRRFNAWLSTRIGLERML

SEQ ID NO: 14687 - DNA, 1158 bp, Pseudomonas fluorescens
  CDS (1)..(1158): transl_table=11
atgcgcgcagcggtgttcccctggcgcgaaggcaaccgcttcgagttgctgatcgacggcccgcagttcttcccgcggatgctggtggccattgcccgcgcccagcaccaggtggaactggagctgtacctggtggaagccgggacctgcgccgaggccatggtccaggccctggtgcaggcagcgcagcgcggggtacgggtgcgctgcctgttcgacgactacggcagcctggcctttacccaggccctgcgccgcagcctgaccgaggccggtgtcgaactgcgcttctacaaccggctgaaatggcgccagggctttctcaacctgtaccgcgatcatcgcaagctgctgctggtggacaaggccctggcggtggtgggcggcaccggagtcaccgatgagttctggaagcccgaggacaatagctgcgactggcatgaggtgatggtggagattgccggccccatggtcagcgactggcagcagctgttcgaccggcaatggagcgccaacctgtatagcggggcctggaagcccggtgccgatttcggcctgccacgcctgccgcgcctgcccgataccggcgagggcatgggccgggtggcctacgccgacgcccgtcagcaccgcgacatcctgcattcgctgatccgggccctgagcagcgggcagcggcgcatctggctggcgactccgtattttctgcccacctggtcggtgcgccgttcgttgcgcaaggcggcggcccgaggcctcgacgtacgcctgctgctgaccgggccgcgcaccgaccacccggcggtgcgctatgccgggcaccgctactacccgcgcctgctcaaggccggtgtgcggattttcgagtaccagccgcgtttcctgcacctgaagatggcactggtggacgactgggtgagcgtgggctcgtgcaacttcgaccactggaacctgcgcttcaacctggaagccaatctggaagccctggaccctgcgttgacccaggcagtggtggcgagttttgacgccgactttgcccagagcgaggaagtcagcctggcggtgtggcgcaagcgaccgctgtggcggcggatcaagcagcggatctggggttgggtcgaccgtctggtggtcaacctgctggatcggcgcggctga

SEQ ID NO: 14688 - protein, 385 aa, Pseudomonas fluorescens
MRAAVFPWREGNRFELLIDGPQFFPRMLVAIARAQHQVELELYLVEAGTCAEAMVQALVQAAQRGVRVRCLFDDYGSLAFTQALRRSLTEAGVELRFYNRLKWRQGFLNLYRDHRKLLLVDKALAVVGGTGVTDEFWKPEDNSCDWHEVMVEIAGPMVSDWQQLFDRQWSANLYSGAWKPGADFGLPRLPRLPDTGEGMGRVAYADARQHRDILHSLIRALSSGQRRIWLATPYFLPTWSVRRSLRKAAARGLDVRLLLTGPRTDHPAVRYAGHRYYPRLLKAGVRIFEYQPRFLHLKMALVDDWVSVGSCNFDHWNLRFNLEANLEALDPALTQAVVASFDADFAQSEEVSLAVWRKRPLWRRIKQRIWGWVDRLVVNLLDRRG

SEQ ID NO: 14689 - DNA, 1485 bp, Staphylococcus haemolyticus
  CDS (1)..(1485): transl_table=11
atggtagaaatatactcaatgtctttcacgcattcctcattgattattaatatcattttaattgctgcctttatattaaacttaatttttgcgtttgttattatctttatggagcgccgtagtgctggttcaatatgggcttggctacttgttttagtatttttaccaattatagggtttattttatatttactattaggacgccaaattcaacgcaatcgtatttttaaattgaaaaaagaagaccgtaaaggccttgctatgattgtcgatgaacaaattgaagcattagaaagcgacgatttctcaaaaggtaatcatcaaattgttaagtttaaagaaatggtacgcatgttactttttaacaatgctgcattccttactactgataatcaaaccaagatttatactgatggccatgcaaaatttgatgcattattaagtgatattaaaaatgcaaaagattatatacatattcaatactatattttcaaaagtgatgaattaggtcatcgaattctctcagcacttgaggataaacttgatgagggcttagaagttaaaatgttatacgatgatatgggatcaagaactctaagaaaaaaagatttaaaacactttcgtcaaaaaggtggacatgttgaatctttctttccttctaaactcccacttataaacctacgtatgaataaccgaaaccatagaaaaatagttattattgacggtaaaattggttatgttggtggttttaatgtaggcgacgaatatttaggtaaagataaaaaatttggatattggcgagacactcatttgcgattagaaggagattctgtaaacgcacttgaactgagatttatattagattggaactcacaatcaaaccgtgattcaatcgaatatgaagatcgctattttcctgatgtagactctggtggaacaataggtgtacaaattgcctcaagtggtcctgatgaagattgggagcaaatcaaatatggttatttgaaaatgatttcttcagctaaacaatctatttatattcaatcaccctattttattcctgatcaagccttcattgatgcaattaaaatagcagctttaggtggtgtagaggtaaatatcatgattcctaataaacctgatcatccttttgtttattgggctaccttaaaaaacgcagcttctctattatcagctggcgtgaaaatctatcattatgataatggtttcttacactccaaaacattaattattgatgatgaaattgcttcagtaggtactgccaacatggataatcgtagttttacattgaactttgaagtaaacgcattcatctatgatgaagcaattgcagcgcaactaaaagaagcatttattcaagatatgaaagtatcttaccgactcactgaagacttatataataaacgaagcctgtggattaaatttaaagaaggtatatctcaattactttcacctattctatag

SEQ ID NO: 14690 - protein, 494 aa, Staphylococcus haemolyticus
MVEIYSMSFTHSSLIINIILIAAFILNLIFAFVIIFMERRSAGSIWAWLLVLVFLPIIGFILYLLLGRQIQRNRIFKLKKEDRKGLAMIVDEQIEALESDDFSKGNHQIVKFKEMVRMLLFNNAAFLTTDNQTKIYTDGHAKFDALLSDIKNAKDYIHIQYYIFKSDELGHRILSALEDKLDEGLEVKMLYDDMGSRTLRKKDLKHFRQKGGHVESFFPSKLPLINLRMNNRNHRKIVIIDGKIGYVGGFNVGDEYLGKDKKFGYWRDTHLRLEGDSVNALELRFILDWNSQSNRDSIEYEDRYFPDVDSGGTIGVQIASSGPDEDWEQIKYGYLKMISSAKQSIYIQSPYFIPDQAFIDAIKIAALGGVEVNIMIPNKPDHPFVYWATLKNAASLLSAGVKIYHYDNGFLHSKTLIIDDEIASVGTANMDNRSFTLNFEVNAFIYDEAIAAQLKEAFIQDMKVSYRLTEDLYNKRSLWIKFKEGISQLLSPIL

SEQ ID NO: 14691 - DNA, 1515 bp, Listeria monocytogenes
  CDS (1)..(1515): transl_table=11
atgcgcaaactgattcaatttctgtttatagcagtagttttatttttagtggaatatgttttaatcaatcaagcagctatattattcttagtaacaagtgggattatccaactatgcggggttattatcgccattcgactactcctatttgaccaacggaatactagctcaaaagtcgcctgggttgcggttatttttattttgcctgtactcggaacgattagttaccttgtgttcggtagaaatccagcaactagaaaattcagcacagctcaagtaaaggaaaaaacaaaattaattaatgcgattcatgcaattccaaacaacactaatgaaaaattgccacgactatcaaaaagaatagcgcatttaacgtccatagagccaatcaaggggaataaaatcgaaatattaacaaatggtgaggaaacttttccagtgctcctagacgcgcttagaaaggctgaaaaccacattcacattcaatattacattttcaaaacggatgcgatttctactgaaattcgtgatattttggtggaaaaggcgaaatctggtgttgaggttagatttatgtttgatggtctcggatcaagcaaactgggtaaagcctttttagctcctttgaaagaggctggagttagtattcacgcatttgatccaattgcctccccctggattgtaagaacagccaatttaagaaatcaccgtaaaatcgtggtgattgatggccaaattggctttacaggtgggcttaatattggggaagaatatcgttccaatacacctgattttcgtgtttggcgcgatacacacataaaaataacaggccaagctgtaatcgaactccaagaatccttcctaaacgattgggtatacatggaaaatcaagctggcgccgctgacgggtttattagcgaatctggttcaaaacaatatttttctccagtcgatatgggtgatgaatgggctcaagttatttacggcggaccatatgataaagaaaaatgggttcgggattcgatgcttgatttgattgattccgctaaagaatcagtttggattgtatcaccctatttcgttccagatgaggagtcgcttgcggttattcgccgggttgcgatgagtggtgttgacgtgcgggttattattcctggtaaaggcgatcgcgggacttcattccacggaagtaatgcttatgtaaaaacaatgattgaagcaggcgcgaaaatgtatgcttatgccgatgactcttttgttcatgccaaagcaatgcttgtggacggaacacgtgcggctattggaactgccaattttgacgtgcgtagttttagattgaatcatgaattaatggtattcttatatgatgaaagcgaggctatgcatcatttaaaacgtgacttcaaaaaagattttgaagatagccgactatttacgatgaaagatatggaaaacaaaccattattgactcgtataaaagaagttctatccagtttactatcaccaattttataa

SEQ ID NO: 14692 - protein, 504 aa, Listeria monocytogenes
MRKLIQFLFIAVVLFLVEYVLINQAAILFLVTSGIIQLCGVIIAIRLLLFDQRNTSSKVAWVAVIFILPVLGTISYLVFGRNPATRKFSTAQVKEKTKLINAIHAIPNNTNEKLPRLSKRIAHLTSIEPIKGNKIEILTNGEETFPVLLDALRKAENHIHIQYYIFKTDAISTEIRDILVEKAKSGVEVRFMFDGLGSSKLGKAFLAPLKEAGVSIHAFDPIASPWIVRTANLRNHRKIVVIDGQIGFTGGLNIGEEYRSNTPDFRVWRDTHIKITGQAVIELQESFLNDWVYMENQAGAADGFISESGSKQYFSPVDMGDEWAQVIYGGPYDKEKWVRDSMLDLIDSAKESVWIVSPYFVPDEESLAVIRRVAMSGVDVRVIIPGKGDRGTSFHGSNAYVKTMIEAGAKMYAYADDSFVHAKAMLVDGTRAAIGTANFDVRSFRLNHELMVFLYDESEAMHHLKRDFKKDFEDSRLFTMKDMENKPLLTRIKEVLSSLLSPIL

SEQ ID NO: 14693 - DNA, 1485 bp, Salmonella typhimurium
  CDS (1)..(1485): transl_table=11
atgaagaaactgcccggctttacgcaagattacttactcagcaaggcgacgaccctgcctgataaaacacgcctggagcgtgccgttgaaccgctatgcgcgcgccatcccggagagtgcggcattctcgcgctggataacagtctggacgcttttgccgcccgctaccgcctgaccgaaatggcggcgcggacgctggatgtgcagtattatatttgggaagacgatatgtccgggcggctgctcttttcggtactgctgtcggcggcgaagcgcggcgttcatgttcgtctgctgctggatgataacaatacgcctggtctggatgatacgttgcgcttgctggatagccatcctaatatcgaagttcgtctgtttaatcctttctcttttcgtacgctacgcgcgctgggatatttgacggattttgcgcggctgaatcggcggatgcacaataaaagttacactgccgacggcgtagtgacgctggtcggtgggcgcaacatcggcgatgcctatttcggcgctggcgaggagccgctattttccgatctggacgtgatggccattggcccggtggtcaatgatgtcgccaatgattttgaacgttactggcgctgtagttcagtgtcgacattgcagcaagtattatccctttctgagcaggaactgacgcagcgtatcgaacttcccgaatcctggtataacgatgagatcacccgccgttatctgcataagctggaaaccagccagtttatggcggatctcgatcgcggaacgttgccgctgatttgggcaaaaacacgcttgcttagcgatgacccttctaaaggcgaggggaaggcgcagcgccattcgcttcttccgcagcgattatttgacgtgatggggtcgccgacggagcgtatcgacattatttccgcttactttgtccctacgcgcgcaggcgtggcgcagttgcttaatctggtcaggaaaggcgtgaagatcgccatcttaactaactctctggcggccaacgatgtggcggtcgttcacgcagggtacgcgcgctggcgcaagaaattactgcgctatggcgtggagctctacgaactgaaaccgacccgcgaacatgaaaccgccgtacatgatcgcggactcaccgggaactcaggttccagcttacatgctaaaacgttcagtattgatggtagtaaggtgtttatcgggtcgcttaattttgatccccgttcaacgcttttaaataccgaaatgggctttgtcattgaaagtgaaacgctggcgacgcttatccataagcgttttacacagagccaacgcgatgcggcctggcaactgcggctggatcgctggggacgaattaactggatcgatcgtcagcaagaagaggaaaaggtgttaaagaaagaacccgctacgcgtttctggcaacgagttctggtacggttggcggcaattttacctgtggaatggttgctgtga

SEQ ID NO: 14694 - protein, 494 aa, Salmonella typhimurium
MKKLPGFTQDYLLSKATTLPDKTRLERAVEPLCARHPGECGILALDNSLDAFAARYRLTEMAARTLDVQYYIWEDDMSGRLLFSVLLSAAKRGVHVRLLLDDNNTPGLDDTLRLLDSHPNIEVRLFNPFSFRTLRALGYLTDFARLNRRMHNKSYTADGVVTLVGGRNIGDAYFGAGEEPLFSDLDVMAIGPVVNDVANDFERYWRCSSVSTLQQVLSLSEQELTQRIELPESWYNDEITRRYLHKLETSQFMADLDRGTLPLIWAKTRLLSDDPSKGEGKAQRHSLLPQRLFDVMGSPTERIDIISAYFVPTRAGVAQLLNLVRKGVKIAILTNSLAANDVAVVHAGYARWRKKLLRYGVELYELKPTREHETAVHDRGLTGNSGSSLHAKTFSIDGSKVFIGSLNFDPRSTLLNTEMGFVIESETLATLIHKRFTQSQRDAAWQLRLDRWGRINWIDRQQEEEKVLKKEPATRFWQRVLVRLAAILPVEWLL

SEQ ID NO: 14695 - DNA, 1530 bp, Bacillus anthracis
  CDS (1)..(1530): transl_table=11
atgaagaaacctatcatccaattactattaatatttacaattgtatctatcgttcctttcctattaaatacatcttatatttcgttatatacatttgtcggcgttctctggtccatcacaattgtaggaatttcattcgttatttttatcgaaaatagatctcctcaaagtaccttagcctggtttttagtattagcacttcttcccgttgtaggtgtgcttttatactctattttcgggcgtagccgttggagaagaaaaaaacatctccatcgttcagaagagcaaagaaagttattccgtgaaatattagaaggaagacgactagagttatcactcaaagtcccattaagtgaacgctctgtccatttaacagaagtcgtacaaaaatttggaggcgggcctgcagcagatagaacgactaccaaacttttaacaaacggagatcaaacattctcagaaattttgcaagcgatcgagcaagcaaaacatcacatacatattcaatactatatttataaatctgatgagattggtacaaaagttcgggatgcgttaatcaaaaaggcaaaagatggtgttattgtacgcttcctttatgatggactcggaagtaatacgttgagaagacggtttttacaacctatgaaagaagctggaattgaaattgttgaatttgatcctattttttcagcttggttacttgaaaccgtcaattatcgtaaccaccgtaaaatcgtcattgtagatggagaaatcggttttactggtggactcaacgtcggtgatgaatatcttggtcgttcaaaaaaatttcccgtttggcgtgacagtcatttaaaagtagaaggaaaagcgctatataaattacaagcaatctttctagaggattggctctatgcatctagtggattgaatacttattcttgggatccatttatgaatagacaatacttccctggtaaagaaatttcaaacgcagaaggtgctgtgcaaattgtagcgagcggaccaagctcagatgataaaagcattcgcaatacattattagctgttatgggctcggcaaaaaaatctatttggattgctacaccctactttattccagatcaagaaactttaacattattacgtttaagtgcaatatctggcatagatgtacgcattttatatcctggtaaaagcgatagtattattagtgaccaagcatctcagtcctacttcactccacttttaaaagctggtgcctccatttatagttataaagatggctttatgcatgcaaaaattttacttgttgatgataaaatcgcaacaatcggaacagcaaatatggacgtacgcagctttgaattgaattacgaaattattagcgtactgtatgaatcagaaactgttcatgatattaaacgtgattttgaagatgactttaagcattctactgaaattaaatggaacgctttccaaaagagaagtatcaaaaaacgaatattagaatcttttatgaggctcatttctcctttactataa

SEQ ID NO: 14696 - protein, 509 aa, Bacillus anthracis
MKKPIIQLLLIFTIVSIVPFLLNTSYISLYTFVGVLWSITIVGISFVIFIENRSPQSTLAWFLVLALLPVVGVLLYSIFGRSRWRRKKHLHRSEEQRKLFREILEGRRLELSLKVPLSERSVHLTEVVQKFGGGPAADRTTTKLLTNGDQTFSEILQAIEQAKHHIHIQYYIYKSDEIGTKVRDALIKKAKDGVIVRFLYDGLGSNTLRRRFLQPMKEAGIEIVEFDPIFSAWLLETVNYRNHRKIVIVDGEIGFTGGLNVGDEYLGRSKKFPVWRDSHLKVEGKALYKLQAIFLEDWLYASSGLNTYSWDPFMNRQYFPGKEISNAEGAVQIVASGPSSDDKSIRNTLLAVMGSAKKSIWIATPYFIPDQETLTLLRLSAISGIDVRILYPGKSDSIISDQASQSYFTPLLKAGASIYSYKDGFMHAKILLVDDKIATIGTANMDVRSFELNYEIISVLYESETVHDIKRDFEDDFKHSTEIKWNAFQKRSIKKRILESFMRLISPLL

SEQ ID NO: 14697 - DNA, 1530 bp, Bacillus cereus
  CDS (1)..(1530): transl_table=11
atgaagaagcctatcgttcaattactattaatatttacaattgtatctatcgttctgttcctattaaatacatcgtatatctcgttatatacatttgtcggtgctctatggtccatcacaatcgtaggaatttcattcgttatttttatagaaaatagatctccacaaagtacattagcatggtttttagtattagcacttcttcctattataggtgtgcttttatacgctattttcggacgcagccgctggagaagaaaaaaacatctccatcgttcagaagaacaaagaaaattattccgtgaaatattagaaggaagaagactagagttattactcacagtcccactaaatgaacgttccatacatttaacagaagtcatacaaaaatttggaggcggtcctgccgcagatagaacaactacaaaacttttaacaaacggagatcaaacattttcagaaattttgcgagctatagagcaagcaaaacatcatatacatattcaatactacatttataaatctgatgaaattggtacaaaagttcgagatgctttaatacaaaaagcaaaagatggtgttattgtacgcttcctttatgatggccttggaagtaatacgttaagaagacgatttttacaacctatgaaagaagctgggattgaaattgtagaatttgaccctattttttcagcttggttacttgaaactgtcaattatcgtaaccatcgaaaaattgttattgtagatggcgaaattggttttaccggaggactcaatgtcggtgatgaatatcttggccgttccaagaaatttcctgtttggcgtgatagtcatttaaaaatagaaggaaaagcattatataaattacaagcaatctttctagaagactggctctatgcctctagtggtttaaatacttattcctgggatcaattcatgaatagacaatacttcccaggtaaagagatttcaaatgcagaaggtgctgttcaaatcgtagcaagcggaccaagctccgatgataaaagtattcgtaatacattattagctgttatgggctctgcaaaaaaatccatttggatcgctacaccctactttattccagatcaagaaactttaacattattacgcttaagtgcaattgccggaatagatgtacggattttatatccaggtaaaagtgatagcatcattagtgatcaagcatctcaatcctatttcactccgcttttaaaagctggtgcttctatttacagttataaagatggttttatgcatgcaaaaattgtactcgttgatgatacaattgcaactattggaacagcgaacatggatgtacgtagctttgaattgaattacgaaattattagtgtactttatgaatcaaaaacagttcacgatattaaacgtgattttgaagaagattttaaacattcaactgaaattaaatggaactctttccaaaaaagaagtataaaaaaacgcatattggagtctttcatgaggcttatttctcctttactgtag

SEQ ID NO: 14698 - protein, 509 aa, Bacillus cereus
MKKPIVQLLLIFTIVSIVLFLLNTSYISLYTFVGALWSITIVGISFVIFIENRSPQSTLAWFLVLALLPIIGVLLYAIFGRSRWRRKKHLHRSEEQRKLFREILEGRRLELLLTVPLNERSIHLTEVIQKFGGGPAADRTTTKLLTNGDQTFSEILRAIEQAKHHIHIQYYIYKSDEIGTKVRDALIQKAKDGVIVRFLYDGLGSNTLRRRFLQPMKEAGIEIVEFDPIFSAWLLETVNYRNHRKIVIVDGEIGFTGGLNVGDEYLGRSKKFPVWRDSHLKIEGKALYKLQAIFLEDWLYASSGLNTYSWDQFMNRQYFPGKEISNAEGAVQIVASGPSSDDKSIRNTLLAVMGSAKKSIWIATPYFIPDQETLTLLRLSAIAGIDVRILYPGKSDSIISDQASQSYFTPLLKAGASIYSYKDGFMHAKIVLVDDTIATIGTANMDVRSFELNYEIISVLYESKTVHDIKRDFEEDFKHSTEIKWNSFQKRSIKKRILESFMRLISPLL

SEQ ID NO: 14699 - DNA, 1503 bp, Bacillus subtilis
  CDS (1)..(1503): transl_table=11
atgctgaaaaggagactggaatttttctttttatatatgatgctcatcggggcatatgtcatttggttttttccggtttccagacttgagttttacggaggattgctttgctatataagcattattttgttcagcatctattcattaattcttgaaaaccgcacctcgcagcacacgctgctatggatccatattcttgtcttttttccaatcgtcggctacgtgttttatctgttttcgggacagctttatgtaaagggaaagctgtttaagacaaaacgaatgtacaacagggaaaagctcaggaagctgtttgacaaggaggaaacgcccgaagtgacagggctgaaggacaatcaagagaggttctttacatattccatcagggctgcccatatgaatatcaatacgaaaagcaacatcaaagtgctgaaaaacggcgaagaaaccttcccggacattttcaaagcaatgagaaaagcggaatcttacatacatattgaatactacatgtttaaatcagacatgctcggacgcggcatgatggatattatgatggagaaagcgcgccagggtgtcgaggtgaggtttttatacgatgcggcaggaagcatgaagctggcaagaagagatattatgagaatgaaacaagcgggggtggacatcgtcccgttttctccgctgaaatacgggtttttcaaccagaagctgaatttcagaaatcaccggaaaatcgtgatcatcgatgggaaaaccggttttgtgggtggattaaatgtcgggaaggaatatatcagcagagatccgtacatcggattttggagagatacacacctgcggcttgagggggaaattgtgcaaacgctccacgctatctttatgctggattgggaatatgtctccaatgaagtgctaattgatcaagaggagtacaataccccggttcccgtggaaggaggaggcatttatcaaattgtcgcgacaggccctgacatgaaggaaagcatgagcgacctttattatgaaatgatttcttcagcgcagaaatcaatatggatcgccacgccctattttgtccccaatgaatccattcgcacggcgctaaaagcagcggcgacaaagggggtagaggtaagggttatggtgccggagaagaacgacagctttttgacccaatacgcgtcgaggtcctatttcccggagctgctccttgagggcattgaagtgtactcctaccaaaaaggcttcatgcatcaaaaagtcatgatcattgatggcgatctcgcctccgtcggtaccgcgaatatggacatgcgcagctttcagctcaactttgaagtgaatgtgttcttcacggatgccgaagcgatccgaacccttgaggcccattttgaagaggatatgcaggaaagtgaaaagctcagccctgtcggcttttataaaagaggtgtggctgaccggacaaaagagtcgtttgcccgcctgttttcaggtgttctgtaa

SEQ ID NO: 14700 - protein, 500 aa, Bacillus subtilis
MLKRRLEFFFLYMMLIGAYVIWFFPVSRLEFYGGLLCYISIILFSIYSLILENRTSQHTLLWIHILVFFPIVGYVFYLFSGQLYVKGKLFKTKRMYNREKLRKLFDKEETPEVTGLKDNQERFFTYSIRAAHMNINTKSNIKVLKNGEETFPDIFKAMRKAESYIHIEYYMFKSDMLGRGMMDIMMEKARQGVEVRFLYDAAGSMKLARRDIMRMKQAGVDIVPFSPLKYGFFNQKLNFRNHRKIVIIDGKTGFVGGLNVGKEYISRDPYIGFWRDTHLRLEGEIVQTLHAIFMLDWEYVSNEVLIDQEEYNTPVPVEGGGIYQIVATGPDMKESMSDLYYEMISSAQKSIWIATPYFVPNESIRTALKAAATKGVEVRVMVPEKNDSFLTQYASRSYFPELLLEGIEVYSYQKGFMHQKVMIIDGDLASVGTANMDMRSFQLNFEVNVFFTDAEAIRTLEAHFEEDMQESEKLSPVGFYKRGVADRTKESFARLFSGVL

SEQ ID NO: 14701 - DNA, 1482 bp, Staphylococcus aureus
  CDS (1)..(1482): transl_table=11
atgcaattttcattttcaaacgatttaggaacgttatttactattattttagccattggattcatcattaatttagtattagcttttattattatctttttagaaagaaataggcgtacagcgagttcaacttgggcatggctatttgtactttttgtcttacccttgattggttttattctttacttgttttttggtagaaccgtttcggcacgcaaattgaataaaaacaatggtaacgtgttaacggatttcgatggacttttgaaacaacaaatagaaagctttgataaaggtaattatggtactgataacaaacaagttcaaaaacatcatgatttagtacgtatgcttttgatggatcaagatggttttttaactgaaaataataaagttgatcatttcattgacggtaatgatttatacgatcaagttttaaaagatattaaaaatgcaaaagaatatatccatttagaatactatactttcgctttagatggtttaggtaaaagaattttacatgctttagaagaaaaattgaaacaaggtttagaagtaaaaatattatatgatgatgttggttctaaaaatgttaagatggcaaattttgatcactttaaatcattaggtggcgaagttgaagcattttttgcgtctaaactaccattattaaatttccgtatgaataacagaaatcatagaaaaatcattattattgatggtcaattaggttatgtcggaggatttaacattggagatgaataccttggtttaggtaaactaggatattggagagatacacatttacgaattcaaggagatgcagttgatgcattacaattgcgctttattttagactggaattcgcaagcacatcgacctcaatttgaatatgatgttaagtatttccctaaaaagaacggaccattgggtaattcaccaattcaaatagctgcaagtggcccagctagtgactggcatcaaattgaatatggttatacaaaaatgattatgagcgctaagaagtcggtatatttgcaatcgccttatttcattccggataattcatatataaatgccattaaaattgcagctaaatcaggtgtagatgtacatttaatgattccatgtaagccagatcatcctttagtttattgggcgacattttcaaatgcctctgacttattatcaagtggtgttaaaatttatacgtatgaaaatggatttatacattctaaaatgtgcttaattgatgatgaaatcgtatcagtgggcacagcaaatatggactttagaagttttgaattaaattttgaagtaaatgcctttgtatatgatgaaaatcttgctaaagatttaagggtggcttatgaacatgatattacaaaatcaaaacaacttactgaagaatcatatgccaatagaccgctgtctgttaaattcaaagaatcgttagctaaattagtttcgccaattttataa

SEQ ID NO: 14702 - protein, 493 aa, Staphylococcus aureus
MQFSFSNDLGTLFTIILAIGFIINLVLAFIIIFLERNRRTASSTWAWLFVLFVLPLIGFILYLFFGRTVSARKLNKNNGNVLTDFDGLLKQQIESFDKGNYGTDNKQVQKHHDLVRMLLMDQDGFLTENNKVDHFIDGNDLYDQVLKDIKNAKEYIHLEYYTFALDGLGKRILHALEEKLKQGLEVKILYDDVGSKNVKMANFDHFKSLGGEVEAFFASKLPLLNFRMNNRNHRKIIIIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATFSNASDLLSSGVKIYTYENGFIHSKMCLIDDEIVSVGTANMDFRSFELNFEVNAFVYDENLAKDLRVAYEHDITKSKQLTEESYANRPLSVKFKESLAKLVSPIL

SEQ ID NO: 14703 - DNA, 1473 bp, Staphylococcus epidermidis
  CDS (1)..(1473): transl_table=11
atgaattttggatttttgggtactattttaactatattgttagtagttgggtttataactaacgtagtattggcatttgtcatcatcttccttgaacgtgatcgacgtactgccagttcaacttgggcgtggttattcgtattattcgttcttcctgtcattggatttattttgtatctatttttaggacgaacggtttccaagaaaaagatggaaaaaaataacggtgatgaattaaatgcatttgaagatttagttcaagaccaaatcgacagttttgataaacataattatggttatatcaatgatcaagtcattaaacaccgtgatttaatacgtatgttgttaatgaaacaagatgcctttttaacagaaaataataaaatcgatttatttacagatggtcataagctttatgaaaaagtacttgaggatatttacaatgctcaagactatatacatctagagtactatacctttgaacttgatggattaggtaaaagaatcttagatgcacttgaaactaaacttaaagaaggtttagaagttaaacttttgtatgacgatgttggttctaaaaaggttagattatcaaaatttaaacatttcagagcattaggtggagaagttgaagcatttttcccttcgaaagtacctttaatcaatttcagaatgaataatcgaaatcatagaaagattatcattatagatggacaaattggttacgttggcggttttaatgtcggcgatgattatttaggattaggtaagttaggttactggagagatacacatacacgtgttcaaggtgaaggcatcgatgcactacaattaagatttattttagactggaattcacagtcgcatcgtccacaatttaaatttgatcaaaaatacttccctaaaaaaattggggacaaaggaaacgcggctattcaaatcgcttctagtggacctgcatttgatttacatcaaatagaatatggttatacaaaaatgataatgagcgctaaaaagtctatctatctacaaagcccttactttattccagaccaatcatacattaatgcattaaaaatggctgctaatagcggcgttgaagtcaaccttatgataccgtgtaaacctgatcatccattcgtttattgggctacattttcaaatgcagctgatttattagatagcggagttaatatttacacttatcaaaatggatttattcattctaaaatattaatgattgatgatgaaatttcttcaattggtagtgcaaacatggactttagaagctttgagctgaatttcgaagtgaacgcatttatatatgatgaagatatagctaaacagttacgtcaagcatttgaaaaagatattgagcaatctaaattacttacaaaagaagtatacgacaagcgtccattatcaattaaatttaaagaaggactagcaaaattaatatctccaattttataa

SEQ ID NO: 14704 - protein, 490 aa, Staphylococcus epidermidis
MNFGFLGTILTILLVVGFITNVVLAFVIIFLERDRRTASSTWAWLFVLFVLPVIGFILYLFLGRTVSKKKMEKNNGDELNAFEDLVQDQIDSFDKHNYGYINDQVIKHRDLIRMLLMKQDAFLTENNKIDLFTDGHKLYEKVLEDIYNAQDYIHLEYYTFELDGLGKRILDALETKLKEGLEVKLLYDDVGSKKVRLSKFKHFRALGGEVEAFFPSKVPLINFRMNNRNHRKIIIIDGQIGYVGGFNVGDDYLGLGKLGYWRDTHTRVQGEGIDALQLRFILDWNSQSHRPQFKFDQKYFPKKIGDKGNAAIQIASSGPAFDLHQIEYGYTKMIMSAKKSIYLQSPYFIPDQSYINALKMAANSGVEVNLMIPCKPDHPFVYWATFSNAADLLDSGVNIYTYQNGFIHSKILMIDDEISSIGSANMDFRSFELNFEVNAFIYDEDIAKQLRQAFEKDIEQSKLLTKEVYDKRPLSIKFKEGLAKLISPIL

SEQ ID NO: 14705 - DNA, 1473 bp, Staphylococcus epidermidis
  CDS (1)..(1473): transl_table=11
atgaattttggatttttgggtaccattttaactatattgttagtagttgggtttataactaacgtagtattggcatttgttatcatcttccttgaacgtgatcgacgtactgccagttcaacttgggcgtggttattcgtattattcgttcttcctgtcattggatttattttgtatctatttttaggacgaacggtttccaagaaaaagatggaaaaaaataacggtgatgaattacatgcatttgaagatttagttcaagatcaaatcgacagttttgataaacataattatggttatatcaatgatcaagtcattaaacaccgtgatttaatacgtatgttgttaatgaaacaagatgcctttttaacagaaaataataaaatcgatttatttacagatggtcataagctttatgaaaaagtacttgaggatatttacaatgctcaagactatatacatttagagtactatacctttgaacttgatggattaggtaaaagaatcttagatgcacttgaaactaaacttaaagaaggtttagaagttaaacttttgtatgacgatgttggttctaagaaggttagattatcaaaatttaaacatttcagagcattaggtggagaagttgaagcattttttccttcgaaagtacctttaatcaatttcagaatgaataatcgaaatcatagaaagattatcattatagatggacaaattggttacattggcggttttaatgtcggcgatgattatttaggattaggtaagttaggttactggagagatacacatacacgtgttcaaggtgaagttatcgatgcactacaattaagatttattttagactggaattcacagtcgcatcgtccacaatttaaatttgatcaaaaatacttccctaaaaaaattggggacaaagggaacgcggctattcaaatcgcttctagtggacctgcatttgatttacatcaaatagaatatggttatacaaaaatgataatgagcgctaaaaagtctatctatctacaaagcccttattttattccagaccaatcatacattaatgcattaaaaatggctgctaatagtggcgttgaagtaaaccttatgataccgtgtaaacctgatcatccattcgtttattgggctacattttcaaatgcagctgatttattagatagcggagttaatatttacacttatcaaaatggatttattcattctaaaatattaatgattgatgatgaaatttcttcaattggtagtgcaaacatggactttagaagctttgagctgaatttcgaagtgaacgcatttatatatgatgaagatattgctaaacagttacgtcaagcatttgaaaaagatattgagcaatctaaattacttacaaaaaaagtatacgacaagcgtccattatcaattaaatttaaagaaggactagcaaaattaatatctccaattttataa

SEQ ID NO: 14706 - protein, 490 aa, Staphylococcus epidermidis
MNFGFLGTILTILLVVGFITNVVLAFVIIFLERDRRTASSTWAWLFVLFVLPVIGFILYLFLGRTVSKKKMEKNNGDELHAFEDLVQDQIDSFDKHNYGYINDQVIKHRDLIRMLLMKQDAFLTENNKIDLFTDGHKLYEKVLEDIYNAQDYIHLEYYTFELDGLGKRILDALETKLKEGLEVKLLYDDVGSKKVRLSKFKHFRALGGEVEAFFPSKVPLINFRMNNRNHRKIIIIDGQIGYIGGFNVGDDYLGLGKLGYWRDTHTRVQGEVIDALQLRFILDWNSQSHRPQFKFDQKYFPKKIGDKGNAAIQIASSGPAFDLHQIEYGYTKMIMSAKKSIYLQSPYFIPDQSYINALKMAANSGVEVNLMIPCKPDHPFVYWATFSNAADLLDSGVNIYTYQNGFIHSKILMIDDEISSIGSANMDFRSFELNFEVNAFIYDEDIAKQLRQAFEKDIEQSKLLTKKVYDKRPLSIKFKEGLAKLISPIL

SEQ ID NO: 14707 - DNA, 1545 bp, Bacillus cereus
  CDS (1)..(1545): transl_table=11
atgaaaaatacgttaaagctgattttctttatactgctattgttcgcattatttgtttcgttacgtatgtttattgatgtagcattttattcagatgtgattgggataaaagatgtttcgattttaggtattattagtattttatttacagtatctgcgtttttaattggttgcgttattttcttagaaaatcgacatccatctaaaacacttacatggttaattgttttaggaatttttccggtatttggtttctttgcttatttattattcggacaaaattttcgaagaaaaagaatgttccaaaagaaggcgttacttgatgaacaggcgtttttacaatataaagggcatgaagattacgaagaacgaattttacgcaatcataagcatcaagaactgttatttcgtttagcggatcgattaggagctttaaatatttcatttcaaactgaaacgaggacattaacaaatggagatgaaacgtttcgggctattttaaatgggttaaaacgagcgaaacatcacattcatatggaatattacattgtgcgtgatgataaattaggaacagaaattaaagatattttaatacaaaaatcgaaagaaggcgttgttgttcgctttttatatgatgcggttggaagttttaagttatcgaaatcgtatattgaagaattaaacgatgcaggtgtagaaatgattccattctttcctgtgcgctttccgattttaaacgataagattaattatcgaaatcataggaaaattgttgtgattgatgggaacgaaggatttgtaggcggattaaatatcggtgatgagtatttagggaaaaataaatattttggcttttggcgagatacgcatttgtatttacgtggtgaagcggttcaaagtttacaacttattttccttcaagactggttttatatgactggagaggctgtgctagcccctgaatatttacaagcaaaagcagttgagggtgatcattggggaggagtgcagctagttgcaggtggccccgataataagtgggaaacgattaagcatttatatttcgcaatgatcgcttctgctcggaaatcaatttggattgcaacgccgtattttattccggatgatgatattttatccgcattaaaggttgctgcacttgctggtattgatgttcgtttattaatgccgagtaaaccggataagcgtactgtcttttacgcatcgagatcgtacttcccagagcttttagatgcaggagtaaagatatatgaatacgaaaaaggttttcttcatagtaaaattgtcatcgttgattctgatttagcttcaattgggacagctaatatggatatgagaagttttcatttgaattttgaagtaaatgcctttttatatgatacagatagcattcgaaaacttgttcaagactttaaagatgatttagaagaatcaagtgaaattcatggtgatcattttcataaaagacgtcttcatagacgaattgttgaatcaacgtaccgattattatcacctttattataa

SEQ ID NO: 14708 - protein, 514 aa, Bacillus cereus
MKNTLKLIFFILLLFALFVSLRMFIDVAFYSDVIGIKDVSILGIISILFTVSAFLIGCVIFLENRHPSKTLTWLIVLGIFPVFGFFAYLLFGQNFRRKRMFQKKALLDEQAFLQYKGHEDYEERILRNHKHQELLFRLADRLGALNISFQTETRTLTNGDETFRAILNGLKRAKHHIHMEYYIVRDDKLGTEIKDILIQKSKEGVVVRFLYDAVGSFKLSKSYIEELNDAGVEMIPFFPVRFPILNDKINYRNHRKIVVIDGNEGFVGGLNIGDEYLGKNKYFGFWRDTHLYLRGEAVQSLQLIFLQDWFYMTGEAVLAPEYLQAKAVEGDHWGGVQLVAGGPDNKWETIKHLYFAMIASARKSIWIATPYFIPDDDILSALKVAALAGIDVRLLMPSKPDKRTVFYASRSYFPELLDAGVKIYEYEKGFLHSKIVIVDSDLASIGTANMDMRSFHLNFEVNAFLYDTDSIRKLVQDFKDDLEESSEIHGDHFHKRRLHRRIVESTYRLLSPLL

SEQ ID NO: 14709 - DNA, 1449 bp, Bacillus subtilis
  CDS (1)..(1449): transl_table=11
gtgagtatttcttccatccttttatcactttttttcattttaaatattcttttggccatcattgtcatcttcaaagaacggcgcgatgccagtgcatcttgggcgtggctgcttgttcttttctttattcccgttttaggctttattttatacttattattcggccataatctcagacgcaagcatttgtttcaatgggaagaccggaaaaagattggaattgaaaggctgctgaagcatcagcttgaagatttagaaaccaagcaatttcagtttaacaaccgggcaacctttgataacaaagatttaatttatatgctgattatgaataaccatgctgtgtttacagaggataattcagttgacgtcattacagatggacgggataaatttcagcggctgctgagtgacatttcaaaggctaaggatcatatccatttacagtattatatttataaaggcgatgaattaggcaaaaaattgcgggacgctctcatccaaaaggcgaaagaaggtgttcaggtcagagtgctttatgatgaactcgggtccagaacgctgagaaaaaagttttttaaagagcttcgcgaggctggcgggcatgtggaggtctttttcccgtcaaagctcaggccgattaacctgcggctgaattaccggaaccatcgaaagcttgtgatcatagacggtatgaccggttatgtcggaggctttaacgtcggagatgagtatctagggcttaatccgaaattcggttattggcgggatacgcatatccggctgcaaggaacggccgtgcacgccatccaaacacgattcatccttgactggaaccaagcttctcatcaccatacgctgacatatattccaaatcactttcctgattacggcccaaaaggcaacgtcgggatgcagattgtcacaagcggccctgattcggaatgggaacaaattaaaaatggctacatcaaaatgatttcgaacgccaagcgttccattttgatacaaacaccttattttatcccagatgcaagcctgctggatgctttaaggatcgcttgcctttcgggcattgacgttaacattatgattccgaacaagcccgatcacgcctttgtatactgggcgacactttcgtatatcggcgatctgctgaaagccggagccactgtctatatttacgataacggctttattcacgcgaaaaccatcgtggtggatgacgaaatcgcttcagtcggcacagcgaacattgatgtccgaagcttcaggctgaattttgaggttaatgcatttatttacgatatcaccattgctaaaaaactggtttcaacttttaaagaagatttgctagtatccagaaaattcacctatgaggagtatctgcagcgcccgttgtggattcgaataaaagaatccgtctcgcggctgttgtcgccgatcttataa

SEQ ID NO: 14710 - protein, 482 aa, Bacillus subtilis
MSISSILLSLFFILNILLAIIVIFKERRDASASWAWLLVLFFIPVLGFILYLLFGHNLRRKHLFQWEDRKKIGIERLLKHQLEDLETKQFQFNNRATFDNKDLIYMLIMNNHAVFTEDNSVDVITDGRDKFQRLLSDISKAKDHIHLQYYIYKGDELGKKLRDALIQKAKEGVQVRVLYDELGSRTLRKKFFKELREAGGHVEVFFPSKLRPINLRLNYRNHRKLVIIDGMTGYVGGFNVGDEYLGLNPKFGYWRDTHIRLQGTAVHAIQTRFILDWNQASHHHTLTYIPNHFPDYGPKGNVGMQIVTSGPDSEWEQIKNGYIKMISNAKRSILIQTPYFIPDASLLDALRIACLSGIDVNIMIPNKPDHAFVYWATLSYIGDLLKAGATVYIYDNGFIHAKTIVVDDEIASVGTANIDVRSFRLNFEVNAFIYDITIAKKLVSTFKEDLLVSRKFTYEEYLQRPLWIRIKESVSRLLSPIL

SEQ ID NO: 14711 - DNA, 1485 bp, Staphylococcus aureus
  CDS (1)..(1485): transl_table=11
atgatagagttattatccattgcactcaagcattctaatattattttaaattccatatttattggtgcatttattttaaacttattattcgcctttaccattattttcatggaaagacgttctgccaattctatctgggcttggttactagtcttagttttcttgcctttattcggcttcattttatacttactattaggacgacaaattcaacgcgaccaaattttcaaaattgataaggaagataaaaaaggattagagttaatcgttgatgagcaattagccgctttaaaaaatgaaaacttttcaaattccaattatcaaattgtaaaatttaaagaaatgattcaaatgttgttatataataacgcagcatttttaacaacagacaacgatttaaaagtatacacagacggccaagaaaaatttgatgacttaatacaagacatccgtaatgctactgattatattcattttcagtactatattattcaaaatgatgaattaggtcgtaccattttaaatgaacttggaaaaaaagcggaacaaggtgtagaagttaaaattctttatgatgacatgggttctcgtggactgcgtaaaaaaggcttacacccgtttcgcaataaaggtggacatgctgaagcatttttcccatcaaaattacctttaattaacttgcgtatgaacaatcgaaaccatcgaaaaattgttgtaatagatggacaaattggatatgttggtggttttaatgttggtgatgagtacttaggtaaatcaaaaaaattcggctattggcgagatacgcatttacgaattgtcggggatgcagtgaatgcattgcaattacgatttattctagattggaattcacaagccacacgtgaccacatctcctatgatgatcgttatttcccagatgtaaattctggcggaacgattggcgtacaaatagcttctagtggtcctgacgaagaatgggaacagattaaatatggttacttgaaaatgatttcatctgctaaaaaatcgatttatattcaatctccctatttcatacctgatcaagcctttttagattctattaaaattgcggcattaggtggtgttgatgtcaatatcatgattcctaataaacctgaccatccgtttgttttttgggctactttaaaaaatgcagcatccttattagatgccggtgttaaagtatttcactacgacaatggctttttacactcaaaaacacttgttatagatgatgaaattgcaagtgttggaacagctaatatggaccatcgcagtttcacgttgaatttcgaagtcaacgcctttatttatgaccaacaaattgccaaaaaattaaaacaagcttttatagatgatttagcagtatcttctgaattaacaaaagcacgttatgctaagcgaagtctttggattaaatttaaagaaggtatttcacaattattgtcacctatcttataa

SEQ ID NO: 14712 - protein, 494 aa, Staphylococcus aureus
MIELLSIALKHSNIILNSIFIGAFILNLLFAFTIIFMERRSANSIWAWLLVLVFLPLFGFILYLLLGRQIQRDQIFKIDKEDKKGLELIVDEQLAALKNENFSNSNYQIVKFKEMIQMLLYNNAAFLTTDNDLKVYTDGQEKFDDLIQDIRNATDYIHFQYYIIQNDELGRTILNELGKKAEQGVEVKILYDDMGSRGLRKKGLHPFRNKGGHAEAFFPSKLPLINLRMNNRNHRKIVVIDGQIGYVGGFNVGDEYLGKSKKFGYWRDTHLRIVGDAVNALQLRFILDWNSQATRDHISYDDRYFPDVNSGGTIGVQIASSGPDEEWEQIKYGYLKMISSAKKSIYIQSPYFIPDQAFLDSIKIAALGGVDVNIMIPNKPDHPFVFWATLKNAASLLDAGVKVFHYDNGFLHSKTLVIDDEIASVGTANMDHRSFTLNFEVNAFIYDQQIAKKLKQAFIDDLAVSSELTKARYAKRSLWIKFKEGISQLLSPIL

SEQ ID NO: 14713 - DNA, 1467 bp, Staphylococcus epidermidis
  CDS (1)..(1467)
atggcacttcatcaatctaatattataattaatattttattagttagtgcctttttattaaatttagtttttgcattcattattattttcatggagaggcgtacagcaaattctatatgggcgtggttattggttttagtttttctacctttagtaggattcatattgtatttattattaggtcgccaaatacagagagaacatatatttaaactcgccaaagaggataaagttggtcttgaaatgattgttgacgagcaattagaggcattgaaaaagcaagacttttctaagggtaatcatcaaattgttaaatttaaagaaatggtacaaatgttactttataataatgctgcttttttaacaactgataatgatctaacaatttatacagatggtcatcagaagttcgatgatttaattaatgatattagacacgcacaatcatatattcacatccaatactacattattcatagtgataatctcggaaagcaattgttacatgaattagaaaaaaaagctgaagaaggtatagaagttaaaatgctatacgacgatatgggctcaagagatttacgaaagaaagatctaaaaaagtttcgtcaaaaaggcggtcacgctgaatctttctttccatcaaaattaccacttattaatttaagaatgaataatagaaaccacagaaaaatagtagtcattgacggtacgattggatatgttggtggttttaatgtaggagatgaatatataggtaaatctaagaaatttggttattggagggacacacacttacgtattaaaggtgacgcggtaaatgcccttcaacttagattcatcttagattggaactcacaatcaactcgtgacaatttaacttatgaatctcgatattttcctgatgttgactctggtggtacgataggcatacaaattgcttcaagtgggcctgatgaagattgggaacaaattaaatatggttatttaaaaatgatttcatcagccaaagaatctatatacattcaatcaccatacttcattcccgatcaagcttttttagattcgattaaaattgcagcgcttggtggtgtggatgttaacatcatggttcctaacaaacgtgatcatccctttgtttattgggctacgcttaaaaacgtagcgtctttacttgaagctggcgttaatgtctatcattatgataatggttttctacattcaaaaacacttgtcattgatgatgaggtagcaagtgtaggaactgccaatatggataatcgaagctttacattaaactttgaggtcaatgcttttatttatgatgaaggcgtagcacgatcattaaaacaagctttcattaatgatatgaaattatctaacaagctcacttctgaagaatatgctaaacgaaatctgctagttaaattcaaagaagggatttcacaactactttctccaattttataa

SEQ ID NO: 14714 - protein, 488 aa, Staphylococcus epidermidis
MALHQSNIIINILLVSAFLLNLVFAFIIIFMERRTANSIWAWLLVLVFLPLVGFILYLLLGRQIQREHIFKLAKEDKVGLEMIVDEQLEALKKQDFSKGNHQIVKFKEMVQMLLYNNAAFLTTDNDLTIYTDGHQKFDDLINDIRHAQSYIHIQYYIIHSDNLGKQLLHELEKKAEEGIEVKMLYDDMGSRDLRKKDLKKFRQKGGHAESFFPSKLPLINLRMNNRNHRKIVVIDGTIGYVGGFNVGDEYIGKSKKFGYWRDTHLRIKGDAVNALQLRFILDWNSQSTRDNLTYESRYFPDVDSGGTIGIQIASSGPDEDWEQIKYGYLKMISSAKESIYIQSPYFIPDQAFLDSIKIAALGGVDVNIMVPNKRDHPFVYWATLKNVASLLEAGVNVYHYDNGFLHSKTLVIDDEVASVGTANMDNRSFTLNFEVNAFIYDEGVARSLKQAFINDMKLSNKLTSEEYAKRNLLVKFKEGISQLLSPIL

SEQ ID NO: 14715 - DNA, 1512 bp, Bacillus halodurans
  CDS (1)..(1512): transl_table=11
atgaaaaatcggttaaacgtcttactctttttattgatcctttcgacaggtttgtaccttacccgttcgttttggcaaggctggattgtcggagcttttagtgtactcattaccatcacggttgtctttataggtatcgttatatttttagaaaaccgtcacccgacaaaaacgttaacatggttaatggtgcttgccgtgtttccagtcgttggcttcatcttttatttgatgttcggacaaaatcatcgaaaaagtaaaacctttatgaaaaaggcattatcagatgaagaggcatttgaaaaaatagagggaaatcgtcagctaaatgaagaacagttacagaaaatgggtggtcatcaacaactgttgtttcgactggctcatcgactagcgaacaatccgatttcattttcaaccaatacgaaagtgctgacagacgggaaagaaacgtttgcccatattaaacaagcgttacgaatggcaacgcatcatattcatctcgaatattatattgttcgtgatgatgaaattggtcaggaaattaaagagatcctaatgcagaaagcgaaggaaggaattcatgtacgttttctttatgacggtgtaggtagctggaagctctctaaatcttatattcaggatctgaagcaggccggagtagagattgttccgtttgcccctgtaaagctaccgtttattaatcatacgatcaattaccgcaatcaccgaaagattatcgtcatcgacggaaccgtgggcttcgtaggtggtttaaatattggcgatgaatatttaggaaaagacccatatttcggattttggcgagatacccatctgtatgttcgcggagaagctgtacgtacattacagctcattttcctccgggattgggcccacgaaacaggagaaacgattttgaagccatcttacctatccccagcattgacaaatatgaaggatgatggcggtgtccagatgattgcgagtggtcctgatactcgttgggaaattaataaaaagctattcttttccatgatcacatcagcgaagaaatcgatttggatcaccagtccatatttcatcccggatgaagatattttaagtgctttaaaaattgctgccctaagtggtattgatgttaggattctcgttcctaatcgtccagataaacggattgtttttcacgcctcccgctcttattttccagagcttcttgaagcgggagtgaaagtatacgaatatacacgaggctttcttcatagcaaaattattatcgtcgataatgagattgcttcgattggaacatcgaacatggatatgcgaagcttccatttgaattttgaagtgaacgcttttctttaccgcacgaaaagtgtaaccacactcgtaagtgattttgtctacgatttggaacatacaaatcaaattcgctttgagcaatttagaaacagagcttggtattatcgcgtacttgaatccacttgtcggctattatcacctttgctatag

SEQ ID NO: 14716 - protein, 503 aa, Bacillus halodurans
MKNRLNVLLFLLILSTGLYLTRSFWQGWIVGAFSVLITITVVFIGIVIFLENRHPTKTLTWLMVLAVFPVVGFIFYLMFGQNHRKSKTFMKKALSDEEAFEKIEGNRQLNEEQLQKMGGHQQLLFRLAHRLANNPISFSTNTKVLTDGKETFAHIKQALRMATHHIHLEYYIVRDDEIGQEIKEILMQKAKEGIHVRFLYDGVGSWKLSKSYIQDLKQAGVEIVPFAPVKLPFINHTINYRNHRKIIVIDGTVGFVGGLNIGDEYLGKDPYFGFWRDTHLYVRGEAVRTLQLIFLRDWAHETGETILKPSYLSPALTNMKDDGGVQMIASGPDTRWEINKKLFFSMITSAKKSIWITSPYFIPDEDILSALKIAALSGIDVRILVPNRPDKRIVFHASRSYFPELLEAGVKVYEYTRGFLHSKIIIVDNEIASIGTSNMDMRSFHLNFEVNAFLYRTKSVTTLVSDFVYDLEHTNQIRFEQFRNRAWYYRVLESTCRLLSPLL

SEQ ID NO: 14717 - DNA, 1512 bp, Bacillus pseudofirmus
  CDS (1)..(1512): transl_table=11
atgaaaaacagattaaatgttttagctttttttgcgctattatttgcggccctgtacatttcaagaggttttctgcaaagctggatggtaggaacactgagcgttgtgtttactctatccgttatatttattggcattattattttctttgagaacagacatcctacaaaaacccttacttggcttctagtgttagcggcatttccagtcgtcggctttttcttttatttaatgtttggacaaaatcatagaaaaagtaagcggttttctaaaaaagcaatagaagatgaacgagcctttcaaaaaattgaggggcagcggcagttaaatgaagagcagctgaagaaaatgggagggcatcaacaattattgttccgcttagctcataagttaggcaaaaacccgatctccttttcaagtgaaacgaaagtattaacagatggaaaggaaacctatgctcatatcctgcaagcactaaaaatggcagaacaccatattcatcttgagtattatatcgttcggcatgatgaccttggtaaccaaattaaagatattttaatttctaaagccaaggaaggagttcacgtacgttttttatatgatggggtagggagctggaagctttcgaagtcatatgtcgaagaactgcgggatgcaggagtggaaatggtttcgttctcacctgtaaaattaccttttttaactcatacgattaattatcgtaaccatcgcaagattattgtcatcgatggggtagtaggatttgtcggtggtttaaatatcggtgatgaatatctaggtaaagatgcatactttggttattggagagatacacacttgtatgtaagaggagaagctgttagaacacttcagcttattttcttgcaggactggcattatcagacaggtgaaacgattttaaaccaaacgtatttatctccttcactatcaatgacaaagggcgatggcggcgttcaaatgattgcaagcgggccggatacgaggtgggaagtgaataagaagctattcttttcaatgatcacttctgcaaaaaaatcgatttggattgcaagtccgtatttcattccagatgatgatattttaagtgctttaaaaattgccgctttaagcgggattgatgtccgaatccttgtcccaaaccgtccagacaagcgaattgtttttcatgcctcaaggtcttatttccctgagctgcttgaagcaggagtaaaggtttacgagtataaccgtggttttatgcacagtaaaataattattgtcgatcatgagatagcatcaataggcacatctaatatggatatgagaagttttcatttaaactttgaggtgaatgcctatttatatcgtacgagcagtgtgacaaagcttgtaagtgattatgtttacgatctcgagcattctaaccaaattaacttttcattgtttaaaaaccgaccatttttccatcggcttattgaatcaacctcaaggcttttatcaccattattgtaa

SEQ ID NO: 14718 - protein, 503 aa, Bacillus pseudofirmus
MKNRLNVLAFFALLFAALYISRGFLQSWMVGTLSVVFTLSVIFIGIIIFFENRHPTKTLTWLLVLAAFPVVGFFFYLMFGQNHRKSKRFSKKAIEDERAFQKIEGQRQLNEEQLKKMGGHQQLLFRLAHKLGKNPISFSSETKVLTDGKETYAHILQALKMAEHHIHLEYYIVRHDDLGNQIKDILISKAKEGVHVRFLYDGVGSWKLSKSYVEELRDAGVEMVSFSPVKLPFLTHTINYRNHRKIIVIDGVVGFVGGLNIGDEYLGKDAYFGYWRDTHLYVRGEAVRTLQLIFLQDWHYQTGETILNQTYLSPSLSMTKGDGGVQMIASGPDTRWEVNKKLFFSMITSAKKSIWIASPYFIPDDDILSALKIAALSGIDVRILVPNRPDKRIVFHASRSYFPELLEAGVKVYEYNRGFMHSKIIIVDHEIASIGTSNMDMRSFHLNFEVNAYLYRTSSVTKLVSDYVYDLEHSNQINFSLFKNRPFFHRLIESTSRLLSPLL

SEQ ID NO: 14719 - DNA, 1473 bp, Buchnera aphidicola
  CDS (1)..(1473): transl_table=11
atgataaattatctatttactataacaacttggttaattattattagttattggtttataattattattgttacttgtcgaatactttctaagcgtcgagcaatttcatcttctgcagcatggttattagtaatttatattattccatttattggtatatgtacttggttcttacttgaagaaccttatttaggtactcgaaaactaaaattaataaaatccgtatggtctaaaaaaaataaacattttaataatttaaaatcacataactatatttttgaaaacaataatagtgaagtggcgagatcattatttaagttatgtaagtatcgacaaggcatatcgggaataaagtttaataaattaaaactattaaaaaatactaaagatgtaataaaaaatttggtacgagatatctatttagccaaaaacactattgaaatagttttttatatttggaaacctggaggattagcagacaatgtagctattgctttaatacaatcagcaaaacgaggaataaaatgtagacttatgttagattctgcaggaagtttagaattttttagaagcaaatgggttgatatgatgcaacaatctggtattcaaatagtggaagcactcaagatcaatttattgcattttttttttaggagaatggatcttagacaacatagaaaatttatacttattgacaattatataacatatattggaagtatgaatttagtagatccatatttatttaaaaaatctttaggaatcgggcaatggatagacttaatgactcgaatagaagggcccatatctaccactatgggagcaatatattcttgtgattgggaagtagaaactggacaacaaatttcacccaaaagagttaaaaataatcttattattcctacgtatccaattaaagaatgtacttctatagtacaagttattgcttcaggacctggatttactgaagatatgatccatcaagcactacttacagcaatttattcagcacaacaaaaattaactatgactacaccttatctggttcctagcgatgatctattacgcgcaatatgtacagcagcacaacggggagtagaagttattttaatcatacctaaaagtcatgattcattattagtaaaatgggctagtagagttttttttagcgaattattagaatctggcgtgaaaatttaccaatttaaaaaaggattattgcatagtaaaagtgttttagtagataaacaacttagtttaatcggaaccgtaaatttagatatgagaagtttatggttaaattttgaaattacattagttatagacgacaaaaattttgggaaatcactcgcaataatacataatgaatatatatctcattcaagtttacttgaccctaagttatggaaaatacgttcttattggaaaaaaattatagaaaaacttttttattttttaagtccattattataa

SEQ ID NO: 14720 - protein, 490 aa, Buchnera aphidicola
MINYLFTITTWLIIISYWFIIIIVTCRILSKRRAISSSAAWLLVIYIIPFIGICTWFLLEEPYLGTRKLKLIKSVWSKKNKHFNNLKSHNYIFENNNSEVARSLFKLCKYRQGISGIKFNKLKLLKNTKDVIKNLVRDIYLAKNTIEIVFYIWKPGGLADNVAIALIQSAKRGIKCRLMLDSAGSLEFFRSKWVDMMQQSGIQIVEALKINLLHFFFRRMDLRQHRKFILIDNYITYIGSMNLVDPYLFKKSLGIGQWIDLMTRIEGPISTTMGAIYSCDWEVETGQQISPKRVKNNLIIPTYPIKECTSIVQVIASGPGFTEDMIHQALLTAIYSAQQKLTMTTPYLVPSDDLLRAICTAAQRGVEVILIIPKSHDSLLVKWASRVFFSELLESGVKIYQFKKGLLHSKSVLVDKQLSLIGTVNLDMRSLWLNFEITLVIDDKNFGKSLAIIHNEYISHSSLLDPKLWKIRSYWKKIIEKLFYFLSPLL

SEQ ID NO: 14721 - DNA, 1431 bp, Clostridium perfringens
  CDS (1)..(1431): transl_table=11
atgcatttatttataaatatgatatttttaataaatattgtatttatcatttccataatcttcattgaaagaagaaatccccaaactacttgggcttggattttaatattaacctttctacccatattaggatttataatctacattttatttggtcaaaatattacccgtgaaaaaaactttaaaagaaaaattctagatgacaagacaaaacaaaaatatttaaattcatttaagtctcactacaaattagataatatttctttaaaatataaagacttaataatgatgaactttaataatgacaattcaacctacactcaacgtaatgatatagatttatattttgatgctaatagtctttttgaagaaatgattgatgaaataaataaagccgaaaaatttattcatatggaattttatatttttaaaagcgatgaaataggcaaaaaaatcttacaagccttaactaagaaagctaaagaaggtgttgaagtaaaattactagtagattctattggtaactctatacacaaaaaagatatagataaattaaaggcagctggtggagattttaaaatattttttcctggcttttgcaaatatataaacttaagaattaactatagaaatcatagaaagatacttattatagatagcaaagttgcttttttaggtggatttaatataggtgatgaatatcttggaaaagataaaaatattggtcattggcgtgatactcatactaaaataaagggacttgctattaatgatctagaaggaagattccttttagattggagttatgctaatgaatcagatttagacatagatttaaaaaaatattttataaatcctcattcaactgatttgccaaagaagattattggagctcaaatagtttcctctggtcctgaccatactgaacaacaaataaaaaatggatattttaaaattataaattcagctaagaaaaatctttttatacaaacgccttattttgtccctgatgaacctatgcttgaagctttaagacttgctgccttatctggagttgatgtaaaaataatgctacctggtaatcctgatcataaatttatgggatggatagcaaactcttattttgaatccttattaaatgctggtgcaaagatctacttatatgaaaagggctttcttcacgctaaaaccatagtggcagactcttctatatgtagtgtaggaacagctaacatggatataagaagcttttctttaaactttgaaagcaatatatttatatataatgaagctatttcaaaatctatggaagaacaattctttaaagacctaaaggtgtgtactaaagtaacccttgaaagttttgaaaaacgatctattatatcaagaattggagaatccataacaagattagtatctcctttaatgtag

SEQ ID NO: 14722 - protein, 476 aa, Clostridium perfringens
MHLFINMIFLINIVFIISIIFIERRNPQTTWAWILILTFLPILGFIIYILFGQNITREKNFKRKILDDKTKQKYLNSFKSHYKLDNISLKYKDLIMMNFNNDNSTYTQRNDIDLYFDANSLFEEMIDEINKAEKFIHMEFYIFKSDEIGKKILQALTKKAKEGVEVKLLVDSIGNSIHKKDIDKLKAAGGDFKIFFPGFCKYINLRINYRNHRKILIIDSKVAFLGGFNIGDEYLGKDKNIGHWRDTHTKIKGLAINDLEGRFLLDWSYANESDLDIDLKKYFINPHSTDLPKKIIGAQIVSSGPDHTEQQIKNGYFKIINSAKKNLFIQTPYFVPDEPMLEALRLAALSGVDVKIMLPGNPDHKFMGWIANSYFESLLNAGAKIYLYEKGFLHAKTIVADSSICSVGTANMDIRSFSLNFESNIFIYNEAISKSMEEQFFKDLKVCTKVTLESFEKRSIISRIGESITRLVSPLM

SEQ ID NO: 14723 - DNA, 1461 bp, Escherichia coli O157
  CDS (1)..(1461): transl_table=11
atgacaaccgtttatacgttggtgagttggttggccattctgggatactggttgctcattgcaggcgtaactttacgcattctaatgaaacgacgcgcagttccctccgcgatggcctggctgttgattatttacattctgccgttagtcggaattattgcctatcttgccgttggcgagctccatttaggcaaacgccgcgctgagcgcgccagagcgatgtggccttccaccgcaaaatggcttaacgaccttaaagcctgtaagcatatctttgccgaagaaaatagcagtgtcgctgcgccattattcaagctttgcgagcgtcgtcaggggatcgctggggtcaaagggaatcagctacaactgatgaccgagtcagatgatgtgatgcaggcgttaatccgcgacatccagctcgcgcgccataatattgagatggtgttttatatctggcagcccggcggcatggcggaccaggtggctgaatcattaatggcggctgcgcgacgcggcattcattgccgattgatgctcgactccgccgggagtgtagcttttttccacagcccgtggcccgagctaatgcgtaatgccggtattgaagtggtcgaagccttaaaggtcaatctgatgcgtgtgtttttacgccgtatggacctgcgccaacatcgcaagatgatcatgatcgataattacatcgcgtacaccggcagcatgaatatggtcgaccctcgctacttcaaacaagatgcgggcgtagggcaatggattgatctgatggcgcgtatggaaggccccatcgccaccgcgatggggattatttattcctgcgactgggagattgaaacagggaaacgtattctaccgccaccacctgatgtcaatattatgccgtttgagcaggccagcggtcataccattcacacaattgcttctggccccggctttccggaagatctcattcaccaggcattattgactgcggcttattcggcgcgtgaatatttgatcatgaccacgccctactttgtgccaagcgatgatttacttcatgcgatttgcacggcggcgcagcgcggggtggatgtcagtattatccttccgcgaaaaaatgactcgatgctggtcggctgggccagtcgcgcattctttacggaactgcttgctgctggggttaaagtttatcagtttgaaggcgggttactgcataccaagagcgtgctggtcgatggcgaactaagtctggttggcaccgttaaccttgatatgcgtagtctgtggctgaatttcgagattaccctggcaatcgacgataaaggttttggtgcagaccttgccgccgttcaggacgattatatttcgcgttcacgtctgctcgatgcccgtttatggctaaaacgtccattatggcaacgtgtcgccgagcgactgttttacttcttcagcccgttgctgtaa

SEQ ID NO: 14724 - protein, 486 aa, Escherichia coli O157
MTTVYTLVSWLAILGYWLLIAGVTLRILMKRRAVPSAMAWLLIIYILPLVGIIAYLAVGELHLGKRRAERARAMWPSTAKWLNDLKACKHIFAEENSSVAAPLFKLCERRQGIAGVKGNQLQLMTESDDVMQALIRDIQLARHNIEMVFYIWQPGGMADQVAESLMAAARRGIHCRLMLDSAGSVAFFHSPWPELMRNAGIEVVEALKVNLMRVFLRRMDLRQHRKMIMIDNYIAYTGSMNMVDPRYFKQDAGVGQWIDLMARMEGPIATAMGIIYSCDWEIETGKRILPPPPDVNIMPFEQASGHTIHTIASGPGFPEDLIHQALLTAAYSAREYLIMTTPYFVPSDDLLHAICTAAQRGVDVSIILPRKNDSMLVGWASRAFFTELLAAGVKVYQFEGGLLHTKSVLVDGELSLVGTVNLDMRSLWLNFEITLAIDDKGFGADLAAVQDDYISRSRLLDARLWLKRPLWQRVAERLFYFFSPLL

SEQ ID NO: 14725 - DNA, 1449 bp, Listeria monocytogenes
  CDS (1)..(1449): transl_table=11
atgggactgttggcttatctgttagtgattttgctaattttaaatgtattctttgcggcagtgacggtcttcttagaaagacgcgatacatccgccacttgggcttggttgctagtcttaacttttgttccgatatttggtttcattatctatttgatttttgggagaaaattatcaggcaaaaagattttcgattggaagggacaagaaaaaattgggatacaggaatctactgccaatcaaatagaaatgatacggcaaaaagaatttccatttagcgatccgaatgtgaaaaagcatcgtgatttaatctatttattactcgtaaacgatggtgctattttaacgcaagacaatgaagtggaactttttgtagatggacatgagaaattcgatgcgctaattgctgatattgaaaaagcgaaagatcatatacatctcatctattatatttttcattctgatgaactaggcaatcgcttaatgcgcgtgctggaaagaaaagcagcagaaggtttaaatgtgaaaattatttatgatgcaatgggttcaaggacaacgaaaaaatcatttttccgtacgtttcaaaaaaatggtggtctagttagacctttttttccgtctaaattaccattgattaactttcgtctcaactaccgaaatcaccggaaattggctataatcgatggagatgttggttatattggtggttttaatattggtgatgaatatcttggggcatcgaagaaatttggttactggcgtgatacacatttacgtgtacacggaaaagctgtttatgcgatgcaaactcgctttattatggactggaattctgcatcatccacacataaaattgattacaaagcgcgatacttcccgacttttcatgggaaaggtcatacaagtatgcaaattgtttcgagtggtcctgattccgaatggcaacaaatcaaaaatggttacatcaaaatgatcaatgctgctaaaaaaacaatttatttacaatcaccttattttattccagatgcaagtttgcttgaagcaatcaaaatcgcagcactttctggggtagatgtcagggttatgattcctaataagcctgaccatgcttttgtttaccgcgcaactactaactacgccggtgaattaatggaaacgggagcgaaaatctttatttatgataatggttttatccacgcgaaaacactcgttgtagatggcgaaattgcttcagttggaaccgcgaatatggatttccggagtttccgacttaattttgaagtaaatgcttttatttatgaaaaacaaatggtgcaaaaactagaagatgcctttttggaagatattctaaaatcgtatcaactaacacctgaattatatgcaaaacgatctttatggattaaatttaaagaagcggtaagccgacttttatcgcctatattatag

SEQ ID NO: 14726 - protein, 482 aa, Listeria monocytogenes
MGLLAYLLVILLILNVFFAAVTVFLERRDTSATWAWLLVLTFVPIFGFIIYLIFGRKLSGKKIFDWKGQEKIGIQESTANQIEMIRQKEFPFSDPNVKKHRDLIYLLLVNDGAILTQDNEVELFVDGHEKFDALIADIEKAKDHIHLIYYIFHSDELGNRLMRVLERKAAEGLNVKIIYDAMGSRTTKKSFFRTFQKNGGLVRPFFPSKLPLINFRLNYRNHRKLAIIDGDVGYIGGFNIGDEYLGASKKFGYWRDTHLRVHGKAVYAMQTRFIMDWNSASSTHKIDYKARYFPTFHGKGHTSMQIVSSGPDSEWQQIKNGYIKMINAAKKTIYLQSPYFIPDASLLEAIKIAALSGVDVRVMIPNKPDHAFVYRATTNYAGELMETGAKIFIYDNGFIHAKTLVVDGEIASVGTANMDFRSFRLNFEVNAFIYEKQMVQKLEDAFLEDILKSYQLTPELYAKRSLWIKFKEAVSRLLSPIL

SEQ ID NO: 14727 - DNA, 1473 bp, Pseudomonas aeruginosa
  CDS (1)..(1473): transl_table=11
atggccgccaccggagtggacaaggatcgacctcgcgcaatgacctccaccacctacctcggcctgctgctggtcggtatccaggtactcggcttcgtcgccgccatccatgccgtgctcaccgtgcgcaccgcccagggcgcgatcgcctgggccacctcgttggtattcatgccgtacctgaccctgctgccgtacctggtgttcggtcgcagccgtttcgacgcctacatcgaggcgcggcgccaggccaaccgcgagatgcacctggcggccgccgagctggactggcgtccctgggtcgaggaggccctggcggcccgccaggtcagcggctacaaggggctcaaggcgctggtgcggatgacccgcacgccgaccctggcgaacaaccgggtgcgcctgctggtcaacggcgaggccagcttcgaggcgatgttcaaggcgatttccgccgcccgccaggtgatcctggtgcagttcttcatcgtccgcgacgacgccctcggccagcgcctccagcaactgctgctggaacgtgcggccaacggcgtcgaggtgttcttcctctatgacgccatcggcagccacgcgctgccgcaccgctatgtcgagcggctgcgccagggcggcgtgcagatgcatggcttcagcaccggcagcggcatgctcaaccgcttccaggtgaatttccgcaaccaccgcaaggtcgtggtggtggatggcgagtgcggtttcgtcggcgggcacaacgtcggcgtcgagtacctcggcgagaagccgccgctggcgccctggcgcgacactcacatggaactgcgcgggccggcggtggcgtgcctgcaggaaagcttcgccgaggactggtactgggcgacccacagcctgccgccgctgatcctgccgccgcagtacgacagcgagggcgcgctctgccaggtagtcgccagcggtccggcggatgcccaggaaacctgctcgctgttcttcgtcgagatgatcaacgccgcccacgagcgggtctggatcacctcgccgtatttcgttcccgacgaagcggtgatggccgccctgcgcctggcggtgctgcgcggcgtcgacgtgcgcctgctgataccctcgcgcccggaccaccgcacggtgtatgccgcgtccagcctctacgcgctggaggcgatccgtgccggggtcaaggtgttccgctaccagcccggcttcctccaccagaaggtggtgctggtggaccgcgacaccgccgccgtcggcagcgccaacctggacaaccgttcgttccggctgaatttcgaggtgatggtggtgaccgtcgacgagggcttcgccggcgaggtggaggcgatgctcgaggcggacttcgccgagtcgctcgaattcactccggaagaccgccgcagcgtgcgccgcctgcagcaactggggatgcgcgtggcgcggctggtctcgccgatcctctga

SEQ ID NO: 14728 - protein, 490 aa, Pseudomonas aeruginosa
MAATGVDKDRPRAMTSTTYLGLLLVGIQVLGFVAAIHAVLTVRTAQGAIAWATSLVFMPYLTLLPYLVFGRSRFDAYIEARRQANREMHLAAAELDWRPWVEEALAARQVSGYKGLKALVRMTRTPTLANNRVRLLVNGEASFEAMFKAISAARQVILVQFFIVRDDALGQRLQQLLLERAANGVEVFFLYDAIGSHALPHRYVERLRQGGVQMHGFSTGSGMLNRFQVNFRNHRKVVVVDGECGFVGGHNVGVEYLGEKPPLAPWRDTHMELRGPAVACLQESFAEDWYWATHSLPPLILPPQYDSEGALCQVVASGPADAQETCSLFFVEMINAAHERVWITSPYFVPDEAVMAALRLAVLRGVDVRLLIPSRPDHRTVYAASSLYALEAIRAGVKVFRYQPGFLHQKVVLVDRDTAAVGSANLDNRSFRLNFEVMVVTVDEGFAGEVEAMLEADFAESLEFTPEDRRSVRRLQQLGMRVARLVSPIL

SEQ ID NO: 14729 - DNA, 1446 bp, Pseudomonas putida
  CDS (1)..(1446): transl_table=11
atgcatatggattaccacagcccctacttctttggttacctactcggcctgatccatctgctgggtattgtcgccgcactgcatgcgctgttcaccgtgcggacagcccagggcgccattgcttgggcgatgcccttgctcttcatcccctacctcaccttgatcccctacctgatcttcggcgcccgctcgttctatgcctacatcaaggctcggcgccaggccaaccaggaaatgcacgtggccatggccaacctcaactggcggccctgggttgaagaagcccttaccgcccgcgagtcggaaagctacacagccttgcgcgccatgcccaagctgggtcgaatgccatgcctggcaaataaccaggtgaaactgctgatcaatggcaaagccaccttcgatgccatcttcgcagccatcgaaaaagcacgcgatgtggtactggtgcagttcttcatcattcatgacgacaccctcggcaaggcactgcagcaactcttgctacgcaaagccgccgaaggcgtgcaggtgttcgtgctgtacgaccgtgtcggtagccatgccttgccgtccagctacagccaggtgctgcgtgacggcggtgtgcagatccatgcattcgccacacgtcgcggctggttcaaccgcttccaggtgaacttccgcaaccatcgcaagattgtggtggtggatggcttgctcggcttcatcggcggccacaatgtgggagacgagtacctgggtgaacatccacagctttccccttggcgtgacacccacgtacagatcagcgggccagtactggcctgcctgcaagagtcgttcgccgaggactggtactgggccacgcgccagctaccgccgctgatcctgcccgatacatacccggataacggcgtcctgtgtcaggccttggccagcggcccggcagacccacaagaaacctgctcgctgttcttccttgaagcgattcattcggccacccgcagggtgtggatcaccagcccgtacttcatccctgacgaggccgtgttcgccgccttgcggctggcggtgctacgaggagtcgatgtgcgggtgctgatcccgtcacggcctgaccaccgcatcgtctacgccgcctccagcctgtttgccttcgaagcagtgcgcgcgggggtacgtatgttccgttaccaacccgggtttctgcatcagaaggtggtgctggtggatgatgacgtcagcgcaattgggagtgccaacctggacaaccgctcgttccgcctgaacttcgagattaccctgctgacagtcgatcgcggcttcgccgaccaggtcgagcacatgctccaggaagacttcgaacaagcgcgggaaattactgctgaagacacccaagatacccatcgactgcagcaattggggatgcggattgcgcggctgatatcgccgattctttag

SEQ ID NO: 14730 - protein, 481 aa, Pseudomonas putida
MHMDYHSPYFFGYLLGLIHLLGIVAALHALFTVRTAQGAIAWAMPLLFIPYLTLIPYLIFGARSFYAYIKARRQANQEMHVAMANLNWRPWVEEALTARESESYTALRAMPKLGRMPCLANNQVKLLINGKATFDAIFAAIEKARDVVLVQFFIIHDDTLGKALQQLLLRKAAEGVQVFVLYDRVGSHALPSSYSQVLRDGGVQIHAFATRRGWFNRFQVNFRNHRKIVVVDGLLGFIGGHNVGDEYLGEHPQLSPWRDTHVQISGPVLACLQESFAEDWYWATRQLPPLILPDTYPDNGVLCQALASGPADPQETCSLFFLEAIHSATRRVWITSPYFIPDEAVFAALRLAVLRGVDVRVLIPSRPDHRIVYAASSLFAFEAVRAGVRMFRYQPGFLHQKVVLVDDDVSAIGSANLDNRSFRLNFEITLLTVDRGFADQVEHMLQEDFEQAREITAEDTQDTHRLQQLGMRIARLISPIL

SEQ ID NO: 14731 - DNA, 1446 bp, Pseudomonas putida
  CDS (1)..(1446): transl_table=11
atgcatatggattaccacagcccctacttttttggttacctactcggccttatccacctgttgggtgtcgtcgccgcgctccacgcactgttcactgtacgcaccgcccaaggcgcgattgcctgggccatgcccctgttcttcatcccttacctcaccttgatcccctacctgatcttcggcgcccgctcgttctatgcctacatcaaggcccggcgccaggcgaaccaggaaatgcacgtggccatggccaacctaaactggcggccttgggtggaagaagctctcaccgcccgcgagtcggaaagctacgcagccttgcgcgccatgcccaagctggggcgcatgccttgccttgcgaacaaccaagtaaagctattggtcaatggcaaagccacattcgatgccatcttcgcggctatcgaaaaggcacgcgatgtggtgctggtgcagttcttcatcattcatgacgacaccctcggcaaggcactgcagcaactgctgttgcgcaaggccgccgagggggtacaggtgttcgtactgtatgaccgcgtcggcagccatgccttgccggccagctacagccagcaactgcgcaacggtggtgtgcagatccatgccttcgccacccgccgcggctggttcaaccgcttccaggtgaacttccgtaaccatcgcaagattgtggtggtggatggcctgctcggctttatcggcggccacaacgtgggggacgaatacctcggagggcatcctcagctgtcgccttggcgcgacacccatgtgcagatcagcgggccggtgctggcctgcctgcaggagtcgttcgccgaggattggtattgggccacgcgccagctaccgccgctgattctgccggatgcctacccggataacggcgtgctgtgccaggcgttggccagcggccccgccgacccgcaggaaacctgctcgttgttcttcctcgaggcgatccattccgctacccggcgggtatggatcaccagcccttacttcatcccggacgaagcggtctttgctgcactgcgcctggcggtactacggggtgtcgatgtgcgggtactgatcccgtcacggccagaccaccgcatcgtctatgccgcctccagcctgttcgccttcgaagccgtgcgcgcgggtgtgcgcatgttccgctaccagcccggcttcctgcatcagaaggtggtgctggtagatgatgaagtaagcgcaatcggcagtgccaacctggacaaccgttcgttccggctgaacttcgagatcaccctgctaacggtcgaccgcaacttcgccgaccaggtcgaacacatgctgatcaaagactttgaacaggcgcgggagattactgcggaggacagccgcgatacacatcggctacagcaattggggatgcggattgcgcggctgatttcacccattctgtga

SEQ ID NO: 14732 - protein, 481 aa, Pseudomonas putida
MHMDYHSPYFFGYLLGLIHLLGVVAALHALFTVRTAQGAIAWAMPLFFIPYLTLIPYLIFGARSFYAYIKARRQANQEMHVAMANLNWRPWVEEALTARESESYAALRAMPKLGRMPCLANNQVKLLVNGKATFDAIFAAIEKARDVVLVQFFIIHDDTLGKALQQLLLRKAAEGVQVFVLYDRVGSHALPASYSQQLRNGGVQIHAFATRRGWFNRFQVNFRNHRKIVVVDGLLGFIGGHNVGDEYLGGHPQLSPWRDTHVQISGPVLACLQESFAEDWYWATRQLPPLILPDAYPDNGVLCQALASGPADPQETCSLFFLEAIHSATRRVWITSPYFIPDEAVFAALRLAVLRGVDVRVLIPSRPDHRIVYAASSLFAFEAVRAGVRMFRYQPGFLHQKVVLVDDEVSAIGSANLDNRSFRLNFEITLLTVDRNFADQVEHMLIKDFEQAREITAEDSRDTHRLQQLGMRIARLISPIL

SEQ ID NO: 14733 - DNA, 1440 bp, Pseudomonas syringae
  CDS (1)..(1440): transl_table=11
atggattatcacgacccgtactttttcggttatgtcctcggtttcattcacctgctgggcacaggtgccgccatccatgcgctgctgacggtgcgcacctcccaaggcgcgatcgcctgggcgatgccgttgctgttcatcccctacttcaccttgctgccttatctgatattcggacgcagctcgttcgacgcgtatatcaaggcccgccgtgaggccaacaaggagatgcgcgcagcgatcggcagcctcaactggcggccctggatagaagaagccgtagccgcacgccgatcagacgcctacgcggcgttgcgtgcaatgcccaggctggggaacatgccggcgctggccaacaacaaggtcaggctgctgatcaatggcgaagagacgttcggcgcgattttccaggcaatccgcgaagcgaaacagacgatcctgattcagttcttcatcattcatgacgacaacctcggccgccagttgcaaacgctgctgctggaaaaagccgcccagggcgtggcgatttttgtgctgtacgaccgcatcggcagccatgcattgccgggcgcctacatcgacacgttgcgcgacggtggtgtgcagataaaagcctttgccacgcgcggcgggtggctcaaccgcttccagatcaactttcgcaaccatcgcaagatcgtggtggtcgacggcctgaaaggttacatcggcgggcataacgtgggcgatgaatacatgggcctgaaaccgccgctggcgccttggcgcgatacacacgtggaagtcatcggcccggtggtcgcctgcttgcaggaatcgttcgccgaagactggttctgggccacccgcgaactaccgccgcttagcctgcccgacgagtttcccgaggacggcgtgctgtgccagttgctgaccagcgggccggccgatgcccaggaaacctgttcactgtttttcgtcgaagccattcatgctgccgaagaacgcgtatggatcaccagcccctatttcatccctgacgaggccgtgagcgccgcgctgaccctggcggtcctgcgcggtgtggacgtgcgcctgctactgccctcgcgcccagaccattacgtggtctacgccgcctccagcctttatgcctttgatgccgtccgtgcgggtgtgcgagtgtttcgctacgagccgggctttctgcatcagaaggtggtgctggtcgacaacgacatcaccgccatcggcagcgccaacctcgacaaccgctcgttccgactcaacttcgaactgatgctgctcaccgtcgacagcgacttctccagccaggtcgaggccatgctcaccgccgacttcgctgcggcgcgcgaaatatccctgcaggaaagccatgaaacccgacgcctgcatcagctcggcatgcgcgtagccaggctgatctcgccgattttgtga

SEQ ID NO: 14734 - protein, 479 aa, Pseudomonas syringae
MDYHDPYFFGYVLGFIHLLGTGAAIHALLTVRTSQGAIAWAMPLLFIPYFTLLPYLIFGRSSFDAYIKARREANKEMRAAIGSLNWRPWIEEAVAARRSDAYAALRAMPRLGNMPALANNKVRLLINGEETFGAIFQAIREAKQTILIQFFIIHDDNLGRQLQTLLLEKAAQGVAIFVLYDRIGSHALPGAYIDTLRDGGVQIKAFATRGGWLNRFQINFRNHRKIVVVDGLKGYIGGHNVGDEYMGLKPPLAPWRDTHVEVIGPVVACLQESFAEDWFWATRELPPLSLPDEFPEDGVLCQLLTSGPADAQETCSLFFVEAIHAAEERVWITSPYFIPDEAVSAALTLAVLRGVDVRLLLPSRPDHYVVYAASSLYAFDAVRAGVRVFRYEPGFLHQKVVLVDNDITAIGSANLDNRSFRLNFELMLLTVDSDFSSQVEAMLTADFAAAREISLQESHETRRLHQLGMRVARLISPIL

SEQ ID NO: 14735 - DNA, 1461 bp, Salmonella typhi
  CDS (1)..(1461): transl_table=11
atgacaaccttctacaccgtggtgagttggctggtcattttgggatactgggttctcattgccggcgtcacattacgtattctaatgaaacggcgcgcagttccctccgcaatggcctggttgttaatcatctatatccttccgctggtcgggatcatcgcctatttgtccgtgggcgaattgcatttaggcaaacgtcgcgccgagcgtgcccgcgccatgtggccgtctaccgccaaatggttgaatgacctcaaagcctgcaaacacattttcgcgcaagaaaacagtagcgtcgcatcgtccttgtttaagctgtgcgaacgacgtcaggggattgcgggcgtcaaaggcaaccagttgcaattacttaccgactccgatgatgtcatgcaggcgcttattcgcgatatccaactggcgcggcataatatcgaaatggtgttttacatctggcagccaggcggcatggcggatcaggtcgctgaatcgctaatggccgccgcccgccgcggcatccattgccggcttatgctggattccgcgggtagcgtcgctttcttccgcagcccctgggcggccatgatgcgtaacgctggcattgaagtcgtagaggcgctgaaggtgaatctgatgcgcgtctttttacgccgtatggatcttcgccagcaccgtaaaatggtgatgattgacaattacatcgcctataccggcagtatgaatatggtggacccgcgttttttcaaacaggatgccggcgttggacaatgggtcgatttgatggcgcggatggagggtcccgtggcgacagcaatggggattgtttactcctgcgattgggaaatcgagacgggtaaacgcattctgcctcccccgccggacgtgaatattatgccgtttgagcaggccagcgggcataccattcataccattgcttccggtcctggttttccggaagatctcattcaccaggcactattaaccgccacctatgctgcgcgcgaatatttaattatgaccacgccatatttcgtccccagcgacgatctgctgcacgccatttgtaccgctgcgcagcgcggcgtggatgtcagtattatcctgccccgtaaaaatgattcactgctcgtcggctgggccagtcgcgcctttttcagcgagttactggcggcgggcgtgaaaatctatcagttcgaaggcgggctgttgcataccaaaagcgtgctggtcgatggcgaactgagcctggtcggtaccgtgaatctcgacatgcgtagcctgtggcttaatttcgagattacgctggtcattgatgatacgggtttcggcgccgatctggctgcggtacaggacgattatatttcgcgctcccgcctgttagatgcgcgtttgtgggtaaaacgtccgttatggcagcgtattaccgagcgattgttttacttctttagtccattgctgtaa

SEQ ID NO: 14736 - protein, 486 aa, Salmonella typhi
MTTFYTVVSWLVILGYWVLIAGVTLRILMKRRAVPSAMAWLLIIYILPLVGIIAYLSVGELHLGKRRAERARAMWPSTAKWLNDLKACKHIFAQENSSVASSLFKLCERRQGIAGVKGNQLQLLTDSDDVMQALIRDIQLARHNIEMVFYIWQPGGMADQVAESLMAAARRGIHCRLMLDSAGSVAFFRSPWAAMMRNAGIEVVEALKVNLMRVFLRRMDLRQHRKMVMIDNYIAYTGSMNMVDPRFFKQDAGVGQWVDLMARMEGPVATAMGIVYSCDWEIETGKRILPPPPDVNIMPFEQASGHTIHTIASGPGFPEDLIHQALLTATYAAREYLIMTTPYFVPSDDLLHAICTAAQRGVDVSIILPRKNDSLLVGWASRAFFSELLAAGVKIYQFEGGLLHTKSVLVDGELSLVGTVNLDMRSLWLNFEITLVIDDTGFGADLAAVQDDYISRSRLLDARLWVKRPLWQRITERLFYFFSPLL

SEQ ID NO: 14737 - DNA, 1461 bp, Shigella flexneri
  CDS (1)..(1461): transl_table=11
atgacaaccgtttatacgttggtgagttggttggccattctgggatactggttgctcattgcaggcgtaactttacgcattctaatgaaacgacgcgcagttccctccgcgatggcctggctgttgattatttacattctgccgttagtcggaattattgcctatcttgccgttggcgagctccatttaggcaaacgccgcgctgagcgcgccagagcgatgtggccttccaccgcaaaatggcttaacgaccttaaagcctgtaagcatatcttcgccgaagaaaatagcagtgtcgctgcgccattattcaagctttgcgagcgtcgtcaggggatcgctggggtcaaagggaatcagctacagctgatgaccgagtcagatgatgtgatgcaggcgttaatccgcgacatccagctcgcgcgccataatattgagatggtgttttatatctggcagcccggcggcatggcggaccaggtggctgaatcattaatggcggctgcacggcgtggtattcattgccgattgatgctcgactccgccgggagtgtggcttttttccgcagcccgtggcccgagctaatgcgtaatgccggtattgaagtggtcgaagccttaaaggtcaatctgatgcgtgtgtttttacgccgtatggacctgcgccaacatcgcaagatgatcatgatcgataattacatcgcgtacaccggcagcatgaatatggtcgatcctcgctacttcaaacaagatgcgggcgtagggcaatggattgatctgatggcgcgtatggaaggccccatcgccaccgcgatggggattatttattcctgcgactgggagattgaaaccggaaaacgtattctgccgccaccaccagatgtcaatattatgccgtttgaacaggccagcggtcacaccattcacacaattgcttctggccccggctttccggaagatctcattcaccaggcattattgactgcggcttattcggcgcatgaatatttgatcatgaccacgccctactttgtgccaagcgatgatttacttcatgcgatttgcacggcggcgcagcgcggggtggatgtcagtattatccttccgcgaaaaaatgactcgatgctggtcggctgggccagtcgcgcattctttacggaactgcttgctgctggggttaaaatttatcagtttgaaggcgggttactgcataccaagagcgtgctggtcgatggcgaactaagtctggttggcaccgttaaccttgatatgcgtagtctgtggctgaatttcgagattaccttggcaatcgacgataaaggttttggtgcagaccttgccgccgttcaggacgattatatttcgcgttcacgtctgctcgatgcccgtttatggctaaaacgtccattatggcaacgtgtcgccgagcgactgttttacttcttcagcccgttgctgtaa

SEQ ID NO: 14738 - protein, 486 aa, Shigella flexneri
MTTVYTLVSWLAILGYWLLIAGVTLRILMKRRAVPSAMAWLLIIYILPLVGIIAYLAVGELHLGKRRAERARAMWPSTAKWLNDLKACKHIFAEENSSVAAPLFKLCERRQGIAGVKGNQLQLMTESDDVMQALIRDIQLARHNIEMVFYIWQPGGMADQVAESLMAAARRGIHCRLMLDSAGSVAFFRSPWPELMRNAGIEVVEALKVNLMRVFLRRMDLRQHRKMIMIDNYIAYTGSMNMVDPRYFKQDAGVGQWIDLMARMEGPIATAMGIIYSCDWEIETGKRILPPPPDVNIMPFEQASGHTIHTIASGPGFPEDLIHQALLTAAYSAHEYLIMTTPYFVPSDDLLHAICTAAQRGVDVSIILPRKNDSMLVGWASRAFFTELLAAGVKIYQFEGGLLHTKSVLVDGELSLVGTVNLDMRSLWLNFEITLAIDDKGFGADLAAVQDDYISRSRLLDARLWLKRPLWQRVAERLFYFFSPLL

SEQ ID NO: 14739 - DNA, 1485 bp, Staphylococcus aureus
  CDS (1)..(1485): transl_table=11
atgatagagttattatccattgcactcaagcattctaatattattttaaattcaatatttattggtgcatttattttaaacttattattcgcctttaccattattttcatggaaagacgttctgccaattctatctgggcttggttactagtcttagttttcttgcctttattcggcttcattttatacttactattaggacgacaaattcaacgtgaccaaattttcaaaattgataaggaagataaaaaaggattagagttaatcgttgatgagcaattagctgctttaaaaaatgaaaacttttcaaattccaattatcaaattgtaaaatttaaagaaatgattcaaatgttgttatataataacgcagcatttttaacaacagacaacgatttaaaaatatacacagacggccaagaaaaatttgatgacctaatacaagacatccgtaatgctactgattatattcattttcagtactatattattcaaaatgatgaattaggtcgtaccattttaaatgaacttggtaaaaaagcggaacaaggtgtagaagttaaaattctttatgatgacatgggttctcgtggactgcgtaaaaaaggcttacgcccgtttcgcaataaaggtggacatgctgaagcatttttcccatcaaaattacctttaattaacttgcgtatgaacaatcgaaaccatcgaaaaattgttgtaatagatgggcaaattggatatgttggtggttttaatgttggtgatgagtacttaggtaaatcaaaaaaattcggctattggcgagatacgcatttacgaattgtcggggatgcagtgaatgcattgcaattacgatttattctagattggaattcacaagccacacgtgaccacatctcctatgatgatcgttatttcccagatgtaaattctggtggaacaattggcgttcaaatagcttctagtggtcctgacgaagaatgggaacagattaaatacggctatttgaaaatgatttcatctgctaaaaaatcgatttatattcaatctccctatttcatacctgatcaagcctttttagattctattaaaattgcggcattaggtggtgttgatgtcaatatcatgattcctaataaacctgaccatccgtttgttttttgggctactttaaaaaatgcagcatccttattagatgccggtgttaaagtatttcactacgacaatggctttttacactcaaaaacacttgttatagatgatgaaattgcaagtgtgggaacagctaatatggaccatcgcagtttcacattgaatttcgaagtcaacgcttttatttatgaccaacaaattgccaaaaaattaaaacaagcttttatagatgatttagcagtatcttctgaattaacaaaagcacgttatgctaagcgaagtctttggattaaatttaaagaaggtatttcacaattattgtcacctatcttataa

SEQ ID NO: 14740 - protein, 494 aa, Staphylococcus aureus
MIELLSIALKHSNIILNSIFIGAFILNLLFAFTIIFMERRSANSIWAWLLVLVFLPLFGFILYLLLGRQIQRDQIFKIDKEDKKGLELIVDEQLAALKNENFSNSNYQIVKFKEMIQMLLYNNAAFLTTDNDLKIYTDGQEKFDDLIQDIRNATDYIHFQYYIIQNDELGRTILNELGKKAEQGVEVKILYDDMGSRGLRKKGLRPFRNKGGHAEAFFPSKLPLINLRMNNRNHRKIVVIDGQIGYVGGFNVGDEYLGKSKKFGYWRDTHLRIVGDAVNALQLRFILDWNSQATRDHISYDDRYFPDVNSGGTIGVQIASSGPDEEWEQIKYGYLKMISSAKKSIYIQSPYFIPDQAFLDSIKIAALGGVDVNIMIPNKPDHPFVFWATLKNAASLLDAGVKVFHYDNGFLHSKTLVIDDEIASVGTANMDHRSFTLNFEVNAFIYDQQIAKKLKQAFIDDLAVSSELTKARYAKRSLWIKFKEGISQLLSPIL

SEQ ID NO: 14741 - DNA, 1461 bp, Yersinia pestis
  CDS (1)..(1461): transl_table=11
atgacgacattttataccgtaatcagttggctttccgtttttggctactggttactcattgccggggtaacattgcgtattctgatgaaacgcagggccgttccttctgctatggcttggttactgattatctacattctgccattggtggggataattgcttacctttcattcggtgaattgcatttgggtaagcggcgtgctgaacgagctaaagccatgtggccatcgaccgctcgctggctgagtgaactcaaggaatgccaacatatctttgctaactctaatagcgaagttgccagcccactgtttcaattatgtgaacggcgtcaaggaataaacggtgttaaaggaaatcaactacaactattaacaacaaccgatgacacactaaaagcgctagtacgagatattgaactcgcccgccacaatatagaaatggtgttttatatttggcaacctggtggtctggtcgatcaggtggctgaatcgttgatggctgcggctcgacgcggcgttcattgccggctgttactcgattcagcgggtagcaagcaatttttccgcagcccttatcccgcaatgatgcgtaatgcaggtattgaggtggttgaggcacttaaagttaatgtatttcgtatgttcttgcgccgaatggatctgcgccaacatcggaaaattgtgttaatcgacaactatgttgcttataccggcagtatgaacatggtagatccccggttcttcaaacaagatgccggggttggtcagtggattgatatgatggcgcgcatggaaggcccggtagccacaaccctaggtattgtttatgcctgtgactgggaaattgaaacaggcaaacgtattttacccccgccccccgacgcgaatattatgccattcgaagaagagactggtcatacgattcaagtcatcgcttctggccctggtttcccagaagaaatgatccaccaggcattattaacagctgtgtatgccgcacgtgaacagttaattatgactacgccatattttgtccccagtgatgacttattacatgccatctgtaccgcggcacaacgcggggttgatgtcagtattattgtcccgcgtgagaatgattcgatgatggttcgctgggccagccgagcattcttcaccgaattgctgaatgcaggcgttaaaatttatcagtttgaaggcggcctattacacagtaaaagtgttctggtcgatggacagctaagtttagtcggcactgttaatctggatatgcgcagtttgtggctgaattttgaaatcacactggtgattgatgatgatggctttggggctgatttagcacaagttcaggatgattatatcgcccgctctgccttattggatggtgaacggtggaacaagcgccctctttggcaccgagtaactgagcgtttattctattttttcagcccattattgtaa

SEQ ID NO: 14742 - protein, 486 aa, Yersinia pestis
MTTFYTVISWLSVFGYWLLIAGVTLRILMKRRAVPSAMAWLLIIYILPLVGIIAYLSFGELHLGKRRAERAKAMWPSTARWLSELKECQHIFANSNSEVASPLFQLCERRQGINGVKGNQLQLLTTTDDTLKALVRDIELARHNIEMVFYIWQPGGLVDQVAESLMAAARRGVHCRLLLDSAGSKQFFRSPYPAMMRNAGIEVVEALKVNVFRMFLRRMDLRQHRKIVLIDNYVAYTGSMNMVDPRFFKQDAGVGQWIDMMARMEGPVATTLGIVYACDWEIETGKRILPPPPDANIMPFEEETGHTIQVIASGPGFPEEMIHQALLTAVYAAREQLIMTTPYFVPSDDLLHAICTAAQRGVDVSIIVPRENDSMMVRWASRAFFTELLNAGVKIYQFEGGLLHSKSVLVDGQLSLVGTVNLDMRSLWLNFEITLVIDDDGFGADLAQVQDDYIARSALLDGERWNKRPLWHRVTERLFYFFSPLL

SEQ ID NO: 14743 - DNA, 1509 bp, Helicobacter pylori J99
  CDS (1)..(1509): transl_table=11
ttgaaaatctttttagttattctaagcgtctttttttttaatgggtgttttgggctagcctataagactcccatttcaaacccccctatctcttatgacccctacactaccaccattgggagcttgtatgctaaaaatttaaaagaaaaccctaaacatagtgcggccattcttttagaagacggctttgatgccttgttgcacagagtgggtcttattagaatgagccaaaaaagcattgacatgcaaacttatatctataaaaacgacctttcttctcaagtgatcgctaaagaacttttaaacgcggccaatcgtggggtaaaagtgcgcatccttttagatgacaacgggttagattcagatttttcagacatcatgcttttaaatttccacaaaaacattgaagtgaaaatctttaacccctactatatccgcaataaaggcttgcgttattttgaaatgcttgcggattatgaacgcattaaaaaacgcatgcacaacaagcttttcatcgtggataatttcgctgtcattataggggggcgcaacattggggacaattattttgataacgatttagacacgaattttttagatttagacgctttgttttttgggggggttgcttcaaaggccaaagaaagctttgaaaattattggcgattccaccgctctatccctgtttcattattaagaacccataaaagactcaaaaacaacgttaaagaaatcgctaagctccatgaaaaaatccctatcagcgctgaagacgcaaacgaatttgaaaaaaaagtcaatgattttatagaacgcttccaaaaataccaataccccatttattatgggaatgccatttttctagccgatttgcccgccaaaattgacacgcccttgtattcgcccatcaaaatcgcttttgaaaaagcccttaaaaacgctaaagactccgtttttatcgcttcatcgtattttattccaggtaaaaagataatgaaaatctttaaaaatcaaatttctaaggggattgaattgaatattcttaccaattccctttcatctacggacgctatcgtggtctatggggcgtgggaaaggtatcgcaataaattagtgcgaatgggcgcgaatgtctatgaaatacgaaacgattttttcaaccgccagattaaagggcgctttagcaccaaacattccttacacggcaagacaattgtttttgacgatgccctaacgcttctagggagttttaatattgatccgcgctctgcatatattaacactgaaagtgcggtcttgtttgacaacccgtcttttgccaaaagggtgcgtttgtcgcttaaagatcatgcccaacaatcatggcatttagtcttgtatcggcatagagtgatttgggaagctacagaagaaggcatcttaatccatgaaaaaaactcgcctgatacctctttctttttgcgtttgattaaagaatggtctaaagtccttcctgaaagagaactttaa

SEQ ID NO: 14744 - protein, 502 aa, Helicobacter pylori J99
MKIFLVILSVFFFNGCFGLAYKTPISNPPISYDPYTTTIGSLYAKNLKENPKHSAAILLEDGFDALLHRVGLIRMSQKSIDMQTYIYKNDLSSQVIAKELLNAANRGVKVRILLDDNGLDSDFSDIMLLNFHKNIEVKIFNPYYIRNKGLRYFEMLADYERIKKRMHNKLFIVDNFAVIIGGRNIGDNYFDNDLDTNFLDLDALFFGGVASKAKESFENYWRFHRSIPVSLLRTHKRLKNNVKEIAKLHEKIPISAEDANEFEKKVNDFIERFQKYQYPIYYGNAIFLADLPAKIDTPLYSPIKIAFEKALKNAKDSVFIASSYFIPGKKIMKIFKNQISKGIELNILTNSLSSTDAIVVYGAWERYRNKLVRMGANVYEIRNDFFNRQIKGRFSTKHSLHGKTIVFDDALTLLGSFNIDPRSAYINTESAVLFDNPSFAKRVRLSLKDHAQQSWHLVLYRHRVIWEATEEGILIHEKNSPDTSFFLRLIKEWSKVLPEREL

SEQ ID NO: 14745 - DNA, 1509 bp, Helicobacter pylori
  CDS (1)..(1509): transl_table=11
ttgaaaatctttttagtctttttaagcgtctttttttttaatgggtgttttgggttagtctataagactcccatttcaagctctcctatctcttatgatccctacactacccccattgggagcttgtatgctgaaaaattaaaagaaaaccctaaccatagcgcggccattcttttagaagatggctttgacgctctgttgcatagagtgggacttattagaatgagccaaaaaagcattgacatgcaaacttatatctataaaaacgacctttcttctcaagtgattgctaaagaacttttaaatgcggccaatcgtggggtaaaagtgcgcatccttttagacgataacggattggattcggatttttcagatattatgctcttaaatttccataaaaacattgaggtgaaaatttttaacccctactatatccgcaataaaggcttgcgttattttgaaatgcttgcggattatgagcgcattaaaaaacgcatgcacaacaagcttttcatcgtggataatttcgctgtcattataggggggcgcaatattggggacaattattttgataacgatttagacacgaattttttagatttagacgctttgttttttgggggggttgcttcaaaagccaaagaaagctttgaacgctattggagattccaccgctctatccctgtttcattactaagaacccataaaagactcaaaaacaacgctaaagaaatcgctaaactccatgaaaaaatccctatcagcgctgaagacaaaaaccagtttgaaaaaaaagtcaatgattttatagatcgtttccaaaaataccaataccccatttattatgggaatgccatttttttagccgattcacccaaaaaaattgacacgcccttgtattcgcctatcaaaatcgcttttgagaaagcccttaaaaacgctaaggactccgtttttatcgcttcatcgtattttattccaggcaaaaagatgatgaaaatctttaaaaatcaaatttctaaggggattgaattgaacatccttaccaattccctttcatctactgatgcgatagtggtctatggggcatgggaaaggtatcgcaaccaattagtgcgaatgggcgcgaatgtctatgaaatacgaaacgattttttcaaccgccagattaaagggcgctttagcaccaaacattccttgcatggcaagacgattgtttttgatgacaatttaacgcttctagggagtttcaatattgatccgcgctctgcatacatcaacactgaaagcgcggttttgtttgacaacccgtcttttgctaaaagggtgcgtttgtcgcttaaagatcatgcccaacaatcatggcatttggtggtgtatcggcatagagtgatttgggaagcggtggaagaaggcattttaatccatgaaaaaacttcgcctgacacttccttctttttgcgcttgattaaagaatggtctaaagtccttcctgaaagagagctttaa

SEQ ID NO: 14746 - protein, 502 aa, Helicobacter pylori
MKIFLVFLSVFFFNGCFGLVYKTPISSSPISYDPYTTPIGSLYAEKLKENPNHSAAILLEDGFDALLHRVGLIRMSQKSIDMQTYIYKNDLSSQVIAKELLNAANRGVKVRILLDDNGLDSDFSDIMLLNFHKNIEVKIFNPYYIRNKGLRYFEMLADYERIKKRMHNKLFIVDNFAVIIGGRNIGDNYFDNDLDTNFLDLDALFFGGVASKAKESFERYWRFHRSIPVSLLRTHKRLKNNAKEIAKLHEKIPISAEDKNQFEKKVNDFIDRFQKYQYPIYYGNAIFLADSPKKIDTPLYSPIKIAFEKALKNAKDSVFIASSYFIPGKKMMKIFKNQISKGIELNILTNSLSSTDAIVVYGAWERYRNQLVRMGANVYEIRNDFFNRQIKGRFSTKHSLHGKTIVFDDNLTLLGSFNIDPRSAYINTESAVLFDNPSFAKRVRLSLKDHAQQSWHLVVYRHRVIWEAVEEGILIHEKTSPDTSFFLRLIKEWSKVLPEREL

SEQ ID NO: 14747 - DNA, 1242 bp, Escherichia coli
  CDS (1)..(1242): transl_table=11
atgaaatgtagctggcgcgaaggcaataagatccagttgctggaaaacggcgagcaatattatcccgcggtgtttaaggcgattggcgaggcacaagaacgcatcattcttgaaacgtttatctggtttgaggatgacgtcggcaaacaactgcatgcggcactactggcagcagcgcaacgcggggttaaagcggaagtcttgctggatggctacggttcgccggatctcagcgatgagtttgtcaatgaactgacggcagctggcgtagtgttccgctactacgatccccgccctcgcctttttggtatgcgcaccaatgtgtttcgccggatgcatcgcaaaattgtggtaatcgacgcgcgtatcgcctttattggcgggctgaattactccgccgagcatatgtccagctacggtccagaggctaaacaggattacgcggtacgccttgaagggccgattgtcgaagatattctccagtttgagctggaaaacctgcctggacagagcgcggcacgacgctggtggcgacgtcatcacaaagcggaagagaaccgccagccgggagaagcgcaggtattgctggtctggcgcgataacgaagaacatcgcgatgatattgaacgtcactatctgaaaatgctcactcaggcgcggcgagaagtcattatcgccaacgcctacttcttccccggctatcgatttttacacgccttgcgtaaagcggcacggcgcggggtgcggatcaaactgatcattcagggcgaaccggatatgccgattgtcagagtcggtgcgcgcttgctgtataactatctggttaaaggcggcgttcaggtgtttgagtaccgccgccgcccgctccacggcaaagtggcattgatggacgatcactgggcgacagtagggtccagtaatctcgatccgctcagtttgtcactgaatctcgaagcaaatgtcatcatccacgatcgtcattttaaccagacgctgcgcgataatctgaacggcattattgccgcagattgtcagcaggtcgatgagaccatgctgccgaaacgcacctggtggaacctaaccaaaagcgtgctggcgttccactttttacgccacttcccggcgctggttggctggcttccggcacacacgccacgtctggcgcaggttgatcctcccgcacaaccgacaatggaaacgcaggatcgggtagaaactgaaaacacgggggtaaaaccctga

SEQ ID NO: 14748 - protein, 413 aa, Escherichia coli
MKCSWREGNKIQLLENGEQYYPAVFKAIGEAQERIILETFIWFEDDVGKQLHAALLAAAQRGVKAEVLLDGYGSPDLSDEFVNELTAAGVVFRYYDPRPRLFGMRTNVFRRMHRKIVVIDARIAFIGGLNYSAEHMSSYGPEAKQDYAVRLEGPIVEDILQFELENLPGQSAARRWWRRHHKAEENRQPGEAQVLLVWRDNEEHRDDIERHYLKMLTQARREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRHFNQTLRDNLNGIIAADCQQVDETMLPKRTWWNLTKSVLAFHFLRHFPALVGWLPAHTPRLAQVDPPAQPTMETQDRVETENTGVKP

SEQ ID NO: 14749 - DNA, 1242 bp, Salmonella typhimurium
  CDS (1)..(1242): transl_table=11
atgaaatgcggctggcgtgaaggtaatcaaattcagctactggaaaacggcgaccagttctatcctgccgtgtttgaggctatcgctcaggcacagcaaaaaatcattctggaaacctttatcttgtttgaagatgaggtgggtaaaaaactccataccgctctgctaaaagccgcacagcgcggcgtaaaagccgaagtattactcgacggctacggctctcccgatctcagcgacgcgtttgtcggcgaattgacctcagcgggcgtgatttttcgctattacgacccccgcccgcgtctactggggttgcgaaccaatatcttccgccgaatgcaccgcaaaattgtggtgattgatgatcgtattgcctttgtcggcggcattaactactccgccgaacatatgtcggattacggcccgcaggcgaaacaagactacgcggtacgggtcgaagggcctgtagtggccgatatcctgcaattcgaagtcgagaatctgccggggcaaagccccgcgcgccgctggtggaagcgccatcatcaggctgaagaaaatcgccaccccggcgaagcgcaggcgctgtttgtctggcgggataatgaagaacaccgcgacgatatcgaacgtcattatctgaaaatgctgacccaggcaaagcgtgaagtgattatcgctaacgcctattttttccccggctatcgcttgctccacgcaatgcgtaaagccgcccgccgtggcgtgagcgtaaaactgattgtccagggggaaccagacatgccgatagtcaaagtcggcgcgcggttgctctataactatctggtgaagggcggtgtgcaggtttatgaataccgacgacgtccgctgcatggcaaagtggcgctgatggacgatcactgggccacggtagggtcgagtaatctcgatccgctcagcctgtcgcttaaccttgaagctaacctgatcattcacgatcgtacttttaaccagaccctgcgcgataacttacaaggcatcatcgtgaacgattgtaagcaggtcgatgagtctatgctgccgaaacgcacctggtggaacctgaccaaaagcgtgctggcgttccactttttacgtcatttcccggcgctggtcggctggctaccggcgcataccccgcatctggcgcaggttcccccgcctgcccagccagaaatggaaacccaggatcgcgttgatccagaaaatacaggagtgaagccctaa

SEQ ID NO: 14750 - protein, 413 aa, Salmonella typhimurium
MKCGWREGNQIQLLENGDQFYPAVFEAIAQAQQKIILETFILFEDEVGKKLHTALLKAAQRGVKAEVLLDGYGSPDLSDAFVGELTSAGVIFRYYDPRPRLLGLRTNIFRRMHRKIVVIDDRIAFVGGINYSAEHMSDYGPQAKQDYAVRVEGPVVADILQFEVENLPGQSPARRWWKRHHQAEENRHPGEAQALFVWRDNEEHRDDIERHYLKMLTQAKREVIIANAYFFPGYRLLHAMRKAARRGVSVKLIVQGEPDMPIVKVGARLLYNYLVKGGVQVYEYRRRPLHGKVALMDDHWATVGSSNLDPLSLSLNLEANLIIHDRTFNQTLRDNLQGIIVNDCKQVDESMLPKRTWWNLTKSVLAFHFLRHFPALVGWLPAHTPHLAQVPPPAQPEMETQDRVDPENTGVKP

SEQ ID NO: 14751 - DNA, 1242 bp, Shigella flexneri
  CDS (1)..(1242): transl_table=11
atgaaatgtagctggcgcgaaggcaataagatccagttgctggaaaacggcgagcaatattatcccgcggtgtttaaggcgattggcgaggcacaagaacgcatcattcttgaaacgtttatctggtttgaggataacgtcggcaaacagctgcatgcggcactactggcagcagcgcaacgcggggttaaagcggaagtcttgctggatggctacggttcgccggatctcagcgatgagtttgtcaatgaactgacggcagctggcgtagtgttccgctactacgatccccgccctcgcctttttggtatgcgcaccaatgtgtttcgccggatgcatcgcaaaattgtggtgatcgacgcgcgtatcgcctttattggcgggctgaattactcctccgagcatatgtccagctacggtccagaggctaaacaggattacgcggtacgccttgaagggccgattgtcgaagatattctccagtttgagctggaaaacctgcctggacagagcgcggcacgacgctggtggcgacgtcatcacaaagcggaagagaaccgccagccgggagaagcgcaggtattgctggtctggcgcgataacgaagaacatcgcgatgatattgaacgccattatctgaaaatgctcactcaggcgcagcgggaagtgattatcgccaacgcctacttcttccccggctatcgatttttacacgccttgcgtaaagcggcacggcgcggggtgcggatcaaactgatcattcagggcgaaccggatatgccgattgtcagagtcggtgcgcgcttgctgtataactatctggttaaaggcggcgttcaggtttttgagtaccgccgccgcccgctccacggcaaagtggcattgatggacgatcactgggcgacagtagggtccagtaatctcgatccgctcagtttgtcactgaatctcgaagcaaatgtcatcatccacgatcgtcattttaaccagacgctgcgcgataatctgaacggcattattgccgcagattgtcagcaggtggatgaaaccatgctgcccaaacgcacctggtggaacctgaccaaaagcgtgctggcgttccactttttacgccacttcccggcgctggttggctggcttccggcacacacaccacgtctgacgcaggttgatccccccgcacaaccgacaatggaaacgcaggatcgggtagaaactgaaaacacgggggtaaacccctga

SEQ ID NO: 14752 - protein, 413 aa, Shigella flexneri
MKCSWREGNKIQLLENGEQYYPAVFKAIGEAQERIILETFIWFEDNVGKQLHAALLAAAQRGVKAEVLLDGYGSPDLSDEFVNELTAAGVVFRYYDPRPRLFGMRTNVFRRMHRKIVVIDARIAFIGGLNYSSEHMSSYGPEAKQDYAVRLEGPIVEDILQFELENLPGQSAARRWWRRHHKAEENRQPGEAQVLLVWRDNEEHRDDIERHYLKMLTQAQREVIIANAYFFPGYRFLHALRKAARRGVRIKLIIQGEPDMPIVRVGARLLYNYLVKGGVQVFEYRRRPLHGKVALMDDHWATVGSSNLDPLSLSLNLEANVIIHDRHFNQTLRDNLNGIIAADCQQVDETMLPKRTWWNLTKSVLAFHFLRHFPALVGWLPAHTPRLTQVDPPAQPTMETQDRVETENTGVNP

SEQ ID NO: 14753 - DNA, 23 bp, Primer
atgatgaagaaaacgcccacctc

SEQ ID NO: 14754 - DNA, 24 bp, Primer
ttacaataaccattccacgggcaa

SEQ ID NO: 14755 - protein, 736 aa, consensus
  MISC_FEATURE (1)..(736): consensus for the disclosure of Xaa see table VIII
WLXXLXXLXXLXXXXXLXXGXXXXXXXXXXXXXXXXXXXXXXXXXXXXXXXXXXXXXXXXXXXXXXXXXXXXXXXXXXXXXXXXXXXXXXXXXLXXXXXXXXXXXXXXXNXVXLLXXGXEXFXALLXXIXXAXXXIXLXYYIFXXDXIGXXLXXALIXAAXRGVXVRLLLDXIGSXXXXXXXXXXXXXXXLXXXGVXVXXFXPXXXXXXXXXXXXXXXXXXXXXXXXXXRLNXRXHRKIVVIDGXIGFVGGXNIGDEYXXXXXXXXXXXXXXXXXXXXXXXXXXXXWXDXXVRVXGPXVXXLXXXFXXDWXXXTXXXXXXXXXXXXXXXXXXXXXXXXXXXXXXXXXXXXXXXXXXXXXXXXXXXXXXXXXXXXXXXXXXXXVXVVAXGPXXXXXXIXXXXXXXXXXXXXXXXLXLIXXARKXIXIXTPYFVPXXXLLXALXXAAXRGVXXXXXVXILLPXXXDXXLVXXAXXXYXXXXXXXXXXXXXLLXAGVKIYXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLHAKXVVVDXXXXXXXXXIAXVGSANLDXRSXXLNXEVXVVIXDXXXLAXXLXXXXXXDLXXSXXLXXXXWXXRXXXXXXXXXXXXXXXXXXXXXXXXXXXXXXXXXXXXXXXXRLXXXLXRLLSXLL

SEQ ID NO: 14756 - protein, 17 aa, consensus
  MISC_FEATURE (1)..(17): consensus for the disclosure of Xaa see table VIII
LXXXAXXXGXXXXXXXD

SEQ ID NO: 14757 - protein, 20 aa, consensus
  MISC_FEATURE (1)..(20): consensus for the disclosure of Xaa see table VIII
RXHXKXXXXDXXXXXXGXXN

SEQ ID NO: 14758 - protein, 22 aa, consensus
  MISC_FEATURE (1)..(22): consensus for the disclosure of Xaa see table VIII
YXXPXXXXXXXXXXXXXXGXXV

SEQ ID NO: 14759 - protein, 29 aa, consensus
  MISC_FEATURE (1)..(29): consensus for the disclosure of Xaa see table VIII
HXKXXXXDXXXXXXGXXNXXXRSXXXXXE

SEQ ID NO: 14760 - DNA, 192 bp, Escherichia coli
  CDS (1)..(192)
atgcctgagactactaagctgtttaattgtggcgataataagataaaagaaattcaatacttcccaaatcatctggagaaagcacgtatggagtgtgatattgaggttgtctctgcgatatatagcaataaagaattactttttaaagaatgtaattcttttgaagagacatttttatatcatggactttga

SEQ ID NO: 14761 - protein, 63 aa, Escherichia coli
MPETTKLFNCGDNKIKEIQYFPNHLEKARMECDIEVVSAIYSNKELLFKECNSFEETFLYHGL

SEQ ID NO: 14762 - DNA, 1140 bp, Escherichia coli O157:H7 EDL933
  CDS (1)..(1140): transl_table=11
atgtttccattaaatgatctgtcgttaaaaactcagtcggttcaattaaataaaatcacatcgaatactgagtctacgataaaacaacacgagttagtatctgatgatgcaatcataaatgaattatcaagtgagttagtcagttgtcttggaaatgataagtttacaccagttagtgaagactgcaacttactgaatatgctgtctgaatttaagttattgagagagcaatgtttcaggtggggtaattatactctattgtttgaaaattatgagtcttatgataagacggggtctatcacgatagaaaaaaatcagggggaggggactttacccattcggcataaattagagtttatatcgactaatattgcagagttgctggacaagttaacgaaaattacagatgccagactttgcaaaggcttcagtgactgggctagttcagtcaaagaaggcggatcgaatgacctcaaagaaaatgtagatagagcgttggtgagaatgtttaaatgtgttaagcttcacagtaatgaacttgacttatcatacctatttttgggttctgtgccgcctcttccagattggattgaaatgcttagccttgtttataatgaacttgattcaatacaggttcccgaatcatgcaaagaattagaactcgatttcaataaccttacagaatttccacaagtacctgatggaattaccctgatctccgtaaataataacctgatatcgcatattgactcatttccgccaaaggctaagaaaatttttattagtcacaataagctatcggaaacaccagcaataccagacaccgctaaggtttttgattgtggctataataagatacaagaaattcgatacttccccaaaaatctgaaagaagcgcgtattggatataataatattgaggttgttcctgcgatacctggcaatttaaaaatactttttatggaatgtaatcctattaaagaggcatttttaatgccatggactctgacagggatctgctatgaaatatcgcagcgaaaatatattgttacgaatccagccgattatgataaatattccgatatggttaaaaagcatgtaatagatggtgaggaactcataattaaatattttatgtaa

SEQ ID NO: 14763 - protein, 379 aa, Escherichia coli O157:H7 EDL933
MFPLNDLSLKTQSVQLNKITSNTESTIKQHELVSDDAIINELSSELVSCLGNDKFTPVSEDCNLLNMLSEFKLLREQCFRWGNYTLLFENYESYDKTGSITIEKNQGEGTLPIRHKLEFISTNIAELLDKLTKITDARLCKGFSDWASSVKEGGSNDLKENVDRALVRMFKCVKLHSNELDLSYLFLGSVPPLPDWIEMLSLVYNELDSIQVPESCKELELDFNNLTEFPQVPDGITLISVNNNLISHIDSFPPKAKKIFISHNKLSETPAIPDTAKVFDCGYNKIQEIRYFPKNLKEARIGYNNIEVVPAIPGNLKILFMECNPIKEAFLMPWTLTGICYEISQRKYIVTNPADYDKYSDMVKKHVIDGEELIIKYFM

SEQ ID NO: 14764 - DNA, 1140 bp, Escherichia coli O157
  CDS (1)..(1140): transl_table=11
atgtttccattaaatgatctgtcgttaaaaactcagtcggttcaattaaataaaatcacatcgaatactgagtctacgataaaacaacacgagttagtatctgatgatgcaatcataaatgaattatcaagtgagttagtcagttgtcttggaaatgataagtttacaccagttagtgaagacagcaacttactgaatatgctgtctgaatttaagttattgagagagcaatgtttcaggtggggtaattatactctattgtttgaaaattatggggcttatgataagacgggatctatcacgatagaaaaaagtcagggggaggggactttacccattcggcataaattagagtttatatcgaccaatattgcagagttgctggacaagttaaccaaaattacagatgccaggctttgcaaaggtttcagtgactgggctagttcagtcaaagaaggcgcatcgaatgacttgaaagaaaatgtggatagagcattggtgagaatgtttaaatgtgttaagcttcacagtaatgaacttaacttatcaagcctttctttgggttctgtgccgcctcttcctgagtggattgaaatgcttagccttgtttataatgaacttgattcaatacaggtgcccgaatcgtgcaaagaattagaactcgatttcaataaccttacagaatttccacaagtacctgatggaattaccctgatctccgtaaataataacctgatatcgtatattgactcatttccgccaaaggctaagaaaatttttatttgtcacaataagctatcggaaataccagcactaccagacaccgctaaggtttttgattgtagtgagaataatattaaagaaattagatggttccccaaaaatttgaaagaagcgtatattgaatataataagattgaggttattcctgcgatacctggcaatttaaaattactttgtatgaaatgtaatcctattaaagaggcatttttaatgccatggacccttacagggattcgctatgaaatatcgcagcgaaaatatattgttatgaatcccgccgattatgataaatattccgatatggttaaaaagcatgtaatagatggtgaggaattcataattaaatattatatgtaa

SEQ ID NO: 14765 - protein, 379 aa, Escherichia coli O157
MFPLNDLSLKTQSVQLNKITSNTESTIKQHELVSDDAIINELSSELVSCLGNDKFTPVSEDSNLLNMLSEFKLLREQCFRWGNYTLLFENYGAYDKTGSITIEKSQGEGTLPIRHKLEFISTNIAELLDKLTKITDARLCKGFSDWASSVKEGASNDLKENVDRALVRMFKCVKLHSNELNLSSLSLGSVPPLPEWIEMLSLVYNELDSIQVPESCKELELDFNNLTEFPQVPDGITLISVNNNLISYIDSFPPKAKKIFICHNKLSEIPALPDTAKVFDCSENNIKEIRWFPKNLKEAYIEYNKIEVIPAIPGNLKLLCMKCNPIKEAFLMPWTLTGIRYEISQRKYIVMNPADYDKYSDMVKKHVIDGEEFIIKYYM

SEQ ID NO: 14766 - DNA, 24 bp, Primer
atgcctgagactactaagctgttt

SEQ ID NO: 14767 - DNA, 28 bp, Primer
ttaaagtccatgatataaaaatgtctct

SEQ ID NO: 14768 - protein, 59 aa, consensus
  MISC_FEATURE (1)..(59): consensus for the disclosure of Xaa see table VIII
PDTAKVFDCXXNXIXEIRXFPKNLKEAXIXYNXIEVXPAIPGNLKXLXMXCNPIKEAFL

SEQ ID NO: 14769 - DNA, 1686 bp, Escherichia coli
  CDS (1)..(1686)
atgtacgattttaatctggtgttgctgctgcttcagcagatgtgcgtttttttagtcattgcgtggttaatgagtaaaacgccattattcataccgttaatgcaggtcacggttcgtctgccgcataaatttctctgctacatcgtcttttccatcttctgcatcatgggcacctggtttgggttgcacattgacgattctattgccaatacccgtgcgataggcgcggtaatgggcggcttactcggcggtccggtcgtcggtgggctggttggtctgaccggcggcttacatcgatattcgatggggggcatgaccgcgctaagttgcatgatctcaaccatcgttgaaggattgctcggcggcctggtacacagcatcctgatccgtcgcgggcgcactgataaagtctttaaccccattaccgccggtgccgtcacgttcgtcgctgaaatggtgcaaatgctgatcatccttgcgatcgcccgaccttatgaagatgcggtgcgtctggtgagtaatattgctgcgccaatgatggtcaccaataccgtcggcgcggcgctgtttatgcgtatattgctcgataaacgcgcgatgtttgaaaaatacacttcggctttttctgccactgcgctgaaagtggcagcctcgacggaaggcattttgcgacaggggtttaacgaagtgaacagcatgaaagtggctcaggtactgtatcaggagctggatattggtgcagtcgcgattaccgatcgagagaaattgctggcctttaccggaattggtgacgaccaccatttacccggcaaaccgatttcttcgacttacaccttaaaagcgattgaaaccggtgaagtggtctacgctgatggcaacgaagtaccttatcgttgctctttgcatccgcaatgcaaactggggtcgacgctggtaattccgttgcgtggcgaaaatcagcgcgtgatgggcaccatcaaattgtatgaagccaaaaaccggttattcagttcaataaaccgcacgctgggcgaggggattgcgcaactgctttcggcgcagattcttgcagggcaatatgagcggcaaaaagcgatgctcacccagtcagaaatcaaactgcttcacgcccaggtgaatcctcattttttgtttaatgcgcttaacaccattaaagcggtgatccgccgcgacagcgaacaggccagccagctggtgcagtatctttccacttttttccgcaaaaacttaaagcggccttcggagtttgttactctcgccgacgaaattgaacatgtgaacgcttatctgcaaattgaaaaggcgcgcttccagtcgcggttgcaggtcaacattgctattccgcaagaattatcccagcagcaattgcccgcgtttaccctgcaaccgatagtggaaaacgccattaaacatgggacatcacaactgctggatacagggcgagtggcaatcagcgcccgacgtgaggggcaacatttgatgctggagatcgaagacaatgccggtttgtatcaaccggtaaccaatgccagtgggctggggatgaatctggtggataagcgtttacgtgaacggtttggcgatgactatggaataagcgtcgcctgtgagcctgatagttacacccgaataacgttacgactaccatggagggacgaggcatga

SEQ ID NO: 14770 - protein, 561 aa, Escherichia coli
MYDFNLVLLLLQQMCVFLVIAWLMSKTPLFIPLMQVTVRLPHKFLCYIVFSIFCIMGTWFGLHIDDSIANTRAIGAVMGGLLGGPVVGGLVGLTGGLHRYSMGGMTALSCMISTIVEGLLGGLVHSILIRRGRTDKVFNPITAGAVTFVAEMVQMLIILAIARPYEDAVRLVSNIAAPMMVTNTVGAALFMRILLDKRAMFEKYTSAFSATALKVAASTEGILRQGFNEVNSMKVAQVLYQELDIGAVAITDREKLLAFTGIGDDHHLPGKPISSTYTLKAIETGEVVYADGNEVPYRCSLHPQCKLGSTLVIPLRGENQRVMGTIKLYEAKNRLFSSINRTLGEGIAQLLSAQILAGQYERQKAMLTQSEIKLLHAQVNPHFLFNALNTIKAVIRRDSEQASQLVQYLSTFFRKNLKRPSEFVTLADEIEHVNAYLQIEKARFQSRLQVNIAIPQELSQQQLPAFTLQPIVENAIKHGTSQLLDTGRVAISARREGQHLMLEIEDNAGLYQPVTNASGLGMNLVDKRLRERFGDDYGISVACEPDSYTRITLRLPWRDEA

SEQ ID NO: 14771 - DNA, 1677 bp, Vibrio cholerae O1 biovar eltor str. N16961
  CDS (1)..(1677): transl_table=11
atggatctcatcctctcattactgcaacagatgtgtgtttaccttgttctcgcctatatgttgagtaaaacgccgatcttcattcctttgctgaacatttctggtcggtttgaccacaaaatcagtgtttatgttctgttttcgctgttttgcattatgggcacctactttggcctgcagatcaatgatgcgattgccaatacgcgtgccatcggcgctgtgatggggggtctgtttggtggacctgtgattggttttgcggtgggcctcaccggaggcttacaccgctataccttagggggatttaccgatctcgcctgcgcgatttccaccaccgctgaaggtttaattggcggcttgctacacacctatttgctgcgcaaaggcaaagggaagttactgtttagcccaagtattgtctttgcggtcaccttatttgccgaaattgtgcagatgctgatcatcttggtcgtggcgaaaccgtttgaacagtcttacgcgctggtttccaccatcgccgcgccgatgatcattgctaactcagtcggtgccgcactgtttatgagcatcttgctcgatcgcaaaaccatttttgaagagtattccgcgacgttttcacgccgcgctctgaatattgccgagcgttctgttggtatccttgctgccggttttaacccagaaaacgccaacaaaattgcccgaatcgtgtatgaacagaccaatgtcggcgcggtctcgatcaccgatcgcgaaaaaatcctcgcctttgtcgggattggcgatgatcaccataaaccgaatacaccgatcagctcgcaaagcacgctcgatgcgattaatcgcaacgccatcatctatctcgatggcaaagaacatccttatcaatgttctttgtctccgacctgcaaactggggtctgcgttaatcattccgttgcgagctggcgatcgagtgatcggcaccatcaagctctacgagccaaaacgtaagctgttttccaccatcaatatgtcaatggcacagggcatcgcccaactgctatccagccaaattttgtatggcgaatatcagcaaaaacaaatcctgctctcgcgagcggaaatcaaactcctgcaagcgcaggtcaatccgcattttttgtttaacgcactcaataccatcagtgcggtgatccgccgtgagccagataaagctcgcgagctgattttgcatctgtcgcaatttttccgcagcaacctcaaacagaacgtcgaaaccgtcactttgcgtgaagagcttgcccacgtgaacgcttacctcactattgaaaaagcgcgctttagtgacaggctcgatgtggaaattgcgattgatgatgccctgctagaacgcaatgtcccgagcttcactttgcagcctttggtggaaaatgccatcaaacacggcacctctaacctactcgaagctggcaaagtgcgcatttacagtgaagtggttgaagggggaatgcgcgtcgtggtggaagacaacgccgggctctatcagcctccgagtgaagattatgatggtttagggatgcaaattgttgaaaagcgcctcaccaacaaatttggtcttaagtcagggctacagattgaggtcgcgccacaagagtacacgcgaatgagctttgtcattccacagcaaggcacttactaa

SEQ ID NO: 14772 - protein, 558 aa, Vibrio cholerae O1 biovar eltor str. N16961
MDLILSLLQQMCVYLVLAYMLSKTPIFIPLLNISGRFDHKISVYVLFSLFCIMGTYFGLQINDAIANTRAIGAVMGGLFGGPVIGFAVGLTGGLHRYTLGGFTDLACAISTTAEGLIGGLLHTYLLRKGKGKLLFSPSIVFAVTLFAEIVQMLIILVVAKPFEQSYALVSTIAAPMIIANSVGAALFMSILLDRKTIFEEYSATFSRRALNIAERSVGILAAGFNPENANKIARIVYEQTNVGAVSITDREKILAFVGIGDDHHKPNTPISSQSTLDAINRNAIIYLDGKEHPYQCSLSPTCKLGSALIIPLRAGDRVIGTIKLYEPKRKLFSTINMSMAQGIAQLLSSQILYGEYQQKQILLSRAEIKLLQAQVNPHFLFNALNTISAVIRREPDKARELILHLSQFFRSNLKQNVETVTLREELAHVNAYLTIEKARFSDRLDVEIAIDDALLERNVPSFTLQPLVENAIKHGTSNLLEAGKVRIYSEVVEGGMRVVVEDNAGLYQPPSEDYDGLGMQIVEKRLTNKFGLKSGLQIEVAPQEYTRMSFVIPQQGTY

SEQ ID NO: 14773 - DNA, 1686 bp, Salmonella typhimurium LT2
  CDS (1)..(1686): transl_table=11
atgtacgagtttaatctggtgttgctgctgcttcagcagatgtgcgtgtttctggtcattgcgtggctaatgagtaaaacgcgcctgttcatcccgcttatgcaggtcacggttcgtctgccgcacaagcttctgtgttacgtcacgttttctatcttctgcatcatgggcacttattttgggctgcatatcgaagattcgattgccaatacccgcgcaattggcgcggtgatgggcggcctactcggcgggccggtcgtcggcgggctggtcggtctgaccggtgggttacatcggtattctatgggcggcatgacggcgctgagctgtatgatttccaccatcgtcgaagggctgttgggcgggttggtacacagcgttctcatacgtcgcggacgcccggacaaagtgtttagcccgctgacggcgggagcaattacgtgtattgccgaactggtgcagatgctgatcattttactgatagccaggccgtttgacgatgccttgcatctggtcagtaatattgccgcgccgatgatggtgacgaataccgttggcgccgcgctgttcatgcgtattttgctcgataagcgcgccatgttcgaaaaatatacttcggcattttctgctaccgcgctgaaggtcgccgcgtcaacggaggggattctgcgtcagggatttaacgaagtgaacagtatgaaggtggcgcaggtgttatatcaggagctggatattggcgccgtcgccatcaccgatcgcgaaaaactgctggcttttactggtattggcgacgatcaccatctaccgggcaaacccatttcatcaggttatacgctgaaagcaattgaaaccggagaggtggtttatgccgatggcaacgaagtgccgtatcgctgttcgctacacccgcagtgtaaactcggttcgacgctggtgatcccgctgcgtggcgaaaatcagcgagtcatgggcaccattaaattgtacgaagcgaaaaaccgactgttcagctcaattaaccgcaccctgggagagggtattgcgcagcttttatccgcgcagatcctggccgggcagtatgaacggcagaaggcgttgctgacgcagtcagagatcaagctgttgcacgcgcaggtgaacccgcattttctgtttaacgcgctcaataccattaaagcggtgattcgccgcgacagcgaacaggccagccaactggtgcagtacttgtcgaccttttttcgcaaaaatttaaaacgcccgtcggaaatcgtcacgctggcggatgaaattgaacacgtaaacgcttatctgcaaattgaaaaagcgcgttttcagtcgcgtctgcaggtacagcttgatgttccatcgacgctttcacgtcagaaattgcctgcgtttacattacagccgattgttgagaacgccattaaacatggcacgtcgcaactgcttgataccggcaacgtcgctattcgcgcccggcgcgaagggcagcatttgatgttagatattgaggataatgcgggactgtatcagccttccgccggcagtagcgggctggggatgagtctggttgataaacgtctgcgcgaacactttggcgatgattatggtattagcgtggcctgcgagccggactgttttacccgaattacattacgacttccactggaggaggacgcatga

SEQ ID NO: 14774 - protein, 561 aa, Salmonella typhimurium LT2
MYEFNLVLLLLQQMCVFLVIAWLMSKTRLFIPLMQVTVRLPHKLLCYVTFSIFCIMGTYFGLHIEDSIANTRAIGAVMGGLLGGPVVGGLVGLTGGLHRYSMGGMTALSCMISTIVEGLLGGLVHSVLIRRGRPDKVFSPLTAGAITCIAELVQMLIILLIARPFDDALHLVSNIAAPMMVTNTVGAALFMRILLDKRAMFEKYTSAFSATALKVAASTEGILRQGFNEVNSMKVAQVLYQELDIGAVAITDREKLLAFTGIGDDHHLPGKPISSGYTLKAIETGEVVYADGNEVPYRCSLHPQCKLGSTLVIPLRGENQRVMGTIKLYEAKNRLFSSINRTLGEGIAQLLSAQILAGQYERQKALLTQSEIKLLHAQVNPHFLFNALNTIKAVIRRDSEQASQLVQYLSTFFRKNLKRPSEIVTLADEIEHVNAYLQIEKARFQSRLQVQLDVPSTLSRQKLPAFTLQPIVENAIKHGTSQLLDTGNVAIRARREGQHLMLDIEDNAGLYQPSAGSSGLGMSLVDKRLREHFGDDYGISVACEPDCFTRITLRLPLEEDA

SEQ ID NO: 14775 - DNA, 1626 bp, Fusobacterium nucleatum subsp. nucleatum ATCC 25586
  CDS (1)..(1626): transl_table=11
atgatagcatttttctttataaaaattgatagagcaaatattattataaaaagtaaagctaagactaaaaaagatattgttgctctatcttttttcttttcactgctttctattagtggaacttatataggattaaattttaatggtgctattttaaatacaagaaatgttggagttattgcaggtggtattttgggtggtccttatgtttcaataattacaggacttgtagctggaatacatagagcctttgtaaatcttggaagagaaactgctattccctgtgctatttcaacaataataggtggatttttaactgcctatgtacatcgttttataaaaaataaagataggatattttttggatttttcctagcctgtactattgaaaatcttagtatgggattaattttaattttacttatagataaaattttagctcaaaatatagttacaagtttctatattccaatggttcttatgaattccattggggcaagtgttctaattttaatagttgaagacattattcaaaaaagtgaaattgtagcaggaaaccaagctaaacttgctttagagatagcaaataaaactttaccttattttagagaaactgaaaatcttagtgaagtatgtaaaataattgctgaaaatttaggggcaaaagcaacagtaataactgacaaaaaagatattatagcaggattttcctttgacaaagcagagataacaagaactgctataaaaagtaataatacaagaaaagttttaaaaactggggaagtaatgctagttataaaagaagatgatgaaattatagaggattttttagatatttcacctcatataaaatcttgtattattttacctttaaaggagaaaaatgatgtaaatggtacattaaaaattttctttgatacagcagaaaaaataacagaaaagaacagatatctgatgataggtttatcacatcttatatcaacccaaatggaaatcagtaaggtagaaaatttaatatctttacttaaatattctgagttgaaagccttacaatctcaaataaatccacactttttatttaatgtattaaacactatgacctctcttatcagaacaaatcctgaaaaagcaagagaagtaacaatagatttatccaattatttaagatataatttagataacaatgtaaaaagtgtagagcttataaaagaattaaatcaaattgataactatataaaaattgaaaaagcaaggtttggagataaacttaatatagtttatgatgttgatgaaagcttatataattttcaaattccaagtttaattattcagcctctcgttgaaaatagcataaaacatggtattttaaagaaaagagaaaatggctgtgttaaagtaattgtaaagaaaattgataaggatatagaagtcataattgaggatgatggagtaggtatagaacaaactgtaattgacaatttagataaacagatacaagaaaatattggtcttaaaaatgttcatcaaagattaaaacttctctatggagaaggacttaatataaagaaattagagcagggaactagaataaattttaggatacttggaggtgtaaaatatgattaa

SEQ ID NO: 14776 - protein, 541 aa, Fusobacterium nucleatum subsp. nucleatum ATCC 25586
MIAFFFIKIDRANIIIKSKAKTKKDIVALSFFFSLLSISGTYIGLNFNGAILNTRNVGVIAGGILGGPYVSIITGLVAGIHRAFVNLGRETAIPCAISTIIGGFLTAYVHRFIKNKDRIFFGFFLACTIENLSMGLILILLIDKILAQNIVTSFYIPMVLMNSIGASVLILIVEDIIQKSEIVAGNQAKLALEIANKTLPYFRETENLSEVCKIIAENLGAKATVITDKKDIIAGFSFDKAEITRTAIKSNNTRKVLKTGEVMLVIKEDDEIIEDFLDISPHIKSCIILPLKEKNDVNGTLKIFFDTAEKITEKNRYLMIGLSHLISTQMEISKVENLISLLKYSELKALQSQINPHFLFNVLNTMTSLIRTNPEKAREVTIDLSNYLRYNLDNNVKSVELIKELNQIDNYIKIEKARFGDKLNIVYDVDESLYNFQIPSLIIQPLVENSIKHGILKKRENGCVKVIVKKIDKDIEVIIEDDGVGIEQTVIDNLDKQIQENIGLKNVHQRLKLLYGEGLNIKKLEQGTRINFRILGGVKYD

SEQ ID NO: 14777 - DNA, 1740 bp, Thermoanaerobacter tengcongensis MB4
  CDS (1)..(1740): transl_table=11
atgtatgaccttttaatcattctggcggaaagatttagcataattgcacttttagcctttctcctctcaaaagccgaatttttcaaaaaaatggtatacaatactgctctcaccaaaaaagacctgctcatcaccatgcttatatttggcctgattggaatagcaggaacttacctaggagtccccataaatgacgcaatagcaaattcaagagtagtgggccctatggtggcagggcttataggcggacctcttgtaggcctgggcgcaggccttatagcaggtgtacatcgcttcttcctaggaggcttcacagccatctcctgtggaatatccaccattattgaaggttttgcaggtggcctcatacgaaaatactacaaaggtgaatatataccctgggaatacgcatttatggcaggatttataggcgaaggagtgcagatgctgataattttggcgacagctaaaccttttcatcaggccgttgaacttgtaaaaatcataggaatccctatgatggtagtaaatgctacaggaataggcatttttatgataatgataaaatccatattcgacgaaaaagaacagattgctgcaatgcaggcaaaaatagctttagatatcgcctccaaaactcttccttatttgagaaaaggcttaaatgaagaatccgctcaaaagacagcagaaataatcttagagtgcacaaatgtctccgcagtagcaatcactgacaaaaagagaatactggcccatgtcggaatagcttctgaccaccacaaaccagggatgtccatactaacaaatgccacaaaagaagcaatacaaaaaggagaaataaggattgcaaagtctaaagaagaaataggctgtccttatgaaaactgtgaacttcactctgctgtaattgtaccactttttaaatatgacaaactagtaggtactctaaaactttacaaaggaggaaaaaaatcgcgcggcaatgtaataaccaatacagagatagaactggcgaaggggctgggacatttgatatcatatcagctagaaattgcagatgcagagtaccagaaaaaattggcaaccgaggcaaaattaaatgcccttcagtcccaaataaaccctcattttctgtttaactctttaaatactgttatttccttcatacgcacaaatccagaaagggcaagagaacttttaataaatttgagtgaatatttcaggcacaatctgagaaatgtaggaaaatatataaccattgaagaagaattaaacaatataaacgcgtatctgtatattgaaaaagctcgttttggcgacaaactgaatgtagagcaagatgtagatataagtgtgctttcctgttacatgccctcatttatactgcagcctattgtagaaaatgctgtaaagcatggaattttaccaaaaggcgaaagagggacggtaaaaataaaaataaaagatgaaggagattatataagcttctatgtggaagatgatggggtaggaatgactgaagaagaactgcaaaatctctttaagaagggagtaggaaaaggagcaggaataggtctttacaatgtcaacgaaaggctcactgtggctttttgcaaggaatgtgccttgtcaattgaaagtaaattaggtgaaggcacaaaagtatccttcaaaattcctaaaatttacctgcagaggaatgatatttatgaagaagctgagagcgttaattattga

SEQ ID NO: 14778 - protein, 579 aa, Thermoanaerobacter tengcongensis MB4
MYDLLIILAERFSIIALLAFLLSKAEFFKKMVYNTALTKKDLLITMLIFGLIGIAGTYLGVPINDAIANSRVVGPMVAGLIGGPLVGLGAGLIAGVHRFFLGGFTAISCGISTIIEGFAGGLIRKYYKGEYIPWEYAFMAGFIGEGVQMLIILATAKPFHQAVELVKIIGIPMMVVNATGIGIFMIMIKSIFDEKEQIAAMQAKIALDIASKTLPYLRKGLNEESAQKTAEIILECTNVSAVAITDKKRILAHVGIASDHHKPGMSILTNATKEAIQKGEIRIAKSKEEIGCPYENCELHSAVIVPLFKYDKLVGTLKLYKGGKKSRGNVITNTEIELAKGLGHLISYQLEIADAEYQKKLATEAKLNALQSQINPHFLFNSLNTVISFIRTNPERARELLINLSEYFRHNLRNVGKYITIEEELNNINAYLYIEKARFGDKLNVEQDVDISVLSCYMPSFILQPIVENAVKHGILPKGERGTVKIKIKDEGDYISFYVEDDGVGMTEEELQNLFKKGVGKGAGIGLYNVNERLTVAFCKECALSIESKLGEGTKVSFKIPKIYLQRNDIYEEAESVNY

SEQ ID NO: 14779 - DNA, 1698 bp, Yersinia pestis KIM
  CDS (1)..(1698): transl_table=11
atgggcattagccaaacagaactgatcttttcccttttacaacagatgtgtgtgtatttggttattgcctatctgctgagtaaaacaccgctttttatccccttgatgcaagttactatcaggttgccccataaactggtgtgctatctcaccttttccatgttttgcattatgggcacctactttggtcttaacattgatgattctatcgcgaatactcgtgctatcggcgcagtcttgggtggaatgctaggggggccatcggtcgggtttctggtagggctaaccggaggcctgcatcgttattcaatgggggggatgaccgcaaccgcctgtatgttatcaaccattgctgaagggttattgggcggccttctccacctttatctgacacgtaaaaaccgcctcgatttattgtttcagccactggtggtcgcgggcattacactggtagccgaagtgctacaaatgatgattattctggccgtcgcccgccccttcaatgaagcggtcgaattggttgaaaatattgccttgccgatgatgatcaccaataccattggtgccgccatgtttatgcgtatcttattagaccgccgggccattttcgaaaaatacaccacggcattttctgccaaggcgctacaaattgctgcacgggcggaggggctactgcgccatggctttgaccagcagaacagtatgcgggtggctcgtatcttgtatgaggagttgggtgtgggcgcagtagccattactgatcgcgaaaaattactggcctttatcggtagcggtgccgaccaccatcaggtgggcagtgctattacctccagccatacccaccgcgcgattgaactcaatcaggtggtgtatgccgacggcaatgccgtgccttatacctgctcaatttcacccacctgtaagctgggttcaacactggttatccctttgcgaggtgaagagcaccgggtgatcggcagtatcaaattgtatgagccaaaaagtaaattattctccagcattaaccgcaccttaggagagggtattgcgcacttattgtcagcacagattttggcgggagaattcgaacaacaaaaacaattactggcgcaatctgaaatcaaactgctccatgcacaggtcaacccacatttcttgtttaatgcgctcaataccctatcagtggtgatccgccgtaatccagatcatgcccgcaatttggtgctttctttatcaacctttttccgtaaaaacctaaaacgcagccatgacgtggtcacgttaagtgatgagattgaacatgtgaatgcgtatcttgaaatagaaaaggcacgctttgctgatcgtctgaccgtcacggtttcactaccgaatgaactgatggaggcgcacttacccgcgttctccctgcaacccgtggtagaaaatgcaatcaaacatggtatctcacagatgttcagtaacggacgggtcacgttgcgcggtaaattggatgacaacacgttggtattggaagtcgaagataacgccggtttatatcagccgcagccggatggcgatggtctgggaatgagtttggttgatcggcggattaaagcgcgctatggcaaggaatatggcatcaccgtcgtcagtaacgcggaagtatttacccgtattattattaagttaccgtttattaccgtgagcgagcagtaa

SEQ ID NO: 14780 - protein, 565 aa, Yersinia pestis KIM
MGISQTELIFSLLQQMCVYLVIAYLLSKTPLFIPLMQVTIRLPHKLVCYLTFSMFCIMGTYFGLNIDDSIANTRAIGAVLGGMLGGPSVGFLVGLTGGLHRYSMGGMTATACMLSTIAEGLLGGLLHLYLTRKNRLDLLFQPLVVAGITLVAEVLQMMIILAVARPFNEAVELVENIALPMMITNTIGAAMFMRILLDRRAIFEKYTTAFSAKALQIAARAEGLLRHGFDQQNSMRVARILYEELGVGAVAITDREKLLAFIGSGADHHQVGSAITSSHTHRAIELNQVVYADGNAVPYTCSISPTCKLGSTLVIPLRGEEHRVIGSIKLYEPKSKLFSSINRTLGEGIAHLLSAQILAGEFEQQKQLLAQSEIKLLHAQVNPHFLFNALNTLSVVIRRNPDHARNLVLSLSTFFRKNLKRSHDVVTLSDEIEHVNAYLEIEKARFADRLTVTVSLPNELMEAHLPAFSLQPVVENAIKHGISQMFSNGRVTLRGKLDDNTLVLEVEDNAGLYQPQPDGDGLGMSLVDRRIKARYGKEYGITVVSNAEVFTRIIIKLPFITVSEQ

SEQ ID NO: 14781 - DNA, 1740 bp, Streptococcus agalactiae 2603V/R
  CDS (1)..(1740): transl_table=11
atgacactctttttaattatgatggagcgagcggggttaatcatattattagcctatgcctttgtgcatatcccctttataaaacaaactttgaagcaacccgaattaaaaaaacaccagtatattctgcttatcttatttagcttatttgctattatttctaattttacaggggtagaaattcagtcagatttatctatcattccacaaactcttaatcatatagcagatcaatcatcggttgccaatacacgtgttttaaccattggtgtatcaggtctaatcggtggccccatagtcggtattatagttggtctcttatctgtattcgttaggtatttgcaaggaggattagcccctcatatttatgtcatttcttccttactaattggtttatgctctggattatcaggcaattatcttcgtaaaaattataataaaattcgtgttttagatgcaatggttgttggtttcggtatggaaattctacaaatgatctgtatcctcatttttagtgttgactttaatcaggcgcttcgcttagtatcttttatcagcatgccaatgattttaagtaatactttaggtttaggtatatttatatccattatttcatctactcaaaaattagaagaacatgctaaagcatttcaaacccatcaagtacttgaattagcaaatttaacccttccttaccttagaaagggactgacaacagaatcttgtcaaccagtagctgaaattattcataaacatatggatgtgagtgctgttagcctgactagtcaatcagccattttagcctatgtaggagatggagctgaccatcatcttcctaatactcaaatattaacaaagcttgctaaaagagcaatagatactggtaaagttagtgtcgcaactgataaaagtgaaatcgaatgcgaccataagaattgcccacttagttcagcaattgttattccattacacatccacgatgttatagtgggtactttgaaattatatttttcagacgcacaacatatgacttacgttgaccgtcaattagctgaaggattaggcaatatcttttccactcagttagctttgggacaagctgaggaagcaacaaggttactacaggatgcggaaatgaagtctctccaagcgcaggttaatccgcattttctttttaatgcacttaatactatttatggtttaattcgcatggatagcgaaaaagcaagaaagctcgtccaagattttagcaaggttattcgtgctaatcttcaacgggcaaagcaaaatttaattcctcttcatgatgaattggaacaggttaacgcctatttagcccttgaagaagcaagatttcccaacatggtggcctttaatttagacaaccaaacaaattcagatgacaacttaatgattcctccctttacattgcaggtcttgattgaaaactcttataaacacgcttttaagcatgttaataaaaataaccagctaaaggttactattgcaagaaataatgataggcttcatatcattgtccaagacaatggtattgggattccaaaagaaaaattaataacgcttggaaaaaaaactcaaatttcaaaacaaggttctggtacagctattgagaatctcgttcgtcgcttgaatattatttatgatggacaagcaagtttaaaatttgaatcaaatgattcaggaacttgtgctattgttaatatccccattaaaaattag

SEQ ID NO: 14782 - protein, 579 aa, Streptococcus agalactiae 2603V/R
MTLFLIMMERAGLIILLAYAFVHIPFIKQTLKQPELKKHQYILLILFSLFAIISNFTGVEIQSDLSIIPQTLNHIADQSSVANTRVLTIGVSGLIGGPIVGIIVGLLSVFVRYLQGGLAPHIYVISSLLIGLCSGLSGNYLRKNYNKIRVLDAMVVGFGMEILQMICILIFSVDFNQALRLVSFISMPMILSNTLGLGIFISIISSTQKLEEHAKAFQTHQVLELANLTLPYLRKGLTTESCQPVAEIIHKHMDVSAVSLTSQSAILAYVGDGADHHLPNTQILTKLAKRAIDTGKVSVATDKSEIECDHKNCPLSSAIVIPLHIHDVIVGTLKLYFSDAQHMTYVDRQLAEGLGNIFSTQLALGQAEEATRLLQDAEMKSLQAQVNPHFLFNALNTIYGLIRMDSEKARKLVQDFSKVIRANLQRAKQNLIPLHDELEQVNAYLALEEARFPNMVAFNLDNQTNSDDNLMIPPFTLQVLIENSYKHAFKHVNKNNQLKVTIARNNDRLHIIVQDNGIGIPKEKLITLGKKTQISKQGSGTAIENLVRRLNIIYDGQASLKFESNDSGTCAIVNIPIKN

SEQ ID NO: 14783 - DNA, 1683 bp, Shewanella oneidensis MR-1
  CDS (1)..(1683): transl_table=11
atgtccttgatcttgcttctgacccaacagatgtcactctatttagtgatcgtttatttagtcagtaaaacaccgctttttaaactgtttgcagaaacgtcaccgcgcctgcctcacaagatatttatttatctggttttttctagcttttgtatcatggcgacctactttggtgagcaaacctcgggggctattgccaatactcgtgccatgggcgccgtattaggcggattgctcggcggccctgttacaggttttttggtggggctcactggtggattacaccgctatagtatgggcggctttaccgatttagcctgtgctatctcgacaacactcgaagggctctcggcgggaatgatcagtttttacctgcgccgcgcaggtaagagtgagcttatctacaatccactcttggtttgtctagtgaccttttacgccgaaataatgcagatgagccttattttgctcatcgcttgcccctttgatgccgcttgggagttagttcgtcagattgctccaccgatgttgttggtcaactccatcggcgcggcactatttatgagtatgatccgcgaccaaaaaaccatgttcgataagctctcatctagcttttcaaccaaagcacttaaaatcgctgaacgcagtgtaggtttactttccaagggatttaatgaagaaagtagcggtaaggtcgcgcaaattgtgattgaagaaaccaatgttggtgcggtggccattacggatagagaaaagctcttggcctttatcgggattggcgccgaccaccatatccctggcacgccgatttcctcccaaatcacccttgaggccatcaatcaaaacaaagtaatgtttgccgatggggtcgaaatcccctattcctgctcgatttcgagccagtgtaaactcggctctagtctggttatcccgctgcgcagcgacactgaagtcattggcaccataaagttatacgaacctaaaaataaactgttcttgaacattaaccgtaccttgggtgaagggatcgctcggctattatcgaaccaaattctttatggccgttttgaacaacagcaaaacctactcacccaagccgaattaaaattgctgcaagcacaagtcaatccacactttttattcaacgctctcaatactattagtgcaattattaagcgcgatccggatatgtcgaaacaactgttacaacagttatcacagtttttacggatcaatttaaaacgcacgacgggtttagtcacacttggggatgagctcgatcacatcgcctcctatctcaccatcgagaaagcaagatttattaataaattacaagtcaatattgccattccagagtcactttatcactgtaaagtccctgcatttaccctacagcctattattgagaatgcggtaaaacatggcacctcccatatgattgaccaagggcagatcaaggtcactgggcgtttggatgaacatgtattggcgttagaggtcattgataatgctggcctatatcaaccttctactgactctgaagggttgggaatgaatctagtccataaacggatccaaaacctgtttggcgaacagtacgggctccaagttgaatgcgagccggatgaatacaccaaagtcatcattcgcttacccatagaaaagacggaaactagcacgtga

SEQ ID NO: 14784 - protein, 560 aa, Shewanella oneidensis MR-1
MSLILLLTQQMSLYLVIVYLVSKTPLFKLFAETSPRLPHKIFIYLVFSSFCIMATYFGEQTSGAIANTRAMGAVLGGLLGGPVTGFLVGLTGGLHRYSMGGFTDLACAISTTLEGLSAGMISFYLRRAGKSELIYNPLLVCLVTFYAEIMQMSLILLIACPFDAAWELVRQIAPPMLLVNSIGAALFMSMIRDQKTMFDKLSSSFSTKALKIAERSVGLLSKGFNEESSGKVAQIVIEETNVGAVAITDREKLLAFIGIGADHHIPGTPISSQITLEAINQNKVMFADGVEIPYSCSISSQCKLGSSLVIPLRSDTEVIGTIKLYEPKNKLFLNINRTLGEGIARLLSNQILYGRFEQQQNLLTQAELKLLQAQVNPHFLFNALNTISAIIKRDPDMSKQLLQQLSQFLRINLKRTTGLVTLGDELDHIASYLTIEKARFINKLQVNIAIPESLYHCKVPAFTLQPIIENAVKHGTSHMIDQGQIKVTGRLDEHVLALEVIDNAGLYQPSTDSEGLGMNLVHKRIQNLFGEQYGLQVECEPDEYTKVIIRLPIEKTETST

SEQ ID NO: 14785 - DNA, 1683 bp, Vibrio vulnificus CMCP6
  CDS (1)..(1683): transl_table=11
atggaactggtgatttcactgctacaacagatgtgtgtctatcttgttttagcctatatgctcagcaagacccccatcatcttaccactgctgaacatctcatcgcgtttgagccaccgcgttctgtgctacttattgttttccgccttctgtatcttgggcacctactttggtttacacatcaatgacgccatagccaatactcgtgcaattggggcagtcatgggcggcttgtttggcgggccgattgtgggctttgccgtgggattaaccggtggtttacatcgctacaccttaggaggattcaccgatttagcctgcgcgatttcgaccacagcggaaggcttgattggtggcttgctgcatatctatctaatcaagaaaaacaaaggtgcccaactgttcaacccctccgtggtgtttagcatcaccttcgtcgccgaaataatacaaatgatcattttgctggtggtcgctaagccctttgatcaagcgtacagcctcgtttcgaccattgccgcccccatgatcattgccaactcggtgggtgccgcgttgtttatgagcattttacaagacagaaaaaccatctttgaaaagtactccgccaccttttcgcgtcgggcattgaccattgcggatcgctctgtgggtatcttgcacacgggctttaacagtgccaacgcagaaaaaatcgcccgcattatttatgaagaaaccaatgtgggcgcggttgcgatcaccgaccaagagaagattctcgcgtttgtcggcattggggatgatcaccacaagcctaatacgcccatttcgtcgcaaagcacccttgattcgatgagtcaaaacgccatcatttatctcgatggtagcgagcgtccatatcaatgctctctcgcttccgactgtaaattaggctcggcactgatcattccactacgagcaggcaaagaggtggtgggaaccattaagctgtacgagccaaagcgcaagttgttttcaaccattaatatgtcgatggccgaaggcattgcccaactgctttccagccaaattctctatggcgattatcagcaacaacaaacgctgctgacgcaatcggagattaagctgctgcatgctcaagtgaatccgcatttcttattcaacgcgctaaacacgattagcgcggtgattcgtcgcgatcctgacaaagcacgtgaactgattcaaaatttgtcacacttctttcgcagcaacttaaaacagaacatcaacaccgtcacactgaaagaagagctggcgcatgtgaatgcctacctcagcattgaaaaagcacgttttgctgaccgcctagagatagagattgatatcacgccagagctgttcgacacaaaactgcccagctttaccttgcagcctttggtggaaaacgccattaagcatggtatttcaaatatgcttgagggaggacgggtgcgcatttacagccaatcttgtgagcaaggtgatgtcatcgtggtcgaagataatgcaggtagctatcagcccccagcagaaaatcattcaggactgggaatggaaatagtcgataaacggctgacgcaccattttgggcgtgactcagcactaaaaatcgaggcgaaagagcatcaatttactaaaatgagctttatcattccccgcagccatcacactgcaatttag

SEQ ID NO: 14786 - protein, 560 aa, Vibrio vulnificus CMCP6
MELVISLLQQMCVYLVLAYMLSKTPIILPLLNISSRLSHRVLCYLLFSAFCILGTYFGLHINDAIANTRAIGAVMGGLFGGPIVGFAVGLTGGLHRYTLGGFTDLACAISTTAEGLIGGLLHIYLIKKNKGAQLFNPSVVFSITFVAEIIQMIILLVVAKPFDQAYSLVSTIAAPMIIANSVGAALFMSILQDRKTIFEKYSATFSRRALTIADRSVGILHTGFNSANAEKIARIIYEETNVGAVAITDQEKILAFVGIGDDHHKPNTPISSQSTLDSMSQNAIIYLDGSERPYQCSLASDCKLGSALIIPLRAGKEVVGTIKLYEPKRKLFSTINMSMAEGIAQLLSSQILYGDYQQQQTLLTQSEIKLLHAQVNPHFLFNALNTISAVIRRDPDKARELIQNLSHFFRSNLKQNINTVTLKEELAHVNAYLSIEKARFADRLEIEIDITPELFDTKLPSFTLQPLVENAIKHGISNMLEGGRVRIYSQSCEQGDVIVVEDNAGSYQPPAENHSGLGMEIVDKRLTHHFGRDSALKIEAKEHQFTKMSFIIPRSHHTAI

SEQ ID NO: 14787 - DNA, 1698 bp, Clostridium tetani E88
  CDS (1)..(1698): transl_table=11
atgatattaatgatatatatacaacttttaggtagtatgtctacaatagctttatccgcctatattttcaatcagtactacatatctaaaaaacttttttgcttagataaagaatttaataaacttgctttaatagtttttttcagtcttctatccatattgggtacctacactggagttaatatagattctatggccccagctagttttaataaatctacattaattaatttaaatccccatgccatagctaatactcgccccataggagctataactgctggatatttaggtggccctctggttggtatatgtgtaggacttattgcaggtttacaaaggtattatgtagggggctttacagcattagcctgtgcagtagccacaataatgggaggaatttgtggtggtttagccagaaaacactctaaatctaaaacccttaatccaaaacttgcttttataaccacaataattgcagaaatattggaaatgattataatacttattttatccaaaccctttaatcatgccctacaattagaaaaaatttttgctctacctatgataattataaattctgtaggagttttcgtttttgtatatattacaaaagatgccttagagcaatataacagaataggtgccacagaggcacaaaaagctttaaatatagctgaaaaaactctaaattactttaaaaagggttttcacaaagataattctgaaaaaatagcaaaaatcatttggcaaaatacttcctttgaaagtgtttttattgcagatactaaaaaaatgatctcatattatggagaagatataaattctaatcttttaaatgaatccttaaaaaattactataaatctgctgactataaaataattaaatatagagactcttcatctgaaacagttgaaaatatatttttttgtattccaatatatgatgaaaataatttagaattagtaattggcttaaatatagtatccgaaagttttgtagataaatattttacattgtttgttaagcaattaagcacattgctctctaatcaattaaagctttacaaattaaataaaatagccaatgaagtttatgtagctgaatttaaagcattaaaagctcaaatacaccctcattttttatttaatgcactaaacactatttcctctttttgcagaacaaaccctaataaagcaagagaacttatactaaatttatctagctactttagacagactttgaaaagagaagaagattttattacaattaaagaagagtatgattttttaaattcttatctttctatagaaaacgcacgttttggagaaagattaaaagtgaatataaatttccctaaaaatttattaaactataaaattcctgtttttttattacaacctctagtagagaactctataaatcatggaattttacctaaaccctctggtggaacagttattatagaggcttactcctctaatgaaaatttaaattttattgtaaaagataatggagttggtatgaaagaaactgatcttaaaaagatacattctttttctactggtataggactaaacaatgtaaatgaaaggctaaaacttctcttcggagaagactataaaataaatataaaaagcaaccctaataaaggtacttctatatctttttcaatacctaaggagatgaatttatga

SEQ ID NO: 14788 - protein, 565 aa, Clostridium tetani E88
MILMIYIQLLGSMSTIALSAYIFNQYYISKKLFCLDKEFNKLALIVFFSLLSILGTYTGVNIDSMAPASFNKSTLINLNPHAIANTRPIGAITAGYLGGPLVGICVGLIAGLQRYYVGGFTALACAVATIMGGICGGLARKHSKSKTLNPKLAFITTIIAEILEMIIILILSKPFNHALQLEKIFALPMIIINSVGVFVFVYITKDALEQYNRIGATEAQKALNIAEKTLNYFKKGFHKDNSEKIAKIIWQNTSFESVFIADTKKMISYYGEDINSNLLNESLKNYYKSADYKIIKYRDSSSETVENIFFCIPIYDENNLELVIGLNIVSESFVDKYFTLFVKQLSTLLSNQLKLYKLNKIANEVYVAEFKALKAQIHPHFLFNALNTISSFCRTNPNKARELILNLSSYFRQTLKREEDFITIKEEYDFLNSYLSIENARFGERLKVNINFPKNLLNYKIPVFLLQPLVENSINHGILPKPSGGTVIIEAYSSNENLNFIVKDNGVGMKETDLKKIHSFSTGIGLNNVNERLKLLFGEDYKINIKSNPNKGTSISFSIPKEMNL

SEQ ID NO: 14789 - DNA, 1671 bp, Vibrio parahaemolyticus RIMD 2210633
  CDS (1)..(1671): transl_table=11
atggaactggttatctctctcttgcagcaaatgtgtgtttacttagtcttggcttacatgctgagtaaaacacccatcatcttaccgttactgagtatttcgtctcgccttagccatcgtttaatttgctacgtgctcttttctggcttttgtatcctcgggacgtactttggcctgcacatcaatgatgcgatcgccaacacgcgtgccattggcgctgtcatgggcgggttgttcggcgggccagtagtcggttttgctgtcggcttaaccggcgggattcatcgttattcccttggtggctttaccgacctagcctgtgctatttcaaccactgctgaaggcgtgattggtggcttgttacatgtctaccttatcaaacgcaacaagggcgcattgctgttcaacccaagtgtggtgttcagcgtgacatttgttgccgaagttgtgcagatgattttgttgttggcggtagccaaacccttcgaccaagcctacgaactggtgtcagcgattgccgctccgatgatcattgccaactcgttcggtgccgcacttttcatgagcatcctacaagatagaaaaaccatttttgaaaagtactccgctaccttttcacgccgcgcgcttaccatcgccgatcgctccgtaggcattttgagcaacggttttaacaccgagaatgcagaaaaaatcgctcgtatcatttacgaagaaaccaaggttggcgcagttgcaattactgatcaagagaagattttggcgtttgtcggcattggcgatgaccaccatagaccgaatacgcctatttcatcgcaaagcacattagattcgatggagaaaaacgacatcatctaccttgatggtacagagcgtccgtatcagtgttctttggcgaaagattgcaaactcggttcggcgttgatcattccattgcgtgcgggtaaagcggtcatcggaacaatcaaactctatgaacctaagcgtaagctgttctcaaccgccaacatgtcaatggcagaagggatagctcagttgctctccagccaaattttgtatggcgattatcaacaacaacaagcgctgttagcgcaggcagaaatcaaactgttgcacgcgcaggtaaaccctcactttttgtttaacgcgctcaataccatcagtgcgattacgcgccgcgatccagataaagcccgcgaattaattcaaaatttatcgcactttttccgcagtaacttaaaacagaacatcaatacggtgacgctgaaagaagagcttgcacacgtcaattcttacctcagtatcgaaaaagcacgcttcacggatcgcttggaagtagaaatagatatcgacccagagttgctcgatatcaagctgccaagtttcacacttcaacccttggtggaaaatgccatcaaacacggcatctccaatatgcttgaaggtggaaaagttaaaatttacagcgaaatgcaccctcaaggacacctgattacagtcgaggacaacgcaggcagtttccagccaccaaaagacaaccactcaggtttaggcttggaaattgtagacaaacgtctcactaatcaatttgggcgtgattcagcgctaaaaattgcgtgtgtgacgcatcaatttactaaaatgagctttatcattcccccgaaatcataa

SEQ ID NO: 14790 - protein, 556 aa, Vibrio parahaemolyticus RIMD 2210633
MELVISLLQQMCVYLVLAYMLSKTPIILPLLSISSRLSHRLICYVLFSGFCILGTYFGLHINDAIANTRAIGAVMGGLFGGPVVGFAVGLTGGIHRYSLGGFTDLACAISTTAEGVIGGLLHVYLIKRNKGALLFNPSVVFSVTFVAEVVQMILLLAVAKPFDQAYELVSAIAAPMIIANSFGAALFMSILQDRKTIFEKYSATFSRRALTIADRSVGILSNGFNTENAEKIARIIYEETKVGAVAITDQEKILAFVGIGDDHHRPNTPISSQSTLDSMEKNDIIYLDGTERPYQCSLAKDCKLGSALIIPLRAGKAVIGTIKLYEPKRKLFSTANMSMAEGIAQLLSSQILYGDYQQQQALLAQAEIKLLHAQVNPHFLFNALNTISAITRRDPDKARELIQNLSHFFRSNLKQNINTVTLKEELAHVNSYLSIEKARFTDRLEVEIDIDPELLDIKLPSFTLQPLVENAIKHGISNMLEGGKVKIYSEMHPQGHLITVEDNAGSFQPPKDNHSGLGLEIVDKRLTNQFGRDSALKIACVTHQFTKMSFIIPPKS

SEQ ID NO: 14791 - DNA, 1773 bp, Chromobacterium violaceum ATCC 12472
  CDS (1)..(1773): transl_table=11
ttgagccagaacaaggccgcggggacggcacggtcgttaaactgttctcgcgcaaacaatccatgccatcgaatgatcgtagaactgaccctggtgctgtcgctgctgcagcagatgtgcgtttatctggtgatcgcctacctgctgtccaagacgccgctgttcatcccgctgacccagatcacgctgcaattgccccacaagctggtctgttatctggtgttttcgatgttttgcatcatgggcacctatttcggcctgcacatccaggactccatcgccaatacccgcgccatcggcgcggtgctgggcggcatgctgggcggcccctgggtggggctggcggtgggcttcaccggcggcctgcaccgctattcgctgggcgggctcaccgccggcgcctgcatggtgtcgacgatgatggagggcctgctgggcggcctggtgcatctctacctggtgcgccgcggcctgcgcgcgcggctgttcgacccgctggtggtggcggcggtggcctgcgtcgccgagatcggccagatgctgatcctgctggcgctggtgcgcccgtccgaggcggccgaacgcctggtggccagcatcgcgctgccgatgatggcggccaacacgctgggggcggcgatgttcatgcgcattctgctggaccgccgggtgctggcggaaaaatactccaccgccttctccggcaaggcgctgcagatcgctgcccgcgccgaaggggtgctgcgccagggcttcgacccggaaaacagcatgaccgtggcgcgcatcctgtacgaggagctgggcgtcggcgcggtggccatcaccgaccgcgagcggctgctggccttcatcggcataggcgcggatcatcacctgcccggcacggccatcacctcgccgcacacccaccgcgcgatcgagcgcaacgaggtggtgtacgccgacggcaacgaaacgccctaccgctgctcgatcagcccccagtgccggctggcgtcctcgctggtgatcccgctgcgcggcgaggacgaacgggtgatcggcaccatcaagctgtacgagccgcgcaacaagctgttctcccgcatcaacctgacgctgggcgaaggcatcgcccgcctgctgtccgcccagatcctgcagggccagtacgataaacaaaagcagctgctggcgcagaccgagatcaaactgctgcacgcccaagtgaacccgcacttcctgttcaacgctctgaacacgctgtcggcggtgatacggcgcaacccggaacatgcccgccggctggtgcagtacctgtccaccttcttccgcaagaacctgaaacgctccggcgaagcggcgacgctggaggacgagatcgaacacgtcagcgcctacctgcgcatcgaggaagcgcgcttcgccgggaggctggacgtggagatctcgctggacgaggcggcccgccgggcgcggctgccggcgttctcgctgcagcccatcgtcgagaatgccatcaagcacggcacctcccaactactggaagccggccgcatccgcatcgccgcgcgctgcgccgacggcaggctttgcgtgacggtggaagacaacgccggcctgtacgcgccggccggccccggcgacggcttaggcatgtcgctggtggaccggcgcatccgcgcccggcacggaccggcttacggcgtgtcggtggagtgcgagccggaggcctatacccgcgtcacgctcagcgtgccctgccccgagcctggagaaatcccatgctga

SEQ ID NO: 14792 - protein, 590 aa, Chromobacterium violaceum ATCC 12472
MSQNKAAGTARSLNCSRANNPCHRMIVELTLVLSLLQQMCVYLVIAYLLSKTPLFIPLTQITLQLPHKLVCYLVFSMFCIMGTYFGLHIQDSIANTRAIGAVLGGMLGGPWVGLAVGFTGGLHRYSLGGLTAGACMVSTMMEGLLGGLVHLYLVRRGLRARLFDPLVVAAVACVAEIGQMLILLALVRPSEAAERLVASIALPMMAANTLGAAMFMRILLDRRVLAEKYSTAFSGKALQIAARAEGVLRQGFDPENSMTVARILYEELGVGAVAITDRERLLAFIGIGADHHLPGTAITSPHTHRAIERNEVVYADGNETPYRCSISPQCRLASSLVIPLRGEDERVIGTIKLYEPRNKLFSRINLTLGEGIARLLSAQILQGQYDKQKQLLAQTEIKLLHAQVNPHFLFNALNTLSAVIRRNPEHARRLVQYLSTFFRKNLKRSGEAATLEDEIEHVSAYLRIEEARFAGRLDVEISLDEAARRARLPAFSLQPIVENAIKHGTSQLLEAGRIRIAARCADGRLCVTVEDNAGLYAPAGPGDGLGMSLVDRRIRARHGPAYGVSVECEPEAYTRVTLSVPCPEPGEIPC

SEQ ID NO: 14793 - DNA, 1431 bp, Chromobacterium violaceum ATCC 12472
  CDS (1)..(1431): transl_table=11
ctggccggcggcatattgttcggcccctgggtgggcattccggccggcgtcgtctccggcctgcaccgctacctgatcgacatccacggctacacctcgctggcctgcctgatctccagcatctgcgccggcttgctcgccaccgccatccactaccgcgccggccgccagcgcttgtggctgtacggcatcgccgccggcgtcgcctgcgagagcctgaccatggcgctgatcctgtggttcacccagccggcggtcggccaggccatcgtcggccacatcgcctatccgatgatcaccggcacggtctgcatcggcctcatcatcaagctggtgcaggatctggacgacgagaaggaactgttggcggcccgccaggccaagctggcgctgaccatcgccaaccgcaccctgccctatttccagaacgtggaccgcgacgcgctggtggaagtgtgcaccgtgatccgcaaccacatcggcgccgacgcggtggccatcaccgatacccgcgacgtgctggcctacgtggggctgggcaaggactactacgaaccggccgcccactccgccatcggcgagatcacccgccgcgcggtggagcaggaccagatcatcatcgagaacgacctgcgccagtaccgggtggcggacttccactcggtgatcatcattccgctgcgcgaaaacggccgcgtcaccggcacgctgaagatcttcttccgccagagcggcggcatcaccggctcgctgcgcgagctggggctgggcctgtcgcagctgatctccacccagatggaggcgtcgcgcatcaagcagctgcaggagatggcgcgcaaggccgagttcgccgcgctgcagagcaagatcaacccgcacttcctgttcaacgcgttgaacgccatctcgtccttgatccgcatccagccgtcggaggcgcggcagctgatcgccaagctggccgactacctgcgctacaacctgtcgctgggcgacaccctgatcgacatccaggaagaactgaagcaggtgcgcgactacgtggccatagagcaggcacgcttcggcagcaagctgtccgtcgcattcgatatcgacgaagtccacgcccgcgtgcccagcctgctgctgcagcccttggtggaaaacgcgatactgcacggcatccagccgcgcaaggaggcgggcgaggtgcgcatcgcggtgaagaagctggacgaccgcatccgggtatccgtgcgcgacaccggctacggcatcagccaggaagtgatggacggcatcgccgagggcaaggtggagagccgcagcatcggcctgtccaacgtcaacgagcgcatcaagctcttgtacggcgagggcctgcggcttacccggctggagccgggcaccgaagtcagtttcgaattgccgctggaggaaaaagcatga

SEQ ID NO: 14794 - protein, 476 aa, Chromobacterium violaceum ATCC 12472
MAGGILFGPWVGIPAGVVSGLHRYLIDIHGYTSLACLISSICAGLLATAIHYRAGRQRLWLYGIAAGVACESLTMALILWFTQPAVGQAIVGHIAYPMITGTVCIGLIIKLVQDLDDEKELLAARQAKLALTIANRTLPYFQNVDRDALVEVCTVIRNHIGADAVAITDTRDVLAYVGLGKDYYEPAAHSAIGEITRRAVEQDQIIIENDLRQYRVADFHSVIIIPLRENGRVTGTLKIFFRQSGGITGSLRELGLGLSQLISTQMEASRIKQLQEMARKAEFAALQSKINPHFLFNALNAISSLIRIQPSEARQLIAKLADYLRYNLSLGDTLIDIQEELKQVRDYVAIEQARFGSKLSVAFDIDEVHARVPSLLLQPLVENAILHGIQPRKEAGEVRIAVKKLDDRIRVSVRDTGYGISQEVMDGIAEGKVESRSIGLSNVNERIKLLYGEGLRLTRLEPGTEVSFELPLEEKA

SEQ ID NO: 14795 - DNA, 1683 bp, Vibrio vulnificus YJ016
  CDS (1)..(1683): transl_table=11
atggaactggtgatttcactgctacaacagatgtgtgtctatcttgttttagcctatatgctcagcaagacccccatcatcttaccactgctgaacatctcatcgcgtttgagccaccgcgttctgtgctacttattgttttccgccttctgtatcttgggcacctactttggtttacacatcaatgacgccatagccaatactcgtgcaattggggcagtcatgggcggcttgtttggcgggccgattgtgggctttgccgtgggattaaccggtggtttacatcgctacaccttaggaggattcaccgatttggcctgcgcaatttcgaccacggctgaaggcttgattggtggcttgctgcatatctatctaatcaagaaaaacaaaggtgcccaactgttcaacccctccgtggtgtttagcatcaccttcgtcgccgaaattatacaaatgatcattttgctggtggtcgctaagccctttgatcaagcgtacagcctcgtttcgaccatcgccgcccccatgatcattgccaattcggtcggtgccgcgttgtttatgagcattttgcaagacagaaaaaccatctttgaaaagtactccgccaccttttcgcgtcgggcgttgaccattgcagatcgttctgtgggtatcttgcacacgggctttaacagtgccaacgcagaaaaaatcgcccgcattatttatgaagaaaccaatgtgggcgcggttgcgatcaccgaccaagagaagatcctcgcgtttgtcggcattggggatgatcaccacaagcctaatacgcccatttcgtcgcaaagcacccttgattcgatgagtcaaaacgccatcatttatctcgatggtagcgagcgtccatatcaatgctctctcgctgccgactgtaaattaggttcggcactgatcattccactgcgggcaggtaaagaggtggtgggaaccattaagctgtacgagccgaagcgcaagttgttttcaaccattaatatgtcgatggccgaaggcattgcccaactgctttccagccaaattctctatggcgattatcagcaacaacaaacgctgctgacgcaatcggagattaagctgctgcatgctcaagtgaatccacatttcttattcaacgcgctaaacacgattagcgcggtgattcgtcgtgatcctgataaagcacgcgaactgattcaaaatttgtcgcatttctttcgcagcaacttaaaacagaacatcaataccgtcactctgaaagaagagctggcgcatgtgaatgcctacctcagcattgaaaaagcgcgttttgctgaccgcctagagatagagattgatatcacgccagagctgttcgacatcaaactgcccagttttaccttgcagcctttggtggaaaacgccattaagcatggtatttcaaatatgcttgagggaggacgggtgcgcatttacagccaatcttgtgagcaaggtgatgtcatcgtggtcgaagataatgcaggcagctatcagcccccagcagaaaatcattcgggactgggaatggaaattgtcgataaacgactgacgcaccattttgggcgtgactcagcactaaaaatcgaggcgaaagagcatcaatttactaaaatgagctttatcattccccgcagccatcacactgcaatttag

SEQ ID NO: 14796 - protein, 560 aa, Vibrio vulnificus YJ016
MELVISLLQQMCVYLVLAYMLSKTPIILPLLNISSRLSHRVLCYLLFSAFCILGTYFGLHINDAIANTRAIGAVMGGLFGGPIVGFAVGLTGGLHRYTLGGFTDLACAISTTAEGLIGGLLHIYLIKKNKGAQLFNPSVVFSITFVAEIIQMIILLVVAKPFDQAYSLVSTIAAPMIIANSVGAALFMSILQDRKTIFEKYSATFSRRALTIADRSVGILHTGFNSANAEKIARIIYEETNVGAVAITDQEKILAFVGIGDDHHKPNTPISSQSTLDSMSQNAIIYLDGSERPYQCSLAADCKLGSALIIPLRAGKEVVGTIKLYEPKRKLFSTINMSMAEGIAQLLSSQILYGDYQQQQTLLTQSEIKLLHAQVNPHFLFNALNTISAVIRRDPDKARELIQNLSHFFRSNLKQNINTVTLKEELAHVNAYLSIEKARFADRLEIEIDITPELFDIKLPSFTLQPLVENAIKHGISNMLEGGRVRIYSQSCEQGDVIVVEDNAGSYQPPAENHSGLGMEIVDKRLTHHFGRDSALKIEAKEHQFTKMSFIIPRSHHTAI

SEQ ID NO: 14797 - DNA, 1359 bp, Anopheles gambiae str. PEST
  CDS (1)..(1359)
atggatggccacacctcgatcccgtgcctcatcgccagcatcatcgccggcctgctcgccacctggctgcacctgcgctgtcgcaagtcgcggctctggctgtacggcattctggcggggatgttgtgcgaggggctcaccatgctgctcatctggctgctgaccgagccccatgcggtgggcgtcgagatcgtcagccacatcgcctacccgatgatcgccggggcgctctgcatcggcctgatcatcaagctggtgcaggatctggatgacgagaaagagctgatcgccgccaagcaggccaagctggcgctggatatcgccaacaagacgctgcccttcttccagaacatcgatcgccactccctgagccaggtctgcgccatcattcgcagcgagatcagcgccgatgcggtggccatcaccgatacccgcgacgtgctggcctatgtcggggtgggcaaggattactacgagctggacgagcaccatgccatcagcgacatgacccagcgggcggtgctgctggaccagatcatcatcaacaacgatctgcgccagtatcacctctccgatttccactcggtcatcattattccgctgcgggaaaacggctcggtgagtggcaccctcaagatctactaccgtcgcacccacagcatcaccagctccctcaaggagatggcggtgggcctctcccagctcatctccacccagatggaggtgtcgcgcatcgagcagctcaaggagatgacccgcaaggcggagttcaccgcgctgcagagcaagatcaacccgcacttcctgttcaacgccctcaatgccatctcgtcgctgatccgcattcggccccagcaggcacgtcagctgatcgccaatctggcggactacctgcgctacaacctcaacaaaggggataccctcatcgacatccaggaagagctgcagcaggtgcgcgactacgtggccatcgagcaggcccgcttcggcgacaagttggaggtggtattcgaggtggacgacgtgcacatccaggtgccgagcctgctgttgcagccgctggtggaaaacgccatcctgcacggcatccagccccgcagcgcaccgggtcgggtcaccatcgaggtgaagcagctggcgggcggcatccgggtggcggtgcgggacaccggttacggcatcagccaggaggtgatcgacggggtggctgccggtcgggtggagagccgcagcatcggcctgatgaacgtacatcagcgggtcaagctgctctatggcgatggcctgcacctcaagcggctggagccgggtaccgaagtgagtttctatctgccggatcaggagtcgatgccatgctga

SEQ ID NO: 14798 - protein, 452 aa, Anopheles gambiae str. PEST
MDGHTSIPCLIASIIAGLLATWLHLRCRKSRLWLYGILAGMLCEGLTMLLIWLLTEPHAVGVEIVSHIAYPMIAGALCIGLIIKLVQDLDDEKELIAAKQAKLALDIANKTLPFFQNIDRHSLSQVCAIIRSEISADAVAITDTRDVLAYVGVGKDYYELDEHHAISDMTQRAVLLDQIIINNDLRQYHLSDFHSVIIIPLRENGSVSGTLKIYYRRTHSITSSLKEMAVGLSQLISTQMEVSRIEQLKEMTRKAEFTALQSKINPHFLFNALNAISSLIRIRPQQARQLIANLADYLRYNLNKGDTLIDIQEELQQVRDYVAIEQARFGDKLEVVFEVDDVHIQVPSLLLQPLVENAILHGIQPRSAPGRVTIEVKQLAGGIRVAVRDTGYGISQEVIDGVAAGRVESRSIGLMNVHQRVKLLYGDGLHLKRLEPGTEVSFYLPDQESMPC

SEQ ID NO: 14799 - DNA, 1716 bp, Desulfovibrio vulgaris subsp. vulgaris str. Hildenborough
  CDS (1)..(1716): transl_table=11
atgttcataacgctctccgagcgtttcggcctgcttctggcgggtggtttcgccatcatgaccctcgccccgctggacaaactcgggccggggcgcacacgttcgtggcgggccacggcgttgctggtggtgctgttctcgctgttcaccatccttggcacctacaacggcaacatcgtgttccagtcgttcgccaacctgcgcgccatgggggcggtgacggcggggcttttcggcggtccgatggtgggcgcgctgaccgggctcatcgccggagggcatcgctacttcatcgacgtgggcgggttcagtgccgtgccgtgcgggctcgcaacctttctggagggacttgccgcagggctcttcgcgtggcgttttccctcccgcagcctcgactggggcactgccatgaccttcgccgccgtgggtgaggctgtgcacatgtgccttgttctcgggctggcacgcccctatgctcaagcggtcgacctcgtggaggtcatcgggctgcccatgatattgctcaatggcgtgggggcggccatcttcgtgcaggcgttgcgcatgcagatgcacttccgggacctgcgcgactcgtcgcaggcgcggcagatactctccatcgccaaccgcacgctcccgcacctgcgcgcgggcttgagcgccgcctccgcacgggccacagccgagatcatcctcgacgagacacgggtggctgccgtggctctcaccagcaacgacatggtgatggcgcacgtgggtgcggcctccgaccaccacagggccgggcattccgtgtgcacgcaggcgacacgccgggtggccacggatggcattccgctcttcgtgacggggcatgacgaaataggctgccagcttgaggcatgcccgctgtgcagtgccatcatcgtgcccctgcgcaagggcgataccatcctcggctgtctcaaactctacggaaccaaggacagaccgctcgaccagacgctgttcgaactggccaagggacttgccgacctgttcgccacgcagatcgaactcgaagacatcggtatcaagaaccagttgctcgcccgggcggagatccgccggttacaggcgcagatcaacccgcactttctcttcaattcgctgaacacggtggcctcgttctgccggacggcaccgggacaggctcgcgagctcattctcgaccttgcccgctacatgcgacgcaacctcgataccagccgtgaagccatccatcttgccgaagaggtggagcagattcgcgcctacctcgtcatcgagaaggcccgtttcggagagcgcatccgcgccgtcatcgacatcgaccccgagacggaacactgcctcgttccgcccctgctcattcagccgctggtggagaacagtgtgcgtcacggcatcctcggcaacgaggaggggggcgttgtgcgccttgccacgagcatggaagacggccacgtggtcgtggttgtcgaggatgacggcgcaggtatgcccgagtccacgcggcagggtatcctcaacggtacgcctgtcacggcccatggcgaaggcatcggtgcgagcaactgcaaccagcgtctcgtgcagttgtacgggcccgcctacgccctctccatcgacagcgcccccggcatgggaacgcgcatcaccttccgcgttcccgcctcgaccgacgccgaggtgttcgcctcggcagctgcctga

SEQ ID NO: 14800 - protein, 571 aa, Desulfovibrio vulgaris subsp. vulgaris str. Hildenborough
MFITLSERFGLLLAGGFAIMTLAPLDKLGPGRTRSWRATALLVVLFSLFTILGTYNGNIVFQSFANLRAMGAVTAGLFGGPMVGALTGLIAGGHRYFIDVGGFSAVPCGLATFLEGLAAGLFAWRFPSRSLDWGTAMTFAAVGEAVHMCLVLGLARPYAQAVDLVEVIGLPMILLNGVGAAIFVQALRMQMHFRDLRDSSQARQILSIANRTLPHLRAGLSAASARATAEIILDETRVAAVALTSNDMVMAHVGAASDHHRAGHSVCTQATRRVATDGIPLFVTGHDEIGCQLEACPLCSAIIVPLRKGDTILGCLKLYGTKDRPLDQTLFELAKGLADLFATQIELEDIGIKNQLLARAEIRRLQAQINPHFLFNSLNTVASFCRTAPGQARELILDLARYMRRNLDTSREAIHLAEEVEQIRAYLVIEKARFGERIRAVIDIDPETEHCLVPPLLIQPLVENSVRHGILGNEEGGVVRLATSMEDGHVVVVVEDDGAGMPESTRQGILNGTPVTAHGEGIGASNCNQRLVQLYGPAYALSIDSAPGMGTRITFRVPASTDAEVFASAAA

SEQ ID NO: 14801 - DNA, 1770 bp, Bacillus thuringiensis serovar konkukian str. 97-27
  CDS (1)..(1770): transl_table=11
atgctaaatttagtacttatgatgattgaacgcgtcggacttattgttattctaggatttttactttcgcatattaaaacattcaggcgccttcttcataagcaagatggttatgtagataagcttaagcttatttgtattttttcggtgtttacaattgtaagcaattacaccgggattgaaatagcagggaatacgattatgaatgaaaattggctacagggtgtttcatcatcgagtaccattgcaaatacacgtattatgggtgttggaattagtggattgcttggtggtcctattgttggagttggagtaggatcgattgctggtattcaccgttatatgcttggcgggacgacagcgctaagttgcgcaatctcttcaattttagcaggcgttataactgggtatattggatacatttttaaaaagtataatcgtacaattacgcctaaattttcagcagttttaagtgtgtttatcgtttctttagaaatgattatgattctattaattgtagaggatggcattagcattgtgaaaacaattgcgataccaatgatccttgtaaatagctttggaagttttattttactttctatgatacaagctattttgcgccaggaagagaacgcaaaggcacttcagactcataaggtattacgtattgcagataaaacgttaccgtattttcgccaaggcttaacagaagaatcttgtaagcatgtggcacaaattattcaccgctttacaggaacagatgcggtatccttaacagatacagagaaaatattagctcatgttggattagcgtcagatcaccatattccttcacatagtttaataaccggtttgtcgaaagaagtgttacatacagggaaaataatgaaagcgaaatcacgtgaggtcattaattgtcaacatgaaggctgtcctttgcaagcggcgattgttattccgctaacttcacatggaaatacgatagggacattaaaactatatttcaaaaatcctaaccagttaagtcgtgtggaagaggaattagcagaagggttagcaaaaatattctctacacaacttgaattaggtgaagctgagttgcaaagtaaattattgcaagatgcggagataaaggcattacaagcacaaattaacccacactttttatttaatgcgattaatacagtatcagctttatgccgaacagatgtagaaaaagcaaggaagttattattgcagcttagcgtgtatttccgttgtaatttgcaaggggcacgtcagttattgattccactagaacaagaattaaaccatgtacaggcatacttatcactagaacaagcaaggttcccaaataagtatgaagtaaagatgtatattgaggatgagctcaagacaactttagtaccaccgtttgttcttcaactattggttgaaaatgcgttgcgacacgcctttccaaagaagcaacccgtatgtgaagtggaagtgcatgtttttgaaaaagagggtatggttcattttgaggtaaaggataatgggcaaggtattgaggaagaacgtttagaacaattaggaaagatggtagtttcgtcaaagaaagggactggaacagctttatataatattaatgaacgtcttattgggttatttgggaaggaaacgatgcttcatatcgaaagtgaagtaaatgaggggacagagattacttttgttattccaaaaaaagtaggggaggaagagcagattgttaaaagtactagtagttga

SEQ ID NO: 14802 - protein, 589 aa, Bacillus thuringiensis serovar konkukian str. 97-27
MLNLVLMMIERVGLIVILGFLLSHIKTFRRLLHKQDGYVDKLKLICIFSVFTIVSNYTGIEIAGNTIMNENWLQGVSSSSTIANTRIMGVGISGLLGGPIVGVGVGSIAGIHRYMLGGTTALSCAISSILAGVITGYIGYIFKKYNRTITPKFSAVLSVFIVSLEMIMILLIVEDGISIVKTIAIPMILVNSFGSFILLSMIQAILRQEENAKALQTHKVLRIADKTLPYFRQGLTEESCKHVAQIIHRFTGTDAVSLTDTEKILAHVGLASDHHIPSHSLITGLSKEVLHTGKIMKAKSREVINCQHEGCPLQAAIVIPLTSHGNTIGTLKLYFKNPNQLSRVEEELAEGLAKIFSTQLELGEAELQSKLLQDAEIKALQAQINPHFLFNAINTVSALCRTDVEKARKLLLQLSVYFRCNLQGARQLLIPLEQELNHVQAYLSLEQARFPNKYEVKMYIEDELKTTLVPPFVLQLLVENALRHAFPKKQPVCEVEVHVFEKEGMVHFEVKDNGQGIEEERLEQLGKMVVSSKKGTGTALYNINERLIGLFGKETMLHIESEVNEGTEITFVIPKKVGEEEQIVKSTSS

SEQ ID NO: 14803 - DNA, 1743 bp, Erwinia carotovora subsp. atroseptica SCRI1043
  CDS (1)..(1743)
atgcacgaaatatttgaaatgctccttgcggtctttgaccgcgccgccctgatgctgatttgtttatttttcctgacaagaacgcgccagttccggcaattactgcaaaaagagcaacattctccgagagaacgggtgatggtgacagccatcttttcactgtttgcgctgtttggtacgtattccggtattaatgttgaagggtcgcttgtcaacgtgcgcgtgattgccgtgatgtctggcggtattctctttggcccttgggtggggatcgcgacaggtatcattgcgggggcacaccgttatttaattgatattgatggcatcacctctgtaccttgcttgattaccagcatcatcgccggtatcacttctggctacatcaataagaaagtcaaaaaagagcagcagtggagcatagggattctgggcgggatgctgtgtgagtcattaactatgttgctggttgtagcatgggcgacgccgatcgagttagggctggatattgtttcaaaaattgccgtgccgatgattcttggctccatctgtattggcctgattgtactgctggtgcagagtgtagcgaatgaaaaagaggtgattgccgctaggcaggccaaactcgcactcgatatcgcacacaaaacactgccgtatttccgcaatatcaacagtgattcactgacggccatttgtagaatcatccgtactgaaattaatgcggacgcagtagcgataacgaacacgcagcacattcaggcttatgtggggattggggaagacaaatataatatcggccacgacattatcagcccgatgacgcagcaggcgattcatgacggaaaaatcatcattaaaaataatgatgaacagcatcttacgccggaaattcattcgatgattgtcatcccgctgtgggaacatgggcaggtgacaggcacgctgaaaatctattatcgccatgcacataaaattacctattcattacgcgtgatggctgtcggcctatcgcaaatcatgtcaacgcaaattgaggtttcccgtacagaacaactgcgcgatatggcaaataaggcggaattgagagcgctgcaaagtaaaatcaatccgcactttctttttaatgctctgaatgcgatctcctcgtccattcgaattaatcccgatacggcgcgccagttggtcatcaatctgtctcgctatttgcgctataaccttgagctcaatgacgatgcgctgatcgatataaaaaaagagctgtaccaaatacaggattatatcgcgattgagcaggcgcgctttggcgctaagttgacggtgatttacgatattgacgacgatgtggcgtacaaaattcctagcttattaattcagccgctggtggaaaatgcgattgtgcatggtattcagcctttcaaaggaaagggaaccgtagtgctgtccgtgaaagagcagggcgataagctgctggtggcggtaaaagatacaggccacggcatcagtcaggagacgatagatcgcgtcgcgcgcaatgaattgccggggaataagattggcctgcttaatgttcatcaccgagtccgcttgctctatggtgatggcttacatattcgccgtttggaacctgggactgagatttatttctatattccacgagaagataaaaccccgtcggcattgccggataccgtgcaggtgccgtcatcaagatattctgctgagaaaacaggaggcaacccatga

SEQ ID NO: 14804 - protein, 580 aa, Erwinia carotovora subsp. atroseptica SCRI1043
MHEIFEMLLAVFDRAALMLICLFFLTRTRQFRQLLQKEQHSPRERVMVTAIFSLFALFGTYSGINVEGSLVNVRVIAVMSGGILFGPWVGIATGIIAGAHRYLIDIDGITSVPCLITSIIAGITSGYINKKVKKEQQWSIGILGGMLCESLTMLLVVAWATPIELGLDIVSKIAVPMILGSICIGLIVLLVQSVANEKEVIAARQAKLALDIAHKTLPYFRNINSDSLTAICRIIRTEINADAVAITNTQHIQAYVGIGEDKYNIGHDIISPMTQQAIHDGKIIIKNNDEQHLTPEIHSMIVIPLWEHGQVTGTLKIYYRHAHKITYSLRVMAVGLSQIMSTQIEVSRTEQLRDMANKAELRALQSKINPHFLFNALNAISSSIRINPDTARQLVINLSRYLRYNLELNDDALIDIKKELYQIQDYIAIEQARFGAKLTVIYDIDDDVAYKIPSLLIQPLVENAIVHGIQPFKGKGTVVLSVKEQGDKLLVAVKDTGHGISQETIDRVARNELPGNKIGLLNVHHRVRLLYGDGLHIRRLEPGTEIYFYIPREDKTPSALPDTVQVPSSRYSAEKTGGNP

SEQ ID NO: 14805 - DNA, 1719 bp, Erwinia carotovora subsp. atroseptica SCRI1043
  CDS (1)..(1719)
atggttagccaggttgatctaattctttccctgttacagcagatgtgtgtttatctggtcatcgcttatctgctcagtaaaacaccgctgtttatcccgctgatgcaggtcaccattcgcctgccgcacaagctggtctgctatctggttttttccgtgttttgcattatgggaacctacttcggcctgcatatagacgattcgattgccaatacccgcgcgacaggcgcggtgctcgggggcatgctgggcggcccttctgtgggctttctcgtcgggttgactggcggactacaccgctattcgatgggcggtatgactgcgctggcctgtatgttgtcgaccattgccgaaggcctgctcggcgggttgctgcatcgctatctggcacgtcgtaaccgtatcgatctgctctttaaaccactcgtcgtcggcctgaccgcactggttgcggagatactacaaatggcgattattctgctggtcgcccgaccgtttgataacgccgctgagttggtgagggatattgcgctaccgatgatgatcaccaataccatcggttccgctatgttcatgcgcatcctgctcgacaggcgcgccatttttgaaaaatacacttctgcattctccgccaaggcgctgcaaatcgcggcacgcgccgaaggggcgctgcgtcaggggttcaatccgcaaaacagtatgcgcgttgcccgtattttgtatgaagaactgggtgtcggtgccgtggcgattaccgatcgcgacaaactgctggccttcatcgggttaggcgacgatcaccacaacgtcggtgcgcccatcacgtcatcacacacgcgccgggcgatagacaacaatcaggtggtgtacgccgacggcaacgaggtgtcttatacctgttcggtttcatcgcactgcaagctcggctccacgctggtgatcccactgcggggcgaagatcagcgtgttgtcggcacgatcaagctttatgaacccaagaataagctattttccagcattaaccgtacgctaggagaagggatcgcccacctgctttccgcacagattctgacaggccgttttgaacaacagaaacagctgctggcgcagtcggaaatcaagctgctgcacgcgcaggtcaacccgcattttctgttcaatgcactgaatacgctgtccgccgtgatacgacgcaaccccgaccacgcccgccagttggtgctgtctctgtcgacgtttttccgtaaaaatctcaagcgcagtaacgatgaagtgtcgctcaatgatgagctggagcacgttaacgcctatctggaaatcgaaaaggcgcgctttgccgatcacctgacggtagaaatctcgctaccggagtcgctgcgcgaagcgcgactaccggcgttttctctgcaaccgattgtcgaaaatgcgattaagcacggtacttcgcagatgattgaacacggacacatccacattagcggacgtctgcacgccaacacgctggaactgtcagtggaagataatgctggcacctatcagccccgcagcggtggcgatggtctaggcatgaatctggtcgaccgccgtattaaagcgcgctacggcaaccgctatggcatcacggtagtcagcgaaacagataaattcactcgggtcgaagtacgcgtcccgctgatttcagcgcgcaaggcattggaaaaactggatagcgtggcgtga

SEQ ID NO: 14806 - protein, 572 aa, Erwinia carotovora subsp. atroseptica SCRI1043
MVSQVDLILSLLQQMCVYLVIAYLLSKTPLFIPLMQVTIRLPHKLVCYLVFSVFCIMGTYFGLHIDDSIANTRATGAVLGGMLGGPSVGFLVGLTGGLHRYSMGGMTALACMLSTIAEGLLGGLLHRYLARRNRIDLLFKPLVVGLTALVAEILQMAIILLVARPFDNAAELVRDIALPMMITNTIGSAMFMRILLDRRAIFEKYTSAFSAKALQIAARAEGALRQGFNPQNSMRVARILYEELGVGAVAITDRDKLLAFIGLGDDHHNVGAPITSSHTRRAIDNNQVVYADGNEVSYTCSVSSHCKLGSTLVIPLRGEDQRVVGTIKLYEPKNKLFSSINRTLGEGIAHLLSAQILTGRFEQQKQLLAQSEIKLLHAQVNPHFLFNALNTLSAVIRRNPDHARQLVLSLSTFFRKNLKRSNDEVSLNDELEHVNAYLEIEKARFADHLTVEISLPESLREARLPAFSLQPIVENAIKHGTSQMIEHGHIHISGRLHANTLELSVEDNAGTYQPRSGGDGLGMNLVDRRIKARYGNRYGITVVSETDKFTRVEVRVPLISARKALEKLDSVA

SEQ ID NO: 14807 - DNA, 1698 bp, Yersinia pseudotuberculosis IP 32953
  CDS (1)..(1698): transl_table=11
atgggcattagccaaacagaactgatcttttcccttttacaacagatgtgtgtgtatttggttattgcctatctgctgagtaaaacaccgctttttatccccttgatgcaagtcactatcaggttgccccataaactggtgtgctacctcaccttctccatgttttgcattatgggtacctattttggtctgaacattgatgactctatcgcgaatactcgcgctatcggtgcagtcttggggggaatgttaggggggccatcggttggttttttggtagggctaaccggaggcctgcatcgttattcaatgggggggatgactgcaaccgcctgtatgttatcaaccattgctgaagggctattgggtggccttctccacctttatctgacacgtaaaaaccgcctcgatttactgtttcagccgctggtggtcgcgggtattacactggtagccgaagtgctacaaatgatgattattctggccgtcgcccgccccttcaatgaagctgtcgaattggttgaaaatattgccttgccgatgatgatcaccaataccattggtgccgccatgtttatgcgtatcttattagaccgccgggccattttcgaaaaatacaccacggcattttccgcgaaggcgctacaaattgctgcacgggcggagggtctactgcgccatggctttgaccagcaaaacagtatgcgagtggcgcgtatcttgtatgaagagttgggcgtgggcgcggtagccattactgatcgcgaaaaattgctggcctttatcggtagcggtgccgaccaccatcaggtgggcagtgctatcacctccgaccatactcaccgcgcgattgaactcaatcaggtggtgtatgccgacggcaatgccgtgccttatacctgctcaatttcacccacctgtaagttgggttcaacactggttatccctttgcgaggtgaagagcaccgggtgatcggcagtatcaaattgtatgagccaaaaagtaaattattctccagcattaaccgcaccttaggagagggtattgcgcacttattatcagcacagattttggcgggagaattcgaacaacaaaaacaattactggcgcaatctgaaatcaaactgctccatgcacaggtcaacccacatttcttgtttaatgcgctcaataccctatcagtggtgatccgccgtaatccagatcatgcccgcaatttggtgctttctttatcaacctttttccgtaaaaacctaaaacgcagccacgatgtggtcacgttaagtgatgagattgaacatgtgaatgcgtatcttgaaatagaaaaggcacgctttgctgatcgtctgactgtcacggtctcactgccgaatgaactgatggaggcacgcttacccgcgttctccctgcaacccgtggtagaaaatgcaatcaagcatggtatctcacagatgttcagtaacgggcgggtcacgttgcgcggcaaattggatgacaacacgttggtattggaagtcgaagataacgccggtttatatcagccgcagccggatggcgatggtctgggaatgagtttggttgatcggcgaattaaagcgcgctctggcaatgaatatggcatcaccgtcgtcagtgaagcggaagtctttacccgcattattattaagctaccgtttattaccgtgagtgagtattaa

SEQ ID NO: 14808 - protein, 565 aa, Yersinia pseudotuberculosis IP 32953
MGISQTELIFSLLQQMCVYLVIAYLLSKTPLFIPLMQVTIRLPHKLVCYLTFSMFCIMGTYFGLNIDDSIANTRAIGAVLGGMLGGPSVGFLVGLTGGLHRYSMGGMTATACMLSTIAEGLLGGLLHLYLTRKNRLDLLFQPLVVAGITLVAEVLQMMIILAVARPFNEAVELVENIALPMMITNTIGAAMFMRILLDRRAIFEKYTTAFSAKALQIAARAEGLLRHGFDQQNSMRVARILYEELGVGAVAITDREKLLAFIGSGADHHQVGSAITSDHTHRAIELNQVVYADGNAVPYTCSISPTCKLGSTLVIPLRGEEHRVIGSIKLYEPKSKLFSSINRTLGEGIAHLLSAQILAGEFEQQKQLLAQSEIKLLHAQVNPHFLFNALNTLSVVIRRNPDHARNLVLSLSTFFRKNLKRSHDVVTLSDEIEHVNAYLEIEKARFADRLTVTVSLPNELMEARLPAFSLQPVVENAIKHGISQMFSNGRVTLRGKLDDNTLVLEVEDNAGLYQPQPDGDGLGMSLVDRRIKARSGNEYGITVVSEAEVFTRIIIKLPFITVSEY

SEQ ID NO: 14809 - DNA, 1785 bp, Bacillus licheniformis ATCC 14580
  CDS (1)..(1785): transl_table=11
atggtccaactcatgattatgatgctggagagagtggggatcatcgtcattctgggctttatgttggcccatatgaaggtgttccgtcagcacctacagcatccggaagggtataagggcaagggagttctcatctttattttttccttgttcagcatcatcagcaactatacaggcattgaaatccgggagcgcgagattttgaacaatgactggattttcgcaatcgacccgtcaagctcgattgccaatacgagaattctcggcgtcgaaatcggcggcttgatcggagggccgtttgtcggagcgggtgtcggactgctctcaggcattcaccgtttttcactgggagggacgacggctttgagctgcgcggtttcttcactgctggcaggtgtcattgcgggttatatcggcagctttttcaggaatcggcaccagatggtgacaccgcgggtagccgctcttgcgggcatttgtatggagggcctgcagatgcttatgattctcgtgcttgcaaaaccgcaggctgaggcacttgcgcttgttcagatgatcggcattccaatgatgattgtcaacgggacgggcagctttatttttctatcgatcattcagtctattatccgcaaagaggaacaggcgcgggccgttcagacccataaggtattttcgatagcggatcagacgcttccttttttccgccggggactgaatgaggattcctgcaaaagcgccgctctcattatacaccgcatgacagggacggatgccgtatcgattacggatagagagaacattctcgctcatgtcggagatggagcagatcatcatattccttcgaaaaatctgatcaccggtttatcgaaaaaagtcattcaaaccggaaaggtcatgaaagtgaagtcgcgcgatgaaatcgagtgtgcgcaccgttcctgtccgctgcaggcggcgatcgtactgccgctcttctccaaccgcgaaacaatcggcacgctgaagctgtacttcaagcacccgtccggtcttaaccgtgtgacggaagagctggccgaagggcttgccatgcttttttccactcagctagaactcggtgaggctgagctgcaaagcaagcttttgaaagatgccgaaatcaaggcgcttcaagcgcaggtcaatccgcactttttatttaatgccatccatacgatttctgctctgtgcaggacagatccggaaaaaacgcgaaaacttctcttgcagctgagcgtttattttcgttccaatctgcagggagccaggcagctgatgattccgctttcaaaagagctgaaccatctggaagcctatttatcattggagcaggcccgatttccgggcaagtatcatattgattttcatatcgaggacggccttgaaaatatggaaatccctccttttatcttgcagctgctcgttgaaaatgcgcttcgccatgcatttccgagaaaacaaaaggtatgcacggtaaaagtatccgctgtgagagagcgggacggcgttttgatgaaggtgtcagacaacggcaggggaattaatccggagatgcttggacagctggggcaggcgcccgccccttcaaaggaaggaaatgggacggcgctttacaatgtgaaccagcggctcaccggtttgttcgggcaccaggctgctctgcagattgccagcgaacttgataaaggaacagagatatccttcaagattccttttcaaaccgaaagagaggggaacagagatgctcaaggtattaatcgtggatga

SEQ ID NO: 14810 - protein, 594 aa, Bacillus licheniformis ATCC 14580
MVQLMIMMLERVGIIVILGFMLAHMKVFRQHLQHPEGYKGKGVLIFIFSLFSIISNYTGIEIREREILNNDWIFAIDPSSSIANTRILGVEIGGLIGGPFVGAGVGLLSGIHRFSLGGTTALSCAVSSLLAGVIAGYIGSFFRNRHQMVTPRVAALAGICMEGLQMLMILVLAKPQAEALALVQMIGIPMMIVNGTGSFIFLSIIQSIIRKEEQARAVQTHKVFSIADQTLPFFRRGLNEDSCKSAALIIHRMTGTDAVSITDRENILAHVGDGADHHIPSKNLITGLSKKVIQTGKVMKVKSRDEIECAHRSCPLQAAIVLPLFSNRETIGTLKLYFKHPSGLNRVTEELAEGLAMLFSTQLELGEAELQSKLLKDAEIKALQAQVNPHFLFNAIHTISALCRTDPEKTRKLLLQLSVYFRSNLQGARQLMIPLSKELNHLEAYLSLEQARFPGKYHIDFHIEDGLENMEIPPFILQLLVENALRHAFPRKQKVCTVKVSAVRERDGVLMKVSDNGRGINPEMLGQLGQAPAPSKEGNGTALYNVNQRLTGLFGHQAALQIASELDKGTEISFKIPFQTEREGNRDAQGINRG

SEQ ID NO: 14811 - DNA, 1770 bp, Bacillus cereus E33L
  CDS (1)..(1770): transl_table=11
atgctaaatttagtacttatgatgattgaacgcgtcggacttattgttattttaggatttttactttcgcatattaaaacattcaggcgccttcttcataagcaagatggttatgtagataagcttaagcttatttgtattttttcggtgtttacaattgtaagcaattacaccgggattgaaatagcagggaatacgattatgaatgaaaattggctacagggtgtttcttcatcgagcacaatcgcgaatacacgtattatgggtgttggaattagtggattgcttggtggtcctatcgtcggaattggagtaggatcgattgctggtattcaccgttatatgcttggcgggacgacagcgctaagttgcgcgatttcttcaattttagcaggcgttataactgggtatattggatacatttttaaaaagtataatcgtacaattacgcctaaattttcagcagttttaagtgtgtttatcgtttctttagaaatgattatgattctattaattgtagaggatggcattagcattgtgaaaacaattgcgataccaatgatccttgtaaatagctttggaagttttattttactttctatgatacaagctattttgcgccaggaagagaacgcaaaggcacttcagactcataaggtattacgtattgcagataaaacgttaccgtattttcgccaaggcttaacagaagaatcttgtaagcatgtggcacaaattattcaccgctttacaggaacagatgcggtatccttaacagatacagagaaaatattagctcatgttggattagcgtcagatcaccatattccttcacatagtttaataaccggtttgtcgaaagaagtgttacatacagggaaaataatgaaagcgaaatcacgtgaggtcattaattgtcaacatgaaggctgtcctttgcaagcggcgattgttattccgctaacttcacatggaaatacgatagggacattaaaactatatttcaaaaatcctaaccagttaagtcgtgtggaagaggaattagcagaagggttagcaaaaatattctctacacaacttgaattaggtgaagctgagttgcaaagtaaattattgcaagatgcggaaataaaggcattacaagcacaaattaacccacactttttatttaatgcgattaatacagtatcagctttatgccgaacagatgtagaaaaagcaaggaagttattattgcagcttagcgtgtatttccgttgtaatttgcaaggggcacgtcagttattgattccactagaacaagaattaaaccatgtacaggcatacttatcactagaacaagcaaggttcccaaataagtatgaagtaaagatgtatattgaggatgagctcaagacaactttagtaccaccgtttgttcttcaactattggttgaaaatgcgttgcgacacgcctttccaaagaagcaacccgtatgtgaagtggaagtgcatgtttttgaaaaagaaggtatggttcattttgaggtaaaggataatggacaagggattgaggaagaacgtttagaacaattaggaaagatggtagtttcgtcaaagaaagggactggaacagctttatataatattaatgaacgtcttattgggttatttgggaaagaaacgatgcttcatatcgaaagtgaagtgaatgaggggacagagattacttttgttattccaaaaaaagtaggggaggaagagcagattgttaaaagtactagtagttga

SEQ ID NO: 14812 - protein, 589 aa, Bacillus cereus E33L
MLNLVLMMIERVGLIVILGFLLSHIKTFRRLLHKQDGYVDKLKLICIFSVFTIVSNYTGIEIAGNTIMNENWLQGVSSSSTIANTRIMGVGISGLLGGPIVGIGVGSIAGIHRYMLGGTTALSCAISSILAGVITGYIGYIFKKYNRTITPKFSAVLSVFIVSLEMIMILLIVEDGISIVKTIAIPMILVNSFGSFILLSMIQAILRQEENAKALQTHKVLRIADKTLPYFRQGLTEESCKHVAQIIHRFTGTDAVSLTDTEKILAHVGLASDHHIPSHSLITGLSKEVLHTGKIMKAKSREVINCQHEGCPLQAAIVIPLTSHGNTIGTLKLYFKNPNQLSRVEEELAEGLAKIFSTQLELGEAELQSKLLQDAEIKALQAQINPHFLFNAINTVSALCRTDVEKARKLLLQLSVYFRCNLQGARQLLIPLEQELNHVQAYLSLEQARFPNKYEVKMYIEDELKTTLVPPFVLQLLVENALRHAFPKKQPVCEVEVHVFEKEGMVHFEVKDNGQGIEEERLEQLGKMVVSSKKGTGTALYNINERLIGLFGKETMLHIESEVNEGTEITFVIPKKVGEEEQIVKSTSS

SEQ ID NO: 14813 - DNA, 1719 bp, Photobacterium profundum SS9
  CDS (1)..(1719): transl_table=11
atggaactgattttttcattactccaacagctcagtgtttatttagttattgcttatctactaagtaaaaccccgttgtttatgccactcactacggtatctggccgattatcccaacgtttttcatgttatgtcttattctctcttttttgtattttaggcacctactttggcctcaacattgaagatgctatcgcgaatacacgcgcgataggtgctgtaatgggagggttactcggtgggcccattgtggggtttgctgtgggcttaactggcggcatgcaccgttacagcatgggaggctttactgatgtcgcttgcgctatctctaccacaactgaagggttgcttggtgggctcttacacagctactacgtacgccgcgggcaagtcgaccagctttacaggcctttcatcgttttcacgattacattagtcgctgaaatcattcaaatgtttatcattttaatcgtggctgaaccctacgataaagccttacaccttgtcagcgccatagccttaccaatggtcattgctaactcgttaggcgcagctttattcatgagtatcattcaagatagaaaaacgatttatgaaaaatattcagctgcattttccagtcgagcattaaaaatagcccaacgctctgtcggcattttaagccaaggatttaatgaagaaagtacaaaaaaaatagccaaaatcgtttatgaggaaacgggcgttggcgcagttgccattacagatcgagataaaatattagcgtttattggtatcggtgatgatcaccatttacccggtacaccaatatcgtctggctatactcgtcgatcgatagataactgcgaattggtttacgcagatggccatgatatgccttactgttgttcgctaagcaaccgctgtaaattaggctctgcacttgttattcctttagtgggaggaaataacgatgtgctaggaacaataaaactgtacgaaccaaagcgtaaactattctctacagtgaacctaacattaggtgaaggcattgctaaattgctttcaaatcaaattttaactggacgctatgaacaacaacaaatcttactgactcaagcagagctgcgtttactacaagcccaagttaatcctcacttcctattcaatgccctcaatacgattagtgcaataattcgtcgagaccccgataaagcacgccagttgatccaacatctatcacaattcttccgtcgtaatttaaagcaaaacatcgaaaccgttactattagcgaagaactacagcatgttcgatcttacttagaaattgagctcgcacgtttttctgatcgcctgaatgttgaaatcattgtgcccgatgagctaatgagcattaatttaccgacgtttaccttacaacccttagttgaaaatgccattaagcacggtacttcatcattgctcgagaatggtcaaatcattattcgggggtacgtttttgacaatcatttggttttggaagtagaagataatgcaggcacctaccaaccagtcagcgaagaaagtgggctaggcatgaaaattgtcgataagcggttaaaaaacatgtttgggcaacaatacggtttaaagatgagtagtcagcctaatatatggacacgggctacaattacactaccagaagataaaaccttgcagcacaatgatataaacaaaacatacaccgcagaaaacaagtaa

SEQ ID NO: 14814 - protein, 572 aa, Photobacterium profundum SS9
MELIFSLLQQLSVYLVIAYLLSKTPLFMPLTTVSGRLSQRFSCYVLFSLFCILGTYFGLNIEDAIANTRAIGAVMGGLLGGPIVGFAVGLTGGMHRYSMGGFTDVACAISTTTEGLLGGLLHSYYVRRGQVDQLYRPFIVFTITLVAEIIQMFIILIVAEPYDKALHLVSAIALPMVIANSLGAALFMSIIQDRKTIYEKYSAAFSSRALKIAQRSVGILSQGFNEESTKKIAKIVYEETGVGAVAITDRDKILAFIGIGDDHHLPGTPISSGYTRRSIDNCELVYADGHDMPYCCSLSNRCKLGSALVIPLVGGNNDVLGTIKLYEPKRKLFSTVNLTLGEGIAKLLSNQILTGRYEQQQILLTQAELRLLQAQVNPHFLFNALNTISAIIRRDPDKARQLIQHLSQFFRRNLKQNIETVTISEELQHVRSYLEIELARFSDRLNVEIIVPDELMSINLPTFTLQPLVENAIKHGTSSLLENGQIIIRGYVFDNHLVLEVEDNAGTYQPVSEESGLGMKIVDKRLKNMFGQQYGLKMSSQPNIWTRATITLPEDKTLQHNDINKTYTAENK

SEQ ID NO: 14815 - DNA, 1356 bp, Photobacterium profundum SS9
  CDS (1)..(1356): transl_table=11
gtgtacaccgagcaatttatgatgctgctagcggtatttgaacgtgcagcactgatgctaatggcattatttttcttaactcgcaccaacctattccaacatattgttatcaaaacccaacgacacccaattgaaacagcgcttatctctgcactcttcattttatttgctgtctttagtacctacacaggtgtcaatgttgatggctcactcatcaatgttcgtattattgcggtcttgtctggtggaatcatttttggtccttgggtgggtattcctgctggcattatttcaggcttacaccgttaccttatcgacatggacggccccacctcggtagcttgtttaatttccagtacgattgcgggcctattggcaacatggattcattttcgatgccacaaaaaatcgtacgcaaaatgggggattcttgcaggtatgttctgtgaaatcttaaccatgattttaattgtgagcttgtctgaagataagcagttggcttataccattgtggaacatattagcgtacccatgatcgcaggggcggtgtgcattgggcttattatcaaattggttcaagatttagatgaagagaaagatttaatcgcagccaaacaagcaaagcttgccctcgatatcgccaacaaaaccctgccttattttcgaaataatcatcgagattcgctgacgaaagtatgcggtattattcgtgaggaaacccaggcagatgccgtcgctattaccgatgttaaagacgtattagcttacgtcggtatagggcaagaaaactacttggatgcctaccataaaatcagtttgatgacccaacaagcagtcaatactggcgagcaaatcattagtaataatcttaatgtgcaaggctttcattcactgttaattattccactgtgggaaaacggtgccgttagcggtacgttaaaaatattctaccaccagccacaccgcattcggccgtcattacgtgaaatgaccataggcttatcgcaattgatttccactcagatggaagtctcgcgtcttgaacagttgaaagccatgaccagcaaagcagagctttctgcactacaaagcaaaattaatccgcactttttattcaatgcattgaatgcgatttcaacgttagtgcgtattcatcccgataaagctcgtcaattgattgctaatttagcagattttttacggtataacctcgaacgtaataatgatttgatcgatatccaagaagagttacaacaagtaagggattatgtcgctattgaacaagcccgctttggtgacaagttagaagtaacgttcgatgtcgatgatgtgcatctcgcgattccctgtttatga

SEQ ID NO: 14816 - protein, 451 aa, Photobacterium profundum SS9
MYTEQFMMLLAVFERAALMLMALFFLTRTNLFQHIVIKTQRHPIETALISALFILFAVFSTYTGVNVDGSLINVRIIAVLSGGIIFGPWVGIPAGIISGLHRYLIDMDGPTSVACLISSTIAGLLATWIHFRCHKKSYAKWGILAGMFCEILTMILIVSLSEDKQLAYTIVEHISVPMIAGAVCIGLIIKLVQDLDEEKDLIAAKQAKLALDIANKTLPYFRNNHRDSLTKVCGIIREETQADAVAITDVKDVLAYVGIGQENYLDAYHKISLMTQQAVNTGEQIISNNLNVQGFHSLLIIPLWENGAVSGTLKIFYHQPHRIRPSLREMTIGLSQLISTQMEVSRLEQLKAMTSKAELSALQSKINPHFLFNALNAISTLVRIHPDKARQLIANLADFLRYNLERNNDLIDIQEELQQVRDYVAIEQARFGDKLEVTFDVDDVHLAIPCL

SEQ ID NO: 14817 - DNA, 1686 bp, Salmonella enterica subsp. enterica serovar Paratyphi A str. ATCC
  CDS (1)..(1686): transl_table=11
atgtacgagtttaatctggtgttgctgctgcttcagcagatgtgcgtgtttctggtcattgcgtggctaatgagtaaaacgcgcctgttcatcccgcttatgcaggtcacggttcgtctgccgcacaagcttctgtgttacgtcacgttttctatcttctgcattatgggcacttattttgggctacatatcgaagattcgattgccaatacccgcgcgattggcgcggtgatgagtggcctactcggcgggccggtcgtcggcgggctggtcggcctgaccggtgggttacatcggtattctatgggcggcatgacggcgctgagctgtatgatttccaccatcgtcgaagggctgctgggcgggttggtacacagcgttctcatacgtcgcggacgcccggacaaagtgtttagcccgctgacggcgggagcaattacgtgtgttgccgaactggtgcagatgctgattattttattgatagccaggccgtttgacgatgccctgcatctggtcagtaatattgccgcgccgatgatggtgacgaataccgttggcgccgcgctgttcatgcgtattttgctcgataagcgcgccatgttcgaaaaatatacttcggcattttctgctaccgcgctgaaggtcgccgcgtcaacggaggggattctgcgtcagggatttaacgaagtgaacagtatgaaggtggcgcaggtgttatatcaggagttggatatcggcgccgttgccatcaccgatcgcgaaaaactgctggcttttaccggtattggcgacgatcaccatctaccgggcaaacccatttcatcaggttatacgctgaaagcaattgaaaccggagaggtggtttatgccgatggcaacgaagtgccgtaccgctgttcgctacacccgcagtgtaaactcggctcgacgctggtgatcccgctgcgtggcgaaaatcagcgagtcatgggcaccattaaattgtacgaagcgaaaaaccggctgttcagctcaattaaccgtaccctgggagagggtattgcgcagcttttatccgcgcagatcctggccgggcagtatgaacggcagaaggcgttgctgacgcagtcagagatcaagctgttgcacgcgcaggtgaatccgcattttctgtttaatgcactcaataccattaaagcggtgattcgccgcgacagcgaacaggccagccaactggtgcagtacttgtcgaccttttttcgcaaaaatttaaaacgcccgtcggaaatcgtcacgctggcggatgaaattgaacacgtgaacgcttatctgcaaattgaaaaagcgcgttttcagtcgcgtctgcaggtacagcttgatgttccatcgacgctttcacgtcagaaattgcctgcgtttacattacagccgattgttgagaacgccattaaacatggcacgtcgcaactgcttgataccggcaacgtcgctattcgcgcccgacgcgaagggcagcatttgatgttagatattgaagataatgcgggactgtatcagccttccgccggcagtagcgggctggggatgagtctggtggataaacgtctgcgcgaacactttggcgatgattatggtattagcgtggcctgcgagccggactgttttacccgaattacattacgacttccactggaggaggacgcatga

SEQ ID NO: 14818 - protein, 561 aa, Salmonella enterica subsp. enterica serovar Paratyphi A str. ATCC
MYEFNLVLLLLQQMCVFLVIAWLMSKTRLFIPLMQVTVRLPHKLLCYVTFSIFCIMGTYFGLHIEDSIANTRAIGAVMSGLLGGPVVGGLVGLTGGLHRYSMGGMTALSCMISTIVEGLLGGLVHSVLIRRGRPDKVFSPLTAGAITCVAELVQMLIILLIARPFDDALHLVSNIAAPMMVTNTVGAALFMRILLDKRAMFEKYTSAFSATALKVAASTEGILRQGFNEVNSMKVAQVLYQELDIGAVAITDREKLLAFTGIGDDHHLPGKPISSGYTLKAIETGEVVYADGNEVPYRCSLHPQCKLGSTLVIPLRGENQRVMGTIKLYEAKNRLFSSINRTLGEGIAQLLSAQILAGQYERQKALLTQSEIKLLHAQVNPHFLFNALNTIKAVIRRDSEQASQLVQYLSTFFRKNLKRPSEIVTLADEIEHVNAYLQIEKARFQSRLQVQLDVPSTLSRQKLPAFTLQPIVENAIKHGTSQLLDTGNVAIRARREGQHLMLDIEDNAGLYQPSAGSSGLGMSLVDKRLREHFGDDYGISVACEPDCFTRITLRLPLEEDA

SEQ ID NO: 14819 - DNA, 1794 bp, Bacillus clausii KSM-K16
  CDS (1)..(1794): transl_table=11
atgtttgaactattgcttttaatgctagagcgccttggcctcattgtcatgcttgcatttattgcgacgaggatgcgctttttccgtgtcatggttaaatcgactcggttaacgcgtaagcagacatggacggcgattttgttttttggcgcattcggcattattggcacttactctggcgtcacttttcaagcagaatcccttgtgctgcagcggatcacatttggcattcaagaagatgccgcgattgcgaacttcagggtgattggcgttgtgttagccggactgtttggcggctataaagtcggtcttagcgccgggttaatagcaggcgtccatcggatgttgcttggcggcttcacggccttctcatgtgggatcgctacgattgtcgccggcttatttgctgctttttaccgatcgaaaaatccgaatgcggttaaccggccgctgtctatctttcttctcggtgcattggcggaaaccgtgcaaatgggtttaattgctttgcttgcaaatccgacggctgctgcgatttcccttgtgcaaacgatcgggttgccaatgattgtggccaatgggattggctgtacgctctttttgctcattatccaaagcgtgacaaaagaagaacagaaagcaggcgctttgcaagcgcaaaagagcttgcgcattgccgaacaaacactggcccattttaagcatgggctatcaagccattctgctaaggaagtatgcgacattttatataaagaactgaatgcctgtgcgattgcaatgacaaatcaggatatgattcttgcccatattggcgttgcggctgaccaccataaaaccaacatgagcattcaaacgaaattaacggctgaagtgatcgcaaaaaagcaaatgattattgctggcgatgatgaaatccactgcaaagagccgaattgcccacttggcgcagccgtcatcgcccctttaattatccgggctgaagtggtaggcacacttaaattttattttcattcaaaaaaagaaattacggaattagagacggaaatgctttctggtttaaccaatttgcttagcagccagctagagttggctgaagccgaccgggcgtatcaacttgccaaagaagcagaaatcaatgcgctacaagcgcaaatcagcccccattttttatttaatacgttaaatacagtcatttccttgattcggatcgagccaatgaaagcaaggacgatgctccattcgttagcgcaatttttacggcaaaatgtctcggcgacgacgacaaagcttcattctcttgcagaagagctccaccatataaaggcttatttatcgattgaagaagtccgctttgaaggccggctaactgtccagtataagattgatgagcggtttttgcatgtatcgattccgccgctaacgttgcagccactcgttgagaacgcgatgaagcatggttttaaaaataaacgctctgattgtgtgctaatcatttctgtgcaagaacaaggggaagatgtcgttctttctgttcaagataacggggcagggtttgatcctgacaaactgaaaaaactaggaaatgaacttcctgccacagacagcggtacaggcattggcctctacaacagcaataaacgattgcaaatgatgtatggccctgaagcgtcattggcattttcagcccagcctggtcggggaacactcgtccgtttccgaattccaaaattggctagaaaggacagggagcaccatgaacatgaagaacaaaccgattcgcacgctggtcgctga

SEQ ID NO: 14820 - protein, 597 aa, Bacillus clausii KSM-K16
MFELLLLMLERLGLIVMLAFIATRMRFFRVMVKSTRLTRKQTWTAILFFGAFGIIGTYSGVTFQAESLVLQRITFGIQEDAAIANFRVIGVVLAGLFGGYKVGLSAGLIAGVHRMLLGGFTAFSCGIATIVAGLFAAFYRSKNPNAVNRPLSIFLLGALAETVQMGLIALLANPTAAAISLVQTIGLPMIVANGIGCTLFLLIIQSVTKEEQKAGALQAQKSLRIAEQTLAHFKHGLSSHSAKEVCDILYKELNACAIAMTNQDMILAHIGVAADHHKTNMSIQTKLTAEVIAKKQMIIAGDDEIHCKEPNCPLGAAVIAPLIIRAEVVGTLKFYFHSKKEITELETEMLSGLTNLLSSQLELAEADRAYQLAKEAEINALQAQISPHFLFNTLNTVISLIRIEPMKARTMLHSLAQFLRQNVSATTTKLHSLAEELHHIKAYLSIEEVRFEGRLTVQYKIDERFLHVSIPPLTLQPLVENAMKHGFKNKRSDCVLIISVQEQGEDVVLSVQDNGAGFDPDKLKKLGNELPATDSGTGIGLYNSNKRLQMMYGPEASLAFSAQPGRGTLVRFRIPKLARKDREHHEHEEQTDSHAGR

SEQ ID NO: 14821 - DNA, 1776 bp, Staphylococcus epidermidis RP62A
  CDS (1)..(1776): transl_table=11
atgcttaatttatttattttattacttgaacgcgtgggattaattattttactcgcatatatactcatgaatattaatcattttaaaacaatgatgagcgaacgtgacaaatggcgttcaaaattccaactaatcattatttttggtatattctctatgatttcaaattttacaggaattgaaatagaaaatggccatatcgtatctggtgatatttattaccacttaagcaaagacgcctcaatggccaatacccgtgtattaacaatcggtgtttctggtctaataggtggaccgtgggtagctataattgtaggcattatttcaggattatgtcgtttatatattggcggggctgacgcatatacctatcttatttcatccatagttatcgctatcatatctggttactttggtcatcaaacaataaaacaaaatacatatccgtccattaaaaaaggtgctattatcggtgcaataactgaaattattcaaatgggctgtatattattatttacaaataacctacatcacgcaattacattagtcagttttatagcactaccgatgattatcattaatagtttaggtacagccatatttttaaccatcattttgtcgaccatcaagcaagaagaacaaatgcgtgcagtccagacgcatgatgtattacaactcgctaacgaaacactaccttactttcgatctggacttaatgaaaaatcagcccaacaagctgctgaaattattttaaaattaatgcaagtgtcggcggtcgctattacaaataaaaaagatattttaacacatattggtgcaggcagtgaccatcacgtagcacgtaaagagataattactgatttatctaaagaagtgattcaatctggaaaattaaaagtcgctcatacgagagaaggaattggatgtcaccatcctaattgccctcttgaaggagccattgtcgtccctctttatatacataatgaagtcgcagggactttaaaattttatttcacagataacaatattatttcaacttcagaccaacagctcgcaaaaggtctcgccaatatattttcttcacaactagaactaggtcaagctgaaatgcagggacaattgttgaaagacgctgaaattaaatcattacaagcacaagtcaatccacatttcttttttaatgctattaacactatatcagcactagtaagaattgatagcgaaaaagcacgacgtttactgattcaactcagtcagttcttccgctctaatcttaatggtgcacgtaataatacgattactttacaaaaggaattacaacaagtagcagcatatttatccttagagcaagcgcgctatccaaatagatttaacatacactatcgaattgatgatcagtgtcaagatgcgctcatcccaccttttataattcaaatattagtggaaaattctattaaacatgcatttaaaaatcgtaaaaagaataatcatattgatgtggatgttagcatgaagcaagactacttaagtatatctgttcaagataatggtcaaggcataccagctgatcaattagatactattggatatacgacagtaacgtctaccactggtactggtaatgccttagtcaatcttaataaaagacttactggactatttggaacaacatcggcactgaacattcaatcttctcaatcaggcacgactgtaagttgtttaattccatataaatcttctaaggaggaacactttaatgaaagcgttaatcgttga

SEQ ID NO: 14822 - protein, 591 aa, Staphylococcus epidermidis RP62A
MLNLFILLLERVGLIILLAYILMNINHFKTMMSERDKWRSKFQLIIIFGIFSMISNFTGIEIENGHIVSGDIYYHLSKDASMANTRVLTIGVSGLIGGPWVAIIVGIISGLCRLYIGGADAYTYLISSIVIAIISGYFGHQTIKQNTYPSIKKGAIIGAITEIIQMGCILLFTNNLHHAITLVSFIALPMIIINSLGTAIFLTIILSTIKQEEQMRAVQTHDVLQLANETLPYFRSGLNEKSAQQAAEIILKLMQVSAVAITNKKDILTHIGAGSDHHVARKEIITDLSKEVIQSGKLKVAHTREGIGCHHPNCPLEGAIVVPLYIHNEVAGTLKFYFTDNNIISTSDQQLAKGLANIFSSQLELGQAEMQGQLLKDAEIKSLQAQVNPHFFFNAINTISALVRIDSEKARRLLIQLSQFFRSNLNGARNNTITLQKELQQVAAYLSLEQARYPNRFNIHYRIDDQCQDALIPPFIIQILVENSIKHAFKNRKKNNHIDVDVSMKQDYLSISVQDNGQGIPADQLDTIGYTTVTSTTGTGNALVNLNKRLTGLFGTTSALNIQSSQSGTTVSCLIPYKSSKEEHFNESVNR

SEQ ID NO: 14823 - DNA, 1683 bp, Vibrio fischeri ES114
  CDS (1)..(1683): transl_table=11
atggaattggtgttttcgttattacaacaattaagtgtctatctggttcttgcttacctattgagtaaaacccctctcttcttaccaattacaacgatttctgctcgttggagtcaccgttttctttgttacatcattttttctggcttctgtattttaggaacctatttcgggctctctattcaagatgccattgcaaatacacgagctattggtgcagtaatgggtggcgttttagggggaccatttgttggattctttgttggtttaaccggagggctacaccgttattccatgggtggctttaccgatcttgcctgtgcaatatcaactacagctgaaggcttacttggtggtttatttcatctttattttgttagaaaaaaccagattgaacaattatttagacctcgaactgtattaatgattgccttcattgctgaattacttcaaatgacaattattttggcagtagcaaaaccttttgaccaagcttatgcacttgtctcatcgattgtattaccaatggtagtcgctaactctattggcgcagctatgtttatgagtatcattcaagatagaaaagccatttacgaaaaatactccgcagccttctcaaataaagcactcaatattgcccaacgttcggttgggattttaagccaaggcttcaaccaagaaaacagcaaacaaatagcgaaaatcatctatgaagaaactggtgttggtgcggtttcaattactgatagagagaaaattttagcctttatcggtattggtgatgaccaccacttacccgatacaccaatcgcttctgactacacaaaaaaagcgattaaacgtagcaaagttatgtacattgacggtgatgaacacccttaccaatgttctatttgtgaaaaatgtaaactaggatcggcacttgttattccacttatcggcgcaaataatgaggtaattggcaccattaagctgtacgaaccaaaacggaaactattttcttatatcaatctaacattaggcgaaggtatcgctaaattactctcaaaccagatcttaacgggacgttatttacaacaacaatctttacttactcaagcggaacttcgtgtacttcaagcccaagtaaacccacattttttatttaatgcactaaatactattagtgcagtgatccgccgtgatccaactcgcgcaagagaactgattcagcatttatcgcaatttttccgcatgaacttgaaacagaacattgaacaagtcaccttaagagaagaactgcatcatgtacaatcttatttagaaattgagttagctcgtttcgccgatcgtttaaccgtacatatggatattgatgaaagtctatacggtttgaaattgcctacatttaccttgcaacctcttgtcgaaaacgccattaaacatggaacatctaacttatttgaagcgggtgaaataacaataaaagcctacccttcacatcatcaaattattttagaagtcattgacaatgcagggttatatactgaacaaaactcaaataatggtttaggtaccaccattgtcgacaaacgtttaaagaaccagtttggtgataattttggcttaaccatgagctgtattagtaatcaacaaacaaaagcaacgattcacctaccaatagagaataaaaaccatgcttaa

SEQ ID NO: 14824 - protein, 560 aa, Vibrio fischeri ES114
MELVFSLLQQLSVYLVLAYLLSKTPLFLPITTISARWSHRFLCYIIFSGFCILGTYFGLSIQDAIANTRAIGAVMGGVLGGPFVGFFVGLTGGLHRYSMGGFTDLACAISTTAEGLLGGLFHLYFVRKNQIEQLFRPRTVLMIAFIAELLQMTIILAVAKPFDQAYALVSSIVLPMVVANSIGAAMFMSIIQDRKAIYEKYSAAFSNKALNIAQRSVGILSQGFNQENSKQIAKIIYEETGVGAVSITDREKILAFIGIGDDHHLPDTPIASDYTKKAIKRSKVMYIDGDEHPYQCSICEKCKLGSALVIPLIGANNEVIGTIKLYEPKRKLFSYINLTLGEGIAKLLSNQILTGRYLQQQSLLTQAELRVLQAQVNPHFLFNALNTISAVIRRDPTRARELIQHLSQFFRMNLKQNIEQVTLREELHHVQSYLEIELARFADRLTVHMDIDESLYGLKLPTFTLQPLVENAIKHGTSNLFEAGEITIKAYPSHHQIILEVIDNAGLYTEQNSNNGLGTTIVDKRLKNQFGDNFGLTMSCISNQQTKATIHLPIENKNHA

SEQ ID NO: 14825 - DNA, 1677 bp, Fusobacterium nucleatum subsp. vincentii ATCC 49256
  CDS (1)..(1677): transl_table=11
atgaatatacaatttatttcacatttaatcagcaatattggttgttctgccataattgcatttttctttatcagaattgataaagcaaatatcattattaaaagcaatgctaaaactaaaaaagatataatagctctatcttttttcttctcattactttctataagtggaacttatataggattaaattttaatggtgctatactaaatactagaaatgttggtgttatagcaggaggtattttaggtggtccttatgttgcaataattacaggacttgtagcaggaatacatagagcctttgttaatcttggaagagaaactgctataccttgtgccattgcaacaataacaggtggatttttaactgcttatgtacatcgttttattaaaagtaaggataaaatattttttggcttttttttagcttgtgtagttgaaaatcttagtatgggcttaattttgattatacttaaagataaaattttagctcaaaatatagttgcaaatttttatgttcccatggtctttatgaattctattggatctagtgtgcttattttactcgttgaagatattatccaaaaaagtgaacttatagcaggtagacaagccaaacttgctttggaaatagcaaataaaactttacctcattttagagaaactgaaaatcttagtgaagtatgcaaaataattgctgaagatttaggagcaaaagcaactgtgattactaataaaaaggaaattattgcaggtttttcttttgataaagataaaataaaaaaagcagatataaaaagtaataatactagaaaagttttaaaaactggtgaaacgatgttagttataaaagaagatgatgaaattatagaagattttttagatatttcaccacatataaaatcttgtattattttgcctttaaaggaaaaaaatgatatcagtggaactttaaaaattttctttgatacagcagagaaaattacagataaaaatagatatttaatgataggtttatcgcatcttatatcaactcaaatggaaattagtaaggttgaaaatttaatatctttacttaaatattctgagttaaaagccttacaatctcaaataaatccacactttttattcaatgtattaaatactatgacctctcttatcagaacaaaccctgaaaaagctagggaggtaacaatagatttatccaattatttaagatataatttagataacaatgtaaaaagtgtagagcttataaaagaactaaatcaagttaatacttatattaaaattgagaaggtaagatttggagataaattaaatataatttatgatgttgatgaaagtctatataattttcaaattcctagtttaattattcaaccacttgttgaaaatagtataaaacatggaattttaaagaaaagggataatggttgtgtcaaaataattataaagaagattggtaaagatatagaagttatcattgaagatgatggaataggtatagaacaaactataatcgataatttagataaacaaataaaagaaaatatagggcttaaaaatgtacatcaaagattgaaacttctctatggagaaggacttaatataaaaaaattggagcagggaacgagaataaaatttaaaatacttggaggtgttaaatatgattaa

SEQ ID NO: 14826 - protein, 558 aa, Fusobacterium nucleatum subsp. vincentii ATCC 49256
MNIQFISHLISNIGCSAIIAFFFIRIDKANIIIKSNAKTKKDIIALSFFFSLLSISGTYIGLNFNGAILNTRNVGVIAGGILGGPYVAIITGLVAGIHRAFVNLGRETAIPCAIATITGGFLTAYVHRFIKSKDKIFFGFFLACVVENLSMGLILIILKDKILAQNIVANFYVPMVFMNSIGSSVLILLVEDIIQKSELIAGRQAKLALEIANKTLPHFRETENLSEVCKIIAEDLGAKATVITNKKEIIAGFSFDKDKIKKADIKSNNTRKVLKTGETMLVIKEDDEIIEDFLDISPHIKSCIILPLKEKNDISGTLKIFFDTAEKITDKNRYLMIGLSHLISTQMEISKVENLISLLKYSELKALQSQINPHFLFNVLNTMTSLIRTNPEKAREVTIDLSNYLRYNLDNNVKSVELIKELNQVNTYIKIEKVRFGDKLNIIYDVDESLYNFQIPSLIIQPLVENSIKHGILKKRDNGCVKIIIKKIGKDIEVIIEDDGIGIEQTIIDNLDKQIKENIGLKNVHQRLKLLYGEGLNIKKLEQGTRIKFKILGGVKYD

SEQ ID NO: 14827 - DNA, 1734 bp, Dechloromonas aromatica RCB
  CDS (1)..(1734)
atgttcttcgaatcaattacgctcagtctgaccctgctgcagcagacttgcgtttatctggtgattgcgtatctgctcagccggacccgcatcttcatcccgctgatgcacgtcaccattcgcctgccacaccgggcgacctgctacgtggtgttctcgctgttctgcatcatgggcacctacctcggcctgaagatcgacgattcgattgccaacacgcgtgccatcggcgccgtgctcggcggtatcctgggcggcccgtcggttggcctggcggtcggtttcaccggcgggctgcatcgctattcgctgggcggtatttcggcccaggcctgcatgatctcgaccatcatcgaaggcctgatcggcggcatgttccaccgtcacatgatgcagcagggcaaggttggtgccatttttcagccgctaccggtggcgctggtcaccttcgtggcagaaatcgcccagatgctgacgctgttgttgctggtcaaacctttctcggtggctttccacctggtcgaacagatcgccgtcccgatgtgcctcgccaacgccctgggggccggactgttcatgcgcattctgctcgatcgccggcagttgtacgaacggcaatcgacggtgttctcgaccaaggccctggccatcgccgcccgggtcgagggggtcttgcgcgatggcttcaacatcgataccagtgcccaggtggcgcaggtgctgtatgaggaaaccggtgtcggcgccgtggccattaccgataccgaacacctgctggccttcatcggcatcggcgccgaccaccatatcccgggaacgccgatcagttctgtgctgacccgccaggcaatcgagcgtaacgaggtggtttacgccgacggcaatgaaatcgcctatcgctgctcgatcaacccgaaatgcccgctcgccgcctcgctgatcatcccgctggtcggcgaagatgggcgggtgatcggtaccatcaagctctacgaaccgcgcagccgtctgttctcgaccatcaaccggacgctgggcgaaggcatcgcccggttgctctccaatcagatcctggccggccgctacatgcgccagcgcgaaatgctggcgcaatcggaaatcaagctgttgcatgcccaggtcaatccgcactttctgttcaatgcgctgaacacgctatcggccgtcatccggcgcgatccggaaaaggcctgtcatctggtgctcaatctgtcgaccttcttccgcaagaacctcaagcggccgagcgaggaggccgcccttagcgaagaagtcgcccacgtcgcggcgtatctggaaatcgaacaggcccgcttcctcgacaagctggaggtcgagttcgacattccggaccatctcaagcatgtccgcatgccggcattttcattgcaaccggtggtcgaaaatgcgatcaaacacggcacctcgcaactgctgggcgttggccgggtgcgtatttcggcacgggaagagggcgatgatctgctgctctgcgtcgaagacaatgccggcctctatgtgccatcgaccgacagcggcggactcggcgtcaatctggttcgtcgtcgtatcgtcaatcgctatggctcgcgttacggtatggaaatcgaatgtgaacccgaagtttgcacgcgagtgaccctccgcttgccgatcccgcccagcgactgtcggcccatccaaggagcaagccttgaacgtattgatcattga

SEQ ID NO: 14828 - protein, 577 aa, Dechloromonas aromatica RCB
MFFESITLSLTLLQQTCVYLVIAYLLSRTRIFIPLMHVTIRLPHRATCYVVFSLFCIMGTYLGLKIDDSIANTRAIGAVLGGILGGPSVGLAVGFTGGLHRYSLGGISAQACMISTIIEGLIGGMFHRHMMQQGKVGAIFQPLPVALVTFVAEIAQMLTLLLLVKPFSVAFHLVEQIAVPMCLANALGAGLFMRILLDRRQLYERQSTVFSTKALAIAARVEGVLRDGFNIDTSAQVAQVLYEETGVGAVAITDTEHLLAFIGIGADHHIPGTPISSVLTRQAIERNEVVYADGNEIAYRCSINPKCPLAASLIIPLVGEDGRVIGTIKLYEPRSRLFSTINRTLGEGIARLLSNQILAGRYMRQREMLAQSEIKLLHAQVNPHFLFNALNTLSAVIRRDPEKACHLVLNLSTFFRKNLKRPSEEAALSEEVAHVAAYLEIEQARFLDKLEVEFDIPDHLKHVRMPAFSLQPVVENAIKHGTSQLLGVGRVRISAREEGDDLLLCVEDNAGLYVPSTDSGGLGVNLVRRRIVNRYGSRYGMEIECEPEVCTRVTLRLPIPPSDCRPIQGASLERIDH

SEQ ID NO: 14829 - DNA, 1731 bp, Rhodospirillum rubrum
  CDS (1)..(1731)
atgaccatcggaccgctcgccctcgtcatctcgctgtcccagcagatgtgcgtttatctggtcgtggcctatctgctcagcaagacgccgctgttcatccccttggtccatgtgaccatccgcctgccgcataaggcggcctgctacgccattttctcgttgttttgcatcatgggcacctatttcggcctgcgcatcgatgattcgatcgccaatacccgggcgatcggcgcggtgctcggcggaatgctgggcgggccctcggtcgggctggcggtcgggctgaccggcggcctgcaccgttattcgatgggcggcttcacggccttggcctgcgccatttcgacaacggccgaagggctgatcggcggcctcgtccaccgctatctggtcagtcgcggccagaccggcaagctgttccagccgctggtggtcgggctggtgacgctgttcgccgaggtctgccagatgctgatcatcattctggtcgcccggccggcggtcaacgccgtgcatctggtggaaaccatcgccctgccgatgctggtggccaattcggtgggggcggcgatgttcatgaccatcctgcttgaccgccggacgatgtttgaaacccaatcgagcgtgttctcggccaaggcgctgaagatcgccgcccgcgccgaaggagcgctgcgtagcggcttcaaccgcgaaaactccatgcgcgtcgcccgcatcatctatgaggagaccggcgtcggcgccgtggcgatcaccgatcgcgacaagatcctggccttcatcggcatcggcgacgaccaccataagcccggcatggcggttacctcgctgcagaccctggaatcaatccgcgagaaccgggtgatgtatgccgatggcaatgaggtggcctatcaatgctcgatcagcccgacctgccccttgggcgccgccctggtcatcccgctggttgacgagggcgagcaggtgatcggcaccatcaagctttacgagcccaaaacccggctgttttcgacgatcaatcgcaccttgggcgagggcgtggcccggttgctgtcgacgcagatcctggccgggcgctatgagcagcagcgccagttgcttgcccaatccgaaatcaagctgctccacgcccaggtcaatccgcatttcctgttcaacgccctcaacacgctttcggcggtgatccgccttgatcccgaccatgcccgccatctggtgcaaagcctgtcgaccttctttcgcaagaacctcaagcggaccagcgaacaggtgacgctcaacgacgaggtcgagcaggtcagcgcctatctggaaatcgaactggcgcgctttggcgatcggctgtcggtggatttcaatgtgcccgccgatttgggaaccgccaccttgcccaccttttcgcttcagccgctggtcgaaaacgccatcaagcatggcaccgcccaattgctgggcgatggacggatcggcgtttcggccgagcgccagggcggcgatctggtggtgcgggtggaagacaacgccgggctttatgaacggcggcccggcggcgacggcctggggatgaatttggtcgaccggcggatccgggcgcgctatggccagggctatggtctgagcgttgagtgcgagcgcgatgtggtcacccgcgtcatcttgcgtgtgccgtttgacccaagccccgccggggtcgctagccccgctttcgaaaaggtcggcccgtga

SEQ ID NO: 14830 - protein, 576 aa, Rhodospirillum rubrum
MTIGPLALVISLSQQMCVYLVVAYLLSKTPLFIPLVHVTIRLPHKAACYAIFSLFCIMGTYFGLRIDDSIANTRAIGAVLGGMLGGPSVGLAVGLTGGLHRYSMGGFTALACAISTTAEGLIGGLVHRYLVSRGQTGKLFQPLVVGLVTLFAEVCQMLIIILVARPAVNAVHLVETIALPMLVANSVGAAMFMTILLDRRTMFETQSSVFSAKALKIAARAEGALRSGFNRENSMRVARIIYEETGVGAVAITDRDKILAFIGIGDDHHKPGMAVTSLQTLESIRENRVMYADGNEVAYQCSISPTCPLGAALVIPLVDEGEQVIGTIKLYEPKTRLFSTINRTLGEGVARLLSTQILAGRYEQQRQLLAQSEIKLLHAQVNPHFLFNALNTLSAVIRLDPDHARHLVQSLSTFFRKNLKRTSEQVTLNDEVEQVSAYLEIELARFGDRLSVDFNVPADLGTATLPTFSLQPLVENAIKHGTAQLLGDGRIGVSAERQGGDLVVRVEDNAGLYERRPGGDGLGMNLVDRRIRARYGQGYGLSVECERDVVTRVILRVPFDPSPAGVASPAFEKVGP

SEQ ID NO: 14831 - DNA, 1716 bp, Oenococcus oeni PSU-1
  CDS (1)..(1716)
atgcagcgggtcggaactattttgattttggcttttttattggttaatgttcctttctttcgtcgtcttttaccaaaactcgatcaaatcagtacgaaattttatttaattcttatttttgcgggttttgccctgttctccaacttgaccggcgttgaaattacaaaaaacaataaccttgtttcaacaacttttcttaccggtttgccgtcgagcgattcaatagcgaatacgcgaactctggtaattacagttgccggtttagttggtggaccggttgttgggacaataactggtttaattgctggtgttcatcgtgtttttcaagggaatggagctgatagtttttatattttcagttcaattattatcggttggatctctggcatgatcggccacagctattcaaagagacgaacctatccgacagctggggtcgcagcgataaccggacttggcatggaatttatccaaatgctgtttattcttgttttcagtgtttccggtctacaacttgtgaaattaatttttctgccgatgatgattttgaacagttttggaacctgggtttttatgtcgattattagtgcttacctccatcaagaagaacaattaaggtcagttcagacacatgatattctcgaattggcgaacaaaaccctgccttatttcagttccggtttgactgaaagttcggcaatgcaggcagcaacgattattcagcattatacgaattttgatgcaatcggaatcactgattcgcaaaatgttttggcacatgtcggtccaggttctgatcatcacgtccctgagcgtcatgtggttacagatctttcaaaaagagtcttggcttccggaaagatggaagttgccaattccaaagaaatgattggctgtccgatccctggttgtccactggcagctgcgattgtaattcctttaatcgtagataaacaagtggttgggaccttaaaaatgtattttaccgatgcaagaaaattgacaccggtcgaagaacaattggcaaccggtcttgcatcaattttttctagtcaattggctcttggattggctgaagagcaatcgaaactcgttcgcgatgccgaaattaaatctttacaggcacaggttaatccccacttctttttcaatgcgatcaacactatttcggctttaatgaggactgatgccactcaagctcatgatttattattagagcttagtacttattttcggacgaacctgcaaggagcccgtgaaacgggaattacccttaaacaagaagaggcacacgttcaagcatacttgtctctggaacaaagtcgttttccgaataagtacagtgttaacttttcggtaaaaagcaatgaattaaatttattaccgcctttcacaattcaaattttggtcgaaaacgccattcgtcatgctttcagcggccgcaagaagaataattgtgtcaatgttgtcgtcactgaaaagagaaattgtttacatattctggttagtgataacggaaacggaattcctcagaaactattaccacatctgggccaacgggtagtggattctattcagggtagcggaacggcgcttgaaaatttgaatcgccgcttaaccggtctttatggaccgaaatctgctttgaaaattaatagtagctctaagggaaccgacgtaaaaattgtcattccaagaaaggtgaaaacgatatga

SEQ ID NO: 14832 - protein, 571 aa, Oenococcus oeni PSU-1
MQRVGTILILAFLLVNVPFFRRLLPKLDQISTKFYLILIFAGFALFSNLTGVEITKNNNLVSTTFLTGLPSSDSIANTRTLVITVAGLVGGPVVGTITGLIAGVHRVFQGNGADSFYIFSSIIIGWISGMIGHSYSKRRTYPTAGVAAITGLGMEFIQMLFILVFSVSGLQLVKLIFLPMMILNSFGTWVFMSIISAYLHQEEQLRSVQTHDILELANKTLPYFSSGLTESSAMQAATIIQHYTNFDAIGITDSQNVLAHVGPGSDHHVPERHVVTDLSKRVLASGKMEVANSKEMIGCPIPGCPLAAAIVIPLIVDKQVVGTLKMYFTDARKLTPVEEQLATGLASIFSSQLALGLAEEQSKLVRDAEIKSLQAQVNPHFFFNAINTISALMRTDATQAHDLLLELSTYFRTNLQGARETGITLKQEEAHVQAYLSLEQSRFPNKYSVNFSVKSNELNLLPPFTIQILVENAIRHAFSGRKKNNCVNVVVTEKRNCLHILVSDNGNGIPQKLLPHLGQRVVDSIQGSGTALENLNRRLTGLYGPKSALKINSSSKGTDVKIVIPRKVKTI

SEQ ID NO: 14833 - DNA, 1740 bp, Pediococcus pentosaceus ATCC 25745
  CDS (1)..(1740)
atgttaaatttaaccgtacttttgtttgaaagagctggattaattattattttggctttttttctagtaaatattcctcaatttaggaaattactttttcgaaaagattggtcaacaactttccaattatttgcgattttttctatttttacgattgtagcaaatttaattggtgttgaacttcgacctgataatagcattcaattcaaatcccttctgcagaatgttacccctggagattctgtagctaatattcgaattttaacggttacagtttcaggaattattggcgggccgctggttgggggtggagtaggcttagtcgctggacttcaccgaatgttgcaagagtcgctaacaaccgacgcccttttttatattcccagttcgatgataattggaattttagccggtttttttgctaagaaaaaacaacatcgctttgcaacaatgaaagtgtttgatggttttttagtaggacttttaatggaagcaatccaaatgctgtttattttactatttagtccgacaggttggactttggtaaaatatattgcaataccaatgatgctagtaggtgctttagggacttcggttttcttatcaattatcacgctttactttcggcaggaagttgatactcaagctacccaaactaaatcaatttttcagttagctttaaaaactttgccagtttttcgtcaagggttaaatcaagaagccgctaaaaaggctgctagtttaatattggaatatacaaattttgatgcggttggtattacagatgaatctaagattctggcttttgcggggatgggaagtgatcaccatatcacaggtgcttctatcttgacggaattatctgaagaggcggttaaattgggtgaagttcaaattggaaataatgctcatgagattaattgccctgtaaaaagttgtccattacactcggccgtcgtagtacctttaatcattaaaggtaaagcagtaggtagtttgaaactctactatgtagaagaatggcgattaagtccagtggaaattcaattaggaacagggctgggagaaatattagcaatgcagataatgttaggagaaatcgagcatcaatcagaattagtgcgggatgccgaaataaaatctctccaatcgcaagtcaatccgcactttttctttaatgcgataaatacaattgtggcagttatgcggtacgacagtgaccaagcacgtgaattactgatccaactcagtacttattttagggcaaatttaacggggattagagaaacaaccattccgttgtatcaagaattcaaacatgttaaagcctatttaatgcttgaacaaacacgttttccaaatcgatttgaaattttgtttcaccagaaggtttcggaaaatgtaatgatacctccatttagcatccaaattattgttgaaaatgcccttaagcatgcctttaatagtcgaaaaaagggcaatatagtttcaattaatgttgaacagattaaacaaagacttaaaattgaaattactgacaatgggcaagggattgataaaagtattattgataaattaggaaaacagacggtaagttctgtaagtgggagtggaacggcattacaaaatcttaatgtgcgcttgatgggtctttatggtaaagatgccgaactaaaaataagcagtgatcaaaatggaacccaggtggtaatccaaattccatataaggaacaggtgtaa

SEQ ID NO: 14834 - protein, 579 aa, Pediococcus pentosaceus ATCC 25745
MLNLTVLLFERAGLIIILAFFLVNIPQFRKLLFRKDWSTTFQLFAIFSIFTIVANLIGVELRPDNSIQFKSLLQNVTPGDSVANIRILTVTVSGIIGGPLVGGGVGLVAGLHRMLQESLTTDALFYIPSSMIIGILAGFFAKKKQHRFATMKVFDGFLVGLLMEAIQMLFILLFSPTGWTLVKYIAIPMMLVGALGTSVFLSIITLYFRQEVDTQATQTKSIFQLALKTLPVFRQGLNQEAAKKAASLILEYTNFDAVGITDESKILAFAGMGSDHHITGASILTELSEEAVKLGEVQIGNNAHEINCPVKSCPLHSAVVVPLIIKGKAVGSLKLYYVEEWRLSPVEIQLGTGLGEILAMQIMLGEIEHQSELVRDAEIKSLQSQVNPHFFFNAINTIVAVMRYDSDQARELLIQLSTYFRANLTGIRETTIPLYQEFKHVKAYLMLEQTRFPNRFEILFHQKVSENVMIPPFSIQIIVENALKHAFNSRKKGNIVSINVEQIKQRLKIEITDNGQGIDKSIIDKLGKQTVSSVSGSGTALQNLNVRLMGLYGKDAELKISSDQNGTQVVIQIPYKEQV

SEQ ID NO: 14835 - DNA, 1731 bp, Geobacter metallireducens GS-15
  CDS (1)..(1731): transl_table=11
atgctgcaccttctcgtgaatcttctggagcgcctcgggctgttcgccatcgcgttcatcctggtcatgcgcttcgccatcgtcaagcggttcctgatcggcaaggcgagccgctacgaaaagctcaccctgtcggttctcttcggcttcatcggcattgctgggacctacatgggggtgccgatccagaacgccatcgccaattcgcgggtggtgggggtggccctcggggggatcctcggcggccccctggtcggtttcggggccgggctcatcgccggtgggcaccgttttctcatcgatgtggggggcttcacggcgacggcctgcggggtggcgaccatcgcggagggggttgccggcggcctcatctaccaccgcctcaagagggggcagttcgatcccgccgtggcctttatcacgggggtcgcggtggaaaccctccagatggtgatcctccttgtcatggcgaagcccttcaccgcggcggtgagcctggtgagtgtcatcggcttccccatgatcctggtgaactccatcggcttggccctgttcgtggaactggtgtcatcggtgttccgggagaaggagcgcttcgccgcggtccaggcccagacggccctcaatatcgccctgcgcacgctccccttcctccggggggggctcaccgaggggtctgccgcggcaacggcccggatcatccgggagatgactgatctcgatgcggtggccatcaccgacgaggccgccatcctggcccacaccggggccgaggaggatcaccaccgccccggcttgccgcttctgaccgcttccaccaggtctgccctcgcctcgggggagatcaccacccccctgacccgtgacgacatcggctgtacccacgaagggtgccggctcggctcggcgatcatcgttcccctcaagaagcgggagcgcaccgtgggggccctgaagctctaccggctcaaggaagggggaattacccccctcgacatggagctggccaacggtcttgcccacctcttttccaaccagctggagatctcggagctggaggcccagcgaaaactcgtccgggaggcggaaatccgggcgttgcaggcgcagatcaacccccactttctcttcaacaccatcaacaccatcatcagctacacccggaccagtcccgagaccgcttccgacctcctggtgaagctcgccgatttcttccgcaggaacatcaaccccgggggggacagcgttcccctggcgaccgagcttgaacactgccgcgcctacattgccatcgaaaaggcgcgcttcgaggatcggctcagggtggtgttcgatgtcgacgaggaggccctgggctgcaaacttcccaccctgaccctccagcccctcgtggagaatgccctgaagcacggcatcctcccccgcgaggaggggggagagatccgggtcggtgcccaccgggaagggggcgtggtcaggatcgtggtgggggataatggggtggggatgcccccggagcaggttgcccgcctcttttccggggaatcgagtcagctcccgacggagggggcggggattgccctgaacaatgtcaatgcccggctctcggcgctgtacgggccggagcatgccctgcgggtggaaagcaccccgggagcggggaccaccgtgtcattcacggtgccccaaggggggaggggggagtatgctcatgagagtcttcatcgttga

SEQ ID NO: 14836 - protein, 576 aa, Geobacter metallireducens GS-15
MLHLLVNLLERLGLFAIAFILVMRFAIVKRFLIGKASRYEKLTLSVLFGFIGIAGTYMGVPIQNAIANSRVVGVALGGILGGPLVGFGAGLIAGGHRFLIDVGGFTATACGVATIAEGVAGGLIYHRLKRGQFDPAVAFITGVAVETLQMVILLVMAKPFTAAVSLVSVIGFPMILVNSIGLALFVELVSSVFREKERFAAVQAQTALNIALRTLPFLRGGLTEGSAAATARIIREMTDLDAVAITDEAAILAHTGAEEDHHRPGLPLLTASTRSALASGEITTPLTRDDIGCTHEGCRLGSAIIVPLKKRERTVGALKLYRLKEGGITPLDMELANGLAHLFSNQLEISELEAQRKLVREAEIRALQAQINPHFLFNTINTIISYTRTSPETASDLLVKLADFFRRNINPGGDSVPLATELEHCRAYIAIEKARFEDRLRVVFDVDEEALGCKLPTLTLQPLVENALKHGILPREEGGEIRVGAHREGGVVRIVVGDNGVGMPPEQVARLFSGESSQLPTEGAGIALNNVNARLSALYGPEHALRVESTPGAGTTVSFTVPQGGRGEYAHESLHR

SEQ ID NO: 14837 - DNA, 1683 bp, Exiguobacterium sp. 255-15
  CDS (1)..(1683): transl_table=11
gtgcttgagcaaatcccgtttttactcagccgtttaggcatgttagccttattggcttttttattgtcgcaatggcggatatcacgccatttgtttcaaacgtcatcgcgccgcagtcatcgttttattttgctgggtgtgtttgtcgtatcgggtattctgatgaactatgccggaatcggtctttcgacggacgaaacgattgatccgttgatcggattagccgtttcaccggaacagtgggttatcgatacgcggttgacgatcatcgtcacgagcggtctgctcggtggtccgctcatcggcggtctgaccggagtactcgtcggatttcaccgctactatctcggtgcattcggtgcggaatcggcctggatcattgcggtcggaaccggattgttgagtggactgtacagccgccagtggcgcaggaaagacggttattccttgctccaaccgattggtatcgtcttaactgctgtcatcctcgacattggtgtagcattgatgttggcgccggaccaagcccttgtactggaattgacacgtcaagccgtctttccgatgttgtttacgaatgcagtcggaatcagtgtcttcattgcgatcttacggacgcagttgaaaattgagaatgaattgttcgttcgcgaatccgcacgttcctatcgtttattggatgcgattcgtccgttgcgtaaaagtggcatgacggttgatgtcgcccggaaaatcggatcgacaatcttggaagaaacgaaaatcaaccgtgtcgttttacttggaccggatgggattttggccgatgtccggacgggacacgatacagcggatttattccagcatcagacgattttggaatgggtggagacggctgccgtttaccggtcggaagatgagctgacgcgtcaaatcatctcgtttcatcctttacaggtcgaggggaagaaagctggcattgtctgttggtttccggtccatctgttcgatgatacgatggagcgaacgatggaacagttggtggatcttttggcacgcgaacttgtcgttcaccaagaggaacaactgaatcaatttccgaacaccagtattaaaccgatcctgagtccgaactacctcctcgggatcgtcgatgaaatccatcagacggctgatccggataccccggtcaaacaacagctcggagctttgcgacaactgcttacgacagcacgacgactcgacatgtatcccttacgtgaagaattactgaccttaaaatcttacttgtcgctggaaggaatccgccggcatcatccattgacaccggctgcggtcacgattgatttagatatcgaaacggccgttgaagaacattttgtctttccgttgctcgtgacacagcttgtcgataatgcgttacgccatgcctttccccaaagcggtccgtatcaccggattgatgtccgggcatttcaggaagagacacactgggtgcttgaagtgtcggacaacggagtcggcataccggccgaattcttaaaacgctgggagcaggataaaaagacgcaaacgagtaatttgtttttattacgacgtgctcttcaccggcgatacggtgagcaggcggggtgtacgatttattcccgaccgggtggaacacgcctgaaactgacgttgccccttacgaccgatcagatgtaa

SEQ ID NO: 14838 - protein, 560 aa, Exiguobacterium sp. 255-15
MLEQIPFLLSRLGMLALLAFLLSQWRISRHLFQTSSRRSHRFILLGVFVVSGILMNYAGIGLSTDETIDPLIGLAVSPEQWVIDTRLTIIVTSGLLGGPLIGGLTGVLVGFHRYYLGAFGAESAWIIAVGTGLLSGLYSRQWRRKDGYSLLQPIGIVLTAVILDIGVALMLAPDQALVLELTRQAVFPMLFTNAVGISVFIAILRTQLKIENELFVRESARSYRLLDAIRPLRKSGMTVDVARKIGSTILEETKINRVVLLGPDGILADVRTGHDTADLFQHQTILEWVETAAVYRSEDELTRQIISFHPLQVEGKKAGIVCWFPVHLFDDTMERTMEQLVDLLARELVVHQEEQLNQFPNTSIKPILSPNYLLGIVDEIHQTADPDTPVKQQLGALRQLLTTARRLDMYPLREELLTLKSYLSLEGIRRHHPLTPAAVTIDLDIETAVEEHFVFPLLVTQLVDNALRHAFPQSGPYHRIDVRAFQEETHWVLEVSDNGVGIPAEFLKRWEQDKKTQTSNLFLLRRALHRRYGEQAGCTIYSRPGGTRLKLTLPLTTDQM

SEQ ID NO: 14839 - DNA, 1767 bp, Exiguobacterium sp. 255-15
  CDS (1)..(1767): transl_table=11
atgtttgaactcataccctttttactggaacggctcggcatcatgatcattttagcgttcatcctcgcccagtggggaccgacgcggcgtttactgaaacagccggaagccggctggcagtttgggttgctgattctaattttcgccacctatgggattttgagtaattacacgggagtcaaggtcgatttagccaagttcttaccgcacacttggctcgaacaggttgacggtacatcagcaatcgccaacacacggacgatgattgtcgtcatcagcggattgctcgccggtccgatcggtggaacgatcaccggtctcctcgttgggattcaccgctatacacttggcgggtttaccgctttcgcctgcgccctctcgaccgtcgtcgcaggcggtgtcagtggattactccgtccctactggcgcgaccgtctcggcagtcgggcattactgccgatttgcctgacgggttttttaatggttttcgaaatgtcattgattcttctgttttccgacccgttcccggccgccctcgaactcatccagttcatctttcttccgatgaccgtcgtcaacgtcctcggcgtctggctgttcttatcgatcatccgtctcgccgcgcgggaagaggaacacgttcgggcccgtgaagcggaacggtccctgcatatcgcggatttgaccttacctcatttgacacgcggcttaactatccaaaccgcggaagccgtggcagatattttattacaacagacacgcgccgatgcggtctccttgacggatcaatcagtcattttggcacatataggtgtcggcagtgaccatcaccaatccggcgggcactggacgacccgtccgacggagcatgttttgacagacggacaactgaggcttgtcaccgatcgggatgagatcggttgtccaaaagcagattgcccgttacaggcgggcatcattgctccgttaacaatcggcgaaacgacaatcgggacactcaaagtgtattatcctcatcctgaattgctcgacgccgtcgaagtcgaattgatcgaaggactggccaagctcttctcgacccaactcgccctcgggaaagccgagcggcaagccggtctgttaaaggatgctgaaatccgggccctcgaagcacagatccatccgcattttttatttaatgccatcaatacgatttacgcgttatgtcggacagatgtcgaacaggcacggaccttattgctcgaactgtcgacgtttttccgcagcaacctgcagggtgcccgctcgacgaaaattccgctccaaaaagaactggaacatatcgaagcctatatctcactggaagcggcccgttttccgagccgcccgtttgttgatattgatttagaggacgggacggaacaattacttgttccgcctttcgtactccaaccgttgatcgaaaatgccttccagcatgcgtttagtcctggtcaaaccggatatgtcggcgtcacggcctggttaaccgcggatcaactcgttttggaagtcgtcgataacggacgcgggatcgacgcggaacgcctgacacgcctcggtcgggaagtcgttgaatccaacggtaccggcactgcccttttcaatacagccgaacggattaaaagtctgtatgctgaaaacggttcgttccggctgaccagtcaaccgggagaaggtacgaccatcaccatccatctgcccattgaaacaggaaaggaggtttcccatgcgcacgatcctaattga

SEQ ID NO: 14840 - protein, 588 aa, Exiguobacterium sp. 255-15
MFELIPFLLERLGIMIILAFILAQWGPTRRLLKQPEAGWQFGLLILIFATYGILSNYTGVKVDLAKFLPHTWLEQVDGTSAIANTRTMIVVISGLLAGPIGGTITGLLVGIHRYTLGGFTAFACALSTVVAGGVSGLLRPYWRDRLGSRALLPICLTGFLMVFEMSLILLFSDPFPAALELIQFIFLPMTVVNVLGVWLFLSIIRLAAREEEHVRAREAERSLHIADLTLPHLTRGLTIQTAEAVADILLQQTRADAVSLTDQSVILAHIGVGSDHHQSGGHWTTRPTEHVLTDGQLRLVTDRDEIGCPKADCPLQAGIIAPLTIGETTIGTLKVYYPHPELLDAVEVELIEGLAKLFSTQLALGKAERQAGLLKDAEIRALEAQIHPHFLFNAINTIYALCRTDVEQARTLLLELSTFFRSNLQGARSTKIPLQKELEHIEAYISLEAARFPSRPFVDIDLEDGTEQLLVPPFVLQPLIENAFQHAFSPGQTGYVGVTAWLTADQLVLEVVDNGRGIDAERLTRLGREVVESNGTGTALFNTAERIKSLYAENGSFRLTSQPGEGTTITIHLPIETGKEVSHAHDPN

SEQ ID NO: 14841 - DNA, 1686 bp, Desulfuromonas acetoxidans DSM 684
  CDS (1)..(1686): transl_table=11
atggggctgattattgatctgttgcagcagatgtccgtgtttctggtcatcgcctatatttttacgaagtcaccggcgttccgcccgctgaccggtgaaagcctcagccatcgtcataagctgcttctctatgtcattttttccaccttttccattatgggcacctattttggtctgccggtgcaggatgccattgccaacacccgtgccattggcccggtgctggcgggtcttattggcgggcctgtgctcggattggccacaggcctgaccggtggacttcatcgctattttctcggcggatttaccgccttctcctgtggtgtgtcgacgaccgttgaagggctgatcggcggtctggtgtgtctggtgctgctgcgccgtgggcaggcggaacaacgctttaatccgcgtattgccttgttgaccaccctggtcgccgaagggatgcagatggtgatcattctgctgctggcaacgcccaccgaagacgccgtgcaactggtgcaagcgattgccgcgccgatgatcttggctaattccgccggagcggcgttgtttatgagtattatccgcgatcaacggcgcatgtatgatcatttcggcgcactgttctcggccaaggcatttgagttggccgagcgggtgttggagattctcggcgatggcctcaaccataaaagtgcgctggagatggcccaattgattcatcgctggaccggggtcggtgcggtggccatcaccgaccgtgaacaggtgctggcgtttgtcggtcttggtgaagatcaccatctggctgggaatccgatcatgtcgccgttgaccaggcgtgccattgaccagaatcagaccgtgtttgccgatggcgggcgcgagcactatcattgctccatcagtgatcagtgcccgctgagctcggcgttggtggtgccgttgcgtgtggatcgggatgtgatcggcaccattaaactgtatgagccgcggcgcaaattgtttctcaatatcaaccgttctctgggcgagggcttggctgccctgttgtcggagcaactggtccacagccgctatcaggagcagaagacgttgttggcccagtcggaactgaagctggcccaggcccaggtcaatccccattttctgtttaatgcgctgaatactattgtcgccgtgttgcgcaaggatgcggaccgtgcccgtgatctgctgttgcatctgtcgcgcttttttcgcaagaaccttaagcgcaccagtgatatcgcctctctcgaagaggagctggaccatgtgcgttcgtatctgtatatcgaggaggcgcgttttggcgaccgtttgaccgtgaccatggatgttgatccaacgttgatggttctcaagttgccagcgttcaccctgcagccgctgatcgaaaatgcgattaaacatgggatttcgaacattatcggaccgggggagattgcggtgaccggcaggcgaataaagcaggatgtcgagattgtcatttgcgataatgccggcacctgtgccgaccatgaacacagtgatggcctcgggttgcagattgttgataaacggatcaagaacctttatggcccgggatacggcgtcagattgagttgtcttcccggcgaagaaactcaagtgacggtgaccttgccagcgccggaggggaaggaggcagagcaatga

SEQ ID NO: 14842 - protein, 561 aa, Desulfuromonas acetoxidans DSM 684
MGLIIDLLQQMSVFLVIAYIFTKSPAFRPLTGESLSHRHKLLLYVIFSTFSIMGTYFGLPVQDAIANTRAIGPVLAGLIGGPVLGLATGLTGGLHRYFLGGFTAFSCGVSTTVEGLIGGLVCLVLLRRGQAEQRFNPRIALLTTLVAEGMQMVIILLLATPTEDAVQLVQAIAAPMILANSAGAALFMSIIRDQRRMYDHFGALFSAKAFELAERVLEILGDGLNHKSALEMAQLIHRWTGVGAVAITDREQVLAFVGLGEDHHLAGNPIMSPLTRRAIDQNQTVFADGGREHYHCSISDQCPLSSALVVPLRVDRDVIGTIKLYEPRRKLFLNINRSLGEGLAALLSEQLVHSRYQEQKTLLAQSELKLAQAQVNPHFLFNALNTIVAVLRKDADRARDLLLHLSRFFRKNLKRTSDIASLEEELDHVRSYLYIEEARFGDRLTVTMDVDPTLMVLKLPAFTLQPLIENAIKHGISNIIGPGEIAVTGRRIKQDVEIVICDNAGTCADHEHSDGLGLQIVDKRIKNLYGPGYGVRLSCLPGEETQVTVTLPAPEGKEAEQ

SEQ ID NO: 14843 - DNA, 1731 bp, Moorella thermoacetica ATCC 39073
  CDS (1)..(1731): transl_table=11
atggactggtcaatgggcctgcatcttgcggaaagattgagtatggttgccacagcggcttttatcctatctcgtaccccggccctgggacgcatcttatcccggcagcttaccaatcgggacaggctattgctggtccttgtccttggcgggatggggatagttggaacctatgccggtatccccattcacgatgccctggccaactcccgggtggtgggagtgatggtagctggcctgctgggcggtcccttcgtaggggcgggagccggcctgatcgccggcatccatcgctatttaatggggggctttaccgccttcgcctgcggcctggcggcagtagcggaggggaccctcgggggactggtacagcagtgttaccgtcgttcaccggtgccctggcctatggccttcgccgcgggcctggtaggggaaaccatgcagatggtcatcatcctcctgacagcccgcccctttactgaggcctgggctctggttcagattatcggccccccgatgattattgtcaattctattggcgtggccattttcatgtttattgttaaaactgccgccgaacagcaggaccacatcgccgcctgtcaggcccagcgggctctggatattgccaaccagacattacctttcctgcgccatggcttgaaccgggagtcggccgaagaggcggcaaggattatctttaattccattaaagtggccgccgtagctattaccgacaggcaggaaattctggcccatgtgggaatgggcagtgaccaccatcacccgggtatgcctatcatgaccagcgccaccctccaggccatagccaccggagagttgcagctggcccggagccggggtgaaatcggctgccgggagaaggactgtcgtttggcttcggcggtggtggtgcctctcaagaggcgggaagcaaccattggcacgttaaagctttatcacgagcgggagaatagcattaccacggtggacctggaactggcccgggggctggcccacctgttttctacccagctggaactggcagaggtgaaataccaggctcagctacgttcccaggcagaactaaaggtcctgcaggctcagatacacccccacttcctctttaatgccttgaataccattagttccctgatccgtaccagacccgaaaaagcaagggaattgctggcgaaactggccagtttcttccgctatagtttaagaagggacgataaccccattcccctggccgaagagctggcccacgtagattcttacctggctatagaggaagcgcgttttggtaataagctggaggttatccgccaggtggaccccgccaccctggctttccctgtccctgccttcaccctgcaaccggtagtggaaaacgccatcaaacatggattacaacccagaactcaagggggcagggtgatattgaacgccagcgatcggggagcggatgtagaggtcagggtaacggacgacggggtgggtattgccccggaagaaatgaataaaatttttctccctggctacggtcgcggccacggcctgggcctgtctattgttaacgagcgtttaaaggccctttacgggccggaatacgccgtccgggtgaagagtgtccccggccagggtaccgaggtggtcctgcgttttcctaaaaaagttgagcaccgggaggtgaaggaggaagatgacctttaccgccgttgtggttga

SEQ ID NO: 14844 - protein, 576 aa, Moorella thermoacetica ATCC 39073
MDWSMGLHLAERLSMVATAAFILSRTPALGRILSRQLTNRDRLLLVLVLGGMGIVGTYAGIPIHDALANSRVVGVMVAGLLGGPFVGAGAGLIAGIHRYLMGGFTAFACGLAAVAEGTLGGLVQQCYRRSPVPWPMAFAAGLVGETMQMVIILLTARPFTEAWALVQIIGPPMIIVNSIGVAIFMFIVKTAAEQQDHIAACQAQRALDIANQTLPFLRHGLNRESAEEAARIIFNSIKVAAVAITDRQEILAHVGMGSDHHHPGMPIMTSATLQAIATGELQLARSRGEIGCREKDCRLASAVVVPLKRREATIGTLKLYHERENSITTVDLELARGLAHLFSTQLELAEVKYQAQLRSQAELKVLQAQIHPHFLFNALNTISSLIRTRPEKARELLAKLASFFRYSLRRDDNPIPLAEELAHVDSYLAIEEARFGNKLEVIRQVDPATLAFPVPAFTLQPVVENAIKHGLQPRTQGGRVILNASDRGADVEVRVTDDGVGIAPEEMNKIFLPGYGRGHGLGLSIVNERLKALYGPEYAVRVKSVPGQGTEVVLRFPKKVEHREVKEEDDLYRRCG

SEQ ID NO: 14845 - DNA, 1698 bp, Shewanella baltica OS155
  CDS (1)..(1698): transl_table=11
atgtctttgatcctattattgacccaacagatgtcgctgtacttagtgatcgtttacttagtcagtaaaacgccgctgtttaaactgtttgccgaaacctcccctcgtctgccacataagatttttatgtatctgattttttcaagtttctgcatcatggccacctattttggtgaacaaacatcaggtgcgattgcaaatacccgtgctatgggcgctgtgttaggtggattattaggcgggcccgttactggttttctggtaggactaacaggtggccttcaccgctacagtatgggcggctttactgaaatagcctgcgccatttccaccaccttagaaggattatccgctgggatgataagcttctacttaagacgtgcgggtaaaagtgagcttatctacaatccattactcgtttgcctagtgactttttatgccgaaatgatgcaaatgagcatcatcttactggtcgcccgccccttcgatgatgcgtgggagttagtgcgtcaaatcgcgccgcccatgttgttagtcaattccgtgggagcggcactctttatgagcatgatccgcgaccaaaaaactatgttcgataaactttcctccagtttttcaactaaagcattaaagatagccgaacgcagtgtcggactcctatccaaaggatttaacgaagaaagcagcagccgtgtcgccaaaatcgtcatagaagaaaccaatgtaggcgcagtagccatcactgacagggaaaaactgttggcttttattggcataggtgccgatcatcatctgcctggcacgctgatttcatctaagatcaccttagaggcgattaatcaaaataaagtcatgttcgccgatggcgttgaaatgccttactcatgttctatttcaagtaattgtcgtttaggttcgagtctggtgatcccactgcgcagtgataccgaagtcattggcaccattaaactctacgagccgaaaaataaactttttttgaatattaaccgcaccttaggtgaaggtattgcccgtctgttatcaaaccaaattctttatggccgatttgagcaacaacaaaatctgctaactcaagccgaattgaaattactgcaagcgcaggttaatccacactttctattcaatgcacttaacaccattagcgcgattatcaagcgcgatcccgatatgtctaagcaattgctgcagcagttatctcaatttttacggattaatttaaagcgaacgacaggcttagtgacacttggggatgagctagatcacatcgcgtcctatctcaccattgaaaaagcgcgttttattgataaattacaagtcagtatcgcgatacctgaatcactctaccactgcaaagtaccggcctttaccctgcagccgattattgagaatgccgtaaagcacggcacttcgcacatgatagagcaagggcagatcaaagtgacgggcaagcttgaaaatcatgtgttggaattagaagtcacagacaatgccggattatatcagcccgttgagggctctgaaggcctagggatgaacttagtgcataaacgcattcaaaatatttttggcgaacaatatggtgttactgtggaatgcgaagccgatgaattgactcgtgtcaccataagattacctatagaaaaccctgagatatccaatatggacacccgcacgtga

SEQ ID NO: 14846 - protein, 565 aa, Shewanella baltica OS155
MSLILLLTQQMSLYLVIVYLVSKTPLFKLFAETSPRLPHKIFMYLIFSSFCIMATYFGEQTSGAIANTRAMGAVLGGLLGGPVTGFLVGLTGGLHRYSMGGFTEIACAISTTLEGLSAGMISFYLRRAGKSELIYNPLLVCLVTFYAEMMQMSIILLVARPFDDAWELVRQIAPPMLLVNSVGAALFMSMIRDQKTMFDKLSSSFSTKALKIAERSVGLLSKGFNEESSSRVAKIVIEETNVGAVAITDREKLLAFIGIGADHHLPGTLISSKITLEAINQNKVMFADGVEMPYSCSISSNCRLGSSLVIPLRSDTEVIGTIKLYEPKNKLFLNINRTLGEGIARLLSNQILYGRFEQQQNLLTQAELKLLQAQVNPHFLFNALNTISAIIKRDPDMSKQLLQQLSQFLRINLKRTTGLVTLGDELDHIASYLTIEKARFIDKLQVSIAIPESLYHCKVPAFTLQPIIENAVKHGTSHMIEQGQIKVTGKLENHVLELEVTDNAGLYQPVEGSEGLGMNLVHKRIQNIFGEQYGVTVECEADELTRVTIRLPIENPEISNMDTRT

SEQ ID NO: 14847 - DNA, 1674 bp, Shewanella baltica OS155
  CDS (1)..(1674): transl_table=11
gtgctcgaaaatcaaatgatgttactggcggtatttgaacgggcggccttgatgctgatgaccttgttctttttaacccgcactcgaccgtttcagcgtttattccaaaagcgtaatcacacccccgcagagctggtctctgtggcggcgatattttgcttatttgcggtgtttagtacttataccggtattgaggttgaaggcgcgctggttaacgtgcgcattatcgcgattgtttccggtggaattttatttggcccttgggtcggcattcccgcgggcgtgttgtcggggctgcatagatatctgattgatatggatggcgatacttctatcccgtgtttaatcgccagcataattgccggtctaatggcgacctggatttactacaaatgccccaaatctaagttatggatttatggcatagtggcgggcatgttgtgcgaaacactgaccatgttgttgatttggctgctgacagagccgcaccaagtgggcgtagatattgtgagtcacattgcctatcccatgattgcgggcactgtgtgcatcggactgattatcaagctagtgcaagacctcgacgatgagaaagagctcattgccgccaagcaggccaagctcgcgctggatattgccaacaaaaccttacctttcttccgcaaaattgaccgccatgccttagagcaagtgtgcggcgtgatccgcaatgaaatccatgcagatgccgtggcgattaccgatactcgcgatgtattggcctatatgggcgtaggcaaagattactacgaggtcgatggtcatcaagcgattagcgagatgactcaaagggcgatagagctagatcaaaacattattaacaacgacttacgccaatatcatttatcggattttcattcggtcatcataatcccgctgcgtgaaaacggcactgtgagcggcacgttgaagatttattatcgtaatacctatcggattaccagctcgctgcgggaaatggcggtgggcttgtcgcagttgatttcgacccagatggaagtgtcgcgtatcgagcaactgcaggagatgacccgcaaggcggagtttactgcgctgcagagcaagattaacccgcactttttgtttaatgccctcaatgcgatttcttctttgatccgtattcggccgcagcaggcgcgggagttgattgctaatctggccgattatctgcgctataacctagccaagggcgatgagctgattgatatccaagaggaagtcaaacaagtacgcgattatgtggcgatcgagcaggcgcgctttggcgataagcttgaagtggtgttcgatgtcgacgatgtgcatttttgtgtaccttgcctcttgttgcagccgctggtggaaaacgccattttgcacggcattcagccacgtagtgcaccgggcagagtgaccatagaagtgaaaaaactcgatgctggcattcgcgtggccgtgcgtgacactggttatggcatcagccaagaggtgatagatggcgtcgccgcgggtcgcatagaaagcagcagtattgggctgatgaatgtgcaccagagggtgaagttattgtacggcgaagggctgcagcttaaacggctggagccggggactgaagtcagcttttatttaccggaaaatgaggcgcaagtatgttaa

SEQ ID NO: 14848 - protein, 557 aa, Shewanella baltica OS155
MLENQMMLLAVFERAALMLMTLFFLTRTRPFQRLFQKRNHTPAELVSVAAIFCLFAVFSTYTGIEVEGALVNVRIIAIVSGGILFGPWVGIPAGVLSGLHRYLIDMDGDTSIPCLIASIIAGLMATWIYYKCPKSKLWIYGIVAGMLCETLTMLLIWLLTEPHQVGVDIVSHIAYPMIAGTVCIGLIIKLVQDLDDEKELIAAKQAKLALDIANKTLPFFRKIDRHALEQVCGVIRNEIHADAVAITDTRDVLAYMGVGKDYYEVDGHQAISEMTQRAIELDQNIINNDLRQYHLSDFHSVIIIPLRENGTVSGTLKIYYRNTYRITSSLREMAVGLSQLISTQMEVSRIEQLQEMTRKAEFTALQSKINPHFLFNALNAISSLIRIRPQQARELIANLADYLRYNLAKGDELIDIQEEVKQVRDYVAIEQARFGDKLEVVFDVDDVHFCVPCLLLQPLVENAILHGIQPRSAPGRVTIEVKKLDAGIRVAVRDTGYGISQEVIDGVAAGRIESSSIGLMNVHQRVKLLYGEGLQLKRLEPGTEVSFYLPENEAQVC

SEQ ID NO: 14849 - DNA, 1710 bp, Shewanella amazonensis SB2B
  CDS (1)..(1710): transl_table=11
atgtcgcttatcctgctgctgacccagcaaatgtgtctctacttggtgtttgtttacctcgccagtaaaacacctctgtttaaggttctcaccgaaaacgcccccagattgccccacaaggtcatcatctatgttattttttcggccttctgcattatggccacctactttggcgagcaaacccacggcgcaatagccaataccagggccatgggagccgtactcggtggcctgctcggtggacctgtgaccggcttttttgttggccttaccggcggcctgcacaggtatagcatggggggctttaccgatgtcgcctgcgcactctcgacaacgctcgaggggctttctgccgggcttatcagcctgacacttcgccgagccggaaaaaccgaactgattttccaccctctggtggctggctttgttaccttctatgccgaagtcatgcaaatgctcatcatactgctggtcgccaaaccctatgacgaagcctgggcactggtgaggcaaattgcccctcccatgctgctggtgaactccatgggctcggccctctttatgagcatgctcaaagatcaaaaagcgatgtttgataagctctcctccaccttttccaccaaggcgctgaagattgcggaacgcagtgttgggctcttgtctcagggatttaacgaaaaaaccagcgcccaggtcgcccgaattgttatcgaagaaaccaatgttggcgccgtggccatcactgacagggaaaaactgctcgcctttattggtattggcgccgaccaccatataccgggaacacccattgcctcggccatcacactcgaagctatccgagacaacaaggtaatgtttgccgatgggatggaagtgccctacgcctgttctatttcctcccaatgccgtttgggttcaagtttggtgatcccccttcgcagcgatactgaagtcataggcaccattaagctctacgagcccaagaacaaattatttttaaacatcaaccgcacccttggcgaaggtattgccaaactcctgtccaaccaaatcctctatggtcgggtagagcaacaaaagaacctgctcacccaaaccgagcttaagctgttgcaggcgcaggtaaacccccatttcctgttcaatgcgcttaataccattggcgccatcattcgccgcgaccctgatatggctcgcggactgctgcaaaagctatcgcagtttttacgcattaatctgaaacgcagcccggaaatggttaccctggccgatgaacttgagcatatcgacgcctaccttggcatcgaaaaagcccgttttatcgatcgcctcagcgtgaatatcgccatcccccccgaactgatgcaccagaagctacccgcctttactctgcaacccattatcgaaaatgctgtaaaacacggcacctcacaattgctgtcaccgggcgtgattgacgtgagtggcaggcagcaggagcagatgctggtgttggaagtcgccgacaacgcggggttgtatcgccccactcccaacaatgaaggtctggggatgaatctggtgcataaacgcattcaaaatcaatttggagaacagtacggcgtgacggttgaatgcgaacccgatacgctcacccgggtcagaatttgcctgccaatcaacgtcgacacacccatcgacaccgacaattcgggagacaagccgagatga

SEQ ID NO: 14850 - protein, 569 aa, Shewanella amazonensis SB2B
MSLILLLTQQMCLYLVFVYLASKTPLFKVLTENAPRLPHKVIIYVIFSAFCIMATYFGEQTHGAIANTRAMGAVLGGLLGGPVTGFFVGLTGGLHRYSMGGFTDVACALSTTLEGLSAGLISLTLRRAGKTELIFHPLVAGFVTFYAEVMQMLIILLVAKPYDEAWALVRQIAPPMLLVNSMGSALFMSMLKDQKAMFDKLSSTFSTKALKIAERSVGLLSQGFNEKTSAQVARIVIEETNVGAVAITDREKLLAFIGIGADHHIPGTPIASAITLEAIRDNKVMFADGMEVPYACSISSQCRLGSSLVIPLRSDTEVIGTIKLYEPKNKLFLNINRTLGEGIAKLLSNQILYGRVEQQKNLLTQTELKLLQAQVNPHFLFNALNTIGAIIRRDPDMARGLLQKLSQFLRINLKRSPEMVTLADELEHIDAYLGIEKARFIDRLSVNIAIPPELMHQKLPAFTLQPIIENAVKHGTSQLLSPGVIDVSGRQQEQMLVLEVADNAGLYRPTPNNEGLGMNLVHKRIQNQFGEQYGVTVECEPDTLTRVRICLPINVDTPIDTDNSGDKPR

SEQ ID NO: 14851 - DNA, 1677 bp, Shewanella frigidimarina NCIMB 400
  CDS (1)..(1677): transl_table=11
atgtcgttaatattactgctaacacaacaaatgtgtgtttacttagttatcgtttacttagtcagtaaaacgccattatttaaactatttgcagagacttcaaaacgattacctcataagatttttatttacttagtgttctccagcttttgcataatggcaacttactttggtgaacaaacctcaggagccattgctaatactcgtgctatgggcgctgtattaggcggattactaggtggacctgtaactggtttactggttgggttaacgggtggattacaccgttattctatgggtggattcaccgatattgcttgcgccatatccaccagcttagaaggcttatccgcaggtatgatcagttattacttcaaaaaagccggtaaatcagaaatggtttatcagccaattgtggtattgggggtcacgtttatggctgaaataatgcagatgtcgataattgtattagtcgcaaaaccctttgatcaggcttgggaattggtcaaactgatcgccccgcccatgttactgattaattcactcggcgctgcgatgtttatgagtattgttcgcgaccaaaaagccatgtttgataaactttcttccagtttttcgactaaagcacttaaaatagctgagcgcagtgtcggcttactgtctaaaggatttgatttggagtcgagtaaaaaagtcgcccaaatcataatagaagaaactcaagttggcgcagtcgccattaccgacaccactaaattactggcatttattggccttggggcagatcaccatattcctaatacgcctatttcctcaaaaatcaccctcgatgccatcgcacaaaatagtgtgatgtttgctgatggggtcgataccacttattcctgctctatatcgcccaattgcagtttaggctcaagcctagtcattccgctgcgcagcaacgacgaagtcattggcacaattaaattatacgaacctaaaaacaaattgtttttaaacataaatcgcacattaggcgaaggtattgcgaggttaatgtctaaccaaattctttatggccgctttgagcaacagcaaagcttattgatgcaagcagagataaagttgttacaggctcaggttaatccgcactttttatttaatgcactcaataccatcagtgcaattattaagcgtgacccacaaatgtctaagcaattattacagcagttatcgcaatttttgcgcatcaacttgaccagaactacagggctggtgacaatggctgatgaacttgagcacatcgacgcttatctcgctatcgaacgcgctcggtttatcgacaaactgcaagtcaacatagatattgctatgatttatcatcaccaaaaaatgcccgcatttaccttacagccgttaattgaaaatgcagtaaaacacggtacatcgcggatgcttgatgccggtgtgattgatgttaaagccacattggatggcgatgatttattactcaacgtgaccgataatgcaggtttatatcaaccctctaacaacactgatggtttaggaatgaacttagtccataaacgaattcagaatttatttggcagccaatacggcattgaagttgagtgtgaaccagatgtattcactcgtgttagtgtgcgtttaccgttaaaggaaatggaccaatga

SEQ ID NO: 14852 - protein, 558 aa, Shewanella frigidimarina NCIMB 400
MSLILLLTQQMCVYLVIVYLVSKTPLFKLFAETSKRLPHKIFIYLVFSSFCIMATYFGEQTSGAIANTRAMGAVLGGLLGGPVTGLLVGLTGGLHRYSMGGFTDIACAISTSLEGLSAGMISYYFKKAGKSEMVYQPIVVLGVTFMAEIMQMSIIVLVAKPFDQAWELVKLIAPPMLLINSLGAAMFMSIVRDQKAMFDKLSSSFSTKALKIAERSVGLLSKGFDLESSKKVAQIIIEETQVGAVAITDTTKLLAFIGLGADHHIPNTPISSKITLDAIAQNSVMFADGVDTTYSCSISPNCSLGSSLVIPLRSNDEVIGTIKLYEPKNKLFLNINRTLGEGIARLMSNQILYGRFEQQQSLLMQAEIKLLQAQVNPHFLFNALNTISAIIKRDPQMSKQLLQQLSQFLRINLTRTTGLVTMADELEHIDAYLAIERARFIDKLQVNIDIAMIYHHQKMPAFTLQPLIENAVKHGTSRMLDAGVIDVKATLDGDDLLLNVTDNAGLYQPSNNTDGLGMNLVHKRIQNLFGSQYGIEVECEPDVFTRVSVRLPLKEMDQ

SEQ ID NO: 14853 - DNA, 1695 bp, Erwinia amylovora
  CDS (1)..(1695): transl_table=11
atgtacgaattgaactcaattttactgctgttacagcagatgtgtgtgtttctggttatcgcctggctgatgagcaaaacaggcctgtttatcccattgatgcaggtgacggtgcggctgccgcataagctgatgtgctatatcactttctcaattttttgcgttatgggcacctgttttggcctgcatattgaggatcccgtcgcaaacacgcgggcgatgggtgcggtaatgggggggctgctcggtgggccgctggttggtgggctggttggcctgaccggcgggctgcatcgttactcgcttggcggtatgaccgcgttcagctgtacgatctcaaccatcgtcgaaggactgctggctgggcttgtacatgccatactgattaaacgcgggcgcagcgataaggtcttcagtccgctgacggccggcgcgatcacctttattgccgaactgctgcaaatggtgatgattatgctcatttcccgcccgttcaatgatgccgtgcacctggtgcaaaacacggctgcgccaatgttgatcgctaacacctttggcgcggcgatgtttatgcgtattctgctggataaacgcgcaatgttcgagaaacataccacggcgttttccgccaccgctctgaaattagcgggctgtaccgaaggcattttgcgccaggggtttaactcgcagaacagcatgaaggtggcacaggtgctttaccaggagctggatatcggcgcggtggcgatcaccgattgcgacaaactgctggcatttaccggcatcggcgatgaccatcatttgccgggaaagccgatctcttcatccctgacacggaaagcaatcgatactggagaagtggtttacgccgacgggaacgcagtcccctgtcgctgttcactactggctggctgcaagctgggttccactttagttatcccactgcgtggagaaaatcaacgcgtgataggcaccattaaactgtatgagccgcgcaatcggctgttcagctcgattaaccgtacgttgggggaggggattgcacagctgctgtcagcacagatccttaccgggcagtatgagcggcagaaagcactgctggcgcagtcagagatcaagctgctgcatgcacaggtcaacccgcactttttgtttaatgcgcttaatactctgttggcggtgatccgtcaggatagcgataaggcaggtcagctggtgcaatacctgtccacctttttacgtaataatctcaagcgtccgtcggaaatcgtcacgctggctaatgagattgaacatgtgaatgcctatctgcaaatcgaacaggcgcgctttcagtcacgcctgcgggttcagctgcgggtgccgtcggagctgggccactatcagatgcccgcttttatcctgcaacctattatagaaaatgccattaagcacggcacctcacagctgatcggctgcggtgaaatcacgctgcaggccagccgtgaaggtcagtatctgctgctggacatcgaggataatgccggcctttatctgccggaacagcatggcggtgggctgggtataagcctggtcgataaacgactgcgcgtgcgttttggcgatgattatggcattcacgttgcctgtgaacccaatcattttacccgcattactctgcgtctgccgctggagccagtatgttcagcgtattga

SEQ ID NO: 14854 - protein, 564 aa, Erwinia amylovora
MYELNSILLLLQQMCVFLVIAWLMSKTGLFIPLMQVTVRLPHKLMCYITFSIFCVMGTCFGLHIEDPVANTRAMGAVMGGLLGGPLVGGLVGLTGGLHRYSLGGMTAFSCTISTIVEGLLAGLVHAILIKRGRSDKVFSPLTAGAITFIAELLQMVMIMLISRPFNDAVHLVQNTAAPMLIANTFGAAMFMRILLDKRAMFEKHTTAFSATALKLAGCTEGILRQGFNSQNSMKVAQVLYQELDIGAVAITDCDKLLAFTGIGDDHHLPGKPISSSLTRKAIDTGEVVYADGNAVPCRCSLLAGCKLGSTLVIPLRGENQRVIGTIKLYEPRNRLFSSINRTLGEGIAQLLSAQILTGQYERQKALLAQSEIKLLHAQVNPHFLFNALNTLLAVIRQDSDKAGQLVQYLSTFLRNNLKRPSEIVTLANEIEHVNAYLQIEQARFQSRLRVQLRVPSELGHYQMPAFILQPIIENAIKHGTSQLIGCGEITLQASREGQYLLLDIEDNAGLYLPEQHGGGLGISLVDKRLRVRFGDDYGIHVACEPNHFTRITLRLPLEPVCSAY

SEQ ID NO: 14855 - DNA, 1770 bp, Bacillus anthracis
  CDS (1)..(1770): transl_table=11
atgctaaatttagtacttatgatgattgaacgcgtcggacttattgttattctaggatttttactttcgcatattaaaacattcaggcgccttcttcataagcaagatggttatgtagataagcttaagcttatttgtattttttcggtgtttacaattgtaagcaattacaccgggattgaaatagcagggaatacgattatgaatgaaaattggctacagggtgtttcatcatcgagtaccattgcaaatacacgtattatgggtgttggaattagtggattgcttggcggtcctatcgtcggaattggagtaggatcgattgctggtattcaccgttatatgcttggcgggacgacagcgctaagttgcgcgatctcttcaattttagcaggcgttataactgggtatattggatacatttttaaaaagtataatcgtacaattacgcctaaattttcagcagttttaagtgtgtttatcgtttctttagaaatgattatgattctattaattgtagaggatggcattagcattgtgaaaacaattgcgataccaatgatccttgtaaatagctttggaagttttattttactttctatgatacaagctattttgcgccaggaagagaacgcaaaggcacttcagactcataaggtattacgtattgcagataaaacgttaccgtattttcgccaaggcttaacagaagaatcttgtaagcatgtggcacaaattattcaccgctttacaggaacagatgcggtatccttaacagatacagagaaaatattagctcatgttggattagcgtcagatcaccatattccttcacatagtttaataaccggtttgtcgaaagaagtgttacatacagggaaaataatgaaagcgaaatcacgtgaggtcattaattgtcaacatgaaggctgtcctttgcaagcggcgattgttattccgctaacttcacatggaaatacgatagggacattaaaactatatttcaaaaatcctaaccagttaagtcgtgtggaagaggaattagcagaagggttagcaaaaatattctctacacaacttgaattaggtgaagctgagttgcaaagtaaactattgcaagatgcggagataaaggcattacaagcacaaattaacccacactttttatttaatgcaattaatacagtatcagctttatgccgaacagatgtagaaaaggcaagaaagttattattacagcttagcgtgtatttccgttgtaatttgcaaggggcacgtcagttattgattccactagaacaagaattaaaccatgtacaggcatacttatcactagaacaagcaaggttcccaaataagtatgaagtaaagatgtatattgaggatgagctcaagacaactttagtaccaccgtttgttcttcaactattggttgaaaatgcattgcgacacgcttttccaaagaagcaacccgtatgtgaagtggaagtgcatgtttttgaaaaagagggtatggttcattttgaagtaaaggataatggacaagggattgaggaagaacgtttagaacaattaggaaagatggtagtttcgtcaaaaaaagggactggaacagctttatataatattaatgaacgtcttattgggttatttgggaaggaaacgatgcttcatatcgaaagtgaagtaaatgaggggacagagattacttttgttattccaaaaaaagtaggggaggaagagcagattgttaaaagtattagtagttga

SEQ ID NO: 14856 - protein, 589 aa, Bacillus anthracis
MLNLVLMMIERVGLIVILGFLLSHIKTFRRLLHKQDGYVDKLKLICIFSVFTIVSNYTGIEIAGNTIMNENWLQGVSSSSTIANTRIMGVGISGLLGGPIVGIGVGSIAGIHRYMLGGTTALSCAISSILAGVITGYIGYIFKKYNRTITPKFSAVLSVFIVSLEMIMILLIVEDGISIVKTIAIPMILVNSFGSFILLSMIQAILRQEENAKALQTHKVLRIADKTLPYFRQGLTEESCKHVAQIIHRFTGTDAVSLTDTEKILAHVGLASDHHIPSHSLITGLSKEVLHTGKIMKAKSREVINCQHEGCPLQAAIVIPLTSHGNTIGTLKLYFKNPNQLSRVEEELAEGLAKIFSTQLELGEAELQSKLLQDAEIKALQAQINPHFLFNAINTVSALCRTDVEKARKLLLQLSVYFRCNLQGARQLLIPLEQELNHVQAYLSLEQARFPNKYEVKMYIEDELKTTLVPPFVLQLLVENALRHAFPKKQPVCEVEVHVFEKEGMVHFEVKDNGQGIEEERLEQLGKMVVSSKKGTGTALYNINERLIGLFGKETMLHIESEVNEGTEITFVIPKKVGEEEQIVKSISS

SEQ ID NO: 14857 - DNA, 1782 bp, Bacillus subtilis
  CDS (1)..(1782): transl_table=11
atgattcatttaatgattatgatgctggagagagtggggattattgttatattagggttcattctcgcccatacgaaacttttcagacaagctcttcagaatcaggacggctataaaggaaaagcgattttaatttctattttttctcttttcagcatcatcagcaattatacaggcatcgaaattcaaagaaatatgattgtaaacaatgactgggtgtttacgatagatccatcgggctctatcgcgaatacccgtattttgggcgtggaaatcgggggccttctcggaggtccttttgtaggggctgggatcggcatacttgcgggcctgcatcgtttttcactcggtggcagcacggccttaagctgtgccgtctcatctattttagcgggtgttcttgcaggcttgatcggcaggtattttacgaagcgatatcgaatgccgacaccgcgcatcgccgctcttgtgggaatcggcatggagtcactgcaaatgatcattattttgctgatggcaaagccgttcagtgacgcttgggagcttgtcagcatgatcggaattccgatgatactcatcaatggaacaggcagttttatttttctgtctattattcaagcgatcattcgcaaggaagaacaggcaagggctctcgaaacgcatcgagtgcttacgattgctgatcagacacttccatttttccgccaaggattaaatgaaaactcctgtaaaagtgtagcggctattatccataagctgacaggaacagatgcggtgtctctcactgacaaagaaaagatccttgcgcatgtcggtgcgggaatggatcaccacatcccatcgaaaagcttgatcaccggcctgtccaaaaaggtgattaaaacagggcatattatgaaggcgatttcgcaggaagagattgaatgcacgcatgctgaatgccctttgcacgctgcaattgtcctaccgctgacatcgaacggcaatacaatcggcaccttaaaaatgtactttaaaagcccggcaggcctgagtcaggtagaggaggaacttgccgaggggctggccatgctgttttcgacacagcttgagcttggggaagcagagctgcaaagcaaacttctcaaggatgctgaaattaaagcgcttcaagcacaggtgaatccgcattttttatttaatgcgatcaacacgatttctgcgttatgccgtacagatgttgaaaaaacccgtaagctcctattgcagctcagtgtttattttcgttcaaaccttcaaggagcgagacagctgctgattccgctctcaaaggagctgaaccatcttaacgcctatttgtcattagaacaggcgcgttttcccgggaaatataaaattgagcttaatatcgacagcagactggagcagattgaaatccctccgtttgttttgcaggtgcttgtcgagaacgcgcttcggcacgcgtttccgaaaaaacaagacatatgcaaggttacagtctgtgtcttatctgatgatgcatccgtctatatgaaggtggcggataacggacgcggaattccgccggacgtcttgccggaactggggaagaaaccgtttccgtctaaggagggaaccggtacagcgctttataacctaaatcagcggctgatcggtttattcggacagcaggctgcactgcatatcagcagtgaggttcataaagggacagaggtttcctttcaagtgccaatgcaacagatgaaagagggagaagaacatgctcagggtgttaatagttga

SEQ ID NO: 14858 - protein, 593 aa, Bacillus subtilis
MIHLMIMMLERVGIIVILGFILAHTKLFRQALQNQDGYKGKAILISIFSLFSIISNYTGIEIQRNMIVNNDWVFTIDPSGSIANTRILGVEIGGLLGGPFVGAGIGILAGLHRFSLGGSTALSCAVSSILAGVLAGLIGRYFTKRYRMPTPRIAALVGIGMESLQMIIILLMAKPFSDAWELVSMIGIPMILINGTGSFIFLSIIQAIIRKEEQARALETHRVLTIADQTLPFFRQGLNENSCKSVAAIIHKLTGTDAVSLTDKEKILAHVGAGMDHHIPSKSLITGLSKKVIKTGHIMKAISQEEIECTHAECPLHAAIVLPLTSNGNTIGTLKMYFKSPAGLSQVEEELAEGLAMLFSTQLELGEAELQSKLLKDAEIKALQAQVNPHFLFNAINTISALCRTDVEKTRKLLLQLSVYFRSNLQGARQLLIPLSKELNHLNAYLSLEQARFPGKYKIELNIDSRLEQIEIPPFVLQVLVENALRHAFPKKQDICKVTVCVLSDDASVYMKVADNGRGIPPDVLPELGKKPFPSKEGTGTALYNLNQRLIGLFGQQAALHISSEVHKGTEVSFQVPMQQMKEGEEHAQGVNS

SEQ ID NO: 14859 - DNA, 1755 bp, Staphylococcus aureus
  CDS (1)..(1755): transl_table=11
gtgctatcgctaacaatgttattacttgagcgtgtaggtttaattattattttggcctatgtgttgatgaatattccatattttaaaaacttaatgaatcgtcgacgtacatggaaagcacgttggcaattatgtattattttcagtttgtttgccttaatgtctaatttaactggtatcgtcatcgatcatcaacatagtttgtcaggaagtgtgtacttccgtttagatgatgatgtatctttagctaacacacgtgtattaacgataggtgtcgcaggattagttggtggcccttttgtaggtctatttgttggcgttatttcaggtattttcagagtgtatatgggtggggcggatgcacaagtttatcttatctcatctatatttatcggtataattgctggttattttggcttacaagctcaaagacgcaagcgttacccgagtattgcgaaaagtgccatgattggaattgttatggaaatgattcaaatgttgagcattttaacattttcccacgacaaagcatatgcggttgacctcatatcattaattgcactaccaatgattattgttaatagcgttggtacggcgatttttatgtctattatcatttcaacattaaagcaagaagagcaaatgaaggctgttcaaacacatgacgtactgcaattgatgaaccagacattgccgtattttaaagaaggattgaatagagaatcggcacagcaaattgcgatgattattaaaaatttaatgaaagtatctgccgtagcaattacaagcaaaaatgaaatcttatcgcatgtaggtgcaggtagtgatcatcacataccaacaaatgaaatattaacaagtctgtctaaagatgtattgaaatcaggaaagttgaaagaagtgcatactaaagaagagattggttgtagtcatccgaattgcccgcttagagcagctatcgtgataccacttgagatgcatggttctatcgtcggtacattgaagatgtattttacaaaccctaatgatttaacttttgtggaacgtcaacttgcagaaggattggcaaatatttttagtagccaaattgaacttggtgaagccgaaacgcaaagtaagttattgaaagatgctgagattaagtcattacaggcacaagtgagtccacattttttcttcaattcaattaacacgatttcagctttagttagaataaatagcgaaaaggcacgagagttactattagaattgagttattttttcagagcgaatttacaaggctcaaagcaacatacgattactttagataaagagttaagtcaagtgcgtgcatacttatcactcgaacaagcacgttatccaggaagatttaatatcaatattaatgttgaagacaaatatcgcgatgtgcttgtaccaccatttttaattcaaattttagttgaaaatgccatcaaacatgcgtttacgaatcgaaagcaaggtaacgatattgacgtgtcagtgattaaagaaactgcaacacatgtacgtattattgtacaagataatggtcagggtatttctaaagataaaatgcatttgttgggagaaacatctgtagaatcagaatctggaactggtagtgctttagaaaatttaaacttacgcctaaaaggattatttggaaaatccgcagcattacaatttgaatcgacatcgagcggtaccactttttggtgtgtacttccttatgaaagacaagaggaggaataa

SEQ ID NO: 14860 - protein, 584 aa, Staphylococcus aureus
MLSLTMLLLERVGLIIILAYVLMNIPYFKNLMNRRRTWKARWQLCIIFSLFALMSNLTGIVIDHQHSLSGSVYFRLDDDVSLANTRVLTIGVAGLVGGPFVGLFVGVISGIFRVYMGGADAQVYLISSIFIGIIAGYFGLQAQRRKRYPSIAKSAMIGIVMEMIQMLSILTFSHDKAYAVDLISLIALPMIIVNSVGTAIFMSIIISTLKQEEQMKAVQTHDVLQLMNQTLPYFKEGLNRESAQQIAMIIKNLMKVSAVAITSKNEILSHVGAGSDHHIPTNEILTSLSKDVLKSGKLKEVHTKEEIGCSHPNCPLRAAIVIPLEMHGSIVGTLKMYFTNPNDLTFVERQLAEGLANIFSSQIELGEAETQSKLLKDAEIKSLQAQVSPHFFFNSINTISALVRINSEKARELLLELSYFFRANLQGSKQHTITLDKELSQVRAYLSLEQARYPGRFNININVEDKYRDVLVPPFLIQILVENAIKHAFTNRKQGNDIDVSVIKETATHVRIIVQDNGQGISKDKMHLLGETSVESESGTGSALENLNLRLKGLFGKSAALQFESTSSGTTFWCVLPYERQEEE

SEQ ID NO: 14861 - DNA, 1776 bp, Staphylococcus epidermidis
  CDS (1)..(1776): transl_table=11
atgcttaatttatttattttattacttgaacgcgtgggattaattattttactcgcatatatactcatgaatattaatcattttaaaacaatgatgagcgaacgtgacaaatggcgttcaaaattccaactaatcattatttttggtatattctctatgatttcaaattttacaggaattgaaatagaaaatggccatatcgtatctagtgatatttattaccacttaagcaaagacgcctcaatggccaatacccgtgtattaacaatcggtgtttctggtctaataggtggaccgtgggtagctataattgtaggcattatttcaggattatgtcgtttatatattggcggggctgacgcatatacctatcttatttcatccatagttatcgctatcatatctggttactttggtcatcaaacaataaaacaaaatacatatccgtccattaaaaaaggtgctattatcggtgcaataactgaaattattcaaatgggctgtatattattatttacaaataacctacatcacgcaattacattagtcagttttatagcactaccgatgattatcattaatagtttaggtacagccatatttttaaccatcattttgtcgaccatcaagcaagaagaacaaatgcgtgcagtccagacgcatgatgtattacaactcgctaacgaaacactaccttactttcgatctggacttaatgaaaaatcagcccaacaagctgctgaaattattttaaaattaatgcaagtgtcggcggtcgctattacaaataaaaaagatattttaacacatattggtgcaggcagtgaccatcacgtagcacgtaaagagataattactgatttatctaaagaagtgattcaatctggaaaattaaaagtcgctcatacgagagaaggaattggatgtcaccatcctaattgccctcttgaaggagccattgtcgtccctctttatatacataatgaagtcgcagggactttaaaattttatttcacagataacaatattatttcaacttcagaccaacagctcgcaaaaggtctcgccaatatattttcctcacagctagaactaggtcaagctgaaatgcaaggacaattattgaaagacgctgaaattaaatcattacaagcacaagtcaatccacatttcttttttaatgctattaacactatatcagcactagtaagaattgatagcgaaaaagcacgacgtttactgattcaactcagtcagttcttccgctctaatcttaatggtgcacgtaataatacgattactttacaaaaggaattacaacaagtagcagcatatttatccttagagcaagctcgctatccaaatagatttaacatacactatcgaattgatgatcagtgtcaagatgcgctcatccccccttttataattcaaatattagtggaaaattctattaaacatgcatttaaaaatcgtaaaaagaataatcatattgatgtggatgttagcatgaagcaagactgcttaagtatatctgttcaagataatggtcaaggcataccagctgatcaattagatactattggatatacgacagtaacgtctaccactggtactggtaatgccttagtcaatcttaataaaagacttactggactatttggaacaacatcggcactgaacattcaatcttctcaatcaggcacgactgtaagttgtttaattccatataaatcttctaaggaggaacactttaatgaaagcgttaatcgttga

SEQ ID NO: 14862 - protein, 591 aa, Staphylococcus epidermidis
MLNLFILLLERVGLIILLAYILMNINHFKTMMSERDKWRSKFQLIIIFGIFSMISNFTGIEIENGHIVSSDIYYHLSKDASMANTRVLTIGVSGLIGGPWVAIIVGIISGLCRLYIGGADAYTYLISSIVIAIISGYFGHQTIKQNTYPSIKKGAIIGAITEIIQMGCILLFTNNLHHAITLVSFIALPMIIINSLGTAIFLTIILSTIKQEEQMRAVQTHDVLQLANETLPYFRSGLNEKSAQQAAEIILKLMQVSAVAITNKKDILTHIGAGSDHHVARKEIITDLSKEVIQSGKLKVAHTREGIGCHHPNCPLEGAIVVPLYIHNEVAGTLKFYFTDNNIISTSDQQLAKGLANIFSSQLELGQAEMQGQLLKDAEIKSLQAQVNPHFFFNAINTISALVRIDSEKARRLLIQLSQFFRSNLNGARNNTITLQKELQQVAAYLSLEQARYPNRFNIHYRIDDQCQDALIPPFIIQILVENSIKHAFKNRKKNNHIDVDVSMKQDCLSISVQDNGQGIPADQLDTIGYTTVTSTTGTGNALVNLNKRLTGLFGTTSALNIQSSQSGTTVSCLIPYKSSKEEHFNESVNR

SEQ ID NO: 14863 - DNA, 1746 bp, Streptococcus agalactiae
  CDS (1)..(1746): transl_table=11
atgttgatggtgttgttattccaaaggctaggaattattatgattttagcctttttattggtaaataatagttatttcagacagttaattgaagagcggtctaaacgtgaaacggtagtacttgtcatcattttcggcttgtttgttattatatctaatataacaggaattgaaataaaaggggatcgaagtttggtcgagcgcccttttctaacaacgatttcccattctgactcacttgctaatacaaggactttagttattacaacggcaagtttggttggtggacctctggttggatcaattgttggttttattggaggagttcatcgcttttttcaaggaagcttttcaggttctttctatattgtcagttcagttctagtcggcattgttagcggaaagattggtgataagcttaaggaaaaccatctctacccttcaacaagccaagttattttaattagtattattgccgaaagtatccagatgctatttgttggtatttttacaggatgggaacttgtcaaaatgattgtcattccaatgatgattttaaatagtttaggttccacacttttccttgcgattttgaaaacttatttgtcaaatgaaagtcagttacgcgcagttcaaacgagagatgttcttgaattgactcgacagactctgccctacctcagacaaggtttgacaccgcaatctgctaggagtgtttgcgaaattataaagaggcatactaactttgatgctgtaggattaacagatcggtcaaacgtattagctcatattggtgttggccatgatcaccatattgcaggacaaccagtcaaaacagacctatctaaaagtgttatttttgatggcgaaccaagaattgcgcaagataaagcggcgatttcttgtccagatcacaactgtcagttaaattctgctattgtagttcctctaaaaataaatgataaaactgtgggtgccttaaaaatgtactttgcaggagataagacaatgtctgaggtggaggaaaacctagtccttggtttagcgcaaatattttcaggacaactggcaatggggataacagaggaacaaaataagttagccagtatggcagagataaaggctttacaagcacaaatcaaccctcatttcttctttaatgccattaacacaattagtgcattaatccgtattgattctgataaagcacgttatgcactgatgcagttaagtactttttttagaacaagtttgcaaggtggtcaggatcgtgaggtaacgcttgagcaagaaaaatcacatgtggatgcttatatgaatgttgaaaaattacgtttccctgataaatatcagttatcttatgatattagtgcaccagaaaaaatgaagttaccgccttttggtttacaggtactggtagagaatgcagttagacatgctttcaaagaacgtaagacggacaaccatatattggttcaaataaagccagatggtcattattattgtgtttctgttagtgacaatggacaaggaatctcagatactatcattgataaattaggtcaagaaacagttgcagagagtaagggtacaggtactgctctagttaatctaaataacaggctgaatttattatatggtagtgtaagttgccttcatttttcgagcgacaagaatggtacaaaagtttggtatcgaatacctaatagaataagggaggatgaacatgaaaattttaattcttga

SEQ ID NO: 14864 - protein, 581 aa, Streptococcus agalactiae
MLMVLLFQRLGIIMILAFLLVNNSYFRQLIEERSKRETVVLVIIFGLFVIISNITGIEIKGDRSLVERPFLTTISHSDSLANTRTLVITTASLVGGPLVGSIVGFIGGVHRFFQGSFSGSFYIVSSVLVGIVSGKIGDKLKENHLYPSTSQVILISIIAESIQMLFVGIFTGWELVKMIVIPMMILNSLGSTLFLAILKTYLSNESQLRAVQTRDVLELTRQTLPYLRQGLTPQSARSVCEIIKRHTNFDAVGLTDRSNVLAHIGVGHDHHIAGQPVKTDLSKSVIFDGEPRIAQDKAAISCPDHNCQLNSAIVVPLKINDKTVGALKMYFAGDKTMSEVEENLVLGLAQIFSGQLAMGITEEQNKLASMAEIKALQAQINPHFFFNAINTISALIRIDSDKARYALMQLSTFFRTSLQGGQDREVTLEQEKSHVDAYMNVEKLRFPDKYQLSYDISAPEKMKLPPFGLQVLVENAVRHAFKERKTDNHILVQIKPDGHYYCVSVSDNGQGISDTIIDKLGQETVAESKGTGTALVNLNNRLNLLYGSVSCLHFSSDKNGTKVWYRIPNRIREDEHENFNS

SEQ ID NO: 14865 - DNA, 1743 bp, Streptococcus mutans
  CDS (1)..(1743): transl_table=11
atgttaatgatattattatttcagagacttggtattatcatgattctggcatttttactagtcaataacagctattttcgacagttgattgaagaacgttctaagcgtgaaaagctggttcttattatcatttttggtattttcgtcatcatttccaatatgacaggaattgaaatcactagcgataaaagtttggtggaacgtcctattctaacgactatttctcattcagattctctagctaatacgagaactttggttatcacaacggctagcttagtcggcggtcctttagttggaactgttgtgggtttcattggtggtgtccatcgtttctttcaagggaatttttctggtgctttttacattgtcagttctgctttggtaggatatattagtggtcgactgggtgatcaattaaaaactaataacctttatccatctacttcgcaggtcattgttatcagcattattgctgaaagtattcaaatgctctttgtcggtttctttactggctgggatttggttaaactgattttcattcctatgatgttgcttaacagtctaggttcgaccttatttctagctattctcaagacctacttatccaatgaaagacagctgagagctgttcagactcgggatgttttagatttgacgcagcaaacccttccttatttaagacagggactgagtcagcaatcagctactaaagtgtgtaatatcattaagcagcatactaattttgatgccgttggtctgactgatcgaaccaatgtcctagctcatatcggcgttggtcaagatcatcatattgccggacaagcggtcaaaacagatctctcaaaaagtgttattttaaacggtcagccacaaattgccttagataaaacagccattgcctgtccagaccaaagctgtctcctcaattcagccatcgtcgttccgctcaagatcaataatgagacagttggggccttaaaaatgtacttttctggtgataagaagatgaccgaagtcgaagaaaatcttgccctaggtctcgcacaaattttttctggacaattggccatcggtattgccgaggaacaaaataagttggctaatattgcagaaatcaaggccttgcagtcccagattaatccccatttcttcttcaatgctataaacaccatcagtgctttgattcgtcttgatgccaacaaagctcgatatgctctcatgcaattaagtacttttttccgaaccagtttacaaggcggacaagatagagaaatctctttagaacaggaaaaagcgcacgttgatgcttatatgaatcttgaaaagctgcgctttcctgataaatatcaactggattatcatattactgtttcaactaaaatgaccctgcctccttttggtttgcaggttttggttgaaaatgcagtgcgtcatgcttttaaagaacgcaagaaagacaatcatatttgtatttccataacagatcagggagagttttacaaggtggccgttagcgataatggtcagggtatttctcctaatatgattgacaaattaggacaggaaactgtatctgaaagcaagggaacaggaacagcccttgttaatttaaacaatcgcctaaatttactttatggcagtgctagtcagttacactttgacagtacagatcaaggaacaaccgtctggtatgagattccttatcaaaaaggagataaagatgaacattttaattcttga

SEQ ID NO: 14866 - protein, 580 aa, Streptococcus mutans
MLMILLFQRLGIIMILAFLLVNNSYFRQLIEERSKREKLVLIIIFGIFVIISNMTGIEITSDKSLVERPILTTISHSDSLANTRTLVITTASLVGGPLVGTVVGFIGGVHRFFQGNFSGAFYIVSSALVGYISGRLGDQLKTNNLYPSTSQVIVISIIAESIQMLFVGFFTGWDLVKLIFIPMMLLNSLGSTLFLAILKTYLSNERQLRAVQTRDVLDLTQQTLPYLRQGLSQQSATKVCNIIKQHTNFDAVGLTDRTNVLAHIGVGQDHHIAGQAVKTDLSKSVILNGQPQIALDKTAIACPDQSCLLNSAIVVPLKINNETVGALKMYFSGDKKMTEVEENLALGLAQIFSGQLAIGIAEEQNKLANIAEIKALQSQINPHFFFNAINTISALIRLDANKARYALMQLSTFFRTSLQGGQDREISLEQEKAHVDAYMNLEKLRFPDKYQLDYHITVSTKMTLPPFGLQVLVENAVRHAFKERKKDNHICISITDQGEFYKVAVSDNGQGISPNMIDKLGQETVSESKGTGTALVNLNNRLNLLYGSASQLHFDSTDQGTTVWYEIPYQKGDKDEHFNS

SEQ ID NO: 14867 - DNA, 1698 bp, Escherichia coli
  CDS (1)..(1698): transl_table=11
gtgcacgaaatattcaacatgctgctggcggtcttcgatcgggcagcgttaatgcttatctgcctgttctttctcatccgtatccgcctgtttcgcgaactgttgcacaagtcggcgcactccccaaaagaattgctcgccgttaccgccattttctcgctgttcgccctgttcagcacctggtccggcgttcccgtagaaggctcgctggtgaacgtacgtattatcgcggtgatgtccggcgggattctgtttggcccgtgggtaggcatcattaccggcgtgattgcgggtattcaccggtatttaattgatatcggcggcgtgacggcgatcccctgctttatcaccagcattctggcgggttgtatatcgggctggatcaacctgaaaatccccaaagcacagcgctggcgcgtcggtattctcggcggcatgttgtgtgagacgttgaccatgattctggtaattgtctgggcaccaactaccgcgttggggatcgatatcgtctctaaaatcggcattccaatgatcctcggtagcgtctgtatcggctttattgtgcttctggtgcaaagcgttgagggcgaaaaagaggccagcgccgcgcggcaggccaagctggcgctggatatcgccaacaaaacgctaccgctgtttcgccatgtcaatagcgagtcattacgcaaggtctgcgaaattatccgcgatgacattcacgccgatgcggtggcgattactaataccgatcatgtgctggcctatgttggcgtgggtgaacataactatcagaatggcgatgacttcattagcccgactacccgtcaggcgatgaattacggaaaaatcatcattaaaaacaatgatgaagcccaccgcacaccagagattcattccatgctggtgatcccattgtgggagaaaggggtcgtgaccggaacgctgaaaatttactactgccacgcgcatcagatcacctcgtcattacaggaaatggcggtcggtctgtcgcaaatcatctccacgcaactggaggtttcacgcgccgagcagctacgtgaaatggcaaataaggcagagcttcgcgccctgcaaagcaaaattaatccccattttctgtttaacgctctgaacgctatttcatcgtcaatccgtctgaatccggataccgctcgccagttgatctttaatctgtcgcgttatctgcgctataacattgaattaaaagacgatgagcaaatcgatatcaaaaaagagctgtatcaaattaaagactatattgccattgagcaggcccgctttggtgacaagctgacggttatctatgatattgatgaagaggtgaattgctgcattcccagcctgctgatccagccgttggtggagaacgccattgtccacggtattcagccttgcaaaggtaaaggcgttgtcaccatcagcgttgcagagtgcggaaatcgggtacgcattgcggtgcgagataccgggcacggcatcgatccaaaggtgattgagcgggtcgaagcgaatgaaatgccgggcaataaaattggcctgctgaatgtccatcatcgcgtgaagttattgtatggcgaggggctgcatatccgccgcctggagccggggacggaaattgcgttttacattcctaaccaacgcaccccagtcgcctcacaggctacgttattgctttga

SEQ ID NO: 14868 - protein, 565 aa, Escherichia coli
MHEIFNMLLAVFDRAALMLICLFFLIRIRLFRELLHKSAHSPKELLAVTAIFSLFALFSTWSGVPVEGSLVNVRIIAVMSGGILFGPWVGIITGVIAGIHRYLIDIGGVTAIPCFITSILAGCISGWINLKIPKAQRWRVGILGGMLCETLTMILVIVWAPTTALGIDIVSKIGIPMILGSVCIGFIVLLVQSVEGEKEASAARQAKLALDIANKTLPLFRHVNSESLRKVCEIIRDDIHADAVAITNTDHVLAYVGVGEHNYQNGDDFISPTTRQAMNYGKIIIKNNDEAHRTPEIHSMLVIPLWEKGVVTGTLKIYYCHAHQITSSLQEMAVGLSQIISTQLEVSRAEQLREMANKAELRALQSKINPHFLFNALNAISSSIRLNPDTARQLIFNLSRYLRYNIELKDDEQIDIKKELYQIKDYIAIEQARFGDKLTVIYDIDEEVNCCIPSLLIQPLVENAIVHGIQPCKGKGVVTISVAECGNRVRIAVRDTGHGIDPKVIERVEANEMPGNKIGLLNVHHRVKLLYGEGLHIRRLEPGTEIAFYIPNQRTPVASQATLLL

SEQ ID NO: 14869 - DNA, 25 bp, Primer
atgtacgattttaatctggtgttgc

SEQ ID NO: 14870 - DNA, 24 bp, Primer
ttatgcctcgtccctccatggtag

SEQ ID NO: 14871 - protein, 601 aa, consensus
  MISC_FEATURE (1)..(601): consensus for the disclosure of Xaa see table VIII
LXLILXLLXXMXLXLVLAYLLSKTXLFRXLLXXXXXXXXXKLLLXLIFSLFXIMGTYXGLXIXXXXXXXXXXXXXXXXXXXSIANTRXIGXVLGGLLGGPVVGXXVGLIGGLHRYXLXXGGXTALACAISTILEGLLGGLIXXXLXRXXXXXXXXXPXXAXLITLVAEILQMLIILLVAKPFXXAVXLVXXIALPMILXNSVGAALFMXIIXDXXXXXEXXXAXQSXKALXIAXRTLPXLRXGLNXESAXXVAXIIXEETXVXAVAITDREKILAFVGIGXDHHIPGXXXIXSXLTKXAIXXGXVMXAXXXEXXXXXXXXXXXCXLXSALVIPLRXXXXXVIGTLKLYXXXXXXKXKLISXIXXXLAEGLAXLLSTQIXLGXXEXQXXLLXXAEIKALQAQVNPHFLFNALNTISALIRXDPDKARXLLLQLSXFFRXNLXXXXXXXITLXEELXHVXAYLSIEXARXXXXXFXDRLXVXIXIDDXLXXXXXLPAFTLQPLVENAIKHGXXXXXXXGXVXIXXXXXXXXXLXLXVXDNGXGIXXXXLXGLXXXXXXXXXXXGXGLGLXNVXKRLXXLFGXXXGLXIXSXXXXGTRVSXXIP

SEQ ID NO: 14872 - protein, 62 aa, consensus
  MISC_FEATURE (1)..(62): consensus for the disclosure of Xaa see table VIII
IXXXXXXXXXXXXXXXXXXXXXNXRXXXXXXXGXXXGPXXXXXXGXXXGXXRXXXXXXXXXX

SEQ ID NO: 14873 - protein, 91 aa, consensus
  MISC_FEATURE (1)..(91): consensus for the disclosure of Xaa see table VIII
LXXXXXXXXXXXXVXXXXXPMXXXXXXGXXXXXXXXXXXXXXXXXXXXXXXXXXXXXXXXXXXXXXXXXXXXXXXXXXXXXXXXXXXXXXX

SEQ ID NO: 14874 - protein, 72 aa, consensus
  MISC_FEATURE (1)..(72): consensus for the disclosure of Xaa see table VIII
HFXFNXXXXXXXXXXXXXXXXXXLXXXLXXXXRXNXXLXXXXXXXXXXXXEXXXXXXYXXXEXXRXXXXXXX

SEQ ID NO: 14875 - DNA, 1431 bp, Escherichia coli
  CDS (1)..(1431)
atgaaggattatgtaatggaaaactttaaacatctccctgaaccgttccgcattcgtgttattgagccagtaaaacgtaccactcgcgcttatcgtgaagaggcaattattaaatccggtatgaacccgttcctgctggatagcgaagatgtttttatcgatttactgaccgacagcggcaccggggcggtgacgcagagcatgcaggctgcgatgatgcgcggcgacgaagcctacagcggcagtcgtagctactatgcgttagccgagtcagtgaaaaatatctttggttatcaatacaccattccgactcaccagggccgtggcgcagagcaaatctatattccggtactgattaaaaaacgcgagcaggaaaaaggcctggatcgcagcaaaatggtggcgttctctaactatttctttgataccacgcagggccatagccagatcaacggctgtaccgtgcgtaacgtctatatcaaagaagccttcgatacgggcgtgcgttacgactttaaaggcaactttgaccttgagggattagaacgcggtattgaagaagttggtccgaataacgtgccgtatatcgttgcaaccatcaccagtaactctgcaggtggtcagccggtttcactggcaaacttaaaagcgatgtacagcatcgcgaagaaatacgatattccggtggtaatggactccgcgcgctttgctgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcggcctgctgtgcatgaaagacgacagcttctttgatgtgtacaccgagtgcagaaccctttgcgtggtgcaggaaggcttcccgacatatggcggcctggaaggcggcgcgatggagcgtctggcggtaggtctgtatgacggcatgaatctcgactggctggcttatcgtatcgcgcaggtacagtatctggtcgatggtctggaagagattggcgttgtctgccagcaggcgggcggtcacgcggcattcgttgatgccggtaaactgttgccgcatatcccggcagaccagttcccggcacaggcgctggcctgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaaggattaacctttacgtacgaaccgaaagtattgcgtcacttcaccgcaaaacttaaagaagtttaa

SEQ ID NO: 14876 - protein, 476 aa, Escherichia coli
MKDYVMENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKAMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 14877 - DNA, 1638 bp, Fusobacterium nucleatum subsp. nucleatum ATCC 25586
  CDS (1)..(1638): transl_table=11
atgaaaaaatatttacttgatgtcccagtaccacgctctttttcttatgttaaacgtaacattcctgaagtgacagttgaacaaagggaacgtgcattaaaagcaactcactataatgaatttgctttccctgctggaatgctaacagtggatatgttatcagactcgggaactactgctatgacagaccaacaatggtcagctatgttcctaggtgatgaatcttacggaagaaacaaaggttactatgtattacttgatgcaatgagagattgttttgaaagaggggataatcaaaaaaaaattattaacctagttcgtactgattgtcaagacatagaaaaaatgatgaatgaaatgtatctatgtgaatatgaaggtggactattcaatggtggagctgctcaacttgaaagacctaacgctttcttaatgccacaaggtcgtgcagcagaatctattctatttgaaatagttcgtaagatacttgctgttcgtgaaccaggaaaagtatttactattccatctaatggacactttgatacaacagaaggaaatattaaacaaatgggatctgtccctcgtaacttatataataaagaactattatatgaagttccagaaggtggtcgttatgaaaaaaatcctttcaaaggagatatggatataaataaacttcaacaacttattgatgctgttggaatagaaaatataccaatgatttatacaacagtaactaacaacactatttgtggacaagcagtatcaatgaaaagtattcgtgaaactgcaaaaattgctcataaatatgaaataccatttatgctagatgctgcaagatgggctgaaaactgttactttataaaaatgaatgaagaaggatacagagataaatctattgctgaaattgcaaaagaaatgttctcttactgtgatggatttactgcttctcttaaaaaagatggacatgctaatatgggaggaattttagctttccgtgataaaggatatttctggaagaaattctctgattttaatgaagatggaacagttaaaacagatgtaggaatattattaaaagttaaacaaatatcttcttatggtaatgactcttatggaagtatgtcaggtcgtgacattatggcacttgctgctggactttatgaatgttgtaatttcaactacctacaagaaagagttgaacaatgtaactatctagcagaaggtttctataaagcaggtgttaaaggagttgttcttccagcaggaggacacggagtctatataaatatggatgaattctttgatggaaaaagaggacatgaaacttttgcaggagaaggattcagtcttgaacttatcagaagatatggaattcgtgtttctgaattaggagattattctatggaatatgatttaaaaactcctgaacaacaagcagaagttgcaaatgttgtaagatttgcaataaatagaagtgtttattcacaagaacatcttgactatgttattgcagctgtaaaagctctttatgaagatagagaaagtattcctaatatgagaattgtttctggtcataatttacctatgagacacttccatgctttcttggaaccttatccaaatgaagaaaaatag

SEQ ID NO: 14878 - protein, 545 aa, Fusobacterium nucleatum subsp. nucleatum ATCC 25586
MKKYLLDVPVPRSFSYVKRNIPEVTVEQRERALKATHYNEFAFPAGMLTVDMLSDSGTTAMTDQQWSAMFLGDESYGRNKGYYVLLDAMRDCFERGDNQKKIINLVRTDCQDIEKMMNEMYLCEYEGGLFNGGAAQLERPNAFLMPQGRAAESILFEIVRKILAVREPGKVFTIPSNGHFDTTEGNIKQMGSVPRNLYNKELLYEVPEGGRYEKNPFKGDMDINKLQQLIDAVGIENIPMIYTTVTNNTICGQAVSMKSIRETAKIAHKYEIPFMLDAARWAENCYFIKMNEEGYRDKSIAEIAKEMFSYCDGFTASLKKDGHANMGGILAFRDKGYFWKKFSDFNEDGTVKTDVGILLKVKQISSYGNDSYGSMSGRDIMALAAGLYECCNFNYLQERVEQCNYLAEGFYKAGVKGVVLPAGGHGVYINMDEFFDGKRGHETFAGEGFSLELIRRYGIRVSELGDYSMEYDLKTPEQQAEVANVVRFAINRSVYSQEHLDYVIAAVKALYEDRESIPNMRIVSGHNLPMRHFHAFLEPYPNEEK

SEQ ID NO: 14879 - DNA, 1392 bp, Clostridium tetani E88
  CDS (1)..(1392): transl_table=11
atggattatatggatttaagtaagtaccctgcagaaccttttaaaattaagagtgttgagcctgttaaaatgatttcaagagaagaacgtgaaatagctatgaaagaggctggatacaacacatttaatttaagatcagaggatgtatatattgatttacttactgactcaggaaccaatgctatgagtgatgctcaatgggcaggtatgatgattggagacgaagcttatgctggaagtaaaaactggttatttttagaatcaactataaaagaattatttggatttaaacatgttgttcctactcaccaaggacgtggtgcagaaaatctcctttcaagtatagctattaaaccagggcaatatgtagcaggaaatatgtattttacaactactagatatcatcaagaaaaaaatggtggtatttttgtagatataataagagatgaagctcacgatgcaagtatagatattccttttaaaggtaatattgatgttaataaattagaaaaacttattgaagaaaaaggtgcagaaaacatagcttatgtatgccttgctgttactgtaaatctagcaggtggacaaccagtttctatggctaatatgagagcagttagagaacttacagcaaaacatggaattaaggtattctatgatgctactagatgtgttgaaaatgcatattttataaaagaacaagaggaaggatatgcagatgtttcaattaaagatatagtacacgaaatgtttagctattccgatggtgctactatgtctggtaaaaaagatggtattgtaaatatcggtggattcttagcaattaatgatgaagagttatttggaaaagctaaagaaatagtagtagtttacgaaggtatgccatcctatggtggtatgactggccgtgatatgcaggctatagcaattggatttagagaagcaatgcaatatgaatatatagaacacagaataagacaggttagatatcttggagatagattaaaagaagcgggagttcctatagttgaaccagttggaggacatgctgtattcttagatgcaagaagattttgcccacatctagatcaagagcaattcccagctcaatcactagctgcttcactttacattgactctggtgttagatcaatggaacgtggtatagtttcagcaggcagagatgttaatacaggcgaaaatcataaaccaaaattagagacagttagacttactattccaagaagagtttacacttacaaacatatggatgttgttgctgaatcagttatacatctatataagcataaagaagatataagaccacttaaattcacttatgaacctgcacaattaagattctttactgcaaaatttgattatgcagactaa

SEQ ID NO: 14880 - protein, 463 aa, Clostridium tetani E88
MDYMDLSKYPAEPFKIKSVEPVKMISREEREIAMKEAGYNTFNLRSEDVYIDLLTDSGTNAMSDAQWAGMMIGDEAYAGSKNWLFLESTIKELFGFKHVVPTHQGRGAENLLSSIAIKPGQYVAGNMYFTTTRYHQEKNGGIFVDIIRDEAHDASIDIPFKGNIDVNKLEKLIEEKGAENIAYVCLAVTVNLAGGQPVSMANMRAVRELTAKHGIKVFYDATRCVENAYFIKEQEEGYADVSIKDIVHEMFSYSDGATMSGKKDGIVNIGGFLAINDEELFGKAKEIVVVYEGMPSYGGMTGRDMQAIAIGFREAMQYEYIEHRIRQVRYLGDRLKEAGVPIVEPVGGHAVFLDARRFCPHLDQEQFPAQSLAASLYIDSGVRSMERGIVSAGRDVNTGENHKPKLETVRLTIPRRVYTYKHMDVVAESVIHLYKHKEDIRPLKFTYEPAQLRFFTAKFDYAD

SEQ ID NO: 14881 - DNA, 1380 bp, Bacteroides thetaiotaomicron VPI-5482
  CDS (1)..(1380): transl_table=11
atggaattaccttttgctgaatcatggaaaatcaagatggtagaacccatcagaaaaagtacccgcgaagaacgcgagcaatggattaaagaagcacattataacgtctttcaactcaaatcagagcaagtttatattgatcttatcaccgactccggaacgggagccatgagcgaccgccaatgggcaggcatgatgctgggtgatgaaagttatgccggtgccacctccttcttcaaactaaaagataccattacaagaataacaggattcgaatacatcattcctacccatcaaggacgggcagcagaaaatgttcttttctcttatctggtacatgaaggcaatatagtacccggcaactcacatttcgataccaccaaaggacatatcgaaggacggcacgccatcgcactggactgtacgattgacgaagcaaagaatactcaactggaaattcccttcaaaggaaatgtagaccctgccaaattagagaaagcactaagcgaatatgccgaccgcattccttttatcattgttaccattaccaacaataccgcaggaggtcaacctgtatccatgcaaaacctgcgtgaagtacgtgctatcgccaataaatacaacaaacctgtacttttcgactccgcccgctttgctgagaatgcctacttcatcaagatgcgtgaaaaaggttatcaagacaaatcaatcaaagaaatcacccgtgaaatgttcgatcttgccgacggtatgacaatgagtgccaagaaagacggcatagtcaacatgggcggtttcattgccacccgacgcaaagaatggtatgaaggtgccaaaggtttctgcgtgcaatacgaagggtacttaacctacggcggcatgaacggacgggacatgaacgccctcgctatcggtcttgacgaaaatacagaatttgataacctggaaacacgtatcaaacaggtagaatacctcgcccagaaactggacgaatacgaaatcccctatcaacgacctgccggcggccatgctattttcgtcgatgcttccaaagtgctgacacatgtcccgaaagaagaatttcccgcacagacattaaccgtcgaactttatctggaggcaggcatacgcggctgcgagattggttacatccttgccgaccgtgaccctattactcacgaaaatcgctttaacggccttgatttacttcgccttgccatccctcgcagggtatatacggacaatcacatgaacgtaatagctgccgccctcagaaacgtattcgaacggagagaaacgatcacccgtggtgtgcgcatcgcttgggaagcccccttgatgcggcattttaccgttcagttagaacgattgtctgtatag

SEQ ID NO: 14882 - protein, 459 aa, Bacteroides thetaiotaomicron VPI-5482
MELPFAESWKIKMVEPIRKSTREEREQWIKEAHYNVFQLKSEQVYIDLITDSGTGAMSDRQWAGMMLGDESYAGATSFFKLKDTITRITGFEYIIPTHQGRAAENVLFSYLVHEGNIVPGNSHFDTTKGHIEGRHAIALDCTIDEAKNTQLEIPFKGNVDPAKLEKALSEYADRIPFIIVTITNNTAGGQPVSMQNLREVRAIANKYNKPVLFDSARFAENAYFIKMREKGYQDKSIKEITREMFDLADGMTMSAKKDGIVNMGGFIATRRKEWYEGAKGFCVQYEGYLTYGGMNGRDMNALAIGLDENTEFDNLETRIKQVEYLAQKLDEYEIPYQRPAGGHAIFVDASKVLTHVPKEEFPAQTLTVELYLEAGIRGCEIGYILADRDPITHENRFNGLDLLRLAIPRRVYTDNHMNVIAAALRNVFERRETITRGVRIAWEAPLMRHFTVQLERLSV

SEQ ID NO: 14883 - DNA, 1380 bp, Porphyromonas gingivalis W83
  CDS (1)..(1380): transl_table=11
atggaattacctttttcagaatcctaccgcattaaaatggtagagtctatccgcaagagtacgcgtgaagaacgcgagcagtggatcaaggaagcccattacaatctcttcctcctcaagagcgactatgtatttatcgatttgctcactgattccggcacaggtgctatgagcgaccgccaatggtctgccatgatgctcggcgatgagagctatgcaggtgcacgctcatactataatatgaagaatgccattcacgacattctgggcttcgactacttcctccccactcatcagggtcgtgctgccgaaaatgtacttttctccactatcgtgaaagaaggcgatgtactgcccggcaactctcacttcgacacgactaaagggcatattgaataccgtcgcgcatttgcccctgactgcaccatcgacgaagctgccgatacgcagatcgagcttccgttcaagggcaatatggatctgaacaagttagagaaaatactgaaagagactcctaaggaaaagatcccttgcgtagtgctcacgatcacgaacaacacagccggagggcagcccgtttctatgaagaatatacgtgaagtgagcgagctgacacatcgttatggtattcgcctgctgatcgactctgcacgctttgctgaaaatgcctacttcatcaagacccgcgaagccggctatgaaaataagagcatcaaggaaatcgtgaaggaaatctattcgtatgccgatatgatgaccatgtccagcaagaaagacgctatcgtgaatatgggtggtttcgtggcattcaaggatgaagagctcttcaagcgttgccagatgttctgtatcatgaacgaaggctttattacttacggtggtatgagcggtcgtgatatgaatgctctggcacaaggcctggacgaaggtaccgacttcgatacgcttgagacccgtatcaaacaggtggaatatctgggcaaaaagttggacgaatatggtattccctaccagcgtcctgccggcggacacgccattttccttgatgctaagaagatccttacaaatgtgccgaaagaagagttcatcgctcagactttgggcgttgagctgtatttggaagccggcatccgtggtgttgagatcggttctatccttgcagaccgtgaccccgtgacgaaggagaaccgctatccgcgtctcgagctcctgcgtctggctattccgcgtcgtacatatacgaacaaccacatggatgttatcgctgctgcggtaaagaatgtatacgaccgtcgcgaaagcattacacgtggctatgtgattacatatgagaatccaatcatgcgtcacttcactgttgagctggaaaaagccaagtaa

SEQ ID NO: 14884 - protein, 459 aa, Porphyromonas gingivalis W83
MELPFSESYRIKMVESIRKSTREEREQWIKEAHYNLFLLKSDYVFIDLLTDSGTGAMSDRQWSAMMLGDESYAGARSYYNMKNAIHDILGFDYFLPTHQGRAAENVLFSTIVKEGDVLPGNSHFDTTKGHIEYRRAFAPDCTIDEAADTQIELPFKGNMDLNKLEKILKETPKEKIPCVVLTITNNTAGGQPVSMKNIREVSELTHRYGIRLLIDSARFAENAYFIKTREAGYENKSIKEIVKEIYSYADMMTMSSKKDAIVNMGGFVAFKDEELFKRCQMFCIMNEGFITYGGMSGRDMNALAQGLDEGTDFDTLETRIKQVEYLGKKLDEYGIPYQRPAGGHAIFLDAKKILTNVPKEEFIAQTLGVELYLEAGIRGVEIGSILADRDPVTKENRYPRLELLRLAIPRRTYTNNHMDVIAAAVKNVYDRRESITRGYVITYENPIMRHFTVELEKAK

SEQ ID NO: 14885 - DNA, 1449 bp, Rhodopseudomonas palustris CGA009
  CDS (1)..(1449): transl_table=11
atggcgacagtgaagtttttcggcaacgaggcggtgccgctcgagatgcacaaggtgcggatcgtacagaaactcaacctgccgccggtcgagcgccgcctggagaagatcaccgaggcgggcaacaacaccttcctgctgaagaacgacgacgtcttcctcgacatgctgaccgacagtggcgtcaacgcgatgagcgaccgccagcaggccgcgatgctgaccgccgacgactcctacgccggcagcgccacctacacccggctcgaagacaagctgcgcgacatcttcggcatgcactacttcctgccgacccatcagggccgtgcctgtgagcacatcctcgccaaggtgttcgtcacgcccggcaaggtggtgccgatgaactatcacttcaccaccaccaaggcgcacatcgtgctgcagggcggcacggtggaggaactggtgaccgatgccggcctcgaagtgaccagcgcgaacccgttcaagggcaacatggacatcgccaagctgcgcgcggtgatcgagaaggtcggcgccgccaatgtcggcttcgtgcggatggagagcggcaccaacctgatcggcggccagccggtgtcgctgcagaacctcgccgacgtcagcaacgtctgcaaggagcacggcgttccgctggtgctcgacgccagcctgctggccgacaatttgtacttcaacaagacccgcgaggatcactgcaagacgctgtcgatccgcgagatcacccgccgcaccgccgacctctgcgacgtcatctacttctcggcgcgcaagctcggctgtgcccgcggcggcggcatctgcatccgcgaccgggcgctgtatgagaagatgcggccgctggtgccgctgtatgaaggcttcctcacctatggcggcatgtcggtgcgcgaaatggaagcgctcaccgtcggcctcgaagaaaccatggacgaggagatgatcaaccaggggccgcagttcatcgcctatatggtcgagcaactggtcgagcgcggcgttccggtgatcaccccggccggcggcctcggctgccacatcgatgccaagcgcttcgtcgatcacatcccgcagtcgcaatatccggccggcgcgctggcggcggcgctgtacgtcgcctccggcatccgcggcatggagcgcggcacgctgtccgaacagcgcgagcccgacggcagcgagatctacgccaatatggaactggtgcgcctcgccatgccgcgccgggtgttcacgctgtcgcaggtcaaatacgcggtcgaccgcattgcctggttgtacaccaaccgcaagctgatcgagggcctgaccttcgtcgaggagccggaagtgctgcggttcttctacggcctgctcaagccggtgaccgactggcagaacaagctggtggcgaaattccgcgaggattttggcgacagcctgtga

SEQ ID NO: 14886 - protein, 482 aa, Rhodopseudomonas palustris CGA009
MATVKFFGNEAVPLEMHKVRIVQKLNLPPVERRLEKITEAGNNTFLLKNDDVFLDMLTDSGVNAMSDRQQAAMLTADDSYAGSATYTRLEDKLRDIFGMHYFLPTHQGRACEHILAKVFVTPGKVVPMNYHFTTTKAHIVLQGGTVEELVTDAGLEVTSANPFKGNMDIAKLRAVIEKVGAANVGFVRMESGTNLIGGQPVSLQNLADVSNVCKEHGVPLVLDASLLADNLYFNKTREDHCKTLSIREITRRTADLCDVIYFSARKLGCARGGGICIRDRALYEKMRPLVPLYEGFLTYGGMSVREMEALTVGLEETMDEEMINQGPQFIAYMVEQLVERGVPVITPAGGLGCHIDAKRFVDHIPQSQYPAGALAAALYVASGIRGMERGTLSEQREPDGSEIYANMELVRLAMPRRVFTLSQVKYAVDRIAWLYTNRKLIEGLTFVEEPEVLRFFYGLLKPVTDWQNKLVAKFREDFGDSL

SEQ ID NO: 14887 - DNA, 1380 bp, Treponema denticola ATCC 35405
  CDS (1)..(1380): transl_table=11
atgaaaaagtatgtaccggaaccttttagaattaagatggttgaacctatcaaaatgacaacacgtgaggaccgcattaagtatcttgaaaaagcaaaatacaatatgtttaacttacgtggagaagatgtctacattgacttattgacagacagcggcacaaacgcaatgagcgataagcaatggggaggcgttatggtcggagatgaagcctatgccggaggaaaaagctatttcaaattggttgatgccggaaaggatatcttcggatatgaatttatccagcccgtccatcagggccgagcagcagaaaaggttttattccccttgttgctcaaaaaaggccaagttgctatttcaaatatgttctttgacacaaccagagctcatgtaactctggccggaggaagacctctcgactgcgtatgtaaggaggcaaaaaaaccttccgaatatgcaccttttaagggaaatatggatgttgaaaagctcgaacagcttattaacgagcatggaaaagaaaaggtcggaatgattgtaatgactattacaaacaactctgccggaggacaacctgtttcaattcagaacatccgtgatgttgccaaaattgcaaaaaaatacggcattttgttcaatattgatgcagcacgatttgcagaaaatgcctactttgtaaaacaaagagaagaagaattcaagaacaagcccattaaagaaattattcgtgaaatgttcagctatgccgatacctttacgatgagtgcaaaaaaagatgctatcgttaatatgggcggtttgataggtattaaaaacaatcaagaaatctatcagatgattaagggcaactgtatttcttttgaaggatttattacctacggaggtctttcaggacgcgatcttgaagcattagccataggtttatacgaaggtattgatgaagaatatttaaaataccgaaacgcttctatggaatacctagcctctcagctccttgatgcaggcgttgccattcaaaaccctgcaggaggacacggtgtttatgttgatgccaacgccatgttcccgcacattccctattatcaattccccggccatactctttgcgtagagttatacaaagaagccggaatccgaacatgcgacatcggttcctttatgctcggaaacgatcccgaaacaggagaacagatcaaatcggaattcgaatttgcccgtcttgcaattccaagaagagtatacacccaatctcacttagacgttattgcaggagctttaattaacattaaagaaagagcctctcaggttaagggctacaaaattatctgggaaccaccgattcttagacacttccaagctcatttggaacccataaaataa

SEQ ID NO: 14888 - protein, 459 aa, Treponema denticola ATCC 35405
MKKYVPEPFRIKMVEPIKMTTREDRIKYLEKAKYNMFNLRGEDVYIDLLTDSGTNAMSDKQWGGVMVGDEAYAGGKSYFKLVDAGKDIFGYEFIQPVHQGRAAEKVLFPLLLKKGQVAISNMFFDTTRAHVTLAGGRPLDCVCKEAKKPSEYAPFKGNMDVEKLEQLINEHGKEKVGMIVMTITNNSAGGQPVSIQNIRDVAKIAKKYGILFNIDAARFAENAYFVKQREEEFKNKPIKEIIREMFSYADTFTMSAKKDAIVNMGGLIGIKNNQEIYQMIKGNCISFEGFITYGGLSGRDLEALAIGLYEGIDEEYLKYRNASMEYLASQLLDAGVAIQNPAGGHGVYVDANAMFPHIPYYQFPGHTLCVELYKEAGIRTCDIGSFMLGNDPETGEQIKSEFEFARLAIPRRVYTQSHLDVIAGALINIKERASQVKGYKIIWEPPILRHFQAHLEPIK

SEQ ID NO: 14889 - DNA, 1380 bp, Treponema denticola ATCC 35405
  CDS (1)..(1380): transl_table=11
atggatattaaaaattatcctgcggaaccttttagaattaaggttgtagaaactgttaagatgatcgataaggatcaaagagcaaaggttgccaaagaagccggttataataccttccttattaattcggaagatgtttatatcgaccttcttaccgactccggaacaaacgccatgagcgataaacaatgggccggaatgatgataggagatgaagcctatgccggaagccgcaactttcatcacttggaagaaacggttcaagagattttcggctttaagcatcttgtgccgacccatcaaggccgcggtgccgaaaaccttctttcaaggatagccattaaacccggtcaatatgtacccggcaacatgtattttaccactaccagataccatcaggaagcaaacggcggtatcttcgtggatatcataaacgatgatgctcatgatgcaggcaaaaatgttccttttaaaggcgacatcgacttgaacaagcttgaaaagcttataaaagaaaagggagccgaaaatatagcctatgtatgtttggctgttacggtaaaccttgcaggcggtcagcccgtttctatgaagaacatgaaggccgtccgtgagcttacaaaaaagcacggcatcaaggtattctacgatgcaacccgctgtgtagaaaacgcctactttatcaaagaacaagaagccggttatgccgacaagtctatcaaagaaatcgtaagagaaatgttcagctatgcagacggatgtaccatgagcggtaaaaaagactgtatcgtaaacatcggaggcttcctctgtatgaacgatgaagatcttttccaagctgcaaaagaattcgttgttgtatttgaaggtatgccttcatacggcggtatggcaggacgcgatatggaagctatggctatcggtctaaaagaagctctccagtttgaatacatcgaacaccgaatcaagcaggtccgctatttaggcgacaagctcttggaagccggagttcctattattgagcccgtaggaggacatgcagtatttcttgatgcaagacgcttctgtcctcatcttaagcaaaccgaatttcccgcacaggccctagccgcagagctttatatcgaatcgggagttagaagtatggaacgcggtatcgtttctgcaggacgcgatcccaaaacaagggaaaaccacgtaccaaagcttgaaacagtccgcttaacaattccgcgccgtgtttatacatataaacacatggacattgtagcagatgccgttattaaattgtacaaacacaaggaagttataaaaggattaaagttcgtttacgaacctaaacaactccgcttctttacggcacgctttgagcatatctaa

SEQ ID NO: 14890 - protein, 459 aa, Treponema denticola ATCC 35405
MDIKNYPAEPFRIKVVETVKMIDKDQRAKVAKEAGYNTFLINSEDVYIDLLTDSGTNAMSDKQWAGMMIGDEAYAGSRNFHHLEETVQEIFGFKHLVPTHQGRGAENLLSRIAIKPGQYVPGNMYFTTTRYHQEANGGIFVDIINDDAHDAGKNVPFKGDIDLNKLEKLIKEKGAENIAYVCLAVTVNLAGGQPVSMKNMKAVRELTKKHGIKVFYDATRCVENAYFIKEQEAGYADKSIKEIVREMFSYADGCTMSGKKDCIVNIGGFLCMNDEDLFQAAKEFVVVFEGMPSYGGMAGRDMEAMAIGLKEALQFEYIEHRIKQVRYLGDKLLEAGVPIIEPVGGHAVFLDARRFCPHLKQTEFPAQALAAELYIESGVRSMERGIVSAGRDPKTRENHVPKLETVRLTIPRRVYTYKHMDIVADAVIKLYKHKEVIKGLKFVYEPKQLRFFTARFEHI

SEQ ID NO: 14891 - DNA, 1617 bp, Entamoeba histolytica HM-1:IMSS
  CDS (1)..(1617)
atgaagcaatctactgaacttggtgttccagttcctacacacgtttcatatgttgtaagacaaacaactgatcttaaaccagaagaaagagaaaaaattcagaaacaaactgaatataattgtttctttttcccatcacaaatgcttcttgtagattatctttccgactctggatcatctgctatgactgatattcaatggagttcattgtttagaggagatgaagcatatggaagaaatcaaggatattatgctttccaagaatctgttagagacgcctttgaacgaggggataaagccaggtgggtggttaaagatattgttagtggtattccaaatttcacaaataatccagaagatccatattggactgaaccagaagttccaggcacttttgttaataaaggaagacttcaaatagaaagaccaaatttctttatcttacctcaaggaagatgtgcagaatgtttattatatgaagttatgtctcaatgtcttggaaaaggagaatggcatttaatttcaaatggatggtttgatactactgaggctaatgctagaaacaatggattccatactgttaatttgtttgctaagaactatcatgatccagtagacccagagactctttggactaagaatgagtttaaaggaaatttgaatattgaacgtgctgaagaatttattaatgaaaagggaaaagaacatattcctttaattttaatgactattaccaacaacactggtgctggtcaaccagtttcaatgaagaatataagagaaacttctgaattagcaaagaagtatgacattccattcttctttgacgcagcaagatttgctgaaaatgcatatttcattcatgaatttgaagaaggatataataaagtttctattccagaaattgttaaagaaatgtttagttatgttgatggattttgtatttctctaaagaaagatggagtttgtaatatgggaggtgcattggctttcagagatcaaggagttttttggagaaagtttagtactaaaggtgatgttggagtagtcttaaaacaacttcaaattttgagatatggtaatgattcttatggaggattaagtggaagagatattatggcatgtgctatgggtttatctgttgttgaaggagagtcatatctcaaaggaagaatagaacaagtacgatatttcgggtatgagttagcaaagagaaatattccagttttcttaccaccaggagggcatgcaatttatattgaaactgataaattctttaataatagaaagaattattctcctggagatttccttggagttggattagttattgaaatgatcagaatgtatggaattagagcttgtgaattgggaccatttgggtttgaatgggataataaagatgaagaagatagaaaaggaattaatgaccaagttagatttgctgttccaagaaacgtatattctaaagagcatattgattatacagttagagcgttagaacagatgtatatgaatagggatttaattcccaaagttagaatttctagaggaagacatttaaagttaagacacttccagtctggattagagcctatttataatgagtccaaataa

SEQ ID NO: 14892 - protein, 538 aa, Entamoeba histolytica HM-1:IMSS
MKQSTELGVPVPTHVSYVVRQTTDLKPEEREKIQKQTEYNCFFFPSQMLLVDYLSDSGSSAMTDIQWSSLFRGDEAYGRNQGYYAFQESVRDAFERGDKARWVVKDIVSGIPNFTNNPEDPYWTEPEVPGTFVNKGRLQIERPNFFILPQGRCAECLLYEVMSQCLGKGEWHLISNGWFDTTEANARNNGFHTVNLFAKNYHDPVDPETLWTKNEFKGNLNIERAEEFINEKGKEHIPLILMTITNNTGAGQPVSMKNIRETSELAKKYDIPFFFDAARFAENAYFIHEFEEGYNKVSIPEIVKEMFSYVDGFCISLKKDGVCNMGGALAFRDQGVFWRKFSTKGDVGVVLKQLQILRYGNDSYGGLSGRDIMACAMGLSVVEGESYLKGRIEQVRYFGYELAKRNIPVFLPPGGHAIYIETDKFFNNRKNYSPGDFLGVGLVIEMIRMYGIRACELGPFGFEWDNKDEEDRKGINDQVRFAVPRNVYSKEHIDYTVRALEQMYMNRDLIPKVRISRGRHLKLRHFQSGLEPIYNESK

SEQ ID NO: 14893 - DNA, 1389 bp, Desulfovibrio vulgaris subsp. vulgaris str. Hildenborough
  CDS (1)..(1389): transl_table=11
atgaagcgcattcccgaaccgttccgcatcaagatgatcgaacccattcgcatgaccaccctcgaagaccgcaccagggcactcgaagaggcggggtacaaccccttccttctcaagagcgaggatgtgtacatcgacctgctgaccgactccggcaccggtgccatgagcgaccgtcagtgggcgggcctcatgatgggcgacgaggcttacgctggtagccgcaacttcctgaatctcgaaaaggccgtgaaggacgtgttcggctacgagcacaccgtccccacccaccaggggcgcggcgccgaacagattctcttcccctgccttgtggcccgcatgaagggcgacaagcccgtcttcatctccaactaccatttcgacaccaccgccgcccacgtcgagatgacgggcgccaaggccatcaacgtggtcaccgagaaggcgttcgacaccggcacctactacgactggaagggcgacttcgaccttgagaagctcgaagccaccatcaggcagcatggcgcgcagaacgtggctggcatcatcgtcaccatcacctgcaacagcgcaggcggccagcccgtctccatggcgaacatccgcgaggcagcagccatcgccaagcgccatggcatcaccgtcatcatcgactccgcccgtttctgcgagaacgcatggttcatcaagcagcgtgaggccggatacgccgacaagtccatccgtgagatcatccgcgagatgtactcctacggcgacgtgctcacctgctctgccaagaaggaccccatcgtcaacatcggcggcctctgctgcatcaaggaggacgtcgacctcttccgtgccgtgcaggtccgctgcgtgcccatggaaggcttcgtcacctacggcggccttgccggacgcgacatggaagcgctggccatcggtctctatgaaggtactgacgaacacttcctcacctaccgcatcaagcaggtcgaatacctcggcgaacgtctgcgtcagggcggggttcccatccagtaccccaccggcggtcacgccgtgttcatcgacgccaagctgatgctgccccacattccgggcaaccagttcccggcacacgccctcgccaatgaggtctacatcgaaggcggcgtgcgcggcgtcgagataggttcgctgctgctcgggcgcgaccccgccaccggcctgcagaaggaatcgccgctggaactgctgcgcctcgccatcccgcgccgcgtctacaccaacgaccacatggactacatcgccgacacggtcatcgccgtgctcgaccgcgcgtcgtccatcaagggccttgagttcacctacgaaccgccggtgctgcgtcacttcaccgcgcgtctgcgccccatcgcctga

SEQ ID NO: 14894 - protein, 462 aa, Desulfovibrio vulgaris subsp. vulgaris str. Hildenborough
MKRIPEPFRIKMIEPIRMTTLEDRTRALEEAGYNPFLLKSEDVYIDLLTDSGTGAMSDRQWAGLMMGDEAYAGSRNFLNLEKAVKDVFGYEHTVPTHQGRGAEQILFPCLVARMKGDKPVFISNYHFDTTAAHVEMTGAKAINVVTEKAFDTGTYYDWKGDFDLEKLEATIRQHGAQNVAGIIVTITCNSAGGQPVSMANIREAAAIAKRHGITVIIDSARFCENAWFIKQREAGYADKSIREIIREMYSYGDVLTCSAKKDPIVNIGGLCCIKEDVDLFRAVQVRCVPMEGFVTYGGLAGRDMEALAIGLYEGTDEHFLTYRIKQVEYLGERLRQGGVPIQYPTGGHAVFIDAKLMLPHIPGNQFPAHALANEVYIEGGVRGVEIGSLLLGRDPATGLQKESPLELLRLAIPRRVYTNDHMDYIADTVIAVLDRASSIKGLEFTYEPPVLRHFTARLRPIA

SEQ ID NO: 14895 - DNA, 1377 bp, Propionibacterium acnes KPA171202
  CDS (1)..(1377): transl_table=11
atgaagtacatccccgaaccgtttaagatcaagatggtcgaaccgattgcgatgacctcccgggaggagcgcgccaacatcctcgcacgggcacattacaacatgttcggcctacccgccgagtccgtctacatcgacctgctcaccgattccggtaccggcgcgatgagtgatgcccagtgggcggccgtgatgcgcggtgacgaggcgtactccggtgggcgcagttatatgcacctcatggacgttgccggcagtatctttggttacagctacattcagccggtgcatcaaggccgtgctgcggaaaaagtgctcatgccgctattggtctctcgtcccggccagctcgtggtggcgaacaccttctttgacaccacacgtgcccacgtcggccttgccggtgggcgtccggtcgacaatgtctgctcggagggtttggattcggccaaagtagccccgttcaagggcaacatggatgtcgcgggcctggagaaactcattgctgagcacggggacgacattgctgcgatcgtcatgaccgtgaccaacaactcggtcggcggtcagccggtttctctgcagaacatgcgagagacctacgaggtggctcacaagtacgcaattccagtctgtcttgacgctgctcgctatgccgagaacgcctatttcatccatgagcgcgaggagggatgtcaggaccgttcgttacgcgatatcgtcgcggagatgttccgctacggcgacatgttcgtcatgagcgcgaagaaggacgccatcgtcaacatgggtggtttgctcggcgtccgcgaagatggcgaactagctgagaaggtcaagagcaacgtcatctcctttgagggctaccttacctacgggggattggcaggtcgcgacttggaagcgttggccgttggcctcgaggagggactcgacatggactggcagcggtaccgtgtcggccaaatccaataccttggcgaccagctcgaggaggctggcgtgcctttccagagccctgttggcggtcatgcagtattcatcgacgccggtcgcatgctgccgcatttggagtggaaacagtacccagggcacgcgctcgctacccaactgtacttggatgcaggaattcgatcctgcgacatcggttcttaccttatggaccgggaccccgttacccaggaggagcaacaggcgcccttcgagttcactcggctagcagtgccgcgacgggtctacacccagtctcacatggacgtcgtcgccgaggccgttaccaagattgcccgggagcctgaaaaagtacccggataccgcattacatgggagcctccggtcttgcgccatttcacaagtcgactcgaaccaattcggtga

SEQ ID NO: 14896 - protein, 458 aa, Propionibacterium acnes KPA171202
MKYIPEPFKIKMVEPIAMTSREERANILARAHYNMFGLPAESVYIDLLTDSGTGAMSDAQWAAVMRGDEAYSGGRSYMHLMDVAGSIFGYSYIQPVHQGRAAEKVLMPLLVSRPGQLVVANTFFDTTRAHVGLAGGRPVDNVCSEGLDSAKVAPFKGNMDVAGLEKLIAEHGDDIAAIVMTVTNNSVGGQPVSLQNMRETYEVAHKYAIPVCLDAARYAENAYFIHEREEGCQDRSLRDIVAEMFRYGDMFVMSAKKDAIVNMGGLLGVREDGELAEKVKSNVISFEGYLTYGGLAGRDLEALAVGLEEGLDMDWQRYRVGQIQYLGDQLEEAGVPFQSPVGGHAVFIDAGRMLPHLEWKQYPGHALATQLYLDAGIRSCDIGSYLMDRDPVTQEEQQAPFEFTRLAVPRRVYTQSHMDVVAEAVTKIAREPEKVPGYRITWEPPVLRHFTSRLEPIR

SEQ ID NO: 14897 - DNA, 1365 bp, Symbiobacterium thermophilum IAM 14863
  CDS (1)..(1365): transl_table=11
atgccaaagggcgagccctttaagatcaagatggtggaaccgatccggctgatcccccgggaggaccgggaggcggccatcaaggcagcgcactacaatcccttcctgctccggtcctccgacgtctacatcgacctgctcaccgactccggcacgggcgcgatgagccagttccagtggtccgccatgatgctgggcgacgagtcgtacgccggcgccagcagctactaccggctgaaggaggcggtcactgacatcaccgggtacgagtacgtcctcccgacccaccagggccgcggcgccgagaagagcgccttcgcgcagctgatcacccggccgggcatgtacgtgctctccaacatgttcttcgacacgactcgcggccacgtgcagctggccggcggccggccgatcgacctgctgctggacgtgcccaccgaggagtaccaccccttcaagggcaacatggacacggccaggctcgaggccttcattcaggagcacggcgcggagaacatcgcctgcatcgtgatgaccgtgaccaacaactccgcgggcgggcagcccgtatccatggccaacatccgcgagacgtcccgcatcgcgcggaagtacggcatcctgctgctgttcgacgtggcccggtacgccgagaactgccacttcatccggatgcgggaggaaggctacgctgacaaggcgcccatcgacatcgcccgggagatgttctcctacggcgacgggttgatgatgagcgccaagaaggacgcgctggtgaacatcggcggcctgctggccttcaaggacgaggagctgtacacccgcgtgggcggcacggtcgtgcccttcgagggcttcctgacctacggcggcctggccggccgggatctggaggccatggcggtgggcctccgggaggcgctggatcccgactacctggcgtaccgggtgggccaggtggagtacctgggcaacctgctgcgcagcgccggcatcccgatccagtggccggtgggcggccatgcggtgttcatcgacgccgcgaagttcctgccgcacatcccgtgggaccagttccccggccacgcgctcacggtggcgctctaccaggagggcggcgtgcgcaccgtggaggtcggctcgctcgtgatgggccgcgaccccgagaccggcgagaacgtccgcagcccgttcgagttcacccggctggcgattccgcggcgggtctacaccaacctgcacctggaagacgtcgccgagaccgtgatcaacgccttccagaagcgggagcagatccgcggcgtcaagttcacccgggagccgaaggtgctgcgccacttcacggcgcacttcgatctggtctag

SEQ ID NO: 14898 - protein, 454 aa, Symbiobacterium thermophilum IAM 14863
MPKGEPFKIKMVEPIRLIPREDREAAIKAAHYNPFLLRSSDVYIDLLTDSGTGAMSQFQWSAMMLGDESYAGASSYYRLKEAVTDITGYEYVLPTHQGRGAEKSAFAQLITRPGMYVLSNMFFDTTRGHVQLAGGRPIDLLLDVPTEEYHPFKGNMDTARLEAFIQEHGAENIACIVMTVTNNSAGGQPVSMANIRETSRIARKYGILLLFDVARYAENCHFIRMREEGYADKAPIDIAREMFSYGDGLMMSAKKDALVNIGGLLAFKDEELYTRVGGTVVPFEGFLTYGGLAGRDLEAMAVGLREALDPDYLAYRVGQVEYLGNLLRSAGIPIQWPVGGHAVFIDAAKFLPHIPWDQFPGHALTVALYQEGGVRTVEVGSLVMGRDPETGENVRSPFEFTRLAIPRRVYTNLHLEDVAETVINAFQKREQIRGVKFTREPKVLRHFTAHFDLV

SEQ ID NO: 14899 - DNA, 1416 bp, Symbiobacterium thermophilum IAM 14863
  CDS (1)..(1416): transl_table=11
ttgctccatgctatgaccgaatcggtccactctggcaaaggaggagttcacgtgcccaagggcgagcccttcaagatcaagatggtggagcccatccggctgatcccccgggaggaccgtgagcgggcgctgaaggaagcgcattacaacccgttcttcctccgatcttctgacgtctacatcgacctgctcaccgactccggtacgggcgcgatgagccagttccagtggtccgccatgatgctgggcgacgagtcgtacgccggcgcaagcagctactacaggctgaaagagacggtcaccgacatcacggggtacgagtacgtcatcccgacccaccagggccgcggcgcagagaaggtcgccttctcgcagctcatcacccggccgggcatgtacgtgctttccaacatgttcttcgacacgacccgcggccacgtgcagctggccggcggccggcccgtcgatctgctcatcgacgtacccaccgaggagtaccaccccttcaagggcaacatggacacggagaggctggagcagttcatccgggagcacggtgcggagaacatcgcctgcatcgtgatgaccgtgaccaacaactccgcgggcgggcagcccgtctccatggccaacatccgggagacttaccagatcgcccggaagtacggcgtgctggtcctgttcgacgtggcccggtacgccgagaactgccacttcatccggatgcgggaggaaggctacgccgacaagcaccccatcgacatcgcccgggagatgttctcctacggcgacgggctgatgatgagtgccaagaaggacgcgctggtcaacatcggcgggctcctcgcctttcgggatgaggaactgttcaccaaggtcggcgcggccgtggtgccgttcgagggcttcctgacctacggcggcctggccgggcgcgatctggaggccatggcggtgggcctccgggaggcgctggaccccgactacctggcgtaccgggtggggcaggtgcagtacctgggcgagatgttgcggaacgcgggcatcccgatccagtggccggtgggcggccatgcggtgttcatcgatgccgcgaagttcctgccgcacgtcccgtgggaccagttccccggccatgccctgaccctcgcgctctacctggagggcggcgtgcgcaccgtagaggtcggctcgctgatgatcggccgcgaccccgagaccggcgagaacgtgcgaggcccgttcgagttcacccggctggcgattccgcggcgggtctacaccaacctgcacctggaggacgtcgccgagaccgtgatcaacgcctttcagaagcgcgaggagatccgcggcgtgaagttcgcccgggagcccaaggtgctccgccacttcacggcctggttcgacccggcttag

SEQ ID NO: 14900 - protein, 471 aa, Symbiobacterium thermophilum IAM 14863
MLHAMTESVHSGKGGVHVPKGEPFKIKMVEPIRLIPREDRERALKEAHYNPFFLRSSDVYIDLLTDSGTGAMSQFQWSAMMLGDESYAGASSYYRLKETVTDITGYEYVIPTHQGRGAEKVAFSQLITRPGMYVLSNMFFDTTRGHVQLAGGRPVDLLIDVPTEEYHPFKGNMDTERLEQFIREHGAENIACIVMTVTNNSAGGQPVSMANIRETYQIARKYGVLVLFDVARYAENCHFIRMREEGYADKHPIDIAREMFSYGDGLMMSAKKDALVNIGGLLAFRDEELFTKVGAAVVPFEGFLTYGGLAGRDLEAMAVGLREALDPDYLAYRVGQVQYLGEMLRNAGIPIQWPVGGHAVFIDAAKFLPHVPWDQFPGHALTLALYLEGGVRTVEVGSLMIGRDPETGENVRGPFEFTRLAIPRRVYTNLHLEDVAETVINAFQKREEIRGVKFAREPKVLRHFTAWFDPA

SEQ ID NO: 14901 - DNA, 1443 bp, Photobacterium profundum SS9
  CDS (1)..(1443): transl_table=11
atgatgaacttaccccaatcctttaagagaaaatctgtagcgttaatgaacttaccccaaccctataagataaaatctgtagagccaattaatttgctctcaaaagaagagcgttttaaagcacttgagagagttggatttaatccatttctgttaaaaagtaatgaagtttttattgatttattaacagactccggcaccggagcgatgagccaagatcagtggtcggccctgatgaaaggagatgaatcctatgccggtagtagcagcttttataagttagaagaagcagttaccgatatttttgattaccaatatacgatcccaacccatcaaggccggggagccgaacaaatattattccctattttaattcagaaaatggaaaaagaacgtggagggaaggcgcctgtttttctctctaattatcatttcgataccaccgccgcacatattgaacttaatggtgcaaaagccgtgaatgtcgtggtcgaagaagcttataaaataaaagattattataattggaaaggtaactttgatttacctttattagtcgggaatattgaaaagtatggttctgaaaatatagcggctattattattaccatcacgtgtaatagtatgggggggcagcctgtttcacttgataatatgaaggccgtttatgatattgcgaaagaatttaatattccagtcgtgatggacgctgcgcgtttctccgaaaatgcgtactttattcttcaacgagatccaatatatttcaatgccagtatcggtgatattgtcaaaaaaatgtttgaatatgcagatatatttacgatgtctgcaaaaaaagacgcgatggttaatatcggtgggttatgttgttttaaaaatgatgaatccctctaccgagaagtgcaaaccttatgtattcctatggaaggattcgccacgtacggtggattagcagggcgtgatatggaagccttagctgtgggtctctatgaggctatcgattaccggtatctatcaacgcggatcaatcaagtttacatgcttaatcaaacacttgctgaggcaggggtgcctgttcagaatccaagcgggggtcatgctgtttttattgatgcaaaggcattcttaccgcatatcccctcggagcaatttcccggtcatgctttggccattgagttatatcttgaagcgggtattcgttccgcagaaattggctccctcctcttaggtcgagagcctaagactagaaaacaaaaagactcaccgacagaacttctgcgtttggctatccctcgacgtacctacaccaatgaacatatggagtatgtggctcactatgtcattaagataatgaaaaacagagataaaatacctggttatcgttttacttatgagcccttagtacttcgccatttcttggcgacgtttgagccggtcagttaa

SEQ ID NO: 14902 - protein, 480 aa, Photobacterium profundum SS9
MMNLPQSFKRKSVALMNLPQPYKIKSVEPINLLSKEERFKALERVGFNPFLLKSNEVFIDLLTDSGTGAMSQDQWSALMKGDESYAGSSSFYKLEEAVTDIFDYQYTIPTHQGRGAEQILFPILIQKMEKERGGKAPVFLSNYHFDTTAAHIELNGAKAVNVVVEEAYKIKDYYNWKGNFDLPLLVGNIEKYGSENIAAIIITITCNSMGGQPVSLDNMKAVYDIAKEFNIPVVMDAARFSENAYFILQRDPIYFNASIGDIVKKMFEYADIFTMSAKKDAMVNIGGLCCFKNDESLYREVQTLCIPMEGFATYGGLAGRDMEALAVGLYEAIDYRYLSTRINQVYMLNQTLAEAGVPVQNPSGGHAVFIDAKAFLPHIPSEQFPGHALAIELYLEAGIRSAEIGSLLLGREPKTRKQKDSPTELLRLAIPRRTYTNEHMEYVAHYVIKIMKNRDKIPGYRFTYEPLVLRHFLATFEPVS

SEQ ID NO: 14903 - DNA, 1467 bp, Photobacterium profundum SS9
  CDS (1)..(1467): transl_table=11
atggaaaactttaaacacttacctgaaccattccgtatccgtgttattgagccagtaaaacgcactactcgtgaatatcgcgatgaagctattttaaaagcgggaatgaacccattcctactagatagtgaagacgtatttattgacctgcttactgatagtggaacgggggcaattactcaagaaatgcaagccgcgatgttccgtggggatgaagcatacagcggtagccgcagttactacgcacttgcgaacgcggtaaaagatatctttggttatgaattaacaattccgactcaccaaggtcgtggtgccgagcaaatctacattcctgtccttatcaagaaacgtgaaatagagaagggactagaccgtaccaaaatggtagcactgtctaactacttctttgatacaacacaaggtcacactcaagtgaactgctgtgtggcaaagaatgtgtatacagaagatgcgtttgatacctcggtcaatgccgatttcaaaggtaactttgacctagttaagctagaagaagcaatccttgcagccgaccctgtaaacgtaccgtacattgtgagtactattacctgtaactctgcaggtggtcagcctgtttctatcgctaacctaaaagcggtgtatgagatcgcacagaaatatgacattccagtaattatggactccgctcgttatgccgagaacgcctactttattcaacaacgtgaagatacttacaaagattggactatcgaagaaatcacgcgtgaatcttataagtatgctgacggcctagcgatgtctgcaaagaaagatgccatggtacagatgggcggtctactttgcttcaaagatgaatccatgatggatgcatacacagagtgtcgtactttgtgtgtgattcaggaaggcttcccaacctacggtggtcttgaaggtggtgcgatggaacgtcttgccgttggtctctatgacggcatgcgtcaggagtggctagcataccgtattggtcaagttcaataccttgtagacggtctagagtctattggtgtcgtatgtcagcaagcggggggccacgcggcattcgttgacgcaggtaagctgcttccacacatttctaccgagcagttccctgcgcatgctcttgcttgcgaactctataaagtggcaggtatccgcgccgttgaaatcggctctctattactaggtcgcgatccagcgacaggtaaacaacatccttgtcctgcggagctacttcgtctgacgatcccacgagcaacttacactcaaacgcatatggatttcgttatagaagcgttccaaaaagtgaaggcaaacgcagcaaatgtgaaaggtcttgattttacttatgagccagcagtgcttcgtcactttacagctcgacttaaagaagttgagcctgtgcaagcagcggtgaaaacggaaaccaagattctagaagaagcttaa

SEQ ID NO: 14904 - protein, 488 aa, Photobacterium profundum SS9
MENFKHLPEPFRIRVIEPVKRTTREYRDEAILKAGMNPFLLDSEDVFIDLLTDSGTGAITQEMQAAMFRGDEAYSGSRSYYALANAVKDIFGYELTIPTHQGRGAEQIYIPVLIKKREIEKGLDRTKMVALSNYFFDTTQGHTQVNCCVAKNVYTEDAFDTSVNADFKGNFDLVKLEEAILAADPVNVPYIVSTITCNSAGGQPVSIANLKAVYEIAQKYDIPVIMDSARYAENAYFIQQREDTYKDWTIEEITRESYKYADGLAMSAKKDAMVQMGGLLCFKDESMMDAYTECRTLCVIQEGFPTYGGLEGGAMERLAVGLYDGMRQEWLAYRIGQVQYLVDGLESIGVVCQQAGGHAAFVDAGKLLPHISTEQFPAHALACELYKVAGIRAVEIGSLLLGRDPATGKQHPCPAELLRLTIPRATYTQTHMDFVIEAFQKVKANAANVKGLDFTYEPAVLRHFTARLKEVEPVQAAVKTETKILEEA

SEQ ID NO: 14905 - DNA, 1401 bp, Photobacterium profundum SS9
  CDS (1)..(1401): transl_table=11
atgaaacgtataccagaaccgttccgcattaaaatggttgaatctattcgcatgacaaacgaagaggatcgacgtgaagccttaattgaagcgggttataaccccttcatgttaagaagcgaagatgtttatatcgatctactgactgattcaggcacaggcgcaatgagtgacgtgcagtgggcaggcttaatgatgggagacgaatcttatgcaggaagccgcaactactttaatttatgcgatgctgtaaaacacttctttgattacaagctcacggttcctgcccatcaagggcgtggcgcagaacagatattatttccttgcttaatagagcgaatgaaaacggtacgtggcggtgatcaacccgtatttatatcgaattaccactttgatacgacagcgggtcatatcgaacttaatggcggtaaagccattaacgtactgactgagaaggcgtttgacacagaaacgtatgacgactggaaagggaattttgatctcgataaactacaatcaaccattgaaatgtatggctcacacaatattgccgccattatcaccacgatcacatgtaacagctcgggcgggcaacccgtttcaatggctaacatgcgtgcggtatacgagattgcgaaagaaaatgatattccagtagtgatcgattcggctcgttattgcgaaaacgcctactttataaagcaacgtgaacctgaatatgccgatacatccattctcgagattattcgcgaaatgtaccgttatggcgacatgttaacgatgtctgctaaaaaagaccctatggtcaatattgggggcttatgctgtattcgtgatcatgaagatcttttccaagcagtacgaacacgttgcgttcctatggaagggtttgttacttatggcggaatggctggacgtgatatggaagccctcgcccgtggtttatatgaaggtgctgatgaagacttccttcactaccgtattggccaagtggaatatttgggtgaacgtttacgagaagcaggtatacccattcaatacccaactggcggtcatgctgtctttgtcgacgcgaccaaaattttgcctcatatccccagtgaacaattcccagcccacgcattatgtaatgagctctatttagagtctggggtgcgggccgtagaaattggttcgttattactgggcagagatcctgaaacaggcaagcagaaagagtcacaattagaattaatgcgcctaactattccacgtcgtgtatataccaatgatcatatggattacgttgccgatgcattaatcgcagttacaaaacgcgcaagtgaaattcgaggactaacctttgagtatgagccaccagtattgcgccatttcaccgctaaattaaaacctgttgaataa

SEQ ID NO: 14906 - protein, 466 aa, Photobacterium profundum SS9
MKRIPEPFRIKMVESIRMTNEEDRREALIEAGYNPFMLRSEDVYIDLLTDSGTGAMSDVQWAGLMMGDESYAGSRNYFNLCDAVKHFFDYKLTVPAHQGRGAEQILFPCLIERMKTVRGGDQPVFISNYHFDTTAGHIELNGGKAINVLTEKAFDTETYDDWKGNFDLDKLQSTIEMYGSHNIAAIITTITCNSSGGQPVSMANMRAVYEIAKENDIPVVIDSARYCENAYFIKQREPEYADTSILEIIREMYRYGDMLTMSAKKDPMVNIGGLCCIRDHEDLFQAVRTRCVPMEGFVTYGGMAGRDMEALARGLYEGADEDFLHYRIGQVEYLGERLREAGIPIQYPTGGHAVFVDATKILPHIPSEQFPAHALCNELYLESGVRAVEIGSLLLGRDPETGKQKESQLELMRLTIPRRVYTNDHMDYVADALIAVTKRASEIRGLTFEYEPPVLRHFTAKLKPVE

SEQ ID NO: 14907 - DNA, 1344 bp, Haloarcula marismortui ATCC 43049
  CDS (1)..(1344): transl_table=11
atgcgctcgtacaaggccaaatcggtaacctcgatacagcttccgccccgtgagcgacgtgagaccgtgctcaccgaggccgggcacaacgtcttcaacctcgctgcggatgacgtctttatcgacttgctaaccgattcggggactggcgcgatgagtgacgaccagtgggcggccgtggttcgaggggacgaggcgtacgccggttcgcgctcgttcaaacgcttccgtgagacggtcgccgacgtgatggggttcgaccgcgtggtcccgacacaccagggccgcggcgcggagaacgtcctgttcggggcactgctggacgacggtgacgtcgttctcaacaacacgcattttgacaccacccgcgcacacgtgacgaatcagggtgcaatcgcggctgactgcccggcagagacggacctgaccactgatactgtcgggacgtttgccggaaacttctccacagaccgggggtgggacgccgtcgaggagcacgggcaggacgctgtttcggccgtcgttctgacgatcacgaacaactccgccgccggccagccggtgtcgatggcgaacatccgcgagacagccgccttcgccacggaaatcgatgcaacgttcgtcatcgacgcctgtcggttcgccgaaaacgcacagttcatcaagcaacgggaccccgaatacgccgatacgcccctcagcgagattgctcgcgagcagttacgtcccgcggacgcaatcacgatgagtggcaaaaaggacgcactggcaaacatcggcgggttcacggctgtccgagacgctgccctgtttgaacagtgcaaacagcgcgcgatcctgtatgaaggattcccgacctacggtggcctcgcaggtcgtgatcttgaagcgatggcgaccggcctgcgggaagcggttcaaccgccgtacgtcgccgagcgaatcgaacaggtcgcgaccctcggggacctcctgcgtgatcgagacatcccgatagtcacgccaaccggcggtcacgccgtctacattgatgcggccgccctgttcccggatattcccgccgaccagtaccccgggcagcgactcgtctgcgaactctaccgcgagggcggcgtccggacagtcgaactcggctcgtttgccttccccgggactaaccgtccggaactcgtccgtctcgcccttcctcgccggacgtactggcacgaacacctcgaacacatcgcggagactgctgcacgagttcgtgaccgccgcgacgagtactccggtctggaaatcgtctgggagcccccaatggaagaactcagacacttctcagcggaacttgagcctgttgcgtag

SEQ ID NO: 14908 - protein, 447 aa, Haloarcula marismortui ATCC 43049
MRSYKAKSVTSIQLPPRERRETVLTEAGHNVFNLAADDVFIDLLTDSGTGAMSDDQWAAVVRGDEAYAGSRSFKRFRETVADVMGFDRVVPTHQGRGAENVLFGALLDDGDVVLNNTHFDTTRAHVTNQGAIAADCPAETDLTTDTVGTFAGNFSTDRGWDAVEEHGQDAVSAVVLTITNNSAAGQPVSMANIRETAAFATEIDATFVIDACRFAENAQFIKQRDPEYADTPLSEIAREQLRPADAITMSGKKDALANIGGFTAVRDAALFEQCKQRAILYEGFPTYGGLAGRDLEAMATGLREAVQPPYVAERIEQVATLGDLLRDRDIPIVTPTGGHAVYIDAAALFPDIPADQYPGQRLVCELYREGGVRTVELGSFAFPGTNRPELVRLALPRRTYWHEHLEHIAETAARVRDRRDEYSGLEIVWEPPMEELRHFSAELEPVA

SEQ ID NO: 14909 - DNA, 1449 bp, Azoarcus sp. EbN1
  CDS (1)..(1449): transl_table=11
atggcacaggtgaagtttttcagcggagagcaggttccgctggaaatgcacaaggtacgcatcgtacagaagctgaaccttccgccggtggaacaccggctcaaggcgatcaccgaagcaggcaacaacactttcctgctgcagaacaaggacgtcttcatggacatgctcaccgacagcggtgtcaatgccatgagcgatcaacagcaggccgcgatgctgatcgccgacgacagctacgccggcagcgcgacctacacccggctcgaaagcaagctccgggaaatcttcggcatggcctatttcctgcccgcccatcaggggcgcgcctgcgaaaacatcctgtcgcaagtgctggtatcgccgggctcgatcgtgccgatgaactatcacttcacgaccaccaaagcgcacatcaccctgaacggcggggtcatcgaagagctggtctcggatgccggcctcgaagtcgtcagcgtccatcccttcaaagggaacatggatatcgccaggctgtcggcggtcatcgaagagcacggcagcaacaagattgcgttcgtccgcatggaagcgggcacgaacctcatcggcggacaaccgttctcgctcgagaacctcaccaacgtgcgtcgcgtgtgcgacaagcacgacgtcctgctcgtgctcgacgcgagcctgctcgccgataacctccacttcatcaagaaccgcgaggaaagctgcaaggatctgagcattcgcgagatcacgcgcaagatggcggacctgtgcgacatcatctatttctcggcacgcaagctcggctgcgcacgcggcggcggcatctgcatcaggaccgaggagctgtaccgcaggatgcgcgggctggtcccgctgtacgaaggcttcctcacgtacggcgggatgtccgtgcgcgaaatggaagcgctgacggtcggcctcgacgaaacgatggacgaggacgtgatcaaccaggggccgcagttcatcggcttcatggtcgacgagctgcaaaaacgcggcgttcccgtcatcacgccggccggcggcctcggttgccacctcaacgtcatgcagttcctcgagcacgtcccgcaggcgcaataccctgccggcgcgctcgcctcggcgctgtatatcgccagcggcatacgcggcatggagcgcggcacgctctccgagcagcgcgaccccgacggcaacgaagtcttggccaacatggaactggtccggctggcgttgccgcgccgggtattcacgctgtcgcaggtcaaatacgcgatcgaccggatctcgtggctgcacgagaaccgccacctcatcggcggcctcgtgttcaccgaagagcctgaaatcctgcgtttcttctatggccggctgaagcccgtttcggattggcagcaaaagctgttcgagaaattccgcgaggacttcggcgacagcctgtag

SEQ ID NO: 14910 - protein, 482 aa, Azoarcus sp. EbN1
MAQVKFFSGEQVPLEMHKVRIVQKLNLPPVEHRLKAITEAGNNTFLLQNKDVFMDMLTDSGVNAMSDQQQAAMLIADDSYAGSATYTRLESKLREIFGMAYFLPAHQGRACENILSQVLVSPGSIVPMNYHFTTTKAHITLNGGVIEELVSDAGLEVVSVHPFKGNMDIARLSAVIEEHGSNKIAFVRMEAGTNLIGGQPFSLENLTNVRRVCDKHDVLLVLDASLLADNLHFIKNREESCKDLSIREITRKMADLCDIIYFSARKLGCARGGGICIRTEELYRRMRGLVPLYEGFLTYGGMSVREMEALTVGLDETMDEDVINQGPQFIGFMVDELQKRGVPVITPAGGLGCHLNVMQFLEHVPQAQYPAGALASALYIASGIRGMERGTLSEQRDPDGNEVLANMELVRLALPRRVFTLSQVKYAIDRISWLHENRHLIGGLVFTEEPEILRFFYGRLKPVSDWQQKLFEKFREDFGDSL

SEQ ID NO: 14911 - DNA, 1404 bp, Nostoc punctiforme PCC 73102
  CDS (1)..(1404)
atgaccgatgccaagcaaacttctccgcgccgccgtcgctcttgggcagagccatataaaattaaggtggttgagccattaaaaattactactcgcgctgaacgcgaacaggcgatcgcacaagcgggttacaatacttttctactacgttctgaagatgtctatattgatttgctcactgatagcggcacttcagccatgagcgattatcagtgggcagggatgatgctgggtgatgaagcttatgccggcagcaaaaatttttacaatttagaagcaagtatccaaaagtattacggctatcgccatattgtacctactcaccaagggcgtggtgcagaaaatattctttctcaaatactgatcaaaccaggagactacatacctggcaatatgtatttcaccacaaccaggttgcatcaggagttagctggcggcacttttgtcgatgtgattattgatgaagcccacgatgcccaatcactgcatccatttaagggtaatgtagacttacaaaagcttacagacctaattgagcgagttggggcagaacgtattccctatattagcgttgccggaaccgtgaatatggctggcggacagccgatttctatggctaacctgcgggcggtacatcagttagcccaaacctacggtatccgcattattcttgatgccacccgcgctgtggaaaacgctcactttatccaacagcgagaggaggattattccagccaagcgatcgctaccatcttacgcgaattttgctcctataccgacggttgcaccatgagcggtaagaaggatgcactggttaacatcggcggttggctggctcttaatgactataatctttacgaagaagcacgtaacttaatagtaatttatgaaggtctacatacttacggtggtatggctggccgggacatggaagctatggcacgaggtatagaagaatcagttcaagacgatcatattcgtgcccgtgtcggtcaggttgagtatcttggacaaaagcttttagattggggtattccaattgttgtgccgattggcggtcatgccatttatttagatgccaaacgctttttaccacaaattccccaagaccaatttccggcacaacgtctagcagcagaactgtatctagaggcaggcattcgggcaatggaacggggcatcgtttccgcagggcgcaataaagaaacaggcgataattattatccagagttagaattagtccgtttaactattccacgccgtgtttacactcaggctcacatggatctgactgctgaagcagttgaagaagtttatcataatcgcgatcgcctacgcggactcaaaatgatttatgagccgaagtatctccgtttctttcaagcaagatttgaattgcagtaa

SEQ ID NO: 14912 - protein, 467 aa, Nostoc punctiforme PCC 73102
MTDAKQTSPRRRRSWAEPYKIKVVEPLKITTRAEREQAIAQAGYNTFLLRSEDVYIDLLTDSGTSAMSDYQWAGMMLGDEAYAGSKNFYNLEASIQKYYGYRHIVPTHQGRGAENILSQILIKPGDYIPGNMYFTTTRLHQELAGGTFVDVIIDEAHDAQSLHPFKGNVDLQKLTDLIERVGAERIPYISVAGTVNMAGGQPISMANLRAVHQLAQTYGIRIILDATRAVENAHFIQQREEDYSSQAIATILREFCSYTDGCTMSGKKDALVNIGGWLALNDYNLYEEARNLIVIYEGLHTYGGMAGRDMEAMARGIEESVQDDHIRARVGQVEYLGQKLLDWGIPIVVPIGGHAIYLDAKRFLPQIPQDQFPAQRLAAELYLEAGIRAMERGIVSAGRNKETGDNYYPELELVRLTIPRRVYTQAHMDLTAEAVEEVYHNRDRLRGLKMIYEPKYLRFFQARFELQ

SEQ ID NO: 14913 - DNA, 1416 bp, Haemophilus somnus 129PT
  CDS (1)..(1416)
atggaaaatttcaaacatttaccagaaccgttccgtattcgtgttattgaacctgtcaaacgtacaactcgtgcctatcgtgatgaagctatcttgaaagcaggtatgaatctatttttattagacagtgaagatatttttattgatctattaactgatagtggtacaggtgccgttactcaagatatgcaggctgccatgctaagaggtgatgaagcttatagcggaagtcgcagttactatgctcttgccaatgctgtgaaagaaatctttggttatgaatacacaattccaacccatcaaggtcgtggtgcagaacaaatttatattcctgtcttgatcaaaaaacgtgagcaagaaaaagggttggatcgaaataaaatggttgttttctctaactatttttttgacactactcaaggtcatagccaattaaatggtgcaactgtacgtaatgtctatataaaagaagcttttgacacagatgtagatcatgatttcaaaggtaattttgatttagaaaaactggaacaaggtattttagaagttggagcaaataatgttccttacattgtatgtactattacctgtaattctgccggtggacaaccggtatctcttgccaatatgaaagccatgtaccaaattgcacgtaaatatgatattcctgtgattatggattcggctcgcttcgctgaaaatgcctactttattcaacaacgtgaagcagaatacaaagattggactattgaacaaattacttacgaaagctataaatatgcagatgccttggctatgtctgcaaaaaaagatgcaatggtacctatggggggactactctgcttcaaagataattcaatggaagatgtttacaacgagtgtcgtacactttgtgttgtacaagaaggtttccctacctatggtggtctagaaggtggtgcaatggaacgcctagctgtaggtttacgtgatggtatgcgtcaagattggttagcttatcgtattagccaaattgaataccttgtacaaggtttagaaaagatcggtgttgtttgtcaacaacctgggggacatgccgcctttgtggatgcaggcaaattattaccacatatcccagcagaacaattccctgctcaggctcttgcttgtgaattatataaagtagcaggtattcgatccgtagaaatcggttctctcctattaggacgagatccgaaaacaggtcaacaattaccttgcccggctgaattgttacgtttaactattcctcgtgcgacctacactcaaacacatatggacttcattattgaagcattcaaacgagtgaaagagaatgcaaaaaatatcaaaggtttagatttcacttatgaacctaaagtactgcgtcatttcaccgctcgattaaaagagatttag

SEQ ID NO: 14914 - protein, 471 aa, Haemophilus somnus 129PT
MENFKHLPEPFRIRVIEPVKRTTRAYRDEAILKAGMNLFLLDSEDIFIDLLTDSGTGAVTQDMQAAMLRGDEAYSGSRSYYALANAVKEIFGYEYTIPTHQGRGAEQIYIPVLIKKREQEKGLDRNKMVVFSNYFFDTTQGHSQLNGATVRNVYIKEAFDTDVDHDFKGNFDLEKLEQGILEVGANNVPYIVCTITCNSAGGQPVSLANMKAMYQIARKYDIPVIMDSARFAENAYFIQQREAEYKDWTIEQITYESYKYADALAMSAKKDAMVPMGGLLCFKDNSMEDVYNECRTLCVVQEGFPTYGGLEGGAMERLAVGLRDGMRQDWLAYRISQIEYLVQGLEKIGVVCQQPGGHAAFVDAGKLLPHIPAEQFPAQALACELYKVAGIRSVEIGSLLLGRDPKTGQQLPCPAELLRLTIPRATYTQTHMDFIIEAFKRVKENAKNIKGLDFTYEPKVLRHFTARLKEI

SEQ ID NO: 14915 - DNA, 1569 bp, Fusobacterium nucleatum subsp. vincentii ATCC 49256
  CDS (1)..(1569): transl_table=11
gtgacagttgaacaaagggaacgtgcattaaaggcaactcactacaatgaatttgcttttcctgctggaatgctaacagtggatatgttatcagattcaggaactactgctatgacagatcaacaatggtctgctatgtttttaggtgatgaatcttatggaagaaacaaaggttactatgtattacttgatgcaatgagagattgttttgaaagaggagataatcaaaaaaagattattaaccttgttcgtactgattgccaagacatagaaaaaatgatgaatgaaatgtatttatgtgaatatgaaggcggattatttaatggaggagctgcccaacttgaaagacctaatgctttcttaatgccacaaggtcgtgcagcagaatctatcttatttgaaatagtgcgtaagatacttgctgttcgtgaaccaggaaaagtatttactattccatctaatggacattttgatacaacagaaggaaatattaaacaaatgggttctgtacctcgtaacttgtataataaagaattattatatgaagttccagaaggtggacattatgaaaaaaaccctttcaaaggagatatggatataaataaactgcaacaacttattgatgctgttggagtagaaaatattcctatgatatatacaacaataactaacaacactatatgcggtcaagcagtatctatgaaaagtattagagaaactgcaaaaattgctcataaatatgaaatcccatttatgttagatgctgcaagatgggctgaaaactgttactttataaaaatgaatgaagatggatatagagataagtctattcctgaaattgcaaaagaaatgttctcttactgtgatggattcactgcttcacttaaaaaagatggacatgctaatatgggaggaattttagctttccgtgataaaggatatttctggaagaaattctctgatttcaatgaagatggaacagttaaaacagatgtaggaatcttgttaaaagttaaacaaatatcttcttatggtaatgactcttatggaagtatgtcaggtcgtgatattatggcacttgctgctggactttatgaatgttgtaatttcaactatttacaagaaagagttgaacaatgtaactatctagcagaaggattctataaagcaggtgttaaaggtgttgttctaccagcaggaggacatggagtttatataaacatggatgaattctttgatggaaaaagaggacatgaaacatttgcaggagaaggatttagtcttgaacttattagaagatatggaattcgtgtttctgaattaggggattattctatggaatatgatttaaaaactcctgaacaacaagcagaagttgcaaatgttgtaagatttgcaataaatagaagtgtttattcacaagaacatcttgactatgttattgcagctgtaaaagctctttatgaagatagagaaagtatacctaatatgagaattgtttctggtcataatctaccaatgagacactttcatgctttcttagaaccttatccaaatgaagaaaaatag

SEQ ID NO: 14916 - protein, 522 aa, Fusobacterium nucleatum subsp. vincentii ATCC 49256
MTVEQRERALKATHYNEFAFPAGMLTVDMLSDSGTTAMTDQQWSAMFLGDESYGRNKGYYVLLDAMRDCFERGDNQKKIINLVRTDCQDIEKMMNEMYLCEYEGGLFNGGAAQLERPNAFLMPQGRAAESILFEIVRKILAVREPGKVFTIPSNGHFDTTEGNIKQMGSVPRNLYNKELLYEVPEGGHYEKNPFKGDMDINKLQQLIDAVGVENIPMIYTTITNNTICGQAVSMKSIRETAKIAHKYEIPFMLDAARWAENCYFIKMNEDGYRDKSIPEIAKEMFSYCDGFTASLKKDGHANMGGILAFRDKGYFWKKFSDFNEDGTVKTDVGILLKVKQISSYGNDSYGSMSGRDIMALAAGLYECCNFNYLQERVEQCNYLAEGFYKAGVKGVVLPAGGHGVYINMDEFFDGKRGHETFAGEGFSLELIRRYGIRVSELGDYSMEYDLKTPEQQAEVANVVRFAINRSVYSQEHLDYVIAAVKALYEDRESIPNMRIVSGHNLPMRHFHAFLEPYPNEEK

SEQ ID NO: 14917 - DNA, 1383 bp, Fusobacterium nucleatum subsp. vincentii ATCC 49256
  CDS (1)..(1383): transl_table=11
atgagatatgaagattatccagcagagccatttagaattaaaagtgtagaaactgttaaaatgattgataaggcagcaagagaagaagtaattaaaaaagcaggatataatactttcttaattaactctgaagatgtttacattgacttattaactgatagtggaactaatgctatgagtgataaacaatggggaggattaatgcaaggtgatgaagcctatgcaggaagtagaaatttcttccatttagaagaaactgtacaagaaatatttgggtttaaacatatagttcctactcaccaaggaagaggagcagaaaatattttatctcaaatagctataaaacctggtcaatatgttcctggaaatatgtattttacaactactagatatcaccaagaaagaaatggtggaatttttagagatgttataagagatgaagctcatgatgccactcttaatgttcctttcaaaggagatatagacttaaataaattacaaaaattaatagatgaagttggagcaaaaaatattgcttatgtttgtttagctgtaactgtaaaccttgctggtggacaaccagtttctatgaaaaatatgaaagcagttagagaattaactaaaaaacatggaataaaagttttctatgatgcaactagatgtgttgaaaatgcttacttcattaaagaacaagaagaaggatatcaagataaaactataaaagaaatagtacatgaaatgtttagctatgctgatggatgtactatgagtggtaaaaaagattgtcttgttaatattggtggattcttatgtatgaatgatgaagatttattcttaaaggcaaaagaaatggttgttgtttatgaaggtatgccatcttatggtggacttgctggaagagatatggaagctatggcaataggattaagagaatctctacaatatgaatacataagacatagaattttacaagttagatacttaggagaaaaattaaaagaagcaggagtacctatacttgaaccagttggaggacatgctgtattcttagatgctagaagattctgtcctcatatcccacaagaagaattcccagctcaagctcttgcagcagctatctatgttgaatgtggtgtaagaactatggaaagaggaataatttctgctggtagagatgtaaaaactggtgaaaaccataaacctaaactagaaactgttagagttactataccaagaagagtttatacttataaacatatggatgtagtagcagaaggtataatcaaattatacaaacataaagaagatataaaaccattagaatttgtatatgaaccaaaacaattaagattctttacagctagatttggaataaaaaaataa

SEQ ID NO: 14918 - protein, 460 aa, Fusobacterium nucleatum subsp. vincentii ATCC 49256
MRYEDYPAEPFRIKSVETVKMIDKAAREEVIKKAGYNTFLINSEDVYIDLLTDSGTNAMSDKQWGGLMQGDEAYAGSRNFFHLEETVQEIFGFKHIVPTHQGRGAENILSQIAIKPGQYVPGNMYFTTTRYHQERNGGIFRDVIRDEAHDATLNVPFKGDIDLNKLQKLIDEVGAKNIAYVCLAVTVNLAGGQPVSMKNMKAVRELTKKHGIKVFYDATRCVENAYFIKEQEEGYQDKTIKEIVHEMFSYADGCTMSGKKDCLVNIGGFLCMNDEDLFLKAKEMVVVYEGMPSYGGLAGRDMEAMAIGLRESLQYEYIRHRILQVRYLGEKLKEAGVPILEPVGGHAVFLDARRFCPHIPQEEFPAQALAAAIYVECGVRTMERGIISAGRDVKTGENHKPKLETVRVTIPRRVYTYKHMDVVAEGIIKLYKHKEDIKPLEFVYEPKQLRFFTARFGIKK

SEQ ID NO: 14919 - DNA, 1182 bp, Haemophilus influenzae 86-028NP
  CDS (1)..(1182)
atggaaaattttaaacatttacctgaacctttccgcattcgtgttattgaaccagtaaaaagaactactcgtgagtatcgtgaacaagcgatgttaaaatcaggcatgaatccatttttattagatagtgaagatattttcattgacttacttacagatagcggtactggtgccgttacacaagatatgcaagctgcaatgttacgtggcgatgaagcctatagtggcagtcgcagttattatgcgctagctaaagcagtgaaagatatttttggttacgaatatacaatccctactcaccaaggtcgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgatggtttagcgatgtccgccaaaaaagatgcgatggtgccaatggggggtattttagcgtttaaagataaatcaatggaggaagtctatcacgaatgtagaacgctttgtgttgtgcaggaagggttccctacttatggaggtttagaaggtggtgcaatggaacgtttggctgttggcttgcatgatggtatgcgccaagaatggctggcttatcgtattgcgcagattgaatattcggttgcaggcttacaaaaaattggcgtgccttgccaacaaccaggtggacacacgacgctcgtagatgctgttaaattattaccacatattgcaggcgaccaatttccagcacaagcgctttgttgcgaactttatgacggtgcaggtacaagatcgtaa

SEQ ID NO: 14920 - protein, 393 aa, Haemophilus influenzae 86-028NP
MENFKHLPEPFRIRVIEPVKRTTREYREQAMLKSGMNPFLLDSEDIFIDLLTDSGTGAVTQDMQAAMLRGDEAYSGSRSYYALAKAVKDIFGYEYTIPTHQGRGAEQIYIPVLIAKREREKGLDRSKMVVFSNYFFDTTQGHSQINGATVRNVYIKEAFDTTAKHPFKGNFDLEKLEKGIQEAGAHNVPYIVCTITCNSAGGQPVSIANLKGMYEIARKYDIPVIMDSARFAENAYFVQQREEAYKDWTIEQITYESYRYADGLAMSAKKDAMVPMGGILAFKDKSMEEVYHECRTLCVVQEGFPTYGGLEGGAMERLAVGLHDGMRQEWLAYRIAQIEYSVAGLQKIGVPCQQPGGHTTLVDAVKLLPHIAGDQFPAQALCCELYDGAGTRS

SEQ ID NO: 14921 - DNA, 1347 bp, Solibacter usitatus Ellin6076
  CDS (1)..(1347): transl_table=11
gtgcgcaccatcatcgaacccttccgcatcaagagcgtggaaccgctgcaccacaccactcccgcggaacgcgagcgctatctcgccaacgcaggctacaacctcttcctcattgacgcccgccacattctgatcgatctgctcaccgactccggcaccagcgccatgtccaacgcgcaatgggccgcgatcatgcgcggcgacgaaagctacgccggcagcgagagcttcttccgcctgaagcgcgtcgccgacgaactcaccggcttccgccacatggttcccactcaccagggccgcgccgccgagcgcatcctcttcacggtgatgtgcaagcccggcgacgtgatcccctccaacacacatttcgataccacccgggccaacgtcgaattcaccggggcccgggccgtcgatctccctatacccgaagcccgcgacacccaggcccgcctggatttcaaagggaatatggatgtccccgcgctcgaggccctgatctccgccgagggcgcggccaagatccccctcgtgatgctgaccgtcaccaacaactccggcggcggccagcccgtttcactggccaacatcggcgctgtcaaggacgtctgcgcacgccaccgcatcccgctctacctcgacgcctgccgcttcgccgaaaacgcctggttcatccaccagcgcgagcccggctaccaggactggtcgccaaagcaaatcgcccagaaaatgttttcactcgccgatggcgccaccttctccgccaagaaggacgccttcgccaacatcggcggcctgctcttcagcaacgacgagcgggtcttccagcaggagaccaacctcctcatcctcaccgaaggcttcccgacctacggagggctcgccggccgcgatctcgacgccatcgccgtcggcctggaagaaatcctcgaccccgattacctcaactaccgcattgtctccaccggctatcttggccgccacatcgccgaccatggcgtccccatcgtcgagccgcccggcggccacgccatctatatcgatgccgcgcgcatgctcccccatatccccccgcaacagttccccggccaggccctcgcggtggagctctaccgccacgccggaatccgtggcgtcgaaatcggcagccttatgttcgcgggagccgcccagcacgaattgctccgcctcgccatcccacgccgcgtctacacccagagccacatcgattacgtggtggaagcgatcctcgaggtcaacgcgaacaagaacgcaatccgcggtatggaaatcgtcgaagccccgcccttcctgcgccacttcagcgcacggatgaggcagctatag

SEQ ID NO: 14922 - protein, 448 aa, Solibacter usitatus Ellin6076
MRTIIEPFRIKSVEPLHHTTPAERERYLANAGYNLFLIDARHILIDLLTDSGTSAMSNAQWAAIMRGDESYAGSESFFRLKRVADELTGFRHMVPTHQGRAAERILFTVMCKPGDVIPSNTHFDTTRANVEFTGARAVDLPIPEARDTQARLDFKGNMDVPALEALISAEGAAKIPLVMLTVTNNSGGGQPVSLANIGAVKDVCARHRIPLYLDACRFAENAWFIHQREPGYQDWSPKQIAQKMFSLADGATFSAKKDAFANIGGLLFSNDERVFQQETNLLILTEGFPTYGGLAGRDLDAIAVGLEEILDPDYLNYRIVSTGYLGRHIADHGVPIVEPPGGHAIYIDAARMLPHIPPQQFPGQALAVELYRHAGIRGVEIGSLMFAGAAQHELLRLAIPRRVYTQSHIDYVVEAILEVNANKNAIRGMEIVEAPPFLRHFSARMRQL

SEQ ID NO: 14923 - DNA, 1374 bp, Desulfitobacterium hafniense DCB-2
  CDS (1)..(1374): transl_table=11
atgaaaacctatcctgcagaaccctttcggattaaggtcgttgaacccgttcggtcgatgaagcgggcagagcgtgaagaggccatgaaagaagcaggctacaacacttttttgctgaagagtgaggatgtctatattgatctgctcacagattccggcactactgccatgagcgataaacaatgggccggtatgatgatcggtgatgaagcctatgccgggagcaggaatttcctgcacctggatcgggtggttaaagaatattatggcttcaagcacctggtccctactcatcaaggacggggggcggaaaacctgctctcccggctgatgattaaacccggggattatgtgcccggcaatatgtattttaccaccacaagataccatcaggaagccaacggagctaccttcagagatattatcattgatgaagcccatgactcagccaaccggcatcctttcaaaggaaatatcgatctcaggaaactccagaccttaatcgatgaagtaggcgcggagaagattccttacatctgccttgccgttactgtcaatctggccggaggacagcccgtttctctggaaaacatgaaggcggtccatgagcttgcccaccaacacggcatcaaggtgttttttgacgctacccgctgtgtggagaacgcttacttcatcaagaagcgggaagcagactaccaggacaagaccatcaaagaaattctcttggagatgatgagctatgccgacggagccaccatgtcgggtaaaaaagattgtatggtcaatatcggcggttttctggccatgaatgatgatgaattgttcctcagggctaaagaactggtggtggtctttgaaggaatgccttcttacggcggcatggccggccgggacatggaagccatggccatcgggattacggaatcggtggattatgcttatattgaacaccgtgtggagcaggtggcctatcttgccgatcagcttttagcggcgggggttcccattgtggaaccggtgggcggccatgccgtcttccttgatgccagacggtttttgccccaccttgagcaggaccacttcccggcacaggctctggccgcccaattatatatagaatccggggtacgctctatggaaagaggaatcatctccgccggacgtgatcttaaaacaggggaaaaccgccatcctaaactggagctggtaaggctgacgattccccgccgggtttatacttacgctcatatggacatcgtggccagagcggttattgagctttaccagcaaagggagaccatcaaagggcttaaatttgtttacgaaccggaaatgcttcgtttcttcaccgccagatttgaacacatttga

SEQ ID NO: 14924 - protein, 457 aa, Desulfitobacterium hafniense DCB-2
MKTYPAEPFRIKVVEPVRSMKRAEREEAMKEAGYNTFLLKSEDVYIDLLTDSGTTAMSDKQWAGMMIGDEAYAGSRNFLHLDRVVKEYYGFKHLVPTHQGRGAENLLSRLMIKPGDYVPGNMYFTTTRYHQEANGATFRDIIIDEAHDSANRHPFKGNIDLRKLQTLIDEVGAEKIPYICLAVTVNLAGGQPVSLENMKAVHELAHQHGIKVFFDATRCVENAYFIKKREADYQDKTIKEILLEMMSYADGATMSGKKDCMVNIGGFLAMNDDELFLRAKELVVVFEGMPSYGGMAGRDMEAMAIGITESVDYAYIEHRVEQVAYLADQLLAAGVPIVEPVGGHAVFLDARRFLPHLEQDHFPAQALAAQLYIESGVRSMERGIISAGRDLKTGENRHPKLELVRLTIPRRVYTYAHMDIVARAVIELYQQRETIKGLKFVYEPEMLRFFTARFEHI

SEQ ID NO: 14925 - DNA, 1389 bp, Desulfitobacterium hafniense DCB-2
  CDS (1)..(1389): transl_table=11
atggcaatcaagtatgtacccgaaccctttcgaattaaggtggtagagcccttgcggatgcttacccaagaagaaagagaagagaaaatcgccaaggctaattacaaccttttcaacttaaaaggagaggattgctacatcgatttgctgactgactccggaaccaatgccatgagccaggagcagtgggctggtgtgatgagaggcgacgaggcctatgcaggagcttccagctactttaaactcatggaagcaggcaaggatatttttggctttggctatatccaacctgttcaccaaggtcgtgcagcagagaaagttgtcttccccttactgctcagcgaaggtaaatttgcaatttccaacatgttttttgataccactcgcgcccatgtcatcttgtctggcgccagacccattgactgcgtggtagaagaagccaaagatccatccaaacgcgctccctttaaagggaatatggacgttgccaagatggaagaagtcatcaaagagaagggtccggaaaacattggtttggttgtcatgaccatcaccaacaactctgccggcggacaacccgtctccatgaaaaatcttcgtgaagtttctgctttagctaaaaaatatggtattcctatgtgcattgacgcagcccgctatgcggaaaatgctcacttcatcaaacgtgatgagccagaatacaaggacgtatccattaaagatattgttcgtgaaatgttcagctacggcgagctcttcactatgtcagctaagaaagacactatcgtcaatatgggcggcctccttggtgttaaagatgccgattcaccgctggtcttaaaaatcaaagctaattgcatcagttatgaaggcttcttcacttatggcggtctttccggtcgtgatatggaagccttggctatcggtctctacgagggaatcgatgaaaactatctccgttaccgaattggtcaaatggaatacctggcagcccgcttagatgatgccggtattgcctatcagtcccctgtcggcggccatggcgtatttgttgatgctgctgccatgttcccccatattccttacaatgagttccctggtcaggttctttgcgtggagctttataaagaagccggcattcggacttgtgatatcggttcttatatgctgggcaacgacccggataccggcgaacagctaaaggccgactttgaattcagccgccttgccataccacgccgggtctacacccaggcccatcttgacattatggctgatgccttgatcgcaattaaagaacgggctcacactattaaacgcggatataaaatcacttgggaaccccccattctgcgccacttccaggcatcactggcacccatcgagtaa

SEQ ID NO: 14926 - protein, 462 aa, Desulfitobacterium hafniense DCB-2
MAIKYVPEPFRIKVVEPLRMLTQEEREEKIAKANYNLFNLKGEDCYIDLLTDSGTNAMSQEQWAGVMRGDEAYAGASSYFKLMEAGKDIFGFGYIQPVHQGRAAEKVVFPLLLSEGKFAISNMFFDTTRAHVILSGARPIDCVVEEAKDPSKRAPFKGNMDVAKMEEVIKEKGPENIGLVVMTITNNSAGGQPVSMKNLREVSALAKKYGIPMCIDAARYAENAHFIKRDEPEYKDVSIKDIVREMFSYGELFTMSAKKDTIVNMGGLLGVKDADSPLVLKIKANCISYEGFFTYGGLSGRDMEALAIGLYEGIDENYLRYRIGQMEYLAARLDDAGIAYQSPVGGHGVFVDAAAMFPHIPYNEFPGQVLCVELYKEAGIRTCDIGSYMLGNDPDTGEQLKADFEFSRLAIPRRVYTQAHLDIMADALIAIKERAHTIKRGYKITWEPPILRHFQASLAPIE

SEQ ID NO: 14927 - DNA, 1443 bp, uncultured bacterium
  CDS (1)..(1443)
atgggcatccggctggccagcggaaagcagattcccatcgagatgcacaaggtgcggatcctgcagagcatacgactcccctcggttgatgaacggctgaaggccgccgaagagggcggctacaatacgtttctgctccgtacgcgcgacgtcttcctggacatgctcacggacagcggcgtcaacgcgatgagcgaccatcagctggcggggatgattgttgcggacgatgcctacgccggcggcgagagctactaccgtctggctgcggccgtcgaggaggtgctcggcttcaagctctgcatgccggcccaccagggccgggcctgcgagcacctgatagacaagatcctgctgcggccgggtcaggtggtgctgaccaactatcacttcaccaccacgcgggcgcacgtggagctgctgggcggccgcatgctggaactgtacgcggccgaggcgctgaacaccgcgagcacgcaccagttcaagggcaacattgatcccggccggctggacgagtgcctcgggaagtacggtcgcgacggcattgcctacgtgcggctcgaagccacgaccaacctgatcggtggccagccgttctccatggacaatctgcgcaccgtgcgccgcttctgcacggacaacaacctgccactggtgctcgacggcagcctgctgagcgagaacgcgtacctgatcagggaacgtgagagcggctacacggacaagagcgtggcggagatcatgaaggagatgtgctcgcacgcggacatctattacatgtctgcgcgcaagaacacgagcgtgcgcggcggcctcatcgccaccaacgaccgcaactactttgtcgcgctgcgcaactggctgccggtctatgagggattcctgacctacggcggcatgtcggtcaaggaagtcgaggcgatggcgatcggcctcagggagctggtgtcggaagacgtggccggctgttcggtgcgtcaggtgcgccacctcgtggacctgctgcagcagcagggcgtcccggtggtgacgccagccggcgggcttgcctgtcacctggacgctggcaagttcttgccgcacatcccgcagagccaatatcccgccggcgcgctcgcagccgccatatacctcgcctcgggaatccgcacgatggagcgcggcacgatctccaccgatcgcgaccccgatggcaaggagatcatgaccgacgtcgaactgacgcggatggcggtgccgcggcgcgtctacaccgtgtcgcacctcgagtacgcggccgacagcgtggtctggctgtacaagcatcgcgatctcgtgaagggcctccggttcgtggaggcaccgccggtgctgcggttcttcttcgggcgcctggaagcaatcgacaaccggggggccgcgttgtgcggggagtaccgcaaggagctgggcgactactag

SEQ ID NO: 14928 - protein, 480 aa, uncultured bacterium
MGIRLASGKQIPIEMHKVRILQSIRLPSVDERLKAAEEGGYNTFLLRTRDVFLDMLTDSGVNAMSDHQLAGMIVADDAYAGGESYYRLAAAVEEVLGFKLCMPAHQGRACEHLIDKILLRPGQVVLTNYHFTTTRAHVELLGGRMLELYAAEALNTASTHQFKGNIDPGRLDECLGKYGRDGIAYVRLEATTNLIGGQPFSMDNLRTVRRFCTDNNLPLVLDGSLLSENAYLIRERESGYTDKSVAEIMKEMCSHADIYYMSARKNTSVRGGLIATNDRNYFVALRNWLPVYEGFLTYGGMSVKEVEAMAIGLRELVSEDVAGCSVRQVRHLVDLLQQQGVPVVTPAGGLACHLDAGKFLPHIPQSQYPAGALAAAIYLASGIRTMERGTISTDRDPDGKEIMTDVELTRMAVPRRVYTVSHLEYAADSVVWLYKHRDLVKGLRFVEAPPVLRFFFGRLEAIDNRGAALCGEYRKELGDY

SEQ ID NO: 14929 - DNA, 1365 bp, Symbiobacterium thermophilum
  CDS (1)..(1365)
atgcccaagggcgagcccttcaagatcaagatggtggagcccatccggctgatcccccgggaggaccgtgagcgggcgctgaaggaagcgcattacaacccgttcttcctccgatcttctgacgtctacatcgacctgctcaccgactccggtacgggcgcgatgagccagttccagtggtccgccatgatgctgggcgacgagtcgtacgccggcgcaagcagctactacaggctgaaagagacggtcaccgacatcacggggtacgagtacgtcatcccgacccaccagggccgcggcgcagagaaggtcgccttctcgcagctcatcacccggccgggcatgtacgtgctttccaacatgttcttcgacacgacccgcggccacgtgcagctggccggcggccggcccgtcgatctgctcatcgacgtacccaccgaggagtaccaccccttcaagggcaacatggacacggagaggctggagcagttcatccgggagcacggtgcggagaacatcgcctgcatcgtgatgaccgtgaccaacaactccgcgggcgggcagcccgtctccatggccaacatccgggagacttaccagatcgcccggaagtacggcgtgctggtcctgttcgacgtggcccggtacgccgagaactgccacttcatccggatgcgggaggaaggctacgccgacaagcaccccatcgacatcgcccgggagatgttctcctacggcgacgggctgatgatgagtgccaagaaggacgcgctggtcaacatcggcgggctcctcgcctttcgggatgaggaactgttcaccaaggtcggcgcggccgtggtgccgttcgagggcttcctgacctacggcggcctggccgggcgcgatctggaggccatggcggtgggcctccgggaggcgctggaccccgactacctggcgtaccgggtggggcaggtgcagtacctgggcgagatgttgcggaacgcgggcatcccgatccagtggccggtgggcggccatgcggtgttcatcgatgccgcgaagttcctgccgcacgtcccgtgggaccagttccccggccatgccctgaccctcgcgctctacctggagggcggcgtgcgcaccgtagaggtcggctcgctgatgatcggccgcgaccccgagaccggcgagaacgtgcgaggcccgttcgagttcacccggctggcgattccgcggcgggtctacaccaacctgcacctggaggacgtcgccgagaccgtgatcaacgcctttcagaagcgcgaggagatccgcggcgtgaagttcgcccgggagcccaaggtgctccgccacttcacggcctggttcgacccggcttag

SEQ ID NO: 14930 - protein, 454 aa, Symbiobacterium thermophilum
MPKGEPFKIKMVEPIRLIPREDRERALKEAHYNPFFLRSSDVYIDLLTDSGTGAMSQFQWSAMMLGDESYAGASSYYRLKETVTDITGYEYVIPTHQGRGAEKVAFSQLITRPGMYVLSNMFFDTTRGHVQLAGGRPVDLLIDVPTEEYHPFKGNMDTERLEQFIREHGAENIACIVMTVTNNSAGGQPVSMANIRETYQIARKYGVLVLFDVARYAENCHFIRMREEGYADKHPIDIAREMFSYGDGLMMSAKKDALVNIGGLLAFRDEELFTKVGAAVVPFEGFLTYGGLAGRDLEAMAVGLREALDPDYLAYRVGQVQYLGEMLRNAGIPIQWPVGGHAVFIDAAKFLPHVPWDQFPGHALTLALYLEGGVRTVEVGSLMIGRDPETGENVRGPFEFTRLAIPRRVYTNLHLEDVAETVINAFQKREEIRGVKFAREPKVLRHFTAWFDPA

SEQ ID NO: 14931 - DNA, 1365 bp, Symbiobacterium thermophilum; identical to SEQ ID NO: 14897
  CDS (1)..(1365)

SEQ ID NO: 14932 - protein, 454 aa, Symbiobacterium thermophilum; identical to SEQ ID NO: 14898

SEQ ID NO: 14933 - DNA, 1386 bp, Chromobacterium violaceum
  CDS (1)..(1386): transl_table=11
atggcacgacgcattcccgaaccgttccgcatcaagatggtggagccgatccgccaaaccaccgccgaataccgccgccaggcgctgcaggaggccgggtggaatcccttcctgttgaaggccgaggatgtctatatcgatctgttgaccgacagcggcaccggcgcgatgtccgaccgccagtgggccggcctgatgatgggcgacgaggcctacgccggcagccgcaacttcctgcggctggccgacaccgtgcgcgagctgttcggctacgcgcacaccattcccacccaccaggggcgcggcgccgagcagatcctgtttccggagctggtgaagcgctgccgcggcgagcggccggtgtttctgtccaactaccatttcgacaccaccaaggcccatgtcgagctggccggcgcgcgcgcggtcaacgcgctgacgccgcgagcgctggacactggcgcggcctacgactggaagggcgacttcgatctggcgcggctgggcgagatcgtcgaggccgagggggaaaacgtcgcggccatcatcgtcaccgtcacctgcaacagcgccggcggccagccggtgtcgatggccaatatccgcgcggccagcgcactggcccgttcgaagggcattccggtggtgatcgacgcggcgcgcttcgccgagaacgcctggttcatccgcgaacgggatccggcctatgccggcgttgccatctcgtccatcgtgcgcgagatgttcgattacggcgacatgttcaccatgtcggccaagaaggacgggctggtcaatatcggcggcctgtgctgcttcaagaacgatgaggcgctgttccgcgcggtgcaggtgcgctgcgtgccgatggagggcttcatcacttacggcggcctggccggccgcgacatggaggcgttggccatcggcctgaaggagggcttggatgacgcttacctgagctatcgcatcggccaggtggcctacctgggcgagcggctgcgcgagggcggcgtgccgatccagaccccgaccggcggccacgcggtcttcgtcgacgccgcgcggctgctgccgcatatcccggccgggcagttccccgcgcacgcgctggcctgcgagctgtatctggaaggcggcgttagggcggtggagatcggttcgctgctgctggggcgccatccgcagaccggccggcaggagccgtcgccgttcgagctgatgcggctgacgataccgcggcgggtctacaccaacgaccatatggactacatcgccgactgcctgatagacgtgaagcggcgcgcggcgggggtgagagggctggttttcgactacgagccgccgatattgcgccacttcaccgcgcggctgcggccggcgtag

SEQ ID NO: 14934 - protein, 461 aa, Chromobacterium violaceum
MARRIPEPFRIKMVEPIRQTTAEYRRQALQEAGWNPFLLKAEDVYIDLLTDSGTGAMSDRQWAGLMMGDEAYAGSRNFLRLADTVRELFGYAHTIPTHQGRGAEQILFPELVKRCRGERPVFLSNYHFDTTKAHVELAGARAVNALTPRALDTGAAYDWKGDFDLARLGEIVEAEGENVAAIIVTVTCNSAGGQPVSMANIRAASALARSKGIPVVIDAARFAENAWFIRERDPAYAGVAISSIVREMFDYGDMFTMSAKKDGLVNIGGLCCFKNDEALFRAVQVRCVPMEGFITYGGLAGRDMEALAIGLKEGLDDAYLSYRIGQVAYLGERLREGGVPIQTPTGGHAVFVDAARLLPHIPAGQFPAHALACELYLEGGVRAVEIGSLLLGRHPQTGRQEPSPFELMRLTIPRRVYTNDHMDYIADCLIDVKRRAAGVRGLVFDYEPPILRHFTARLRPA

SEQ ID NO: 14935 - DNA, 1419 bp, Clostridium tetani
  CDS (1)..(1419): transl_table=11
atgatcatttattatttaaaattggagggatttaacatgaaaattaaatatgtggcagaaccatttaggattaaaatggtagaacctattaaaatgcttactcgtgaagaaagagaattaaaaattgctgaagcaaaatacaatacatttaaccttagaggagaagatgtatatattgatttattaacagatagtggaacaaatgcaatgagcgatgatcaatgggctggtgtaatgaagggtgacgaagcctatgcgggaggaaagagttactttaaattagtggatgcagtaaaagatatatttggatataaatttgttcaacctgtacaccaaggtcgtgcagcagaaaaagttctttttggattattattaggtgagggaaaatattctatatctaatatgcactttgatacaacaagagcacatgttgaattatcaggtgcaagagccattgattgtgttgtaccagaggcttctgatccaacagtaagaataccattcaaaggtaatatggatgttgaaaaacttgaaaaattaattaaagaacatggagcagacaaaattggagttgttgttatgactataacaaataactcagcaggaggtcaaccagtatccattgaaaatatgaaagaaacagctgaaatttgtaaaaagtataatattagactttgtatagatgcggcacgttatgcagaaaatgcttattttataaaacaacgtgaacctggttatgaaaacaaatccataaaggaaattattaaagaaatatttagttatgcagatatatttacaatgagtgcaaagaaagatgccattgtaaatatgggaggacttctaggaattaaagaagacgaagaattattccaattatgtaaaggtcgtacaatatccttcgaagggtttattacttatggaggactttcaggtcgcgatcttgagagtttggcgattggtctttatgaaggaattgatgaaaattacttaagatatagaataggacaaatggaatatcttgcagcacgtcttgacgaagcagggattgcttatcaatcaccagtaggtggacatggagtattcgtagatgctaagagtatgttcccacatattccatataatgagttccctggacaagttttagctgtagaactttataaagaagcaggaatacgcacatgtgaaattggatcttatatgttaggtaatgatccagatactggagaacaacttaaagcagattttgagtttacaagacttgcaattgcacgtcgtgtttatactcaagcgcatattgatattatggcagatgctttaattacaattaaggaaagagcaaacaccgttaaaggttatagaattacatgggaaccaccaatacttcgtcacttccaagcaagtcttgaaccattaaaataa

SEQ ID NO: 14936 - protein, 472 aa, Clostridium tetani
MIIYYLKLEGFNMKIKYVAEPFRIKMVEPIKMLTREERELKIAEAKYNTFNLRGEDVYIDLLTDSGTNAMSDDQWAGVMKGDEAYAGGKSYFKLVDAVKDIFGYKFVQPVHQGRAAEKVLFGLLLGEGKYSISNMHFDTTRAHVELSGARAIDCVVPEASDPTVRIPFKGNMDVEKLEKLIKEHGADKIGVVVMTITNNSAGGQPVSIENMKETAEICKKYNIRLCIDAARYAENAYFIKQREPGYENKSIKEIIKEIFSYADIFTMSAKKDAIVNMGGLLGIKEDEELFQLCKGRTISFEGFITYGGLSGRDLESLAIGLYEGIDENYLRYRIGQMEYLAARLDEAGIAYQSPVGGHGVFVDAKSMFPHIPYNEFPGQVLAVELYKEAGIRTCEIGSYMLGNDPDTGEQLKADFEFTRLAIARRVYTQAHIDIMADALITIKERANTVKGYRITWEPPILRHFQASLEPLK

SEQ ID NO: 14937 - DNA, 1389 bp, Enterobacter aerogenes
  CDS (1)..(1389): transl_table=11
atgaaacgtatccctgagccgttccgcattaaaatggtcgaaaatattcgtatgaccacctttgacgatcgcgtcaaagcgctgaaagaggcgggctataacccgtttttgctcaatagccaggacgtgtatatcgacctgctgaccgactccggcaccggcgcgatgagcgaccatcaatgggccgggctgatgatgggcgacgaagcctacgccgggtcgcgtaactatcagcatctgtgtgaaaaggtcaaagagattatcggctatccgtataccattcccacccaccaggggcgcggcgcggagcagattctgttcccaagcctgattgctcgccgcaagtcggcgcatccggtgtttatttccaacttccacttcgatactaccgccgctcacgtggagcttaacggcgcaaaagccattaacgtggtgacgccgaaagccttcgacacgacctcgtggtacgactggaaaggcaactttgatattgatttactgaaagcgaccatcgccgagcacggcgcggaaaacgtggcggcgattattactaccgtcacctgtaacagttccggcggccagccggtatcgctggcgaatatgcgcgaggtgtatcaaattgcgcgccagaacaatattccggtggtaatcgactccgcccgcttctgcgaaaacgcctggtttattaaacagcgcgaagagggctatgccgataaatcggtgaaagagattattctcgagatgtaccagtatggcgatatgctgaccatgtccgccaagaaagacccgatggtgaatattggcggactgtgctgcttccgcgatgacgaagagctcttcaacgaagtacgcattcgctgcgtgccgatggaaggctttgtcacctacggcggcctggcggggcgcgatatggaggcgctggctatcggtctggaagaagggaccaacgaggattacctcgcttatcgcatcaatcaggtggagtacctcggtgaacgcctgcgcgaaggcggcattccgattcagtatccgaccggcggccatgcggtgttcgtcgatgctaagctgctgctgccgcatattccgccggagcagttcccggcgcacgcgctaaacaacgagctgtatctggaagcgggcattcgcagcgtggaaatcggctccctgctgctgggacgcgacccggaaaccggtaagcagaaggcgtcgccgatggagctgctgcgcctgaccattccgcgtcgggtttataccaacgatcatatggactatatcgctgatgcgctgatcgccgttaaggcgcgcgccgccacgattaagggcctgacctttacctatgaaccgccggtactgcgccacttcgtcgccagactgaaaccggtgaaataa

SEQ ID NO: 14938 - protein, 462 aa, Enterobacter aerogenes
MKRIPEPFRIKMVENIRMTTFDDRVKALKEAGYNPFLLNSQDVYIDLLTDSGTGAMSDHQWAGLMMGDEAYAGSRNYQHLCEKVKEIIGYPYTIPTHQGRGAEQILFPSLIARRKSAHPVFISNFHFDTTAAHVELNGAKAINVVTPKAFDTTSWYDWKGNFDIDLLKATIAEHGAENVAAIITTVTCNSSGGQPVSLANMREVYQIARQNNIPVVIDSARFCENAWFIKQREEGYADKSVKEIILEMYQYGDMLTMSAKKDPMVNIGGLCCFRDDEELFNEVRIRCVPMEGFVTYGGLAGRDMEALAIGLEEGTNEDYLAYRINQVEYLGERLREGGIPIQYPTGGHAVFVDAKLLLPHIPPEQFPAHALNNELYLEAGIRSVEIGSLLLGRDPETGKQKASPMELLRLTIPRRVYTNDHMDYIADALIAVKARAATIKGLTFTYEPPVLRHFVARLKPVK

SEQ ID NO: 14939 - DNA, 1419 bp, Haemophilus influenzae
  CDS (1)..(1419): transl_table=11
atggaaaattttaaacatttacctgaacctttccgcattcgtgttattgaaccagtaaaaagaactactcgtgagtatcgtgagcaagcgatcttaaaatcaggcatgaatccatttttattggatagtgaagatattttcattgacttacttacagatagcggtactggtgccgttacacaagatatgcaagctgcaatgttacgtggcgatgaagcctatagtggcagtcgcagttattatgcgttagctaaagcagtgaaagatatttttggttatgaatatacaattcctactcatcaaggccgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgacggtttagcgatgtccgccaaaaaagatgctatggtgccaatgggggggattttagcgtttaaagataaatcaatggaggaagtctatcacgaatgtagaacgctttgtgttgtgcaagaagggttccctacttatggtggtttagaaggtggtgcaatggaacgcttggctgttggcttacatgatggtatgcgtcaagaatggctggcttatcgtattgcgcaaattgaatatttggttgcaggcttagaaaaaattggtgtgctttgccaacaaccaggtggccacgctgcgttcgtagatgcgggtaaattattaccacatattccagccgaccaattcccagcacaagcactttcttgcgaactttataaagttgcaggtataagagcggtagaaattggctcatttttattagggcgagatccgaagacgggtaaacaactaccatgtccagcagagcttttacgcttaactgtaccacgtgcaacttatacgcaaactcatatggatttcattattgaggcgttccaaaaagtgaaagaaaatgcggagaatattaagggtttaacctttacttatgaaccaaaagttctccgccactttacggcacgtttaaaagaagttgaataa

SEQ ID NO: 14940 - protein, 472 aa, Haemophilus influenzae
MENFKHLPEPFRIRVIEPVKRTTREYREQAILKSGMNPFLLDSEDIFIDLLTDSGTGAVTQDMQAAMLRGDEAYSGSRSYYALAKAVKDIFGYEYTIPTHQGRGAEQIYIPVLIAKREREKGLDRSKMVVFSNYFFDTTQGHSQINGATVRNVYIKEAFDTTAKHPFKGNFDLEKLEKGIQEAGAHNVPYIVCTITCNSAGGQPVSIANLKGMYEIARKYDIPVIMDSARFAENAYFVQQREEAYKDWTIEQITYESYRYADGLAMSAKKDAMVPMGGILAFKDKSMEEVYHECRTLCVVQEGFPTYGGLEGGAMERLAVGLHDGMRQEWLAYRIAQIEYLVAGLEKIGVLCQQPGGHAAFVDAGKLLPHIPADQFPAQALSCELYKVAGIRAVEIGSFLLGRDPKTGKQLPCPAELLRLTVPRATYTQTHMDFIIEAFQKVKENAENIKGLTFTYEPKVLRHFTARLKEVE

SEQ ID NO: 14941 - DNA, 1347 bp, Halobacterium salinarium
  CDS (1)..(1347)
atgcgttctcacacagccacgatggtcgaccgcatcgaggacaccagccgggcggaccgcgaggccgcgctcgccgacgccggccacaacgtcttcgaactcgcaagcgacgacgtggccgtcgacctgctgaccgattcgggaaccggaaccatgagcaacgaccagtgggcggccatgctgcagggcgacgaagcctacgccggcagtgccagcttcgaggacctcgcggtcgccgccgaggacgtgatggggttccagcatatcatccccgcccaccagggccggggcgctgaaaacgtcctctacggggcggtgctctcggctggggacaccgttctgaacaacgcccacttcgacaccacgcgggcgcacgtcgccgccaacgacgccacgcccgtcgactgccccgtcgacggcgcgcgcgaccccgacaccgacgccccgttcaagggcaacttctcggtcgaacgcgcccgccgcgtcgtcgacgacgtcggcgcggacgccgtccccgtcgtcgtgctcaccatcaccaacaactccatggccggccagccggtcagcatcgagaacacccgcgaggtcgccgcgttcgccgacgacatcgacgccacgttcgtcatcgacgcctgccggttcgccgagaacgcccacttcgtccagcagcgcgaacccggctacgagcacgactccgtcgccgccatcgcccgcgagcagctctcgtacgccgacgcctgcgtcatgagcgggaagaaagacggcctggtcaacgtcggcgggttcgtcggcctccacgacgacggccgcctccacgagcagtgccgccagcgcggcatcctctacgagggcttctcgacgtacggcgggatgtccggccgcgacatggcggcgttcgccgtcggcctccgggaggccgtcgaaccgccgtacgtcgccgaacgcgtcgcccaggtccagcggctcgcggacgccctcaccgaccgcgatgtccccatctaccagccggccggcggccacgccgtctacatcgacgccaacgccgcgctcccccacctcccacgcgagcagttccccgggcaggcgttcgtctgtgagctctaccgcgagggcggcgttcgcgccgtggaactcggccggttcgcgttccccgacaccgaccgccgcgacctcgttcggctcgcgctcccccgccgcacgtacggccccgaccacctcgaccacgtcgccgacaccgccgccgcggtctgcgagcgcggcaccgacgtcaccggcctggagatcgtctccgaacccgaactgaccgaactccggcatttctccgcggccctccagccggtcgcgtaa

SEQ ID NO: 14942 - protein, 448 aa, Halobacterium salinarium
MRSHTATMVDRIEDTSRADREAALADAGHNVFELASDDVAVDLLTDSGTGTMSNDQWAAMLQGDEAYAGSASFEDLAVAAEDVMGFQHIIPAHQGRGAENVLYGAVLSAGDTVLNNAHFDTTRAHVAANDATPVDCPVDGARDPDTDAPFKGNFSVERARRVVDDVGADAVPVVVLTITNNSMAGQPVSIENTREVAAFADDIDATFVIDACRFAENAHFVQQREPGYEHDSVAAIAREQLSYADACVMSGKKDGLVNVGGFVGLHDDGRLHEQCRQRGILYEGFSTYGGMSGRDMAAFAVGLREAVEPPYVAERVAQVQRLADALTDRDVPIYQPAGGHAVYIDANAALPHLPREQFPGQAFVCELYREGGVRAVELGRFAFPDTDRRDLVRLALPRRTYGPDHLDHVADTAAAVCERGTDVTGLEIVSEPELTELRHFSAALQPVA

SEQ ID NO: 14943 - DNA, 1416 bp, Pasteurella multocida
  CDS (1)..(1416): transl_table=11
atggaaaacttcaaacatttaccagagccgtttcgtattcgtgtgattgagccagtgagaagaaccacgcgttcgtaccgtgaagaagccattttaaaggcgggaatgaacccattcttactagacagtgaagatgtgtttatcgatctcttaactgacagtggaacaggtgcagtaacacaggaaatgcaagcggcgatgttacgtggcgatgaagcatacagtggtagtcgtagctatcatgcgttagcgaatgcggtgaaagagatttttggttatgaatatacaattccaactcaccaaggtcgtggtgcagaacaaatttatattcccgtattaattaaaaagcgcgagcaagaaaaaggcttagatcgtagcaaaatggtggtgttctctaactatttcttcgataccacacaaggtcatagccaaattaatggtgcgacagtacgcaacgtttatacaaaagaagcgtttgataccagtgttaacgccgatttcaaaggggattttgatcttgaaaaattagaacaagggattcaagaagtcggtgctgaaaacgtcccatatattgtttgcaccattacgtgtaactctgcgggtggtcagcctgtatcattagccaatatgcgagcgatgtatgagattgcgaaaaaatatgatattccagtcgttatggattctgcccgttttgcagaaaatgcctatttcatccaacaacgtgaacctggctataaagagtggacgatcgaacaaatcacttatgaaagctataaatatgctgatgctttagcgatgtctgcgaaaaaagatgcgatggtgccaatgggtggcttactctgctttaaagataaatccatggaagacgtgtataacgagtgtcgtacactttgtgtcgtacaagaaggcttcccgacctatggcggtttagaagggggcgcaatggagcgtttagcggtggggctacgtgatggtatgcgtcaagattggttagcgtatcgtattaatcaaattgagtatttggtgaatggtttagaagcgattggcgtcgtatgtcaacaacctggtggtcacgcggcatttgttgacgcaggaaaattgttaccacatattccagccgatcaattccctgcgcaagcccttgcttgtgaactttataaggtggcgggaattcgtgcagtagaaatcggttcgttcttattaggtcgtgatccaaaaaccggtaaacaattgccttgtcctgcggagttattacgtttaacgattcctcgtgcaacttatactcaaacgcacatggacttcattattgaagcatttaagcaagtcaaagaaaatgcagaaaatattaaagggttaacctttacttatgagccaaaagttttacgtcacttcacggcacgcttaaaagaagtataa

SEQ ID NO: 14944 - protein, 471 aa, Pasteurella multocida
MENFKHLPEPFRIRVIEPVRRTTRSYREEAILKAGMNPFLLDSEDVFIDLLTDSGTGAVTQEMQAAMLRGDEAYSGSRSYHALANAVKEIFGYEYTIPTHQGRGAEQIYIPVLIKKREQEKGLDRSKMVVFSNYFFDTTQGHSQINGATVRNVYTKEAFDTSVNADFKGDFDLEKLEQGIQEVGAENVPYIVCTITCNSAGGQPVSLANMRAMYEIAKKYDIPVVMDSARFAENAYFIQQREPGYKEWTIEQITYESYKYADALAMSAKKDAMVPMGGLLCFKDKSMEDVYNECRTLCVVQEGFPTYGGLEGGAMERLAVGLRDGMRQDWLAYRINQIEYLVNGLEAIGVVCQQPGGHAAFVDAGKLLPHIPADQFPAQALACELYKVAGIRAVEIGSFLLGRDPKTGKQLPCPAELLRLTIPRATYTQTHMDFIIEAFKQVKENAENIKGLTFTYEPKVLRHFTARLKEV

SEQ ID NO: 14945 - DNA, 1401 bp, Photorhabdus luminescens
  CDS (1)..(1401): transl_table=11
atgaaacgtattccagaacctttccgtattaaaatggtagaaaatattcgcatgactactcgtgccgaacgtgaaaaagcattagaagaagccggatataatccattcttattacccagtgacgcggtttatattgatttgctgacagattctggcactggagcaatgagtgatcgccagtgggcggggataatgatgggggatgaagcttatgcaggttcccgtaactattatcatctatgtgataaagtcaatgaattaattggctaccaatatactattccaacccatcaagggcgtggagcagaacagattttatttccgacattaattgctcgtaaaaaagcgcaaggtggtgcaacgcatccggtctttatttctaatttccattttgatacgacagcggctcatgttgaattaaatggcgcgaaagcgattaatgttgttacgtcaaaagcctttgatacaaccacctattatgattggaaaggcgattttgatattgatgaattggaaaaaacgatagcagaacatggcgctgataatgttgtcgcgattatcacaacggttacctgtaatagttccggtggtcagcctatctctctcgctaatatgaaagccgtgtatgagattgcaaagcaacatgatattcctgtggtgattgattcagcccgtttctgtgaaaatgcttggtttattaagcaaagagaaaagggttatgaaaataaatccgttaagcagatcgtcaaggagatgtatcaatatggtgatatgttaaccatgtcagctaaaaaagatcccttggtcaatattggtggtctttgttgtttccgtgatgatgaagatctctttaatgaagtgcgtacccgctgtgtgccaatggaagggtttgtgacttatggcggtcttgccgggcgcgatatggaagcattggcaattggtcttgaagaggggatgaatgagggttatctggcatatcgtattaatcaggtggcttatttaggtaatagattaagagatgcaggtattcctattcaatatccaaccggtggtcatgctgtatttgttgatgctaaattattattaccgcatattccaggggaacaattccccgctcatgcattgaataatgaattatatctggaggcgggaataagaagtgtggaaattggttctttgttattaggtcgtgatccaaaaaccggaaaacagaaaccatcaccgatggaacttttgcgattaactattcctcgtcgcgtttatactaatgatcatatggattatgttgtagaagcctttatttccttgaaggagagaattcctcagattaaaggattaacgtttacttatgaaccatccgtattacgtcatttcgttgcaagattaaaaccaattaaataa

SEQ ID NO: 14946 - protein, 466 aa, Photorhabdus luminescens
MKRIPEPFRIKMVENIRMTTRAEREKALEEAGYNPFLLPSDAVYIDLLTDSGTGAMSDRQWAGIMMGDEAYAGSRNYYHLCDKVNELIGYQYTIPTHQGRGAEQILFPTLIARKKAQGGATHPVFISNFHFDTTAAHVELNGAKAINVVTSKAFDTTTYYDWKGDFDIDELEKTIAEHGADNVVAIITTVTCNSSGGQPISLANMKAVYEIAKQHDIPVVIDSARFCENAWFIKQREKGYENKSVKQIVKEMYQYGDMLTMSAKKDPLVNIGGLCCFRDDEDLFNEVRTRCVPMEGFVTYGGLAGRDMEALAIGLEEGMNEGYLAYRINQVAYLGNRLRDAGIPIQYPTGGHAVFVDAKLLLPHIPGEQFPAHALNNELYLEAGIRSVEIGSLLLGRDPKTGKQKPSPMELLRLTIPRRVYTNDHMDYVVEAFISLKERIPQIKGLTFTYEPSVLRHFVARLKPIK

SEQ ID NO: 14947 - DNA, 1398 bp, Proteus inconstans
  CDS (1)..(1398): transl_table=11
atggctaaaagaattgtagaaccattccgcattaaaatggtagaaaatatccgtattccaagtagagaagaacgtgaagtcgctttaaaagaagcgggatataacccctttttactaccaagtagtgctgtgtatattgacttattaactgactcaggcactacgcgatatgatcatcatggcagcatgatcacaggggatgaggcgtatgcaggatctcgcaactattatgatttaaaagataaagttaaagaaatgtttgattacgattatgtgatccccgctcaccaaggtcgtggtgctgaaaacatgcttttcccagtattattaaaagttaaacaggaacaaggaggagcgaaaaaacccgtatttatttctaacttccactttgatacaacagcagctcacgttgaattaaaccattgtaaagcaattaatattgttaccgaaaaagcctatgactcagatacctatgatgactggaaaggtaactttgatattcaaaaattaaaagataatattgcgccagagtggtgcagaaaacgttgttgccattatttctctattacttgtaatagtgccggtggccagcccgtgtctatggccaatttaaaagaagtatatgaaattgcaaaacaccataacatttttgttgttatggactctgcgcgcttctgtgaaaatgcctattttattaaagaacgtgatcctaaatataaaaacgcgaccattaaagagatcattcttgatatgtataaatatgctgatgcattaacaatgtcagcgaaaaaagacccattattaaatattggtgggttagtctgtattaaaaatgatgagaagatctttactctagcaagacagcgctgtgtgccaatggaaggtttcgtgacctatggtggactggctggtcgtgacatggccgcaatggtacaaggtctcgaggaaggggctggagaagagtatttacattatcgtatcgggcaagttaaatacttaggtgatcgcttgcgtgaaggcggtatttcaattcagtatcctacaggcggccatgcggtattcgttgactgtaagaaacttgttccacatattcctggtgatcagttcccagcacaagcggtaattaatgcgctgtatttagaatcgggtgttcgtgccgttgaaattggatcattcttattaggacgagaccctgaaactggcaaacaaaagcatgcagatatggaatttatgcgattaactattgcgagacgtgtatataccaatgaccatatggattatattgcagatgctctcattggtttaaaagataaatttgcgaccctcaaaggccttgactttgaatatgaaccgccagttttaagacattttactgcgcgattaaaaccaatcaaataa

SEQ ID NO: 14948 - protein, 465 aa, Proteus inconstans
MAKRIVEPFRIKMVENIRIPSREEREVALKEAGYNPFLLPSSAVYIDLLTDSGTTRYDHHGSMITGDEAYAGSRNYYDLKDKVKEMFDYDYVIPAHQGRGAENMLFPVLLKVKQEQGGAKKPVFISNFHFDTTAAHVELNHCKAINIVTEKAYDSDTYDDWKGNFDIQKLKDNIAPEWCRKRCCHYFSITCNSAGGQPVSMANLKEVYEIAKHHNIFVVMDSARFCENAYFIKERDPKYKNATIKEIILDMYKYADALTMSAKKDPLLNIGGLVCIKNDEKIFTLARQRCVPMEGFVTYGGLAGRDMAAMVQGLEEGAGEEYLHYRIGQVKYLGDRLREGGISIQYPTGGHAVFVDCKKLVPHIPGDQFPAQAVINALYLESGVRAVEIGSFLLGRDPETGKQKHADMEFMRLTIARRVYTNDHMDYIADALIGLKDKFATLKGLDFEYEPPVLRHFTARLKPIK

SEQ ID NO: 14949 - DNA, 1404 bp, Proteus vulgaris
  CDS (1)..(1404): transl_table=11
atggctaaaagaatcgtagaaccgttccgtattaaaatggtagaaaaaatccgagttccttcaagagaagaacgtgaagcagcattaaaagaagcaggatataacccatttttactaccaagcagcgcggtatatattgatttattgactgactctggaactaacgcaatgagtgatcatcaatgggcagcgatgattacaggtgatgaagcctatgcgggttcaagaaactattatgatttaaaagataaagcaaaagaactttttaattatgattatattattccagctcaccaaggtcgtggcgctgagaatattctttttcctgtgctattaaaatataaacaaaaagaaggaaaagcgaaaaacccagtttttatttctaacttccactttgatacaaccgctgcccacgtagaattaaatggttgtaaagcaattaatattgttactgaaaaagccttcgattcagaaacctatgatgattggaaaggcgattttgatattaaaaaattaaaagagaatattgcacaacacggtgctgataatattgttgctattgtatcaaccgtgacttgtaatagtgccggcggccagcctgtttctatgagtaatttaaaagaagtttatgaaatagcgaaacaacacggtatttttgttgtgatggattcagctcgtttttgtgagaatgcttattttattaaagcgcgtgatcctaaatataaaaatgccactattaaagaagttatttttgatatgtataaatatgctgatgcattaacaatgtcagcgaaaaaagatccattattaaatatcggtggtttagtcgctattcgtgataatgaagagatatttactttagccagacaacgttgtgtacccatggaaggctttgtaacctatggtggtttagctggtcgtgatatggctgcaatggtacaaggtttagaagaaggaactgaagaagagtatctgcactatcgtattggtcaagttaagtatttaggtgatcgcttacgtgaagcgggtattccaattcaatatcctactggtgggcatgcggttttcgttgactgtaaaaaattagttccgcaaattccgggtgatcaatttcctgctcaagcagttattaatgcactttatctggagtcaggtgtgcgtgcggtagaaattggttcattcttattaggtcgtgatcctgcaacgggtgaacaaaaacatgctgatatggaatttatgcgtttaactattgcacgccgtgtttataccaatgaccatatggattatattgctgatgcattaattgggttaaaagagaagtttgcaacacttaaaggtctagagttcgaatatgaaccacctgtattaagacactttactgcaagattaaaacctatcgaataa

SEQ ID NO: 14950 - protein, 467 aa, Proteus vulgaris
MAKRIVEPFRIKMVEKIRVPSREEREAALKEAGYNPFLLPSSAVYIDLLTDSGTNAMSDHQWAAMITGDEAYAGSRNYYDLKDKAKELFNYDYIIPAHQGRGAENILFPVLLKYKQKEGKAKNPVFISNFHFDTTAAHVELNGCKAINIVTEKAFDSETYDDWKGDFDIKKLKENIAQHGADNIVAIVSTVTCNSAGGQPVSMSNLKEVYEIAKQHGIFVVMDSARFCENAYFIKARDPKYKNATIKEVIFDMYKYADALTMSAKKDPLLNIGGLVAIRDNEEIFTLARQRCVPMEGFVTYGGLAGRDMAAMVQGLEEGTEEEYLHYRIGQVKYLGDRLREAGIPIQYPTGGHAVFVDCKKLVPQIPGDQFPAQAVINALYLESGVRAVEIGSFLLGRDPATGEQKHADMEFMRLTIARRVYTNDHMDYIADALIGLKEKFATLKGLEFEYEPPVLRHFTARLKPIE

SEQ ID NO: 14951 - DNA, 1365 bp, Rhodobacter capsulatus
  CDS (1)..(1365): transl_table=11
atgaaaaccatcatcgaacctttccgcatcaaatcggtcgagccgatccgcctcacctcgcgccccgagcgtgaacgcctggcgcgcgcggccggatacaaccttttcggcctgcactcggatgacgtgctgatcgaccttctgaccgacagcggcaccggcgcgatgtcgtccttgcaatgggccgcggtgatgcagggcgacgaaagctatgccggctcgcccagcttcttccgctttgaagccgcggtgcaaaatctgatgcccttcaagcacatcatcccgacgcatcagggccgcgcggcggaagcgatcctgttctcgatcttcgggggcaagggccgtcgcatcccctcgaacacccatttcgacaccacgcgcggcaatatcgaggcctcgggcgccacgggcgacgatctggtgattgccgagggcaaggacccgcaaaacctgcatccgttcaagggcaacatggatctggcgcggctggaggcttaccttgaggcgcatcacgccgaggtgcccttggtgatgatcaccatcaccaacaatgcgggcggcgggcagccggtgagcctggccaatatccgcgccgtcgccgatctggcgcatcggtatggcaagcctttcgtgatcgacggctgccgctttgccgaaaacgcctggttcatcaagacccgcgaggagggtcaggccgatcgctcgatccccgagatcgtgcgtgactgcttcgcggtggcggatggcatgacgatgtcggcgaaaaaggacgcctttggcaatatcggcggctggctggcgctgaacgacgacgatctggccgaggaggcgcgcgggcatctgatccggaccgaggggttcccgacctatggcgggctggcggggcgtgacttggacgcgctggcgcaggggctggtcgagatcgtcgacgaggattacctgcgctaccgcatccgcacgcatcaatatatcgtcgagcggctggatgcgatgggggttccggtggtgaagcccgcgggcgggcatgcggtcttcatcgacgcgcgggcctggctttcccatatcccgccgctcgaataccccgggcaggcgctggcggtggcgctttatgaaattgcaggcgtccggtcctgcgagatcggcacggcgatgttcggccgccagcccgacggatcggaaaagcccgcggcgatggatctggtgcggctcgccttcccgcgccggacctatacgcaaagccacgccgattacatcgtcgaggctttcgaggagctggcggcaacgaaagacgccctgcgcggctaccggatcgtcaaggagccgaagctgatgcggcatttcacctgccgcttcgagaaactctga

SEQ ID NO: 14952 - protein, 454 aa, Rhodobacter capsulatus
MKTIIEPFRIKSVEPIRLTSRPERERLARAAGYNLFGLHSDDVLIDLLTDSGTGAMSSLQWAAVMQGDESYAGSPSFFRFEAAVQNLMPFKHIIPTHQGRAAEAILFSIFGGKGRRIPSNTHFDTTRGNIEASGATGDDLVIAEGKDPQNLHPFKGNMDLARLEAYLEAHHAEVPLVMITITNNAGGGQPVSLANIRAVADLAHRYGKPFVIDGCRFAENAWFIKTREEGQADRSIPEIVRDCFAVADGMTMSAKKDAFGNIGGWLALNDDDLAEEARGHLIRTEGFPTYGGLAGRDLDALAQGLVEIVDEDYLRYRIRTHQYIVERLDAMGVPVVKPAGGHAVFIDARAWLSHIPPLEYPGQALAVALYEIAGVRSCEIGTAMFGRQPDGSEKPAAMDLVRLAFPRRTYTQSHADYIVEAFEELAATKDALRGYRIVKEPKLMRHFTCRFEKL

SEQ ID NO: 14953 - DNA, 1389 bp, Thermoanaerobacter tengcongensis
  CDS (1)..(1389): transl_table=11
gtgtacgatgatttgacgagaatggctgagccttataagatcaaaatggtggagccgttgaaaattaccacgagggaagagagaataaggcttatcaaagaagccgggtataacttgtttttattaaaatctgacgacgtgtacattgaccttttgactgatagcggcactgctgcgatgagcgattatcaatgggcaggtatgatgctgggggatgaatcttacgcaggaagcagaaactatcagcatttgtgcgaagttgttcaagatatttttggctataagtacgttgtgccaacccatcaagggcgcggagctgaaaaggtgttgtttcctcttctcataaagaagggacagtatgtacttggtaacatgcattttgataccacaaaggcccatattgagctagcaggcggaattggtatagacatggtgataaaggaagctgaggacacagaaaactaccatccttttaaaggaaattttgatgttgaagctttggaaaatttcataaaagaaaaaggtgctgaaaacatagcttttattttagcaacggtgacctgcaacagtgcgggtggacagcctgtttcaatggaaaacataaaagaagtgaggagaattgctgataagtacggtatcaggcttttctttgatgcagcaagatttgcagagaatgcctatttcataaaacagagagaaaaaggctatgaaaacaaatccattaaagaaatagtaagagaaatgttctcctacggcgatggcttcacaatgtctgccaaaaaagatgcgctggtaaacatcggcggccttatcgctataaaggaggatgaggagctttttacaagggttaagacgatgctcatacctatggaaggttttgtaacatacggcgggctcgctgggagagacatggaggctatggcgagaggcttagaagaagttcttgatgaaaattaccttgcttggagaataaatcaggtaaaatatttgggggacaagttgagagaggcaggcataccgattcagtacccgactggcggtcatgctgtatttatagatggcaaaaagtttttgcctcacgtgcctcaggaacaatttccttcccacgcaatttgcgtagaactttatatagaagcaggaattagggctgtagaagtaggtgctcttctagcaggaagggacccagagacaggtcaaaacaggcttccaaaacttgattttgtccgacttaccattcctaggagagtttacacgaacagtcacatggacgtggtagcagaagcagtgaagagggtatatgctagaagagaccaaataaagggttataggtttgtatatgaacctccaattttgagacatttcactgctagattagagcctgtagaatga

SEQ ID NO: 14954 - protein, 462 aa, Thermoanaerobacter tengcongensis
MYDDLTRMAEPYKIKMVEPLKITTREERIRLIKEAGYNLFLLKSDDVYIDLLTDSGTAAMSDYQWAGMMLGDESYAGSRNYQHLCEVVQDIFGYKYVVPTHQGRGAEKVLFPLLIKKGQYVLGNMHFDTTKAHIELAGGIGIDMVIKEAEDTENYHPFKGNFDVEALENFIKEKGAENIAFILATVTCNSAGGQPVSMENIKEVRRIADKYGIRLFFDAARFAENAYFIKQREKGYENKSIKEIVREMFSYGDGFTMSAKKDALVNIGGLIAIKEDEELFTRVKTMLIPMEGFVTYGGLAGRDMEAMARGLEEVLDENYLAWRINQVKYLGDKLREAGIPIQYPTGGHAVFIDGKKFLPHVPQEQFPSHAICVELYIEAGIRAVEVGALLAGRDPETGQNRLPKLDFVRLTIPRRVYTNSHMDVVAEAVKRVYARRDQIKGYRFVYEPPILRHFTARLEPVE

SEQ ID NO: 14955 - DNA, 1419 bp, Vibrio cholerae
  CDS (1)..(1419): transl_table=11
atggaaaattttaaacacttaccagaaccttttcgtattcgtgttattgaaccagttaaacgcaccacacgggaatatcgtgaaaaggcgattttaaatgccggaatgaacccctttttgctcgatagtgaagatgtatttattgacctgctcaccgacagcggcactggcgctatcacgcaggagatgcaagccgcgatgttccgtggtgatgaagcctacagcggcagccgcagctaccacgcactcgcgagagcggttaaagatatttttggttatgaatacacgattccgacccaccaaggtcgtggtgcagagcagatttatattcctgttttgattaaaaagcgtgaaaaagagaaaggactcgatcgcagtaaaatggtcgcactatctaactactttttcgataccactcaaggccatacccaaattaactgctgtgttgctaaaaacgtgtacaccgaggaagcgtttgatactggtgtcaaagctgattttaaaggcaatttcgacttagaaaagctcgaacaagccatccttgaagcgggcccagcaaacgtcccatatattgtcagcaccatcacttgtaactctgcgggtggccagccagtttcgatcgccaacttaaaagccgtgtatgagattgcccagcgttacgacattcccgtgatcatggattctgctcgttttgctgaaaatgcgtattttattcagcaacgtgagcgtgattaccgcaactggagtatcgaagagatcacgcgtgaagcttacaaatacgccgatggactcgcgatgtcggccaaaaaggatgccatggtgcaaatgggcggcttactctgcttcaaagacgaaagcttctttgacgtgtacaccgaatgccgaaccctgtgtgtggtgcaagaaggcttccctacatacggtggcttagaaggcggtgcgatggagcggttggcggttggcttgtatgacggtatgcgccaagattggctcgcttatcgcattaaccaagtggagtatctggtcaatggtttagaagcgattggggttatttgccaacaagctggcggccatgctgcatttgtcgatgcgggtaaactgctgcctcacatcccagcagatcaattccctgctcacgctttagcttgtgaactctataaagtcgcaggcattcgcgcagtagaaattggctcattactactaggacgcgatcctgcaaccggaaaacagcatccttgcccagccgaattgctccgtttaaccattccacgcgcgacttatacgcaaacgcacatggatttcatcatcgaagcatttgagaaggtgaaagccaatgctcgtaacgtcaaaggattggagtttacttacgagccacccgtgctacgccactttacggctcgcttaaaagaaaaagcctaa

SEQ ID NO: 14956 - protein, 472 aa, Vibrio cholerae
MENFKHLPEPFRIRVIEPVKRTTREYREKAILNAGMNPFLLDSEDVFIDLLTDSGTGAITQEMQAAMFRGDEAYSGSRSYHALARAVKDIFGYEYTIPTHQGRGAEQIYIPVLIKKREKEKGLDRSKMVALSNYFFDTTQGHTQINCCVAKNVYTEEAFDTGVKADFKGNFDLEKLEQAILEAGPANVPYIVSTITCNSAGGQPVSIANLKAVYEIAQRYDIPVIMDSARFAENAYFIQQRERDYRNWSIEEITREAYKYADGLAMSAKKDAMVQMGGLLCFKDESFFDVYTECRTLCVVQEGFPTYGGLEGGAMERLAVGLYDGMRQDWLAYRINQVEYLVNGLEAIGVICQQAGGHAAFVDAGKLLPHIPADQFPAHALACELYKVAGIRAVEIGSLLLGRDPATGKQHPCPAELLRLTIPRATYTQTHMDFIIEAFEKVKANARNVKGLEFTYEPPVLRHFTARLKEKA

SEQ ID NO: 14957 - DNA, 1401 bp, Vibrio parahaemolyticus
  CDS (1)..(1401): transl_table=11
atgaaacgtattccagaacctttccgtatcaaaatggttgagccaatcaaaatgaccacgttggctgaccgagaaatcgctctcaaagaagcgggttacaacccatttttattgcgcagtgatgacgtgtatatcgatttgcttaccgattccggcacaggtgccatgagcgataaccagtgggctggcattatgttgggggatgagtcttacgcgggtagtcgtaactactacaacttatgcagcgcagtggagcatttcttcggctacaaactgacggtgcctgcgcaccaaggccgaggagcggagcagatattgttccctgctctgattgaacgtatgcgccaagtacgtggcggtgaaacgccagtgttcatctcgaactatcactttgatactactgcggggcatattgagctcaacggcggtaaggctatcaacgttgtgacggaagaagcgttcgataccacgacgccttacgattggaaaggtaacttcgacctcaacaaactggtagaaacgattgaagagcatggctcgaagaacatctgtgccatcatcacgacagtgacgtgtaacagctcgggtggccaaccggtatcgatggaaaacatgcgcagcgtgtacgaaattgccaccaaatacgatatcccagtggtgattgactcggctcgctattgtgagaatgcttatttcatcaaacagcgtgaagaaggttacgctgacaagtcgattttggaaatcattcgtgaaatgtatcaatacggcgatatgctcacgatgtctgccaagaaagatccaatggtgaacattggtggcatgtgttgtattcgtgatcatcaagagttgttccaagcggtgcaaacgcgctgcgttcctatggaaggttttgtcacttatggcggcatggctgggcgcgatatggaggctttagcccgaggtttgtatgagggcgcggatgaagacttcctgcattatcgaatcagtcaggtgcaatatttgggcgaacgtctgcgggaggggggaattccaatccaatatccaactggtggccatgcggtgtttgttgatgcggcgaaaatattgccgcacattccagccgatcagttcccagcacaagccttgtgtaatgcgttgtatctggaggctgggattcgagctgttgagattggctcattgttgctcggacgtgaccctgaaacgggtgaacagaaagcctctgagcttgaattaatgcgcttaacgattccacgtcgagtctatactaacgaccacatggactatatcgcggatgcgttgatcgagttgaagaaccgagctcatgaattgaaaggtttgatgttcgaatatgagcctccggttttacgtcactttacggctcgcttccgtgaaattgattaa

SEQ ID NO: 14958 - protein, 466 aa, Vibrio parahaemolyticus
MKRIPEPFRIKMVEPIKMTTLADREIALKEAGYNPFLLRSDDVYIDLLTDSGTGAMSDNQWAGIMLGDESYAGSRNYYNLCSAVEHFFGYKLTVPAHQGRGAEQILFPALIERMRQVRGGETPVFISNYHFDTTAGHIELNGGKAINVVTEEAFDTTTPYDWKGNFDLNKLVETIEEHGSKNICAIITTVTCNSSGGQPVSMENMRSVYEIATKYDIPVVIDSARYCENAYFIKQREEGYADKSILEIIREMYQYGDMLTMSAKKDPMVNIGGMCCIRDHQELFQAVQTRCVPMEGFVTYGGMAGRDMEALARGLYEGADEDFLHYRISQVQYLGERLREGGIPIQYPTGGHAVFVDAAKILPHIPADQFPAQALCNALYLEAGIRAVEIGSLLLGRDPETGEQKASELELMRLTIPRRVYTNDHMDYIADALIELKNRAHELKGLMFEYEPPVLRHFTARFREID

SEQ ID NO: 14959 - DNA, 1422 bp, Vibrio vulnificus
  CDS (1)..(1422): transl_table=11
atggataattttaagcatcttccagaaccctttcgtattcgcgttattgagccagtaaaacgcaccactcgcgagtatcgcgaagaagcaattttaaaagcgggcatgaaccctttcctactggatagtgaagatgtctttatcgacttgctgaccgacagtggcacaggggccatcactcaagatatgcaagcggcgatgttccgtggtgatgaagcgtacagtggcagccgcagttatcatgcattggccaacgccgtaaaagacatttttggttacgaattcaccattccgacacaccaaggccgtggtgcagagcagatctacattcctgtgttgatcaaaaaacgtgaaatcgaaaagggattggatcgctctaagatggttgccttgtcaaactacttcttcgataccacccaaggtcacacgcaaattaactgctgtgtggcgaaaaacgtctacaccgaagaagcctttgatacgggcgtgaaagccgactttaaaggcaattttgatttagaaaagctggaagaggcgattctcgaagcgggcccagccaatgtgccatacatcgtcagcaccatcacctgtaactctgctggcggccaaccggtgtcacttgccaacttaaaagcggtgtacgagattgctaaacgttacgatatcccagtgatcatggactctgcccgttttgccgaaaacgcctatttcattcagcaacgcgaaaaggattatcaaaactggagcatcgaggaaatcacccgcgaaagctacaaatacgctgatggtttggccatgtcagcgaagaaagacgccatggtacaaatgggcggtctgctttgcttcaaagatgaaagcttccttgatgtttatactgaatgccgcaccttgtgtgtggttcaagaaggcttccccacttatggtggcttagaaggcggtgcgatggagcgattagcggtgggtctatacgatggtatgcgccaagactggctagcctaccgaattaaccaggtggaatatttggtcaatggcctcgaaagcattggtgtagtttgccagcaagctggtgggcacgcggcctttgttgatgcgggtaaactgcttcctcatattcctgccgatcagttccctgcccatgctttagcgtgcgagctctataaggttgcgggtatccgcgcggtcgaaatcggctcgctgctactcgggcgcgatcccgcgacaggcaagcagcacccgtgtcctgcagagttactgcgcttaaccattccacgcgccacttatactcaaacgcacatggatttcatcatcgaagcatttggtaaagtcaaagccaatgcggcaaacgtcaaaggactcgagttcacctatgagccgcaggtccttcgtcactttaccgcgcgactgaaggaaatcgacgcataa

SEQ ID NO: 14960 - protein, 473 aa, Vibrio vulnificus
MDNFKHLPEPFRIRVIEPVKRTTREYREEAILKAGMNPFLLDSEDVFIDLLTDSGTGAITQDMQAAMFRGDEAYSGSRSYHALANAVKDIFGYEFTIPTHQGRGAEQIYIPVLIKKREIEKGLDRSKMVALSNYFFDTTQGHTQINCCVAKNVYTEEAFDTGVKADFKGNFDLEKLEEAILEAGPANVPYIVSTITCNSAGGQPVSLANLKAVYEIAKRYDIPVIMDSARFAENAYFIQQREKDYQNWSIEEITRESYKYADGLAMSAKKDAMVQMGGLLCFKDESFLDVYTECRTLCVVQEGFPTYGGLEGGAMERLAVGLYDGMRQDWLAYRINQVEYLVNGLESIGVVCQQAGGHAAFVDAGKLLPHIPADQFPAHALACELYKVAGIRAVEIGSLLLGRDPATGKQHPCPAELLRLTIPRATYTQTHMDFIIEAFGKVKANAANVKGLEFTYEPQVLRHFTARLKEIDA

SEQ ID NO: 14961 - DNA, 1371 bp, Citrobacter freundii
  CDS (1)..(1371): transl_table=11
atgaattatccggcagaacccttccgtattaaaagcgttgaaactgtatctatgatcccgcgtgatgaacgcctcaagaaaatgcaggaagcgggttacaatactttcctgttaaattcgaaagatatttatattgacctgctgacagacagtggcactaacgcaatgagcgacaagcagtgggccggaatgatgatgggtgatgaagcgtacgcgggcagcgaaaacttctatcatctggaaagaaccgtgcaggaactgtttggctttaaacatattgttccgactcaccaggggcgtggcgcagaaaacctgttatcgcagctggctattaaacctgggcaatatgttgccgggaatatgtatttcactaccacccgttatcaccaggaaaaaaatggtgcggtgtttgtcgatatcgttcgtgacgaagcgcacgatgccggtctgaatattgcgtttaaaggtgatatcgatcttaaaaaattacaaaagctgattgatgaaaaaggcgcagagaatattgcgtatatctgccttgcggtgacggttaacctcgcgggcggccaaccggtctcgatggctaacatgcgtgcggtgcgtgaactgacagaagcgcatggcattaaagtgttctacgacgctacccgctgcgtagaaaacgcctactttatcaaagagcaagagcagggctttgagaacaagagcatcgccgagatcgtgcatgagatgttcagctacgccgacggttgtaccatgagtggtaaaaaagactgtctggtgaacatcggcggcttcctgtgcatgaacgatgacgaaatgttctcttctgccaaagagttagtcgtggtctacgaagggatgccatcttacggcggcctggccggacgtgatatggaagcgatggcgattggcctgcgtgaagccatgcagtacgaatatattgagcaccgcgtgaagcaggttcgctacctgggcgataagctgaaagccgctggcgtaccgattgttgaaccggtaggcggtcacgcggtattcctcgatgcgcgtcgcttctgcgagcatctgacgcaagatgagttcccggcacaaagtctggctgccagcatctatgtggaaaccggcgtgcgcagtatggagcgcggaattatctctgcgggccgtaataacgtgaccggtgaacaccacagaccgaaactggaaaccgtgcgtctgactattccacgtcgtgtttatacctacgcacatatggatgttgtggctgacggtattattaaactttaccagcacaaagaagatattcgcgggctgaagtttatttacgagccgaagcagttgcgtttctttactgcacgctttgattacatctaa

SEQ ID NO: 14962 - protein, 456 aa, Citrobacter freundii
MNYPAEPFRIKSVETVSMIPRDERLKKMQEAGYNTFLLNSKDIYIDLLTDSGTNAMSDKQWAGMMMGDEAYAGSENFYHLERTVQELFGFKHIVPTHQGRGAENLLSQLAIKPGQYVAGNMYFTTTRYHQEKNGAVFVDIVRDEAHDAGLNIAFKGDIDLKKLQKLIDEKGAENIAYICLAVTVNLAGGQPVSMANMRAVRELTEAHGIKVFYDATRCVENAYFIKEQEQGFENKSIAEIVHEMFSYADGCTMSGKKDCLVNIGGFLCMNDDEMFSSAKELVVVYEGMPSYGGLAGRDMEAMAIGLREAMQYEYIEHRVKQVRYLGDKLKAAGVPIVEPVGGHAVFLDARRFCEHLTQDEFPAQSLAASIYVETGVRSMERGIISAGRNNVTGEHHRPKLETVRLTIPRRVYTYAHMDVVADGIIKLYQHKEDIRGLKFIYEPKQLRFFTARFDYI

SEQ ID NO: 14963 - DNA, 1383 bp, Clostridium tetani
  CDS (1)..(1383)
atggatttaagtaagtaccctgcagaaccttttaaaattaagagtgttgagcctgttaaaatgatttcaagagaagaacgtgaaatagctatgaaagaggctggatacaacacatttaatttaagatcagaggatgtatatattgatttacttactgactcaggaaccaatgctatgagtgatgctcaatgggcaggtatgatgattggagacgaagcttatgctggaagtaaaaactggttatttttagaatcaactataaaagaattatttggatttaaacatgttgttcctactcaccaaggacgtggtgcagaaaatctcctttcaagtatagctattaaaccagggcaatatgtagcaggaaatatgtattttacaactactagatatcatcaagaaaaaaatggtggtatttttgtagatataataagagatgaagctcacgatgcaagtatagatattccttttaaaggtaatattgatgttaataaattagaaaaacttattgaagaaaaaggtgcagaaaacatagcttatgtatgccttgctgttactgtaaatctagcaggtggacaaccagtttctatggctaatatgagagcagttagagaacttacagcaaaacatggaattaaggtattctatgatgctactagatgtgttgaaaatgcatattttataaaagaacaagaggaaggatatgcagatgtttcaattaaagatatagtacacgaaatgtttagctattccgatggtgctactatgtctggtaaaaaagatggtattgtaaatatcggtggattcttagcaattaatgatgaagagttatttggaaaagctaaagaaatagtagtagtttacgaaggtatgccatcctatggtggtatgactggccgtgatatgcaggctatagcaattggatttagagaagcaatgcaatatgaatatatagaacacagaataagacaggttagatatcttggagatagattaaaagaagcgggagttcctatagttgaaccagttggaggacatgctgtattcttagatgcaagaagattttgcccacatctagatcaagagcaattcccagctcaatcactagctgcttcactttacattgactctggtgttagatcaatggaacgtggtatagtttcagcaggcagagatgttaatacaggcgaaaatcataaaccaaaattagagacagttagacttactattccaagaagagtttacacttacaaacatatggatgttgttgctgaatcagttatacatctatataagcataaagaagatataagaccacttaaattcacttatgaacctgcacaattaagattctttactgcaaaatttgattatgcagactaa

SEQ ID NO: 14964 - protein, 460 aa, Clostridium tetani
MDLSKYPAEPFKIKSVEPVKMISREEREIAMKEAGYNTFNLRSEDVYIDLLTDSGTNAMSDAQWAGMMIGDEAYAGSKNWLFLESTIKELFGFKHVVPTHQGRGAENLLSSIAIKPGQYVAGNMYFTTTRYHQEKNGGIFVDIIRDEAHDASIDIPFKGNIDVNKLEKLIEEKGAENIAYVCLAVTVNLAGGQPVSMANMRAVRELTAKHGIKVFYDATRCVENAYFIKEQEEGYADVSIKDIVHEMFSYSDGATMSGKKDGIVNIGGFLAINDEELFGKAKEIVVVYEGMPSYGGMTGRDMQAIAIGFREAMQYEYIEHRIRQVRYLGDRLKEAGVPIVEPVGGHAVFLDARRFCPHLDQEQFPAQSLAASLYIDSGVRSMERGIVSAGRDVNTGENHKPKLETVRLTIPRRVYTYKHMDVVAESVIHLYKHKEDIRPLKFTYEPAQLRFFTAKFDYAD

SEQ ID NO: 14965 - DNA, 1371 bp, Enterobacter agglomerans
  CDS (1)..(1371): transl_table=11
atgaactatcctgccgagcctttccgcattaaaagtgttgaaaccgtatcaatgatctcacgcgatgagcgtgttaaaaaaatgcaagaagcgggctataacacgtttttactgaattcaaaggatatctacatcgatctgctgacagacagcggtacaaatgccatgagtgacaagcagtgggcagggatgatgattggtgatgaagcctacgcaggcagtgaaaacttctaccatctcgaaaaaacggtgaaagagttgtttggtttcaaacacatcgttccaacccaccagggacgcggggcggaaaacctgctctcgcagctggccattaagcccggtcaatatgtcgcaggaaatatgtactttacaacaacccgcttccatcaggaaaaaaatggcgcaacctttgtggatattgtccgcgatgaagcacatgacgccagcctgaatctcccctttaaaggtgatattgacctgaataaattagcgacgctcattaaagaaaaaggcgccgagaacatcgcctatatctgccttgcggtcaccgtgaatctggcgggtgggcagcctgtttcaatggcgaatatgcgtgccgtacatgaaatggccagcacgtatggcattaagatcttttacgatgccacccgttgcgttgaaaatgcctattttatcaaagagcaggaagcgggctacgagaacgtcagtatcaaagatatcgtgcatgaaatgttcagctatgccgatgggtgcaccatgagcggtaaaaaagattgtctggtgaatatcggcggcttcttgtgtatgaacgatgaggagatgttctcagcggcaaaagagttggttgtcgtttatgaaggtatgccgtcatacggcgggctggccggtcgggatatggaagcgatggctattgggctacgtgaagccatgcagtatgaatatattgaacatcgggtcaaacaggtgcgctatctgggcgataaactccgtgaagccggcgtacccattgttgaaccgacgggcggacatgcggtatttcttgatgctcgtcgtttctgtccacacctgacgcaggatcagttccctgcgcagagcctggcagccagcatctatatggaaaccggcgtgcgaagtatggaacgtggaattgtttctgccggtcgtagcaaggaaacgggggagaaccatcgccccaaactggagacggtacgtctcactattccacgccgtgtttacacttacgcgcacatggatgttgttgccgatggcatcattaaactgtaccagcataaagaagatattcgtggtctgacgtttgtttatgaacctaaacaacttcgcttctttactgcgcgttttgactttatttaa

SEQ ID NO: 14966 - protein, 456 aa, Enterobacter agglomerans
MNYPAEPFRIKSVETVSMISRDERVKKMQEAGYNTFLLNSKDIYIDLLTDSGTNAMSDKQWAGMMIGDEAYAGSENFYHLEKTVKELFGFKHIVPTHQGRGAENLLSQLAIKPGQYVAGNMYFTTTRFHQEKNGATFVDIVRDEAHDASLNLPFKGDIDLNKLATLIKEKGAENIAYICLAVTVNLAGGQPVSMANMRAVHEMASTYGIKIFYDATRCVENAYFIKEQEAGYENVSIKDIVHEMFSYADGCTMSGKKDCLVNIGGFLCMNDEEMFSAAKELVVVYEGMPSYGGLAGRDMEAMAIGLREAMQYEYIEHRVKQVRYLGDKLREAGVPIVEPTGGHAVFLDARRFCPHLTQDQFPAQSLAASIYMETGVRSMERGIVSAGRSKETGENHRPKLETVRLTIPRRVYTYAHMDVVADGIIKLYQHKEDIRGLTFVYEPKQLRFFTARFDFI

SEQ ID NO: 14967 - DNA, 1383 bp, Fusobacterium nucleatum
  CDS (1)..(1383): transl_table=11
atgagatttgaagattatccagcagagccatttagaattaaaagtgtagaaactgttaaaatgattgataaggcagcaagagaagaagtaattaaaaaagcaggatataatactttcttaattaactctgaagatgtttacattgatttattaactgatagtggaactaatgctatgagtgataaacaatggggtggattaatgcaaggtgatgaagcttatgcaggaagtagaaatttcttccacttagaagaaactgtaaaagaaatatttgggtttaaacatatagttcctactcaccaaggaagaggagcagaaaatattttatctcaaatagctataaaacctggacaatatgttcctggaaatatgtattttacaactactagatatcaccaagaaagaaatggtggaatatttaaagatattatcagagatgaggcacatgatgctactcttaatgttcctttcaaaggagatattgacttaaataaattacaaaaattaatagatgaagttggagcagaaaacattgcttatgtttgtttagctgtaactgtaaaccttgctggtggacaaccagtttctatgaaaaatatgaaagcagttagagaactaactaaaaaacatggaataaaagttttctatgatgcaactagatgtgttgaaaatgcttacttcattaaagaacaagaagaaggatatcaagataaaactataaaggaaatagtgcatgaaatgtttagctatgctgatggatgtactatgagtggtaaaaaagattgtcttgttaatataggtggatttttatgtatgaatgatgaagatttattcttagctgcaaaagaaatagttgttgtttatgaaggtatgccatcttatggtggacttgctggtagagatatggaagctatggcaatagggttaagagaatctttacaatatgaatacattagacatagaattttacaagttagatacttaggagaaaaattaaaagaagctggtgtacctatacttgaaccagttggaggacatgctgtattcctagatgctagaagattctgtcctcatatcccacaagaagaattcccagctcaagctcttgcagcagctatctatgttgaatgtggtgtaagaactatggaaagaggaataatttctgctggtagagatgtaaaaactggtgaaaaccataaacctaaactagaaactgttagagttactattccaagaagagtttatacttataaacatatggatgtagtagcagaaggtataatcaaattatataaacataaagaagatataaaaccattagaatttgtatatgaaccaaaacaattaagattctttacagctagatttggaataaaaaaataa

SEQ ID NO: 14968 - protein, 460 aa, Fusobacterium nucleatum
MRFEDYPAEPFRIKSVETVKMIDKAAREEVIKKAGYNTFLINSEDVYIDLLTDSGTNAMSDKQWGGLMQGDEAYAGSRNFFHLEETVKEIFGFKHIVPTHQGRGAENILSQIAIKPGQYVPGNMYFTTTRYHQERNGGIFKDIIRDEAHDATLNVPFKGDIDLNKLQKLIDEVGAENIAYVCLAVTVNLAGGQPVSMKNMKAVRELTKKHGIKVFYDATRCVENAYFIKEQEEGYQDKTIKEIVHEMFSYADGCTMSGKKDCLVNIGGFLCMNDEDLFLAAKEIVVVYEGMPSYGGLAGRDMEAMAIGLRESLQYEYIRHRILQVRYLGEKLKEAGVPILEPVGGHAVFLDARRFCPHIPQEEFPAQALAAAIYVECGVRTMERGIISAGRDVKTGENHKPKLETVRVTIPRRVYTYKHMDVVAEGIIKLYKHKEDIKPLEFVYEPKQLRFFTARFGIKK

SEQ ID NO: 14969 - DNA, 1377 bp, Pasteurella multocida
  CDS (1)..(1377): transl_table=11
atgagaaactatcctgcagaaccttataaagtcaaagctgttgaaccgattgcaatgacgactcgtgagcaacgtgaagcctacatgaaaaaagcgggctacaatacgtttttactcaattcagaagaagtgtatattgatttattaaccgatagtggtacctcggccatgagtgataagcaatgggcgggtcttatgatcggtgatgaagcttatgcaggtagccgtaacttcatgcatttacaagacgtggtcagagaatattatggtttcaaatatgtcgtaccaactcaccaaggtcgtggtgcagaaaacttactttcaaccattatgatcaaaccgggcgattatgtaccgggtaatatgtattttactacaacacgcgcgcaccaagagcgtaatggggcgactttcgttgatattattattgatgaagcccatgattcacaaattgatttacctttcaaaggcaatgtcgatgtgaagaaattacaaaaactgattgatgaagtgggtgcggataaaattccttacatctgtttagcagttaccgtaaacttggcaggtggacaacctgtgagtatggcaaacatgcgtgaagtaaaagcattatgtagcaaacatggtattaaagtgatgtttgatgccacacgttgtgtagaaaatgcgtacttcattaaagagcgtgaagcagagtataaagatgcaaccatcaaagatattctaaaagaaatgatgagttatgcagatggttgtaccatgagtggtaaaaaagactgtcttgtgaatattggtggtttcttatgtattaatgatgatgatctttatcaacaagcttgtgaactcgtggtgctctttgaagggatgccatcttatggtggactagctggtcgtgatatggaagcaatggcaattggtattacggaatctgtcgatttccactatatccagcaccgtgttgcacaatgttactacctcgcggataaattagaagcggcgggtgtgccgattgtgaaaccagtgggtggtcatgcggtattcttagatgcgaagaaattccttccacatattccacaagaacaattcccagcacagatgcttgctgcgcaaatttatattgagggtggcgtacgctcaatggaacgtggtattgtatcggcgggtcgtgataagaaaaccggtgcaaaccatacgcctaaattagaattagtgcgtttaactatcccacgtcgtgtttatacttatgcgcatttagatcatgttgctgacaccattattaaactctttaaacacagagatgacattaaaggtcttgatatggtgtatgagcctaaattattacgtttctttacggcgcgttttgaaccgaaagcgtaa

SEQ ID NO: 14970 - protein, 458 aa, Pasteurella multocida
MRNYPAEPYKVKAVEPIAMTTREQREAYMKKAGYNTFLLNSEEVYIDLLTDSGTSAMSDKQWAGLMIGDEAYAGSRNFMHLQDVVREYYGFKYVVPTHQGRGAENLLSTIMIKPGDYVPGNMYFTTTRAHQERNGATFVDIIIDEAHDSQIDLPFKGNVDVKKLQKLIDEVGADKIPYICLAVTVNLAGGQPVSMANMREVKALCSKHGIKVMFDATRCVENAYFIKEREAEYKDATIKDILKEMMSYADGCTMSGKKDCLVNIGGFLCINDDDLYQQACELVVLFEGMPSYGGLAGRDMEAMAIGITESVDFHYIQHRVAQCYYLADKLEAAGVPIVKPVGGHAVFLDAKKFLPHIPQEQFPAQMLAAQIYIEGGVRSMERGIVSAGRDKKTGANHTPKLELVRLTIPRRVYTYAHLDHVADTIIKLFKHRDDIKGLDMVYEPKLLRFFTARFEPKA

SEQ ID NO: 14971 - DNA, 1377 bp, Symbiobacterium sp
  CDS (1)..(1377): transl_table=11
atgcagcgaccctgggcggaaccgtacaagatcaaggcggtggaacccatccgcatgacgacccgggagtaccgggaacaggcgatccgggaggccggctacaacaccttcctgctgcgcagcgaggacgtgtacatcgacctgctgacggactcgggaaccaacgcgatgtcggaccggcagtggggcgccctgatgatgggcgatgaggcctacgccggcgcacgctccttcttccgcctggaggaggcggtgcgcgagatctacggcttcaagtacgtggtgccgacccatcaggggcgcggtgccgagcacctgatctcccgcatcctcatcaagcccggcgactacatccccggcaacatgtacttcacgacgacgcgcacccaccaggagctgcaggggggcacgttcgtcgacgtgatcatcgacgaggcccacgatccccaggccaatcacccgttcaaggggaacgtggacatcgccaagttcgaggcgctcatcgaccgggtcggggccgacaagatcccgtacatcaacgtggcgcttacggtcaacatggccggtggtcagcccgtctccatggccaacctgcgtgaggtgcggaaggtttgcgaccggcacggcatccggatgtggagcgacgcgacccgcgccgtggagaacgcctacttcatcaaggagcgggaggagggctaccaggacaagccggtccgggagatcctgaaggagatgatgtcctacttcgacggctgcaccatgtcgggaaagaaggactgcctggtcaacatcggcggcttcctggccatgaacgaggagtggatcctccagaaggcccgggagcaggtggtcatcttcgagggcatgcccacgtacggcggcctggccgggcgcgacatggaggcgatcgctcagggcatctacgagatggtggacgacgactacatcgcccaccggatccatcaggtgcgctacctgggcgagcagctgctggaggcgggcatccccatcgtgcagcccatcggcggccacgccgtcttcctggacgcccgggccttcctgcctcacatcccgcaggaccagttccctgcccaggcgctggcggcggcgctctacgtggactccggggtgcgcgcgatggagcggggcatcgtctccgccggccgcaacccccagaccggtgagcacaactatcccaagctggagctggtgcgcctcacgatcccgcggcgggtctacaccgaccggcacatggacgtggtggcgtactcggtgaagcacctgtggaaggagcgcgacaccatccgcgggctgcgcatggtctacgagccgcccaccctgcggttcttcacggcccgcttcgagccgatcagctaa

SEQ ID NO: 14972 - protein, 458 aa, Symbiobacterium sp
MQRPWAEPYKIKAVEPIRMTTREYREQAIREAGYNTFLLRSEDVYIDLLTDSGTNAMSDRQWGALMMGDEAYAGARSFFRLEEAVREIYGFKYVVPTHQGRGAEHLISRILIKPGDYIPGNMYFTTTRTHQELQGGTFVDVIIDEAHDPQANHPFKGNVDIAKFEALIDRVGADKIPYINVALTVNMAGGQPVSMANLREVRKVCDRHGIRMWSDATRAVENAYFIKEREEGYQDKPVREILKEMMSYFDGCTMSGKKDCLVNIGGFLAMNEEWILQKAREQVVIFEGMPTYGGLAGRDMEAIAQGIYEMVDDDYIAHRIHQVRYLGEQLLEAGIPIVQPIGGHAVFLDARAFLPHIPQDQFPAQALAAALYVDSGVRAMERGIVSAGRNPQTGEHNYPKLELVRLTIPRRVYTDRHMDVVAYSVKHLWKERDTIRGLRMVYEPPTLRFFTARFEPIS

SEQ ID NO: 14973 - DNA, 27 bp, Primer
atgaaggattatgtaatggaaaacttt

SEQ ID NO: 14974 - DNA, 26 bp, Primer
ttaaacttctttaagttttgcggtga

SEQ ID NO: 14975 - protein, 533 aa, consensus
  MISC_FEATURE (1)..(533): consensus for the disclosure of Xaa see table VIII
EXFRIKXVEXIXXXXXXXRXXXIXXAXXNXFXLXSXXVYIDLLTDSGTXAMSXXQXAAMMXGDEAYAGSXXYXXLXXXVXDIXGYXXXXXXXXXXXXXXXXXXXXXXXXXXXXXXXXXXXXXXXXXXXXXXXXXIPXHQGRGAEXIXXXXLIXXXXXXXXXXXXXXXXXXNXXFXTTXXHXXXXGAXXXXVXXXXAXXXXXXXXXXXXXXFKGXXDLXKLXXXIXXXGXXXIXXIXXXITXNXXGGQPVSMXNMRXXXXIXXXYXIXVXXDAXRXXENAYFIXXXEXXYXXXSIXXIXXEXFXYADXXXMSAKKDXLVNIGGXLXXXDXXXXXXXXXXXXXXXXXXXXLFXXXXXXXVXXEGXXTYGGLXGRDMXALAXGLXEXXXXXYLXXRIXQVXYLXXXLXXXGVXXXXXPXGGHAXFVDAXXXXPXXXHIXXXXFPAXXLXXXLYXXXGIRXXEXGXXXXXXXXXTXXXXXXXXEXXRLXIPRXXYTXXHMDXVXXXXXXLXXXXXXIXXGLXXXXEPXXXXLRXFXA

SEQ ID NO: 14976 - protein, 85 aa, consensus
  MISC_FEATURE (1)..(85): consensus for the disclosure of Xaa see table VIII
EXXXXXXXEXXXXXXXXXRXXXXXXXXXNXFXXXXXXXXIDLLTDSGTXAXXXXXXXXXXXGDEXYXGXXXXXXXXXXXXXXXXX

SEQ ID NO: 14977 - protein, 41 aa, consensus
  MISC_FEATURE (1)..(41): consensus for the disclosure of Xaa see table VIII
PXHQGRXAEXXXXXXLXXXXXXXXXXXXXXXXXXXXXXXXX

SEQ ID NO: 14978 - protein, 100 aa, consensus
  MISC_FEATURE (1)..(100): consensus for the disclosure of Xaa see table VIII
IXXXXXXXXXXXXXXXXTXNXXGGQPXSXXNXXXXXXXXXXXXXXXXXDXXRXXENXXFXXXXXXXXXXXXXXXXXXXXXXXXXXXXXSXKKDXXXXXGG

SEQ ID NO: 14979 - protein, 84 aa, consensus
  MISC_FEATURE (1)..(84): consensus for the disclosure of Xaa see table VIII
GXXXYGGXXGXXXXXXAXGXXXXXXXXXXXXRXXQXXXXXXXLXXXXXXXXXXXGXHXXXXXXXXXXXXXXXXXXXXXXXXXXX

SEQ ID NO: 14980 - DNA, 1041 bp, Escherichia coli
  CDS (1)..(1041)
atgaaagttatgcgtaccaccgtcgcaactgttgtcgccgcgaccttatcgatgagtgctttctctgtgtttgcagaagcaagcctgacaggtgcaggtgcaaccttccctgcgccggtgtatgccaaatgggctgacacttaccagaaagaaaccggtaataaagttaactaccagggtatcggttcttccggtggcgtaaaacagattatcgctaataccgttgattttggtgcctctgacgcgccgctgtctgacgaaaaactggctcaggaaggtctgttccagttcccgaccgtgattggcggcgtggtgctggcggttaacattccagggctgaagtctggcgaactggtgctggatggtaaaaccctcggcgacatctacctgggcaaaatcaagaagtgggatgatgaagccatcgccaaactgaatccgggtctgaaactgccttcacaaaacattgctgtagtacgccgcgcagatggctccgggacttccttcgtcttcaccagctacctggcgaaagtgaacgaagagtggaaaaacaacgttggtactggctctaccgtaaaatggccgatcggtctgggcggtaaaggtaacgacggtatcgccgcgttcgttcagcgtctgccgggtgcaattggttatgttgaatatgcttacgcgaagcagaacaacctggcgtacaccaaactgatctccgctgatggtaaaccggttagtccgaccgaagaaaacttcgctaatgcagcaaaaggtgcagactggagcaaaaccttcgctcaggatctgaccaaccagaaaggcgaagatgcatggcctattacctctaccacgttcattctgatccacaaagatcagaagaaaccagaacaaggcacagaggtgctgaaattcttcgactgggcgtacaaaaccggggctaaacaggcgaacgacctggattacgccagcctgccggatagtgtagttgaacaggttcgcgctgcgtggaagaccaatattaaagacagtagcggtaagccgctgtactaa

SEQ ID NO: 14981 - protein, 346 aa, Escherichia coli
MKVMRTTVATVVAATLSMSAFSVFAEASLTGAGATFPAPVYAKWADTYQKETGNKVNYQGIGSSGGVKQIIANTVDFGASDAPLSDEKLAQEGLFQFPTVIGGVVLAVNIPGLKSGELVLDGKTLGDIYLGKIKKWDDEAIAKLNPGLKLPSQNIAVVRRADGSGTSFVFTSYLAKVNEEWKNNVGTGSTVKWPIGLGGKGNDGIAAFVQRLPGAIGYVEYAYAKQNNLAYTKLISADGKPVSPTEENFANAAKGADWSKTFAQDLTNQKGEDAWPITSTTFILIHKDQKKPEQGTEVLKFFDWAYKTGAKQANDLDYASLPDSVVEQVRAAWKTNIKDSSGKPLY

SEQ ID NO: 14982 - DNA, 1152 bp, Pyrococcus abyssi GE5
  CDS (1)..(1152): transl_table=11
ttggtgtcttctatgagatggatggccctcctgttaatggggctagttggagtaggcttactaattagtggatgtattggggaagagactcctacgcaccaacccaaggttaattctcgatcaaaagcaaagaatcccgaaataatagtaattaggacgagtggagctacatttccccaatatcaaattcaaaagtggattgagaagtatcagaagataaatccccacgtgaagatagagtatgaaggtggtggaagcggatacgggcaagaggccttcctgaaaggccttaccgacataggaagaactgatcctccagttaaggaatcaacttggaagaagttccttcaaactggggatcaacctcttcagttcccggagatcgttggtgccgtcgtcgttgtctacaacgttcctgaggtcaatgaattgaaattaagcagagaggtgttagctaagatattcttgggagaaattgagtactgggatgatcccgctataaagaggctcaatcccaacgaaaagctacctcataagaaaattatagtgatccatagaagcgatgcaagtggaaccacagcgatattcacgacttatctcagccttataagtaaggaatgggctgagaaagtaggagttggtaaggtagttgattggcctgttgataaagtcggtaggggaattggagcaaaaggtaatcctggagttgttgcagctttaaagcaaactaagtatagcatagcctacactgagctatccttcgcaattgaagagaatctcaaagttgccgccctagaaaataaagccggaaagttcgttaagccaaatgaagagactataaaggcggcggttgccaacgttaaagctttcattccagatccaaccgaaggttacaaggaggatcttaagcagcttcttgacgctccaggagaaaattcctaccccatagtggcatttacccatatcctcgtctggcaaaacaagggaggaaagcattacactccagagaaagccaaagcgataaaggatttcctaaggtggatactcacagaaggacagaaaccagagaacctagctccagggtacgttggtcttcctaaagaagttgctgaaattggcttgaaagccgtagaaatgattgaagagaggtga

SEQ ID NO: 14983 - protein, 383 aa, Pyrococcus abyssi GE5
MVSSMRWMALLLMGLVGVGLLISGCIGEETPTHQPKVNSRSKAKNPEIIVIRTSGATFPQYQIQKWIEKYQKINPHVKIEYEGGGSGYGQEAFLKGLTDIGRTDPPVKESTWKKFLQTGDQPLQFPEIVGAVVVVYNVPEVNELKLSREVLAKIFLGEIEYWDDPAIKRLNPNEKLPHKKIIVIHRSDASGTTAIFTTYLSLISKEWAEKVGVGKVVDWPVDKVGRGIGAKGNPGVVAALKQTKYSIAYTELSFAIEENLKVAALENKAGKFVKPNEETIKAAVANVKAFIPDPTEGYKEDLKQLLDAPGENSYPIVAFTHILVWQNKGGKHYTPEKAKAIKDFLRWILTEGQKPENLAPGYVGLPKEVAEIGLKAVEMIEER

SEQ ID NO: 14984 - DNA, 1122 bp, Aeropyrum pernix K1
  CDS (1)..(1122): transl_table=11
gtgttggataagaagcttgttctaaccgtgctggctgttgttgtgcttctcggtatagggcttgccctggcatctggctggttaggcggtgaacagggagagagcagcggagggtcaggccccgcccaagtagtcctccagggtgagggatcaacattcatatatccacagatccaagcatggagcgaggagataaagaagacttacccctggataaccattaattacaacccaacaggcagcggtgcaggccaaagcgctttcaaagatggcgttgtagacttcgccggtagcgacactcctctgcccagagaagtctggtccgccatgcagggtaatgtcatacagattcccgtagtcataggaatgctagcaatagtgtacaacataccaggactggaggacctcaagctagacgccaagactatagccttgatatacaagggagagatagagtactgggacgatcctaggatagcctcgctaaacccgggagccagcctgccccatgagaagatagttgctgtccataggagcgactcgagcggcacaacccacgtattcaccatattcctccataagggagcccccgatgtttggacggaggacctcgtgggtaagtctgttgactggccggttgacgccacgggccgaggtgtaggaggcaagggcaaccagggtgttatggaagtcgtcaagaatactccatacagtattggatatgtggagtatgcttacgtggtcaaagcgggagaaggggttaacgtggctttagttgccaaccgggatgatgtcttcctgaagccttcgcccgaaggagctcaggcagccgcatctggcgccgtccaaaacctgccggactctccagacgacgactggagcacaggctacgacgcgataatatatgctcctggtaaggacagctacccaataacctcctggtcattcctcctattctataagcagtacaacgatagggataaagcggaagccataaagaagtttatcgaatggattaacacagaaggccaaactaagatcatcgagggctatatacctattcccgacgagataaggcagatcaacatgaaagccgtggagatgatctcgtacacgggctga

SEQ ID NO: 14985 - protein, 373 aa, Aeropyrum pernix K1
MLDKKLVLTVLAVVVLLGIGLALASGWLGGEQGESSGGSGPAQVVLQGEGSTFIYPQIQAWSEEIKKTYPWITINYNPTGSGAGQSAFKDGVVDFAGSDTPLPREVWSAMQGNVIQIPVVIGMLAIVYNIPGLEDLKLDAKTIALIYKGEIEYWDDPRIASLNPGASLPHEKIVAVHRSDSSGTTHVFTIFLHKGAPDVWTEDLVGKSVDWPVDATGRGVGGKGNQGVMEVVKNTPYSIGYVEYAYVVKAGEGVNVALVANRDDVFLKPSPEGAQAAASGAVQNLPDSPDDDWSTGYDAIIYAPGKDSYPITSWSFLLFYKQYNDRDKAEAIKKFIEWINTEGQTKIIEGYIPIPDEIRQINMKAVEMISYTG

SEQ ID NO: 14986 - DNA, 1014 bp, Aquifex aeolicus VF5
  CDS (1)..(1014): transl_table=11
atgaacaggaagaaatttcttcttggggtactagcattagcaatttttcccgccgcaggaatagcaaaggaaaaagtaatcaacggtgctggagcaacttttcccgctcctctctactggaaatgggctgacgcttactacaaggcaaccggtattaaggtaaactaccagtccataggttcaggtggaggagttaggcagatagtaaacagaacagttgactttggagcatctgatgctcccttaaaacctgaggaaacaaaaaaacacaatctggctcaattcccgactgtgattggaggtgttaccgtagcttataacttaaggggagtagaaaatctcaagctctctacaagagcggtttgtgatatttttctcggaaaaattaagtactgggatgacccagttataaagaaggataatcccggagtaaaacttcctcacaagagaattaccgttgttcgcaggagtgacggttcaggaactacctggatattcacaaactacctctccaaagcttgccccgagtggaaggaaaaagtcggttacggaaaagcggtaaggtggcctacaggtataggtgctaaaggaaacgaaggtgtagcaaactatataagaaggataaaaggagctataggctatgtggaatacgcttacgcaattcaaaacaagatacccgtcgcggcagtggaaaacagagatggaaaatttgtaaaaccttctatagaaacattccaagcagctgctgcaaacgcaaagtgggatcctaaaaaagacttctacgaagtcctgacatggcagcccggtgaaaaagcttaccccatagctggtgctacctttatactccttgcaaaggacgaagacaggaaggaaataaataaggaagtagttaaattctttgactgggcttacaaaaatggtgataaaatggctatagagttgcattacgtaccgttgcccgaaaacgttaagaacatgattaggaactactggagagagcatggatggtattaa

SEQ ID NO: 14987 - protein, 337 aa, Aquifex aeolicus VF5
MNRKKFLLGVLALAIFPAAGIAKEKVINGAGATFPAPLYWKWADAYYKATGIKVNYQSIGSGGGVRQIVNRTVDFGASDAPLKPEETKKHNLAQFPTVIGGVTVAYNLRGVENLKLSTRAVCDIFLGKIKYWDDPVIKKDNPGVKLPHKRITVVRRSDGSGTTWIFTNYLSKACPEWKEKVGYGKAVRWPTGIGAKGNEGVANYIRRIKGAIGYVEYAYAIQNKIPVAAVENRDGKFVKPSIETFQAAAANAKWDPKKDFYEVLTWQPGEKAYPIAGATFILLAKDEDRKEINKEVVKFFDWAYKNGDKMAIELHYVPLPENVKNMIRNYWREHGWY

SEQ ID NO: 14988 - DNA, 825 bp, Thermotoga maritima MSB8
  CDS (1)..(825): transl_table=11
atgaaaaggtttgtggtacttcttctttcattagtttcggtttttcttgtggcagaaacgctcgtcatcaagggttccaacacagtctttcccatcgctcagctctggatcgaagagttcaaaaagctccacccggatcttcaggtgactctcgaaggtgcgggctcttccacaggaatcgcggcgctcttcaacggaacgaccgacatcgccaactcgagcagatggctcaaaccctctgaaatcgagagaatgaacaaggaaggaaaatacttcattcctttcctcatcgctttcgacggaatagcgatcattgtgaacaaggacctcggcatcgacgacatctccatcgaaactttgaagaagatctacacaggagagatccagtactggtcacaggtgaatccaaatctcccgaaacagagaatcgttgtttactcgagaaacaccgcttctggtacctacgaaacgtttgaaaacaaagtcctcggtggagcgagaatggctccttacgtgagaatggtcgaaagtacccagcttgaggtagagagtgtttccaaaaatccgtacgctattgcttatgttggtgtgggatacgtcacagacgatgtgaaagtcctgaaggtgaacggtatctacccgacgaaggaaaacattctgaaaggaaaatacccgatagcaagacctctcttcatgtttgtcgatgcgacaaatggatttcctgagatgggaagcctcgtcttcgagtacatcatgttcgccttctcgaagaaaggacaggagctggttgaaaaggcaggttacatagccgcttacggtcagtga

SEQ ID NO: 14989 - protein, 274 aa, Thermotoga maritima MSB8
MKRFVVLLLSLVSVFLVAETLVIKGSNTVFPIAQLWIEEFKKLHPDLQVTLEGAGSSTGIAALFNGTTDIANSSRWLKPSEIERMNKEGKYFIPFLIAFDGIAIIVNKDLGIDDISIETLKKIYTGEIQYWSQVNPNLPKQRIVVYSRNTASGTYETFENKVLGGARMAPYVRMVESTQLEVESVSKNPYAIAYVGVGYVTDDVKVLKVNGIYPTKENILKGKYPIARPLFMFVDATNGFPEMGSLVFEYIMFAFSKKGQELVEKAGYIAAYGQ

SEQ ID NO: 14990 - DNA, 900 bp, Vibrio cholerae O1 biovar eltor str. N16961
  CDS (1)..(900): transl_table=11
ttgtcatattcaccgcctaaagtgagcctcgttcaagtgaaacacaacggcaacccagccacttataggaaattcgtgatgaaaaagacagtaatcggtgctatcgctcttatgggcgcacttgcagtaactccagtgatggcgaaagagacaatctcagcagtgggctcaagcagtgttactccgctgatggaagtgttttctgaaacttacgccaaaatgaatcctgaagttttcattgaagtacaaggcccaggctcttctgcgggtatcaaagccgcgaaaaacggcagcgcggacatcggtatgtcatcgcgcaatctgaaagattctgaaaaagaagcgactctggttgaagaagcgatcgcgcttgacggtatcgcagtcgtggttcacccaagcaatgcggtgaaaggtctgacagcagaacaagtttctgaaatctacaaaggcgaaatcaccaactggaaacaagttggtggtgaagataagccaatcgttgctatcactcgtgacaccgcttcgggtactcgtggtgcattcgaagacatcatggaactgaaaaagaaagtggcggataaagaagtctctgctatttctcaacgtgctcaagtcgcgaacggtaacggcgcactgaaaactatggtcgcttctaacccttatgcgattggttatatttcactcggtaccgttgatacttcagttcacgcactggctgtgaacggtgttgaagcgagcgtagataacgtgaaaaacggtacttacaaagtttctcgtccattccttgtgctctacaaacaagataagccatctgctgaagcgaagaaattcctagattggatgctgtcagctgacgcacaaaagattgtcgctgataaaggctacatcacagttaactaa

SEQ ID NO: 14991 - protein, 299 aa, Vibrio cholerae O1 biovar eltor str. N16961
MSYSPPKVSLVQVKHNGNPATYRKFVMKKTVIGAIALMGALAVTPVMAKETISAVGSSSVTPLMEVFSETYAKMNPEVFIEVQGPGSSAGIKAAKNGSADIGMSSRNLKDSEKEATLVEEAIALDGIAVVVHPSNAVKGLTAEQVSEIYKGEITNWKQVGGEDKPIVAITRDTASGTRGAFEDIMELKKKVADKEVSAISQRAQVANGNGALKTMVASNPYAIGYISLGTVDTSVHALAVNGVEASVDNVKNGTYKVSRPFLVLYKQDKPSAEAKKFLDWMLSADAQKIVADKGYITVN

SEQ ID NO: 14992 - DNA, 837 bp, Vibrio cholerae O1 biovar eltor str. N16961
  CDS (1)..(837): transl_table=11
atgatcaggatggcacttgccgccgtttgcgcacttcttttttccatcacaacgatgacaccctttgtgcaagcaagtgaaataaccatttcaggttccacctcagtggccagaattatggacgtactggctgaaaaatataaccaacaacaccccgagacttatgtcgcagttcaaggtgtgggttctaccgctgggatttctcttttgaaaaaaggcgtcgcggatatcgctatgacctcacgctatctcacggaaagtgaagcgcaaaacaccctacacacttttacgctggcttttgatggtttagcgattgtggtcaaccaagccaatccagtcaccaatcttacgcgagagcagctatacggcatttacaaaggccaaatcaccaactggaaacaggtgggcggtaacgatcaaaaaatcgcggtcgtgactcgcgaagcctcatcgggtactcgctacagctttgaaagcttgatgggattaaccaaaaccgtcaaagatcgtgaggtttccgatgttgcgccgaccgcgcttgtcgtcaatagcaacagcatgatgaaaacgttagtcaaccacaatactcaagcggttggctttatctctattggctcggtcgataaatccgtcaaagcgattcagtttgaaaaagcggatcccacttctgacaacatagctaagcacacttaccaattatcacgcccgttcttaattttgcactactcagataacgcagacgaacagaccaaagagttcatcgccttcttaaagtctgaaagcgctaaaaaattgattgtggaatacggctacattatgccaagtgatgtggaataa

SEQ ID NO: 14993 - protein, 278 aa, Vibrio cholerae O1 biovar eltor str. N16961
MIRMALAAVCALLFSITTMTPFVQASEITISGSTSVARIMDVLAEKYNQQHPETYVAVQGVGSTAGISLLKKGVADIAMTSRYLTESEAQNTLHTFTLAFDGLAIVVNQANPVTNLTREQLYGIYKGQITNWKQVGGNDQKIAVVTREASSGTRYSFESLMGLTKTVKDREVSDVAPTALVVNSNSMMKTLVNHNTQAVGFISIGSVDKSVKAIQFEKADPTSDNIAKHTYQLSRPFLILHYSDNADEQTKEFIAFLKSESAKKLIVEYGYIMPSDVE

SEQ ID NO: 14994 - DNA, 1212 bp, Pasteurella multocida subsp. multocida str. Pm70
  CDS (1)..(1212): transl_table=11
ttggctataaaacaatccactcgccttgcctttttcaaaaaatctgtacaaaaacaaccgcactttttgcactgcaaactgtcattcgcctgtcatcaaactgtcatatttgttcattacaatcactttcgctaccacatggtagtgattgaaaagacactcaaaggagtaacatctatgacaaaacgtgcaatgcttttggctattctattcagtacatttgctttgacgacgcaggcacaaaccattactggcgcgggcgcttcttttccttatccaatctatgccaaatgggcatccatgtatgaaaaacaaacaggtaacaaagtcaactatcaatcaattggctcggggggcggtcagcaacaaattatcgccaaaaccattgattttggtgcctcagatgatccgatgaaagcagaacttttagcacaacatcaattattacaatttccagccattatcggtggcacagtgcctgtcgtgaatttaccagaaatcaccgccggacagcttaaactttctggtgaagttctcgccgatattttcttaggcaaaattaaaaagtggaatgatcccgctatcgccaaattaaaccaaggggctaatttacccgataaagccattatcgtcgtacatcgttctgacggttcaggcaccacattcggttggactaattatctttctaaagtatcgactgaatggaaagaaacagtcggtcaaggtaaatcagtcaaatggcctacgggacaaggcggcaaaggtaacgaaggcgtggctgcttatgtcagcaaaatcaaatattcgattggttatgtggaatatgcgtacgcgaaacaaaaccagctcgcttgggcgtcattacaaaataaagccgggcaatttgtacagccctcagcagaaagttttatggcagctgccgccaatgcacaatgggaaagtgcggtcggtatgggcgtcattttaaccaatgaagaaggcgatacatcttggccagtcaccgcagcaagtttcatcttattgcataagcatgcagaaaagccagaaatcaccaaagctgtctttgatttctttgactgggcattcaagcaaggcaaagtcgcagcaaccgagcttgattatgtgcctctgcctgaggaagttattcagaaaattcaagcgcaatggaaaaccgaggtgaagtccagtgatggcaaaacactttggcaataa

SEQ ID NO: 14995 - protein, 403 aa, Pasteurella multocida subsp. multocida str. Pm70
MAIKQSTRLAFFKKSVQKQPHFLHCKLSFACHQTVIFVHYNHFRYHMVVIEKTLKGVTSMTKRAMLLAILFSTFALTTQAQTITGAGASFPYPIYAKWASMYEKQTGNKVNYQSIGSGGGQQQIIAKTIDFGASDDPMKAELLAQHQLLQFPAIIGGTVPVVNLPEITAGQLKLSGEVLADIFLGKIKKWNDPAIAKLNQGANLPDKAIIVVHRSDGSGTTFGWTNYLSKVSTEWKETVGQGKSVKWPTGQGGKGNEGVAAYVSKIKYSIGYVEYAYAKQNQLAWASLQNKAGQFVQPSAESFMAAAANAQWESAVGMGVILTNEEGDTSWPVTAASFILLHKHAEKPEITKAVFDFFDWAFKQGKVAATELDYVPLPEEVIQKIQAQWKTEVKSSDGKTLWQ

SEQ ID NO: 14996 - DNA, 897 bp, Lactococcus lactis subsp. lactis Il1403
  CDS (1)..(897): transl_table=11
atgaaaaagaaaattcttgttggtcttattactgctggtgcattgttaactttggcagcttgtggttcatcaaacggctcatcatctagtagctcaagttcttctgacaaagctctgtcaggaaaaattattgctggaggttcaactgctcttcaaccattagcacaacaatcgtcaacagaatttatggcaaaaaatactggtgttcaagtgactgtgcaaggtggtggttctggtgttggtttgacacaagttgcagctggttctttccagattgggaactctgatatttttgctgaagaaaaatcaggaattgatgcttctgcaattactgaccataaagtagcggttgttggttttgcaccgattgttaacgcaaaaattgatgttaaaaacttaacttctcaacaattgcaagatgtcttcacaggtaaggtgacaaactggaaagatgtgggcggttcagaccaaaaaattacggttatcggacggactgagggttctggaactcgcgtaaactttgataaattcgcacttggtggagcaacagaggttaaaggcccaacacaagatgcttcaggttcagttgttcaaatggtaggtcaaacaccaggagcgatttcatatgtggcactttcttatgttgatacaagtaaagacatcaaagatatttcgattgatggtgttgagccaacagaagcaaatgttgtaactaatgactacaaagtttggtcttacgaacatatgtacaccaatactaagaaagaaactgcagcagataaagctttcattaaatatgtggcagaaaacaacaaggacatcaaaaaattgggatacattccaatcagtgacatgaaagttgaacgtgacgctgacggaaatatcactaaaaaataa

SEQ ID NO: 14997 - protein, 298 aa, Lactococcus lactis subsp. lactis Il1403
MKKKILVGLITAGALLTLAACGSSNGSSSSSSSSSDKALSGKIIAGGSTALQPLAQQSSTEFMAKNTGVQVTVQGGGSGVGLTQVAAGSFQIGNSDIFAEEKSGIDASAITDHKVAVVGFAPIVNAKIDVKNLTSQQLQDVFTGKVTNWKDVGGSDQKITVIGRTEGSGTRVNFDKFALGGATEVKGPTQDASGSVVQMVGQTPGAISYVALSYVDTSKDIKDISIDGVEPTEANVVTNDYKVWSYEHMYTNTKKETAADKAFIKYVAENNKDIKKLGYIPISDMKVERDADGNITKK

SEQ ID NO: 14998 - DNA, 816 bp, Methanothermobacter thermautotrophicus str. Delta H
  CDS (1)..(816)
atggacaccaaactgatcataggaatagtcgtggcaattgtaattattgcaggcgcagtcctggcacttggaggtggcggacagcaggagaagatagacattgttggttcaacatctgtccagccagttgcagagaaacttgcagctgagtacatgaagaagcacctcaatgttaagataaacgtccagggcggcggatccagtgtcggtatcaagagtgccgctgacggcacagcagacatcggaacaagttcaaaggaactcaagcccgatgagaagaagggcctcacagaataccttataggtaaggatggaatagccataatcgtaaacagcaagaacacagtctcagacctaacaaaggaccaggtgaaggatatcttcagcggtaagataaccaactggaaggaggtcggaggccccgatgcaaagataacagtggtaacacgtgaagacggctcaggaaccaggaaggccttcgaggaaatagtgatgggtaaagagaccaagataaagaaggatgccatagttgaaagttcaacagaggcagttaaacaggcagttaaacaggatccaaacgccataggattcatatcactcgccaatctcgatgaaacagtcaaggcacttaaaatagatggtgtcgcaccatcagagcagacagtcgcagatggatcctacaagatacagagaccattcctgttcctggtaaagggcagcgcaaagggtgcagttaaggacttcatagactgggtcctcagcccggagggacaggcaataatcaaatcagaaaaggttgtaccggcaaaggcctag

SEQ ID NO: 14999 - protein, 271 aa, Methanothermobacter thermautotrophicus str. Delta H
MDTKLIIGIVVAIVIIAGAVLALGGGGQQEKIDIVGSTSVQPVAEKLAAEYMKKHLNVKINVQGGGSSVGIKSAADGTADIGTSSKELKPDEKKGLTEYLIGKDGIAIIVNSKNTVSDLTKDQVKDIFSGKITNWKEVGGPDAKITVVTREDGSGTRKAFEEIVMGKETKIKKDAIVESSTEAVKQAVKQDPNAIGFISLANLDETVKALKIDGVAPSEQTVADGSYKIQRPFLFLVKGSAKGAVKDFIDWVLSPEGQAIIKSEKVVPAKA

SEQ ID NO: 15000 - DNA, 837 bp, Methanothermobacter thermautotrophicus str. Delta H
  CDS (1)..(837)
atgatggacatggagctgaaacccaaaaacatcctcataataatcattatcatcgcactcgcatacctcatgatcaaacccggagcagactatgagagaattgaaattgctggttccacatctgttcagccagttgcagaggaacttgcagctgagtacatgaagaagcaccccgatgttaagataaacgtccagggcggcggttccgggatgggtgtaaggacggtccagcagggaatagtcgatatagggaccagctcaaaggccctgaaacctgaggaaaaggacgaccttcaggaatacgtgataggtaaggatggtatagtgatagccgttaacaaccagaaccccgtcgatgatctgacagtggaccagctcagggatatcttcagcggtaagataaccaactggaaggaggtcggaggccccgatgcagagatacatgtgatagtccgtgaggagggatcagggaccagaagctcattcaaatcacttgtcatgaaggacgagaagataaggtccgatgcaatcgttcagggctccacagaatccgtgaaacaggccataaagagcgacccctacgcaattggattcgtttcaatggcacatatgagttccgatgtgaaggcacttgaggtgaatggagtgacaccctcagagaccaccatagcagacggatcctatccactggtggtcccattcgaattcctgacaaagggagaacccaggggagtcgtaaaggacttcataaagtgggttttctcacctgaagggcaggccattgtaaggagccagaaggttgtaccggcaatagcaaatgtctcggatgatacctag

SEQ ID NO: 15001 - protein, 278 aa, Methanothermobacter thermautotrophicus str. Delta H
MMDMELKPKNILIIIIIIALAYLMIKPGADYERIEIAGSTSVQPVAEELAAEYMKKHPDVKINVQGGGSGMGVRTVQQGIVDIGTSSKALKPEEKDDLQEYVIGKDGIVIAVNNQNPVDDLTVDQLRDIFSGKITNWKEVGGPDAEIHVIVREEGSGTRSSFKSLVMKDEKIRSDAIVQGSTESVKQAIKSDPYAIGFVSMAHMSSDVKALEVNGVTPSETTIADGSYPLVVPFEFLTKGEPRGVVKDFIKWVFSPEGQAIVRSQKVVPAIANVSDDT

SEQ ID NO: 15002 - DNA, 1212 bp, Deinococcus radiodurans R1
  CDS (1)..(1212): transl_table=11
gtgtccgtctcatggtcgctgcaaatgcactctgctgcaactgccggggtcacgaacgtctgggcagggagcggggaaggaagggctgcgtcgccgttcttgccggtaagaaccgttcctctatgcggcacatccccagtcttcggaagccttgacgccccgctgacaaagccccgccacactcggcgacgtatgaagaagaccctgctgggcctcagcgcccttgtcatgatcagcaccgccgccgcccagggcgccatcaccggcgcgggcgcgagcttcccctatcccctgtactccaagatgttcagcgagtacaaggcgagcaacgtcaactaccagtcggtgggctcgggcagcggccagaagcagattctggagcgcaccgtggacttcgcgggcagcgacaaccccatgaccgacgcgcagctggggagcgcccccggcaccctgctgcacgtgcccaccgccatcggcgccgtggtgcccgcctacaacctgcccggcgtgaccaagcccctgaacttcgatggccccacgctcgccaacatctacctcggcaaaatcaagacctggggtgaccccgccatcgccaagctcaaccccggcgtgaccattcccccgctgccgatcaccgtggcgcgccgctccgacggctcgggtaccaccttcgtgttctcggactacctgagcaaagtcagcggcgagtggaagagcaaggtcggcgcgggcaacagccttcagtggcccgtcggcaccggcgccaagggcaacgacggcgtggcgggcgtggtcaagggcacccccggcgccatcggttacgtggaactggtgtacgccaagcagaacaagctgtccttcggcgccgtgaaaaaccgcgcgggcaagttcatcctggccgataacggtcccgccagcaacgcggctctgggcgtggtcatccccgccgatacccgcgtcagtctgaccaacagcgccaacgccggcgcttacccgattgccagcttcacctacctgattttctacaaggatcagaagtacggcaaccgcaccgaagcccaggccaaggcgctcaagaacctgctcacctacgtcgtgaccagcggccagcagtacaacgaaggcctcgactacgccaagctgcccagcaacgtggcggccaaggccaagaccatcatcaactcgatgaactacggcggcaagaagctctga

SEQ ID NO: 15003 - protein, 403 aa, Deinococcus radiodurans R1
MSVSWSLQMHSAATAGVTNVWAGSGEGRAASPFLPVRTVPLCGTSPVFGSLDAPLTKPRHTRRRMKKTLLGLSALVMISTAAAQGAITGAGASFPYPLYSKMFSEYKASNVNYQSVGSGSGQKQILERTVDFAGSDNPMTDAQLGSAPGTLLHVPTAIGAVVPAYNLPGVTKPLNFDGPTLANIYLGKIKTWGDPAIAKLNPGVTIPPLPITVARRSDGSGTTFVFSDYLSKVSGEWKSKVGAGNSLQWPVGTGAKGNDGVAGVVKGTPGAIGYVELVYAKQNKLSFGAVKNRAGKFILADNGPASNAALGVVIPADTRVSLTNSANAGAYPIASFTYLIFYKDQKYGNRTEAQAKALKNLLTYVVTSGQQYNEGLDYAKLPSNVAAKAKTIINSMNYGGKKL

SEQ ID NO: 15004 - DNA, 1290 bp, Mycobacterium leprae TN
  CDS (1)..(1290): transl_table=11
atgactgagcgaaagcccagtttcatgcagtattcaccggtgttgttcaccccaatagcgatgtttctgggttcctgcggtgcatactttccgggtgaccaggccactttgcgctcggccagcggtgcgggtgtgcgtcgaaagtgcgctgagaaagcgagatcggtgaaccacgacaaggtatgcagggcgtttgcgatggtgttgacgacggcggtcaccgccggggtgttatccgcgtgcggtagtgacgtcaatcgcggccatactgcgacaacatccatctcagggaaatcggctgacaccgcggcttgcggcggcaaaagaacaatgacggctgaagggtcgaccgctcaacagaacgcgatcgcattgtttaatcagatttggggaaagttgtgccctgacaagaccgtgtcatacaacccgactgggtcgggtgctggtcgtgagcaattcattgccggccgtatcgacttcgctggctcggactcaccgctgcttgcggatcaactcggcccggccgccaaacgctgtaaaggcaacccggcctgggatctgccgctggtgttcggtccggttgcgttggtttacaacctgccaggcgttcaaatgttgaccgtcaatagtgacgtgttggccaaaatcttcagtggcgtgattacgacatggaacgacgggatactggcggctctcaatccaggtgttgtcctgcccaacctcaggatcatgccgatctatcgggcggatgcatcgggaaccaccgacaacttgcagaagtatttgacgaccgatgcaccacagagctgggccaaaggggtcggtgccgagtttcagggcggtgttggcgaaggggtccagaagtcggctggtgtaatccaggcggtgcagactactccaggcgcctttggttatgttgagaagagcttcgctgatcgggctggattgccgttcgcccagattgacaccggcagtggcggcgtaccgcttaccgacgacacggcacgcaatggcataaacgcagccaacttcgtgtccgtcggcaacgacctagtactggacctgaacgcgatgtacagcaccgaacagtctaatgcttacccgttggtcttggccacatatgaaatcgtctgctcgaaaggctacgatccggacacgtttgcggcgatcaagtcattcctcaccgtggcagccaatgacggtcaggccggtcttgcagcggtcggctatgtcccgctgcccgatacaattaaaaaacgactggtcagcgcgatcaatgcaatgcagtag

SEQ ID NO: 15005 - protein, 429 aa, Mycobacterium leprae TN
MTERKPSFMQYSPVLFTPIAMFLGSCGAYFPGDQATLRSASGAGVRRKCAEKARSVNHDKVCRAFAMVLTTAVTAGVLSACGSDVNRGHTATTSISGKSADTAACGGKRTMTAEGSTAQQNAIALFNQIWGKLCPDKTVSYNPTGSGAGREQFIAGRIDFAGSDSPLLADQLGPAAKRCKGNPAWDLPLVFGPVALVYNLPGVQMLTVNSDVLAKIFSGVITTWNDGILAALNPGVVLPNLRIMPIYRADASGTTDNLQKYLTTDAPQSWAKGVGAEFQGGVGEGVQKSAGVIQAVQTTPGAFGYVEKSFADRAGLPFAQIDTGSGGVPLTDDTARNGINAANFVSVGNDLVLDLNAMYSTEQSNAYPLVLATYEIVCSKGYDPDTFAAIKSFLTVAANDGQAGLAAVGYVPLPDTIKKRLVSAINAMQ

SEQ ID NO: 15006 - DNA, 1170 bp, Mycobacterium tuberculosis CDC1551
  CDS (1)..(1170): transl_table=11
gtgctgttagcttcatttgctgcgagcaaaacagctggtcggccgttaggaactgaattgaaactcaaccgatttggtgccgccgtaggtgtcctggctgcgggtgcgctggtgttgtccgcgtgtggtaacgacgacaatgtgaccgggggaggtgcaaccactggccaggcgtcggcgaaggtcgattgcggggggaagaagacactcaaagccagtgggtcgacggcgcaggccaacgcgatgacccgctttgtcaacgtgttcgagcaggcctgccccggccaaaccctgaactacacggccaatggttcgggcgctggaatcagcgaatttaatggcaaccaaaccgatttcggtggctcagatgtacccctgagcaaggacgaggccgcagcggcgcagcggcgttgcggctcgccggcgtggaatctgccggtggtgttcggcccgatcgcggttacctacaacctcaacagcgtttcctcgctaaatttggacggccccacgttggcgaagatcttcaacggctccattacgcagtggaacaatcccgcgatccaggcgctgaaccgcgacttcacgctgccaggtgagcggattcacgtggtgttccgcagcgatgagtcggggaccacggacaacttccagaggtacctgcaggccgcgtccaacggtgcgtggggtaagggcgctggaaagtcgttccaaggcggcgtcggtgagggcgcgcggggtaacgatggcacgtcagcggccgcgaagaacaccccggggtcgatcacctacaacgagtggtcgttcgcccaggcgcagcacctgaccatggccaacatcgtcacttcggctggtggggacccggtggcgattactatcgactcggtcggccagacgatcgccggggccaccatctccggggtgggcaacgacctggtgctcgacacggactcgttctaccggccgaagcgtcccggctcctatccgatcgtgttagcgacatacgaaatcgtttgctcgaagtatcccgactcgcaggttggcacggctgtgaaggcgttcctgcagagcactatcggcgccggtcaaagcggcctgggggacaacggatacatcccaattccggacgagttcaaatcgaggctgtcgactgcggtcaacgcgatcgcctga

SEQ ID NO: 15007 - protein, 389 aa, Mycobacterium tuberculosis CDC1551
MLLASFAASKTAGRPLGTELKLNRFGAAVGVLAAGALVLSACGNDDNVTGGGATTGQASAKVDCGGKKTLKASGSTAQANAMTRFVNVFEQACPGQTLNYTANGSGAGISEFNGNQTDFGGSDVPLSKDEAAAAQRRCGSPAWNLPVVFGPIAVTYNLNSVSSLNLDGPTLAKIFNGSITQWNNPAIQALNRDFTLPGERIHVVFRSDESGTTDNFQRYLQAASNGAWGKGAGKSFQGGVGEGARGNDGTSAAAKNTPGSITYNEWSFAQAQHLTMANIVTSAGGDPVAITIDSVGQTIAGATISGVGNDLVLDTDSFYRPKRPGSYPIVLATYEIVCSKYPDSQVGTAVKAFLQSTIGAGQSGLGDNGYIPIPDEFKSRLSTAVNAIA

SEQ ID NO: 15008 - DNA, 1218 bp, Sulfolobus solfataricus P2
  CDS (1)..(1218): transl_table=11
atgaaagggttttcaactttggcagttgtgataatattaataatagttgttattgcagtggcagggatttttttcgtgataaattcccaaggtggtcataacactacaactacttcaacaagttcatctttttctacttcgtcacaagcttcatcatctcaaactacagcctcatcacaaatttcggcaagtattatagctggtggttctacttttgttaatccattaatgcaagtgtggattaaagatttccagtcaaattataatggaattcaagtaacttatagtgcagtgggtagtggagcaggagtgaataatttcttacaaggtgcctatgacataggagctacagatgttcctccgcccagtaatttgtatcagcaattaactcaaaaatatggtgaagttctcacaatccctgatgttgtaggtgcagtggatataatatacaatattccaagcttttctggtaccttgaacttaacagctgatgttttagcaaagatatacttagggcaaattcaatattgggatgatccagcaataaaagcattaaatccccactttaatttcactcatcaaaaaataatagcagttcatagaagtgatggaagcggcactacctttatctttacatattggctttacacctcatctcaatcttggaggagttcaaatgttagttatggttataccgttaactggccggtagataaacttggaaacggattaggaggtaagggaagtgatggagttacagcatatgtttctcaaaatccttattcaataggctatgttgaggcacagtacgcaatagcgaagaatttaactccagcggccgtattaaatccatccacaggcgattatgttttaccaactcaagcttcaattgagaccgcaattcaaaacgctaatttatcttcgcttccttcttcattgacaagagatttgtctcaatatctttcagtcttcttaaacgttaaagcacacaacgcttatcctatagtgacgttttcatggctagttattaaggtaaattataccgataagtctaaggcagaagcgatttacttatttttgaagtatattgcaactactggacagactgaattaccatcggggtatattgaattaccatcaaatattcaacaattaattctacaaaatcttaagctaatatcatataataatacgtctgtttataccttggtgagctaa

SEQ ID NO: 15009 - protein, 405 aa, Sulfolobus solfataricus P2
MKGFSTLAVVIILIIVVIAVAGIFFVINSQGGHNTTTTSTSSSFSTSSQASSSQTTASSQISASIIAGGSTFVNPLMQVWIKDFQSNYNGIQVTYSAVGSGAGVNNFLQGAYDIGATDVPPPSNLYQQLTQKYGEVLTIPDVVGAVDIIYNIPSFSGTLNLTADVLAKIYLGQIQYWDDPAIKALNPHFNFTHQKIIAVHRSDGSGTTFIFTYWLYTSSQSWRSSNVSYGYTVNWPVDKLGNGLGGKGSDGVTAYVSQNPYSIGYVEAQYAIAKNLTPAAVLNPSTGDYVLPTQASIETAIQNANLSSLPSSLTRDLSQYLSVFLNVKAHNAYPIVTFSWLVIKVNYTDKSKAEAIYLFLKYIATTGQTELPSGYIELPSNIQQLILQNLKLISYNNTSVYTLVS

SEQ ID NO: 15010 - DNA, 897 bp, Clostridium acetobutylicum ATCC 824
  CDS (1)..(897): transl_table=11
atgaaaagtaaaaaaatcaaattaatgtctgtagctataacaatgacaattatggctggtttatttgtaggatgtggaaattcaaattcaagcagcaataaaagtagttcttcaactacgaagaaggtctctggatcaattacactttcaggatctacagcacttcaaccattggcagaaaaatctgtagatggttttaaagaaaaatatcccgatgtgagtgttaatgttcaaggaggaggaagtggtactggattaaaccaggtgcttcaaggagcagttgaagtgggaaattcagatatctttgcagaagaaaaattaaatgcagatgatgcaaaaaaattaacagatcataaagtatgtgcaataggctttgctgtagttactaacaacgatgtaaatgtaaagaatttaacaaaacagcaggttcaagatatatttactggtaagataacaaactggaatcaagttggtggaccaagtgaagcaataaacatagttcacagacctaaatcctctggaacaagagcaactttcactaaaacagttatggatggaaaagacgaaaaagatgatattggaactacacaggacgccagtggatcagttaaaactgcaatgacaagtgcaaaaggttctataagttacttagcattttcttatcttgtaacagatgagggtaaaaaagatataaatattctatcattagatggagtagaggctacttcaaagaatgtagaaaatggtacttatcctttctggtcatatgagcatatgtacacaaaaggtaaaggaaatgatgcagctaaagcatttatagattatatgatgagttcagataataaagccttaattgaaaaaatgggatatatatcagcatctaatataaagaaatag

SEQ ID NO: 15011 - protein, 298 aa, Clostridium acetobutylicum ATCC 824
MKSKKIKLMSVAITMTIMAGLFVGCGNSNSSSNKSSSSTTKKVSGSITLSGSTALQPLAEKSVDGFKEKYPDVSVNVQGGGSGTGLNQVLQGAVEVGNSDIFAEEKLNADDAKKLTDHKVCAIGFAVVTNNDVNVKNLTKQQVQDIFTGKITNWNQVGGPSEAINIVHRPKSSGTRATFTKTVMDGKDEKDDIGTTQDASGSVKTAMTSAKGSISYLAFSYLVTDEGKKDINILSLDGVEATSKNVENGTYPFWSYEHMYTKGKGNDAAKAFIDYMMSSDNKALIEKMGYISASNIKK

SEQ ID NO: 15012 - DNA, 1002 bp, Synechocystis sp. PCC 6803
  CDS (1)..(1002): transl_table=11
atgcttagttcactgcaaaaagttgctaccttctccgtagtcagcgttatcgtcggttttggtggcattggccaggccattgccggtaccctcaatggtgcgggagcgagttttccggccccactctaccaacgttattttgctgagtataaaaaagctaccggtaatactgtcaattacaactccgtcggtagtggcgctggtattcgtcaatttatcggtgaaaccgttgattttggtgccaccgatgctgtgcccacttccgcccaacgtcaacagatgaaacggggtgtggttatggtgcccaccgctggtggcgctgtggcggtagtttacaatttaccaggcaaaaaagtacaactttctcgcattgccttgggtaaaattttcaccggggaactaaaaacctggaaccaggtggattccaaactgcccaacactcccattcgagttgtggtacgggccgatggtagtggcaccacggatatttttactagccacctcagcgctattagtagcacctttagaagcaagattggtgctagccaagatcccaactggggtttccaagtactgaaaggtccgaaaaatgacggggtagcggcaacggttaagcaaacccccggggcgatcggttatgtccaggacacctttgcccgccgtaacgagggtcccaatctgcaaaccgccaaggtacaaaataaggccggtcagtatgtagaacccagcttggcagaggccaataaagccatcagtggagccaagtttgacgcgaactttgttgctgaaataagtgatcctgcctccggttatcccattgtgggtttgacctggttgttggtgtatcaaaacaataaaaatgccaacgttgccaaggacgtcaaagctttggtgcgctggattttgaccactggccaaaaccataatacccagttggagtacaccaaaattcctcccgccgttgcccaacgggtaattgcagcagttaacaagatcaaataa

SEQ ID NO: 15013 - protein, 333 aa, Synechocystis sp. PCC 6803
MLSSLQKVATFSVVSVIVGFGGIGQAIAGTLNGAGASFPAPLYQRYFAEYKKATGNTVNYNSVGSGAGIRQFIGETVDFGATDAVPTSAQRQQMKRGVVMVPTAGGAVAVVYNLPGKKVQLSRIALGKIFTGELKTWNQVDSKLPNTPIRVVVRADGSGTTDIFTSHLSAISSTFRSKIGASQDPNWGFQVLKGPKNDGVAATVKQTPGAIGYVQDTFARRNEGPNLQTAKVQNKAGQYVEPSLAEANKAISGAKFDANFVAEISDPASGYPIVGLTWLLVYQNNKNANVAKDVKALVRWILTTGQNHNTQLEYTKIPPAVAQRVIAAVNKIK

SEQ ID NO: 15014 - DNA, 1152 bp, Synechocystis sp. PCC 6803
  CDS (1)..(1152): transl_table=11
atgactactttcaagcagattaaaaagttgtccaagcatttagtgcccacagcttctatcctggcactaactgttggtctggcagcctgtggtggcggtggtggtggtggtgacacagcccaaaccggtggtggtgatgcaactacaactactgccgcagatgcctttgccagtaaagtttccttgaccggtgccggtgctagttttcctgctcccctttaccaaggctggtttgtggccctcaatcaagctgtgcctaacttagaagttaactatcagtccgtgggtagtggtgctggggttgagcaattcatgagtaagaccgtggattttggtgccagcgatgtggccatggacgacgaagagattgccaaggttaacggtgaagtggtaatgcttcccatgaccgctggtagcattgttatggcctacaacttgcctggggtggaagggttgaagttatcccaggaagccttggcgggcatcatgttgggcaatattactaaatggaatgaccccaaattagtggcggataatcccgatttgaccttgcccgatcgccctatcacggtggtgcatcgttccgacggtagcggtaccacggcggttttcaccatgaacttggccgccatgagtcccgaatttaaggaaaccatcggtgacggtaaaaccgttgagtggcccaccagtaaaggtaaattcatcggtggtaagggtaacgaaggtgtaaccgctggtattcaacaaaatgagggagccattggctacgttgaatatggctacgccaccaacaataacctgaccatggccagcctccagaacaaggatggacagtttgttgtgccgaccgatgaaaatgcttcggccaccctggctgcagtcgaactgccggaaaacctgcgggaattcatcactaaccccgctggggctgattcctatcccattgttacctacacctggatgttgctttatccccagtacgctgatgcggaaaaggctaaaggtatcgaagcgatggtggaatttggtctgaatgaaggtcaaaccatggcccccactttgggttatgtacctttacctcaaaatgtgcgggaaaaagtggccgccgctgctgacaaaatctcccccgattacaccattaccttgaaatag

SEQ ID NO: 15015 - protein, 383 aa, Synechocystis sp. PCC 6803
MTTFKQIKKLSKHLVPTASILALTVGLAACGGGGGGGDTAQTGGGDATTTTAADAFASKVSLTGAGASFPAPLYQGWFVALNQAVPNLEVNYQSVGSGAGVEQFMSKTVDFGASDVAMDDEEIAKVNGEVVMLPMTAGSIVMAYNLPGVEGLKLSQEALAGIMLGNITKWNDPKLVADNPDLTLPDRPITVVHRSDGSGTTAVFTMNLAAMSPEFKETIGDGKTVEWPTSKGKFIGGKGNEGVTAGIQQNEGAIGYVEYGYATNNNLTMASLQNKDGQFVVPTDENASATLAAVELPENLREFITNPAGADSYPIVTYTWMLLYPQYADAEKAKGIEAMVEFGLNEGQTMAPTLGYVPLPQNVREKVAAAADKISPDYTITLK

SEQ ID NO: 15016 - DNA, 1041 bp, Salmonella typhimurium LT2
  CDS (1)..(1041): transl_table=11
atgaaagttatgcgtaccactgtcgcaactgttgtcgccgcgaccttatcgatgagcgcgttctctgcctttgcagcagcaagcctgacaggtgccggtgcaacgtttcctgcgccggtgtatgccaaatgggcggatacctaccagaaagaaaccggtaacaaagtcaattaccaggggataggctcttccggcggcgtgaaacaaatcaccgcgaataccgttgattttggcgcttccgatgcgccgctgtctgacgaaaaactgaatcaggaaggcctgttccagttcccgacggtgatcggcggcgtggtgctggcggtgaatattccaggcctcaaatccggcgaactggtgctggatggtaaaacgctgggtgacatctacctcggtaaaatcaagaagtgggatgatgaagccatcaccaaactgaacccaggcgtgaagctgccttctcagaacatcgctgtggtgcgtcgcgctgacggttccggtacctccttcgtgttcaccagttacctggcgaaagtcaacgacgagtggaaatcgaaagtgggcgcgggttctaccgtgaactggccaaccggtctgggcggtaaaggtaacgacggcatcgcggcatttgtacagcgtctgccaggcgctatcggctacgttgaatacgcttacgccaagcagaacaacctggcctacaccaaattggtttctgccgacggcaaaccggtaagcccgacggaagagagcttctctaatgcggcgaaaggcgcagactggagcaaaaccttcgcgcaggatctgaccaaccagaaaggtgacgatgtgtggccaatcacttccaccacgtttatcctggtccacaaagcgcagaagaaacctgagcagggtgctgaagtgttgaagttcttcgactgggcctacaaaaatggcgctaagcaggcgaatgatctggactacgccagcctgccggataacgttgttgagcaggttcgtgctgcatggaagaccagtataaaagacagcaacggtaaggcgctgtattaa

SEQ ID NO: 15017 - protein, 346 aa, Salmonella typhimurium LT2
MKVMRTTVATVVAATLSMSAFSAFAAASLTGAGATFPAPVYAKWADTYQKETGNKVNYQGIGSSGGVKQITANTVDFGASDAPLSDEKLNQEGLFQFPTVIGGVVLAVNIPGLKSGELVLDGKTLGDIYLGKIKKWDDEAITKLNPGVKLPSQNIAVVRRADGSGTSFVFTSYLAKVNDEWKSKVGAGSTVNWPTGLGGKGNDGIAAFVQRLPGAIGYVEYAYAKQNNLAYTKLVSADGKPVSPTEESFSNAAKGADWSKTFAQDLTNQKGDDVWPITSTTFILVHKAQKKPEQGAEVLKFFDWAYKNGAKQANDLDYASLPDNVVEQVRAAWKTSIKDSNGKALY

SEQ ID NO: 15018 - DNA, 909 bp, Listeria innocua Clip11262
  CDS (1)..(909): transl_table=11
atgaaaaagaagtatttgggaatagtagcaatgttagcagcagtaatgcttgtcttcgcagcatgtggaagtgacagcagttcaaaagataaagcaaacggatcaacaaaaggggataaagaagtttctggctcattaacagcagtcggatccactgcacttcaaccactcgttgaagcagcttccaaagaatttacaaacactaaccctaaagctcaaatcaatgttcaaggcggcggttctggaactggtttaacacaagtacaacaaggtgcagttgaaattggtaactcggacgtattcgctgaagaaaaagacggcgtagatgcttcaaaacttgttgatcatcgtgtagcagttgttggaatggcacctgtagtaaacaaagatgtaggcgttaaaaatattactaaacaacaattaatcgacattttcactggtaaaacaactaactggaaagacgttggcggtaaagacgaaaaaattacaatcatcaaccgtgcggaaggaagcggaacacgtgctactttcgaaaaatggggacttgatggtaaaacaccagttaaagcacaagaacaagattcatccggtacagttcgtaaaatcgtaagcgaaactccaggagcaatcagctacctagcattctcttacattgacgcttccgtagttggtctttcattagatggcgttgaaccaacagaagaaaaagttgcaactaacgattggaaaatctggtcttatgaacatatgtatacaaatggcgaaccaaaaggcctaacaaaaactttcttaaaatatatgacttctgatgaagtacaaaacaatatcgtaccacaacttggttaccaatcaatcaaatccatgaaagtggaacgcgatgcatctggtaaactaactgacgtaaaataa

SEQ ID NO: 15019 - protein, 302 aa, Listeria innocua Clip11262
MKKKYLGIVAMLAAVMLVFAACGSDSSSKDKANGSTKGDKEVSGSLTAVGSTALQPLVEAASKEFTNTNPKAQINVQGGGSGTGLTQVQQGAVEIGNSDVFAEEKDGVDASKLVDHRVAVVGMAPVVNKDVGVKNITKQQLIDIFTGKTTNWKDVGGKDEKITIINRAEGSGTRATFEKWGLDGKTPVKAQEQDSSGTVRKIVSETPGAISYLAFSYIDASVVGLSLDGVEPTEEKVATNDWKIWSYEHMYTNGEPKGLTKTFLKYMTSDEVQNNIVPQLGYQSIKSMKVERDASGKLTDVK

SEQ ID NO: 15020 - DNA, 1179 bp, Nostoc sp. PCC 7120
  CDS (1)..(1179): transl_table=11
atgctctcatatatcaagagaattaaaaataaccgcattccagtatcaattaccgtattaacactggcgatgagtttagctgcttgtggtgggcagcaaggctcagacaacactgcaactcaagatggttcatccggcacagctaaagatgctacagcttccagccctgcaaaattggatcttggcggcaatgtttcattaactggtgcaggtgcatctttccctgcaccactatatgcaagttggtttacagatttaaataaaaagtatcccaatttgcaaattaactatcagtcagtaggtagtggtgcgggagttgagcaatttattcaaggtactgtagactttggtgccagcgacgttgccatgaaggatgaagaaatccagaaagttcagagaggagtgcttttgttaccggtgactgctggtggaattgtactagcttacaacttgcctggtgtgacagaattgaatttaccaagagttgtttatacagatattctcctgggcaaaatcaagacttgggacgctccagaaattaaagctgctaaccctaatgtcaaccttcccagtcaaccaattacggttgtgtatcgttctgatggtagtggtactacaggagtgtttaccaaacacttggctgctgtcagtccagaatggaaaagtaaggttggtgaaggtaagtctgtttcttggccagtgggagttggtggtaagggtaatgaaggtgttactgcccaaattaaacaaactcaaggtgctataggctacattgagtatggttatgctaaacaaaacaatatcagctatgccactttggaaaataaagccggcaagtttgtgaaatacaatgatgagtcagcatctcaaactctagcagcaatccaattgccagaaaacctacgtgcttttgtgccagacccagatggagatggatcatatccaattgtcagtttcagttggattatggcttataaaaattatcctgatccagtaaaagctaaagcaatggaggctgccattgagtacgctttaactgaagggcagaagatttctggagaattaggttatattcccttacctcaagctgtagtgcagaaaactgctactgttgctgaccaaatcagtccagaatataaaatatctgtaagtggcagtggtactagtgccagcaagtag

SEQ ID NO: 15021 - protein, 392 aa, Nostoc sp. PCC 7120
MLSYIKRIKNNRIPVSITVLTLAMSLAACGGQQGSDNTATQDGSSGTAKDATASSPAKLDLGGNVSLTGAGASFPAPLYASWFTDLNKKYPNLQINYQSVGSGAGVEQFIQGTVDFGASDVAMKDEEIQKVQRGVLLLPVTAGGIVLAYNLPGVTELNLPRVVYTDILLGKIKTWDAPEIKAANPNVNLPSQPITVVYRSDGSGTTGVFTKHLAAVSPEWKSKVGEGKSVSWPVGVGGKGNEGVTAQIKQTQGAIGYIEYGYAKQNNISYATLENKAGKFVKYNDESASQTLAAIQLPENLRAFVPDPDGDGSYPIVSFSWIMAYKNYPDPVKAKAMEAAIEYALTEGQKISGELGYIPLPQAVVQKTATVADQISPEYKISVSGSGTSASK

SEQ ID NO: 15022 - DNA, 1032 bp, Ralstonia solanacearum GMI1000
  CDS (1)..(1032): transl_table=11
atgaaattggtcaagactgcgattgcgggcgttgtttcgctggctttcgctggtatcgcgtttgccgccgacatcaccggcgctggcgcgacgttcccggcgcctgtctataacaagtgggctgacgcctatcagaaggccaccggcaccaaggtgaactatcaaggcatcggctcgtcgggcggcatcaagcagatcaccgccaagaccgtcgatttcggcgcctcggacatgccgctcaaggatgacgagctgagcaaggacggcctgctgcaattcccgaccgtgatcggcggcgtggtgccggtgatcaatctgccgggcgtgaagccgggcgagctggtcctgacgggccaggtgctgggcgacatctacctgggcaaggtcaagaagtggaatgacccggccatcgtcaagctgaatccgaaggccaagctgccggaccaggacatcctggtggtgcgccgtgctgacggttcgggcacctcgttcatcttcacgaactacctgtcgaaggtgagcgccgagtggaagggcaaggtcggcgaaggcacgaccgtgaactggccgaccggcacgggcggcaagggcaacgaaggcgtggccgccttcgtgcagcgtctgggtggcgcgatcggctacgtcgagtacgcctacgccaagcagaaccacatgacccacatcaatctgcagaacgcctcgggcgccgtggtgcagccgaccagcgacgccttcaaggccgccgctgccggcgccgactggagcaagtcgttctaccagatcctgaccaaccagccgggcaaggacgcatggccgatcgccggcgcgaccttcatcctggtgcacaagacccaggacaagccggtccagggcaccgaggtcctgaagttcttcgactgggcctacaagaacggcggcaaggatgcttccgcgctggactacgtgccgctgccggacccggtgctgaaccagattcgcgccacctggaagtcgggcgtgaaggacgcttcgggcaagccgatctacaactga

SEQ ID NO: 15023 - protein, 343 aa, Ralstonia solanacearum GMI1000
MKLVKTAIAGVVSLAFAGIAFAADITGAGATFPAPVYNKWADAYQKATGTKVNYQGIGSSGGIKQITAKTVDFGASDMPLKDDELSKDGLLQFPTVIGGVVPVINLPGVKPGELVLTGQVLGDIYLGKVKKWNDPAIVKLNPKAKLPDQDILVVRRADGSGTSFIFTNYLSKVSAEWKGKVGEGTTVNWPTGTGGKGNEGVAAFVQRLGGAIGYVEYAYAKQNHMTHINLQNASGAVVQPTSDAFKAAAAGADWSKSFYQILTNQPGKDAWPIAGATFILVHKTQDKPVQGTEVLKFFDWAYKNGGKDASALDYVPLPDPVLNQIRATWKSGVKDASGKPIYN

SEQ ID NO: 15024 - DNA, 1062 bp, Ralstonia solanacearum GMI1000
  CDS (1)..(1062): transl_table=11
atgttcaagcacgcagtcctggccctggcgatggtcgcctcgggcttgcccgttctcgcgcgggcggaaatcctcggcgcgggatcgaccgccgcggcaccggtctaccgcatctggtcggcgggctacaccgccgcctcgggcacgacgctcaagtacgacgcggtgggctcgggagagggcctcaagcgcatccgcgcgggcacggtggatttcggcgcatcggatgtgccgctgtcgtcggccgatgcggccaaggccgggctggtgtgcgtgccatcggtggtgacgggggcggtccccttcgtcaatctgccgggcatgccgcacggccagttgcggctcacgggcgaggtgctggcgcgcatcttcctcggcaaggtcgagacctgggacgcgcccgaactgcacgcgctcaaccccggcctggcgctgcccaggctgaagatccaccccgtggtgcgcgccgacggctcgggcacgacctatcacttcaccgactacctgagcgccgtcagcgcagactggaaagccgcctacggcaccaagtcgaccctcgcctggccggccgacttcaccgccgccaagggcagcggcgacgtggtcaaggcggtacaggccacgcccggcgccatcggctacgtcgactacaactacgtcctcgacaacgacctgaacgcggtgcagttgcgcaatgccgccggccatttcgtcagcgcccaggtcagcggcttccgcgatgcggtgctgcagagcgcctggaaccgcaagggcgacttcaccgcgccgctcgtgaacctgcccggccccgacacctggccgatcaccatgggcaccttcatcatcgtgccggccgtgagcgccaacggcgcgcgcacgctggacgcgctcaagttcctgacctggggctacttccatggtgacgagctggccgcccgcgccaagttcgtgccgctgcccgagcgcgtccaggcgatcgcgtaccgggaactggcgcgcgtgaccgataccgccggcaccaccatcggactgcagagcatgcccgcgaactgggccaaatag

SEQ ID NO: 15025 - protein, 353 aa, Ralstonia solanacearum GMI1000
MFKHAVLALAMVASGLPVLARAEILGAGSTAAAPVYRIWSAGYTAASGTTLKYDAVGSGEGLKRIRAGTVDFGASDVPLSSADAAKAGLVCVPSVVTGAVPFVNLPGMPHGQLRLTGEVLARIFLGKVETWDAPELHALNPGLALPRLKIHPVVRADGSGTTYHFTDYLSAVSADWKAAYGTKSTLAWPADFTAAKGSGDVVKAVQATPGAIGYVDYNYVLDNDLNAVQLRNAAGHFVSAQVSGFRDAVLQSAWNRKGDFTAPLVNLPGPDTWPITMGTFIIVPAVSANGARTLDALKFLTWGYFHGDELAARAKFVPLPERVQAIAYRELARVTDTAGTTIGLQSMPANWAK

SEQ ID NO: 15026 - DNA, 1233 bp, Pyrobaculum aerophilum str. IM2
  CDS (1)..(1233): transl_table=11
atgggcataaaaacggtcgtaatagccgccgcggcgattataataattgctctactggcggcgttgcttggtttgggcgggggaggcaagcagacccagtcggcagagccccctcagaccagcgcgccgggccagtcgcagactattaccagcacctcggcgataggcggttctctcactggcggcggatctacttttataaatcctcagatggtggcttggtcaaagaggttctatgaagccactggcggaaaggtgcaagtaaattatcaatccattggctccggggcaggaacagcgcagttcttggagaaaaagctagatttcggcgcatccgacgtgcccatgccgagagataaatatgaacaagtcaaggggcgttttatgcaattccccgtaatcataggctctattgttgttgtgtacaacgtgccggagatagcatatgagaagactgggaagtacctaaacctcacctctgaggtgatctctctaatatacacgggggagattaaacagtggtgtgacgataggataaaggcaattaacccaggcctcgcggacaaactcccctgtagggacattacggctgttcacagaagcgacggctcgggcactaccgccgcctttactctttacttatcaaaggcctatcctccgtggaaccagacagtggggtgggggtatactgttaagtggcctgtcgacgagagaggcaagggcgtcggcgccaagggaaatgaaggcgtggcgcaggcggttttgcagaacgcctattccatcggatatgtggaatacgcctattgggttaaaaacaaagagaagtacgacaaaatcggcggcgtggcgtatcttaaaaacgacaacgacgggaagtactacttcccatccgccgaggccgtaagcgctggtgcatcggcggctctggagagatatagagctaagtatgggcaagtgcccgcgccagacgctgactggaatcccgtctctatagagttttcaaacccgccgaagggatacccactgctgtcttttacctacgtctttgtatggaaggactactccgctgagggctacggcaacgcgccggggaaagccgccttaattaggcagtttctccaatgggtgcttacagaaggccaaaagcagggtaacttagttgagggctacatcccgttgccgccggacttagccgccataggcctagaggcccttaagcaagtgaaaccctaa

SEQ ID NO: 15027 - protein, 410 aa, Pyrobaculum aerophilum str. IM2
MGIKTVVIAAAAIIIIALLAALLGLGGGGKQTQSAEPPQTSAPGQSQTITSTSAIGGSLTGGGSTFINPQMVAWSKRFYEATGGKVQVNYQSIGSGAGTAQFLEKKLDFGASDVPMPRDKYEQVKGRFMQFPVIIGSIVVVYNVPEIAYEKTGKYLNLTSEVISLIYTGEIKQWCDDRIKAINPGLADKLPCRDITAVHRSDGSGTTAAFTLYLSKAYPPWNQTVGWGYTVKWPVDERGKGVGAKGNEGVAQAVLQNAYSIGYVEYAYWVKNKEKYDKIGGVAYLKNDNDGKYYFPSAEAVSAGASAALERYRAKYGQVPAPDADWNPVSIEFSNPPKGYPLLSFTYVFVWKDYSAEGYGNAPGKAALIRQFLQWVLTEGQKQGNLVEGYIPLPPDLAAIGLEALKQVKP

SEQ ID NO: 15028 - DNA, 819 bp, Clostridium perfringens str. 13
  CDS (1)..(819): transl_table=11
atgaataggagaagagtagtaattgcattaagcagtattttagcaatgggatttttattaacaggatgtggtggaggatcaagagctaatataataaaaatttcaggctcaagttcagtaggaccattagtagaggctgaagcagaagtttttaaaaaggatatgccagatattactgttgaggtaaatcaattaggatcatcagcaggaataaaagatgctataaatggaactgtagagataggaatttcttcaagagatttaaaggaaaaggaattggaatctggaattaaagaaaaacctattgcctatgatgggatgtcagtaataattaacaatgaaaatccagtgcaaaatcttacaatggagcagattagggatatatatacagggaaaataacaaactggaaagaggttggtggagaagatactccaatagtattagtttcaagggaagatggatcaggaacaagagatgccttccaagaaattgttggattcaattcagaggaaataagtccacaggctcagatttcagatggttctggaagtattaaaacaatggtatcaggaaataagaatgcaataggatatatatcctttagttacgtagataattcagtgcatgcagttagcattgatggagtaaagcctacagccgaaaatgtgcaaaataaaatgtacaagctatcaagaccatttttattagtatataaagaggaaaatttaaatgaaaattcaaagaaatttatagattttataatgagtaaagaaggacaagaaatagttgaagaagatggattaataagtgtaacttaa

SEQ ID NO: 15029 - protein, 272 aa, Clostridium perfringens str. 13
MNRRRVVIALSSILAMGFLLTGCGGGSRANIIKISGSSSVGPLVEAEAEVFKKDMPDITVEVNQLGSSAGIKDAINGTVEIGISSRDLKEKELESGIKEKPIAYDGMSVIINNENPVQNLTMEQIRDIYTGKITNWKEVGGEDTPIVLVSREDGSGTRDAFQEIVGFNSEEISPQAQISDGSGSIKTMVSGNKNAIGYISFSYVDNSVHAVSIDGVKPTAENVQNKMYKLSRPFLLVYKEENLNENSKKFIDFIMSKEGQEIVEEDGLISVT

SEQ ID NO: 15030 - DNA, 1128 bp, Pyrococcus furiosus DSM 3638
  CDS (1)..(1128): transl_table=11
gtgaagaggctagcaacaatatttattatttttgccttggggctttccttagtggcaagcggttgtatatccgagggaaatgcatccaatgtccctcaagcaacttctaaaactgagataataacgattcgcacaacaggtgcaacttttccccaatatcagctccaaaagtggattagcatatatacaaaaaagaacccaaacgttaagatcgagtatgaaggtggtggaagtgggcatggtcaagaagcatttctaaagggccttacagatataggaagaacagaccccccagttaaagaatccacgtggaaaaagttccttgaaactggtgatcagccccttcagtttcctatagttgtcggtgctgtagtcgtcgttcacaatattccaaatgttgatgagctaaagctcgatggagagaccttagcgaaaatctttatgggccaaatagagtattgggatgatccagcaataaagtcccttaatcctaatgtaaaccttcctcacgaaaaaataatagtaattcataggagtgattcgagtggaaccactgcaatttttaccacttacttgagcttagtcagtgaagaatgggccacaaaagtaggagccggaaagactgtggattggccagttgacaaagttggaaggggaattggtgcaaaaggcaacccaggagttgttcaggccttaaagaacaccccatatagtatagcatacactgagctatcttttgcaatagaggaaaatctcaagatagtagcactcaaaaacaaagccggaaacttcgtcaaacctaccgaggagacaataaaagctgcagtagccgcagttaaggcctttatacccgatcccgctgaggggtataaagaggatattaggcaacttctcaatgctcccggagaaaattcatacccgatagttgcttttacacactttctcgtctggcagaataagggaggaaagcactacagtaaagagaaggctcaagcgattaaggactttcttagatgggttttaacagagggacagaaaccagagaatattgctccaggctacgtaggtctcccacctgaagttgccgaaataggtcttaaggcagttgagatgatagaaacaggttaa

SEQ ID NO: 15031 - protein, 375 aa, Pyrococcus furiosus DSM 3638
MKRLATIFIIFALGLSLVASGCISEGNASNVPQATSKTEIITIRTTGATFPQYQLQKWISIYTKKNPNVKIEYEGGGSGHGQEAFLKGLTDIGRTDPPVKESTWKKFLETGDQPLQFPIVVGAVVVVHNIPNVDELKLDGETLAKIFMGQIEYWDDPAIKSLNPNVNLPHEKIIVIHRSDSSGTTAIFTTYLSLVSEEWATKVGAGKTVDWPVDKVGRGIGAKGNPGVVQALKNTPYSIAYTELSFAIEENLKIVALKNKAGNFVKPTEETIKAAVAAVKAFIPDPAEGYKEDIRQLLNAPGENSYPIVAFTHFLVWQNKGGKHYSKEKAQAIKDFLRWVLTEGQKPENIAPGYVGLPPEVAEIGLKAVEMIETG

SEQ ID NO: 15032 - DNA, 1128 bp, Corynebacterium glutamicum ATCC 13032
  CDS (1)..(1128): transl_table=11
gtgaacctcactcttaagcgctccatcgcccttgtgggcgcagttactgcaggctccttcgctcttgtagcttgctccgactccaatgagtctgattccacctcctcatctgcagcttccaccggttcttccgatgctgcatccattgagggcctttccggtgttaccggtcagctcgttgctgaaggtgcatcttcccagcagtccgcaatggactactttggtatccgttactccgaggctgtcagcggtgcatctctggcttacaccccttcaggttccggttccggccgcaccaacttcgctgcaggccaggttgctttcggtggctccgactccgcaatgaaggacgaccaggctgcagaagcagaagcacgttgcaacggcaacgaagcatggcacctgccattcgttatcggcccagttgcagttgcttacaacctgcctggcgttgacaccctgaacctggacaccaacatcatcgctcagatcttcaagggcgagatcaccaagtggaacgacgaagcaatcgcttcccagaacgagggcaccgacctcccagaccaggacatctccgttctgtaccgttccgaagagtccggtacctccgacaacttccagaagttcctcggagcttccaccgacatctgggagaccgaaggccagcagttcccaaccgaggttggctccggtgcgcagggctccaacggtgtagcttctgaggcttccaacatcgagggtgcaatcacctacgttgaagctggtttcgctaaccagtccggcctgggcgttgcaaacatcgacttcggttccggcccagttgaactcaacgctgagtccgttggcgttgcacttggtgcactcgacttcctgactgagggccacaacatggttgttgacaccgacgctatgttcgcaatgaacgaagccggtgcttacccactgatcctcaccacctacgaaatcgtctgctccgcaggctacgacgagaccacccgcgaccaggtcaaggacttcctgaccgttgcactggactcccaggatgaccagctcgaggctctcggctacatcccagttaccggcgagcactacgatcgcctcgttgcagcagttgaagcaattcagtaa

SEQ ID NO: 15033 - protein, 375 aa, Corynebacterium glutamicum ATCC 13032
MNLTLKRSIALVGAVTAGSFALVACSDSNESDSTSSSAASTGSSDAASIEGLSGVTGQLVAEGASSQQSAMDYFGIRYSEAVSGASLAYTPSGSGSGRTNFAAGQVAFGGSDSAMKDDQAAEAEARCNGNEAWHLPFVIGPVAVAYNLPGVDTLNLDTNIIAQIFKGEITKWNDEAIASQNEGTDLPDQDISVLYRSEESGTSDNFQKFLGASTDIWETEGQQFPTEVGSGAQGSNGVASEASNIEGAITYVEAGFANQSGLGVANIDFGSGPVELNAESVGVALGALDFLTEGHNMVVDTDAMFAMNEAGAYPLILTTYEIVCSAGYDETTRDQVKDFLTVALDSQDDQLEALGYIPVTGEHYDRLVAAVEAIQ

SEQ ID NO: 15034 - DNA, 990 bp, Methanopyrus kandleri AV19
  CDS (1)..(990): transl_table=11
gtggggggtgaaattttgaagaagtacctaattgcggctgtggtcgcgatcgcggtcatcgcaggaggcgcggcttactactactccacagcgggtgcagtaaaaacacagctaaggataggaggatcgacgagtctaatgccatttatgatgaaggttgcagcttatgtcggtgaagaacaccgaatgacatggaagcagattggcgaacaagtgggtgttcaaggactacctgacgagcccgtacagttgatggtttctgatggtggatcctccgcaggtattaagggtctcattgagggaacgttcgatatcgctatggcatcgagaccactgaagcctgaagaagctcagcagttaagtgatcctgtgatgtgtcctgtggtcctatcagcgattgtaccgatcgtgaatgggaagacgctaggccagttagacgacatcgacccgaagacgcttagggacatctataccggtaagatcaagtactgggatcaggtgaagccgggtctaccacacaagaaaatcgtcgtaatcggtcgtgcgaagggttcaggcacgcggtcaacgtttgacaagtacctaaacatccaggattacaccaaggacgccatcctctgtgggtctaactcggaggtcctggagaaggtagagaagacgccgtacgctatcggttacgtggattacgcctacgtcgtcaaagccaagaagggcggtaaggtgccgagcgcggtgaagccgctgaaagtcaacggtgttgaagccaacgagcagacgatcatcgcgaagaagtacccactggtcagggccgagtacctgatcatcgaccgctccaatgccccgaagacggcgatcgctttgatcaagtggatcaggaagccggacgtcaacaaggagttcgcggagaaggtgggatacgtcccggtacccgaggatgcaccgctgttctctaagaagccgtacatagagatcaaaccgctagttaagtaa

SEQ ID NO: 15035 - protein, 329 aa, Methanopyrus kandleri AV19
MGGEILKKYLIAAVVAIAVIAGGAAYYYSTAGAVKTQLRIGGSTSLMPFMMKVAAYVGEEHRMTWKQIGEQVGVQGLPDEPVQLMVSDGGSSAGIKGLIEGTFDIAMASRPLKPEEAQQLSDPVMCPVVLSAIVPIVNGKTLGQLDDIDPKTLRDIYTGKIKYWDQVKPGLPHKKIVVIGRAKGSGTRSTFDKYLNIQDYTKDAILCGSNSEVLEKVEKTPYAIGYVDYAYVVKAKKGGKVPSAVKPLKVNGVEANEQTIIAKKYPLVRAEYLIIDRSNAPKTAIALIKWIRKPDVNKEFAEKVGYVPVPEDAPLFSKKPYIEIKPLVK

SEQ ID NO: 15036 - DNA, 999 bp, Methanosarcina acetivorans C2A
  CDS (1)..(999): transl_table=11
atggtatttaagaacgataaagcagtatctccagtcgtagcaacactcgtactggttgttgtcgcaatcatcggcgcagcagcagtcggtgcattactcggtgcattcagcagcgatgtctcggatgaagcaagcgcaggcgaaacttccggtgcttcttcgacagaacttttaattggtggttctaccactgtccagccagtctctgaggttctcgcagatgcttacatggaagaacacaagggaataaaagtcaatgttcagggcggcggttccggtgctggagtttccggtgcagagaaaggagtgctggatattggttcttcctctagcgcaattgcaaaagcagaccacccagatttacaggtctttgagattggtggtagtgcagtggtgcttattggtagtaacgaagtgaccgcaattgaagtacccggcgctgacgcggctgctcagcaggcaaatatgaaagcaatttacaccgctgctgttgagggtgtagctgaatatgacgatacccttacagcctcaactggtgccgcattgacagtcttacagagatcttctgcaagcggcactgaggaaactttctcagaatacattggtgacggtagcaaaacattcatagacggtacagaagcactcggcaaagcttcaaatggtgatgtgtatagcgcggttaagtcagcttcaacacctacaatcggtttcgtagactacggattttataactccgacgactctacagagcttcacttaattggtcttggctgcacacaggctgaaataaccccaacgaatatcaaagctgcattaaaagtaaaatcaaccggaacaggtacagcagacttcccaaccggtctttgcagaaacctgtactactgtactcttggaagcccatcttcaaccgagcagagctttatcaacttcgccatgagccctggagcgattgacttcttccacgaagcagggacattcagcgcatacgattaccagtaa

SEQ ID NO: 15037 - protein, 332 aa, Methanosarcina acetivorans C2A
MVFKNDKAVSPVVATLVLVVVAIIGAAAVGALLGAFSSDVSDEASAGETSGASSTELLIGGSTTVQPVSEVLADAYMEEHKGIKVNVQGGGSGAGVSGAEKGVLDIGSSSSAIAKADHPDLQVFEIGGSAVVLIGSNEVTAIEVPGADAAAQQANMKAIYTAAVEGVAEYDDTLTASTGAALTVLQRSSASGTEETFSEYIGDGSKTFIDGTEALGKASNGDVYSAVKSASTPTIGFVDYGFYNSDDSTELHLIGLGCTQAEITPTNIKAALKVKSTGTGTADFPTGLCRNLYYCTLGSPSSTEQSFINFAMSPGAIDFFHEAGTFSAYDYQ

SEQ ID NO: 15038 - DNA, 1475 bp, Streptomyces coelicolor A3(2)
  CDS (363)..(1475)
gtcgacgagctgctcaccacccgtcttccctgaacacccagacctgagcactcacccacgcgtactcagccccgcgcactcaccccacgcactcagccctgagcacccacccccgcgcactcagccctgagcacccaccccccgcacccagcgaggcccgagcgccccggaaccggcccgtgtcctcgacgtaagcgttccgtgacctcaccgcaccgtccacaggggttcacccggcgttcatttacgcccttcggcgccttcatctcatctgcctaatttcggccttaccactcctcgcacgccgccgaattcaggacggcggctcctggaaggaactccctcaagtgaagcttcagcgcatgaaccggcgggccctcgctctcggtgctctcgccgtctccggcgccctggccctcacggcgtgcggctccgacgacaccggcggcaacagcggcagcgactccagctccgccgccgccaacagcaacatcaagtgcgacgacgccaagggccagctccaggcctccggctcgtccgcccagaagaacgccatcgacgcctgggtcaagcagtacgtcgccgcctgcaacggcgtgcagatcaactacaacccgaccggttccggcgcgggcatcaccgccttcacgcagggccagaccgcgttcgccggttcggactccgcgctgaagccggacgagatcgaggcctcgaagaaggtctgcaaggacggccaggccatcgacctgccgatggtcggcggcccgatcgcggtcggcttcaacgtcaccggcgtcgactcgctcgtcctggacgcgccgaccatggcgaagatcttcgacagcaagatcaccaactggaacgacgaggcgatcaagaagctcaaccccgacgccaagctgcccgacctgaagatccaggccttccaccgctcggacgagtccggcaccacggacaacttcaccaagtacctgaaggccgccgcgcccgacgactggaagtacgagggcggcaagtcctgggaggccaagggcggccagtccgcgcagggctcctccggcctggccggccaggtgaagcagacccccggcgccatctcgtacttcgagctgtcctacgccaaggacggcatcaagaccgtcgacgtcaagaccgcagccgccgagccggtcaaggccaccgtcgagaacgccaccgccgccatcggcgcggccaaggtcgtcggcaccggcaaggacctggcgctggagctggactacaccccggacgccgccggcgcctacccgctggtcctggtgacgtacgagatcgcctgcgacaagggcaacaaggcggacaccctgcccgccaccaagtccttcctgaactacatggcctcggaggacggccagggcctgctggcggacgccggctacgccccgatgcccaccgagatcatcaccaaggtccgcgagaccatctcgggcctgagctga

SEQ ID NO: 15039 - protein, 370 aa, Streptomyces coelicolor A3(2)
MNRRALALGALAVSGALALTACGSDDTGGNSGSDSSSAAANSNIKCDDAKGQLQASGSSAQKNAIDAWVKQYVAACNGVQINYNPTGSGAGITAFTQGQTAFAGSDSALKPDEIEASKKVCKDGQAIDLPMVGGPIAVGFNVTGVDSLVLDAPTMAKIFDSKITNWNDEAIKKLNPDAKLPDLKIQAFHRSDESGTTDNFTKYLKAAAPDDWKYEGGKSWEAKGGQSAQGSSGLAGQVKQTPGAISYFELSYAKDGIKTVDVKTAAAEPVKATVENATAAIGAAKVVGTGKDLALELDYTPDAAGAYPLVLVTYEIACDKGNKADTLPATKSFLNYMASEDGQGLLADAGYAPMPTEIITKVRETISGLS

SEQ ID NO: 15040 - DNA, 909 bp, Methanosarcina mazei Go1
  CDS (1)..(909): transl_table=11
atggtaaataaattaaaaacatatgcaatcctcacgttactggtgtttggacttgtatttctgggaattggatgtaccggaaatgaaaatggcgaaagttcttctcagggtgaagaaacctcttcaggggaagttcccggggctgaatcccggagtattactctgaaaggttcagatacggttctcccccttgctcaggctgaagctgaagaattcatgcttgaaaaccctgacaaaagtgtaactgtcaccggtggtgggtcgggtgttgggattacagctctcattgatggtgaagtcgacattgctgcagcatcccgagaaattaaagccgaagaaatagaagctgctcagtctaacggcatcacccctgtggagacaacaattgcctatgacggcatttcagttgttgttaaccccgggaaccctgtttctgaacttacctttgaccagctgcgcggcatctacaatggaagcatcagcaactggaaggacgtaggtggagaagacaggaagattgtggtgatttccagggacagcagttcaggtacttacgaatatttcaaggaagaggttttacagggagatgaatatagacctgatgcacttacccagcctgcaacagggggaatagttggggaagtttctcagaatcccaatgcaatcggatatatcggtgttgcataccttgatcaaagtgtaaaagccttaagcctggatgcaggaaacggccctgaaaccccaagtcctgaaaacatcctcagcggtgcataccctctttcaaggtctctttacttctacaccaatggtgaaccctcaggcttgacaaaggagttcgttgactttgtactcagcgaaacaggacagagcctggtaactgaagtagggtacttccctgcagatcagtaa

SEQ ID NO: 15041 - protein, 302 aa, Methanosarcina mazei Go1
MVNKLKTYAILTLLVFGLVFLGIGCTGNENGESSSQGEETSSGEVPGAESRSITLKGSDTVLPLAQAEAEEFMLENPDKSVTVTGGGSGVGITALIDGEVDIAAASREIKAEEIEAAQSNGITPVETTIAYDGISVVVNPGNPVSELTFDQLRGIYNGSISNWKDVGGEDRKIVVISRDSSSGTYEYFKEEVLQGDEYRPDALTQPATGGIVGEVSQNPNAIGYIGVAYLDQSVKALSLDAGNGPETPSPENILSGAYPLSRSLYFYTNGEPSGLTKEFVDFVLSETGQSLVTEVGYFPADQ

SEQ ID NO: 15042 - DNA, 1092 bp, Xanthomonas campestris pv. campestris str. ATCC 33913
  CDS (1)..(1092): transl_table=11
atgaaactgcagtcggccagcctgaccgccctgtccctcaccatcgcccttgccctggcggcctgctcgcccggcaaggacgcgcagtccggcgatcccgcacaaggcggtgccaacgcaggcgcggcggccggcgagagcaagagtgcggagatcgccggcgccggtgcgtccttcatctacccgctggtgtccaagtggtcggccgactacaacgccgccaccggcaacaaggtcaattaccagtcgatcggttcgggcggcggcattgcgcagatcaaggccggcaccgtggatttcggctcctccgacaagccgctcgatagcgccgagctgcagcaggccggcctgggccagttcccctcggccatcggcggcgtggtgccggtggtgaacatcgaaggcatggcgcccggcaagctgcgcctgaccggcgccctgctcggcgacatcttcctgggcaaggtcaccatgtggaacgacgcggcgattgctgcggccaacccgggcgtgaccctgccggcgaccaagatcaacctggtgcatcgctccgacggttcgggcaccacattcaacttctccaactacctgtccaaggtcagcccggagtggaagaccaaggtcggcgaaggcacctcggtgcagtggccgggcggcgtgggcggcaagggcaacgaaggcgtggcctcctacgtgcagcagatcaagggctcgatcggctatgtcgaactggcctacgcgctgcagaacaagatgccgtacgcgtcgatgcagaacgctgccggccagtgggtggagccgaacgctgaaagcttcggcgccgcagcggccagcgccgactggaccaatgccaaggacttcaacctggtgatcaccaatgcaccgggcgagaaggcctggccgatcaccgcgaccaacttcatgctgatgcacaagcagcccaaggacgcggcccgcagcaaggccacgctggacttcttcaagtgggcactggaaaacggccaggcccaggccagcgaactgcattacgtgccgctgccgccggagctggtgaagcagatcgaagcctactggggcagcgagttcaagtga

SEQ ID NO: 15043 - protein, 363 aa, Xanthomonas campestris pv. campestris str. ATCC 33913
MKLQSASLTALSLTIALALAACSPGKDAQSGDPAQGGANAGAAAGESKSAEIAGAGASFIYPLVSKWSADYNAATGNKVNYQSIGSGGGIAQIKAGTVDFGSSDKPLDSAELQQAGLGQFPSAIGGVVPVVNIEGMAPGKLRLTGALLGDIFLGKVTMWNDAAIAAANPGVTLPATKINLVHRSDGSGTTFNFSNYLSKVSPEWKTKVGEGTSVQWPGGVGGKGNEGVASYVQQIKGSIGYVELAYALQNKMPYASMQNAAGQWVEPNAESFGAAAASADWTNAKDFNLVITNAPGEKAWPITATNFMLMHKQPKDAARSKATLDFFKWALENGQAQASELHYVPLPPELVKQIEAYWGSEFK

SEQ ID NO: 15044 - DNA, 1092 bp, Xanthomonas axonopodis pv. citri str. 306
  CDS (1)..(1092): transl_table=11
atgaaattgcagtcggccagcctgaccgccctgtccctcaccattgccctcgccctggccgcgtgctcgcccggcaaggacgcgcagtccgcagacgccgcaaagggcgcgccagccgcaggcgccgccgccagcgacagcaagggtgctgaaatttccggcgccggtgcttccttcatctatccgctggtgtccaagtggtcggccgactacaacgccgccaccggcaacaaggtcaactatcaatcgatcggctccggcggcggcattgcgcagatcaaggccggcacggtggatttcggttcgaccgacaagccactggacagcgccgaactgcaacaggctggcctggggcagttcccgtccgccatcggcggcgtggtgccggtggtgaatctggaaggcatcgcgccgggcaagctgcgcttgaccggcgccctgctgggcgacatcttcctgggcaaggtcacgatgtggaacgacgcggccattgtcgcggccaacccgggcgtgaccctgcccgccaccaagatcaacctggtgcatcgctcggatggttcgggcaccaccttcaacttctccaactacctgtccaaggtcagcccggagtggaagagcaaggtcggcgaaggcacctcggtgcagtggccgggtggcgtgggcggcaagggcaacgagggcgttgcgtcgtacgtgcagcagatcaagggctcgatcggctatgtcgagcttgcctacgctctgcagaacaagatgccgtacacctcgctgcagaacgcggccggccaatggatcgagccgaatgcggaaagctttgccgccgccgctgccagcgccgactgggccaacgcccgtgacttcaatctggtgatcaccaatgcgccgggcgagaaggcatggccgatcaccgcgaccaacttcatgttgatgcacaagcagcccaaggacgccgcgcgcagcaaggcgacgctggacttcttcaagtgggcgctggaaaacggccaggcccaggccagcgaattgcactacgtgccgctgccgccggagctggtgaagcagatcgaagcctactggggcagcgagttcaagtaa

SEQ ID NO: 15045 - protein, 363 aa, Xanthomonas axonopodis pv. citri str. 306
MKLQSASLTALSLTIALALAACSPGKDAQSADAAKGAPAAGAAASDSKGAEISGAGASFIYPLVSKWSADYNAATGNKVNYQSIGSGGGIAQIKAGTVDFGSTDKPLDSAELQQAGLGQFPSAIGGVVPVVNLEGIAPGKLRLTGALLGDIFLGKVTMWNDAAIVAANPGVTLPATKINLVHRSDGSGTTFNFSNYLSKVSPEWKSKVGEGTSVQWPGGVGGKGNEGVASYVQQIKGSIGYVELAYALQNKMPYTSLQNAAGQWIEPNAESFAAAAASADWANARDFNLVITNAPGEKAWPITATNFMLMHKQPKDAARSKATLDFFKWALENGQAQASELHYVPLPPELVKQIEAYWGSEFK

SEQ ID NO: 15046 - DNA, 1020 bp, Xanthomonas axonopodis pv. citri str. 306
  CDS (1)..(1020): transl_table=11
gtgatccactccttcaagacccgtctggccgtcggcgtgctcgccgcttcgctggcactgtgcgcccaggctgccgacgtcaccggtgccggtgcgtcgttcatctacccggtgatgtccaagtggtcggccgactacaacgcggccaccaagaagcaggtcaactaccaatcgatcggttcgggcggcggcattgcccagatcaaggcggccagcgtggacttcggctcttccgatgccccgctcaagccggaagaactggccgctgccggcctggcgcagtttccctcggtgatcggcggcgtggtaccggtggtcaacgtgccgggcattgccgccggtacgctcaagttggacggcaagactctgggcgacatcttcctgggcaaggtcagcacctggaacgacccggccatcgccgcgctcaacccgggcgtgaaactgccggaaggcaagatcaccgtggtgcaccgctccgacggctcgggcaccagcttcaacttcaccaactacctctccaaggtcaacccggactggaagggcaaggtcggcgaaggcacggcggtgcagtggccgaccggcatcggcggcaagggcaacgagggcgtggctgcctacgtgaagcagatcaagggcggcatcggctatgtcgagctgtcgtacgcgctgcagaacaagatggcctacaccgcaatgaagaacgcggccggcaagttcgtgcagccgtcggatgaaaccttcgccgccgctgccaacagcgccgactggggcacggccaaggacttctatctggtgatgaccaacgcggccggcgataacgcctggccgatcacggcgaccaacttcatcctggtgcagaaaaagccgaagaatccggctggactgaagaacacgctggaattcttccgctgggtctacaccaagggcgatgcgcaggccaaacagttggactacgtgccgctgccggacacgctggtgacccagatcgaggcgtactgggccaagaatctgccgcactaa

SEQ ID NO: 15047 - protein, 339 aa, Xanthomonas axonopodis pv. citri str. 306
MIHSFKTRLAVGVLAASLALCAQAADVTGAGASFIYPVMSKWSADYNAATKKQVNYQSIGSGGGIAQIKAASVDFGSSDAPLKPEELAAAGLAQFPSVIGGVVPVVNVPGIAAGTLKLDGKTLGDIFLGKVSTWNDPAIAALNPGVKLPEGKITVVHRSDGSGTSFNFTNYLSKVNPDWKGKVGEGTAVQWPTGIGGKGNEGVAAYVKQIKGGIGYVELSYALQNKMAYTAMKNAAGKFVQPSDETFAAAANSADWGTAKDFYLVMTNAAGDNAWPITATNFILVQKKPKNPAGLKNTLEFFRWVYTKGDAQAKQLDYVPLPDTLVTQIEAYWAKNLPH

SEQ ID NO: 15048 - DNA, 1041 bp, Yersinia pestis KIM
  CDS (1)..(1041): transl_table=11
atgaaactgatgcgtaccaccgtagccagcattgtggcagcgactttatctatgactgctgtatccgcgttcgctgctgcaagcctgacaggtgcaggtgcgacattccccgcaccggtgtatgccaagtgggcagattcttatcagaaagaaacaggtaacaaaattaactatcaaggtatcggttcttccggtggcgtgaagcaaattattgccaatactgttgattttggtgcttctgatgcgccattaacagatgaaaaactggctactgaaggtttgttccaattcccgaccgtgattggcggtgtggtgttagccgtgaatattcctggcattaaatccggtgagctgacattagacggtaaaacgctgggtgatatctatctgggcactgtgaaaaagtggaatgatcctgcgattgttaagttgaacccaggcgttaaattaccggatcaaaatattgctgttgtacgtcgtgctgacggctcgggtacctcatttgttttcaccagctacttggctaaagtgaacgcagaatggaaagagaaagtcggggctggctctaccgtgaactggccaaccggtttaggtggtaaaggtaacgacggtatcgctgcttttgttcagcgcctgcctggctcaattggctatgtagaatatgcttacgcgaaacaaaataatttggcttacactaaactgatttcagcagatgggaagcccgttagcccaactgagcacagctttagctctgcagcaaaaggtgtggactggagcaaatcatttgctcaagacttaaccaatcaaaaaggtgatgatgtttggccaattacctcaacgaccttcatcttagtgcataaagaacagaagaatgctgctaatggcacagaagtattgaaattctttgactggggttacacacacggcgctaaacaagctaacgaactggattatgcaacattacccgcggaagttgttgaacaagtacgtgcagcttggaaaactcagattaaagatagcagcggcaagccaatcttctga

SEQ ID NO: 15049 - protein, 346 aa, Yersinia pestis KIM
MKLMRTTVASIVAATLSMTAVSAFAAASLTGAGATFPAPVYAKWADSYQKETGNKINYQGIGSSGGVKQIIANTVDFGASDAPLTDEKLATEGLFQFPTVIGGVVLAVNIPGIKSGELTLDGKTLGDIYLGTVKKWNDPAIVKLNPGVKLPDQNIAVVRRADGSGTSFVFTSYLAKVNAEWKEKVGAGSTVNWPTGLGGKGNDGIAAFVQRLPGSIGYVEYAYAKQNNLAYTKLISADGKPVSPTEHSFSSAAKGVDWSKSFAQDLTNQKGDDVWPITSTTFILVHKEQKNAANGTEVLKFFDWGYTHGAKQANELDYATLPAEVVEQVRAAWKTQIKDSSGKPIF

SEQ ID NO: 15050 - DNA, 1134 bp, Bifidobacterium longum NCC2705
  CDS (1)..(1134): transl_table=11
atgcagaagaacatcctcgttcgctccattgccgctctgtccggcattgtgatgctcgcttccgtggccgcctgcggcgataacaccgccaccacgaccgacaacagctcctcctccgattccacttccaagtccaccccgatctccggcaacttctcgggcgccggcgcctcctctcagcaggccgctgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggttttcaacctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgagaactggccgaacgaggttggccagggtgccaagggcacttctggcgtgatctccaccgtcaagcaggccgacggcaccatcggctacgctgacttctctcaggtcggcgacctgggcaccgtggccgtcaaggtcggcgacaagtacaacgagatttccgccgaggccggctccaaggtcattggggattccaagcaggacgacaccgttaagggtgataaccgcatcgtcatcaagatcaaccacgccaccgaggccgagggcgcttacccgattgtcctggtctcctacgacatcgtctgcccggcctacaaggacaccaagcaggctgagttcgccaaggcttggctgacctacgtgacctccgacgagggccagaaggccgctcaggatgccgccggcaccgctccgctgccctcctccctgaagtccgagatcaccaagtccatcgaggccatcaagaccaagtga

SEQ ID NO: 15051 - protein, 377 aa, Bifidobacterium longum NCC2705
MQKNILVRSIAALSGIVMLASVAACGDNTATTTDNSSSSDSTSKSTPISGNFSGAGASSQQAAVEAWIAGFQGTNPEAKIAYNPSGSGAGVQTFLTGATAWAGSDKALADDEVEQSKSVCTEGTAFDVPVYISPIAVVFNLKGVSDAGKHINMDAATIAKIFDGKITKWNDPAIADQNKDLKLPDTAITVVHRSDKSGTTQNFVSYFKDVTPDNWTYDLSENWPNEVGQGAKGTSGVISTVKQADGTIGYADFSQVGDLGTVAVKVGDKYNEISAEAGSKVIGDSKQDDTVKGDNRIVIKINHATEAEGAYPIVLVSYDIVCPAYKDTKQAEFAKAWLTYVTSDEGQKAAQDAAGTAPLPSSLKSEITKSIEAIKTK

SEQ ID NO: 15052 - DNA, 864 bp, Streptococcus mutans UA159
  CDS (1)..(864): transl_table=11
atgaaaaagaaaaaagtaactttattcgcaatgctagccctggctagtcttgtcttagcggcatgttccaattggattgataaagggcagtcaattaccagtgttggttctacggctttgcagcctttagttgaagcttcttcggatgaatttggacatgctaacattggcaaaacagttaatgttcaaggtggaggttctggtacaggactttctcaagttcaatcaggtgccattcaaattggaaatagcgatctttttgctgaagaaaaagatggtattgatgccagtaagttagtcgaccataaagttgctgttgcaggaattgctgtcattactaacaaaaaagttaaagtatcaaatttaacccttgatcaattaagaaaaattttcacgggagaatatacaaactggaaacagcttggcgggcaagatttggaaatttcgatcatcaatcgtgctgctagttcgggttcacgtgctacctttgacagtgtcgtcatgaaaggaaaaagtgccagacaaagtcaagaacaagattcaaatgggatggtgaagtcaattgtttcacagacaccgggcgctatttcttacctcgcttttgcttacgttgataagtcagtgaaaactttaaagttaaatggttatgaaccaaccgttaagaatgtcacaactaataattggccgctctggtcttatgaacacatgtatactaaaggaaaagccaaaggtttaaccaaagaatttttaaagttcatgatgagtgacaagattcaaaaaggtgttgtgaccagaatgggttatatttctgttaatgatatgaaagtggttaagcgtgcagatggcactgtaattgctaagtaa

SEQ ID NO: 15053 - protein, 287 aa, Streptococcus mutans UA159
MKKKKVTLFAMLALASLVLAACSNWIDKGQSITSVGSTALQPLVEASSDEFGHANIGKTVNVQGGGSGTGLSQVQSGAIQIGNSDLFAEEKDGIDASKLVDHKVAVAGIAVITNKKVKVSNLTLDQLRKIFTGEYTNWKQLGGQDLEISIINRAASSGSRATFDSVVMKGKSARQSQEQDSNGMVKSIVSQTPGAISYLAFAYVDKSVKTLKLNGYEPTVKNVTTNNWPLWSYEHMYTKGKAKGLTKEFLKFMMSDKIQKGVVTRMGYISVNDMKVVKRADGTVIAK

SEQ ID NO: 15054 - DNA, 1122 bp, Corynebacterium efficiens YS-314
  CDS (1)..(1122): transl_table=11
gtgaacctcatcttcaagcgttctgctgccctcgttggcgccgtggccgtcagctccttcgccctcgttgcctgtggcgactccgaagagaccgacaccaccggcaccaccgccgagaccaccggagcggcctccgctgagggactgaccggtacctccggtcagctcgtcggcgagggtgcttcctcccagcagtccgccatggactacttcggcgtccagtactccgaggctgttgacggtgcctccctcgcctacaccgcatccggctcaggctccggacgtaagaacttcgtcggtggccaggtcgccttcggcggttccgactccccgatggatgatgcgcaggccgcggaggccatggaccgttgcgatggcaacgaggcatggcacctgcccttcgttatcggcccggtcgccatcgcctacaacctgcccggcgtggaggacctgaacctgtccaccgccaccgtggcaaacatcttcaagggtgagatcaccaagtggaatgatgacgccatcgccgctgagaacgagggcgttgacctccccgacaccgacatctccgttgtctaccgctccgatgagtccggcaccaccgacaacttccagaagttcctgaccgccgctgagcctgacctgtgggagaccaccggccaggtcttcccggcgaccgtcggtgagggcgccaacggctccaacggtgttgcatcccaggtcaccgcaatcgagggtggcatcacctacgttgaggctggcttcgcacagcagcagggcctgggcatcgccaacctcgacttcggcaacggcccggttgagctcaacgccgagtccgtcggtgtggcactggacaacctggagttcctcaccgagggcaacaacatggtcgttgacaccgaggcactcttcgccgcggacgatgcaggttcctacccgctgatcctcaccacctacgagatcgtctgctccgccggctacgacgacaccacccgcgaccagatcaaggacttcctgaccgtcgcactcgactcccaggatgagaacctcgaggctctcggctacatcccggtcaccggcacccactacgaccgcctggtcgaagcagtcgcggcaatccagtaa

SEQ ID NO: 15055 - protein, 373 aa, Corynebacterium efficiens YS-314
MNLIFKRSAALVGAVAVSSFALVACGDSEETDTTGTTAETTGAASAEGLTGTSGQLVGEGASSQQSAMDYFGVQYSEAVDGASLAYTASGSGSGRKNFVGGQVAFGGSDSPMDDAQAAEAMDRCDGNEAWHLPFVIGPVAIAYNLPGVEDLNLSTATVANIFKGEITKWNDDAIAAENEGVDLPDTDISVVYRSDESGTTDNFQKFLTAAEPDLWETTGQVFPATVGEGANGSNGVASQVTAIEGGITYVEAGFAQQQGLGIANLDFGNGPVELNAESVGVALDNLEFLTEGNNMVVDTEALFAADDAGSYPLILTTYEIVCSAGYDDTTRDQIKDFLTVALDSQDENLEALGYIPVTGTHYDRLVEAVAAIQ

SEQ ID NO: 15056 - DNA, 822 bp, Vibrio vulnificus CMCP6
  CDS (1)..(822): transl_table=11
atgaaaaagacagtaatcggtgcaatcgctcttatgagtgctctgacagtgacaaccgcttcggcaaaagaaacgatctctgcagtgggttcaagcagcgtaactccactgatggaagttttctctgaaacatacatgaagaaaaacccagaagtttttattgaagttcaaggaccaggttcatcggcaggtgttaaagcggcaaaaaatggctctgcagatctcggtatgtcttcacgtgacctaaaatcgtctgagaaagaaaccgctttggttgaagaagtgattgctcgcgacggtatcgcagtggttgttaacccaaagaacacgctgaaaggcctcactgctgagcaagtttctgccatctataaaggcgaagtgacgaactggaaacaagtcggtggtgaagacaaacctatcgttgcaattactcgtgatacagcatcaggtacacgtggcgcatttgaagacattcttaaactgaagaagaaaatctcgggtaaagaagtgtctgcaatctctcaacgtgctcaagtggcaaacggtaacggtgcactgaaaacgatggttgcttcaaacccttacgcgattggttacatctcgctaggtactgttgatgagtcggttcacccgctagctatcgatggcacggatgcgtctattccaaacgtgaaaaacggttcatacaaagtcgctcgtccattccttgttctttacaagcagggcaaaccatctgctgaaacgcagaagttccttgattggatgctgacccctgaagcacaagccattgtagagaagaaaggctacatctcagttaactaa

SEQ ID NO: 15057 - protein, 273 aa, Vibrio vulnificus CMCP6
MKKTVIGAIALMSALTVTTASAKETISAVGSSSVTPLMEVFSETYMKKNPEVFIEVQGPGSSAGVKAAKNGSADLGMSSRDLKSSEKETALVEEVIARDGIAVVVNPKNTLKGLTAEQVSAIYKGEVTNWKQVGGEDKPIVAITRDTASGTRGAFEDILKLKKKISGKEVSAISQRAQVANGNGALKTMVASNPYAIGYISLGTVDESVHPLAIDGTDASIPNVKNGSYKVARPFLVLYKQGKPSAETQKFLDWMLTPEAQAIVEKKGYISVN

SEQ ID NO: 15058 - DNA, 1026 bp, Bradyrhizobium japonicum USDA 110
  CDS (1)..(1026)
atggagaccagcatgaatttcctcaaaacgatcgtcgctgccggcttggtcgccgcatcgacgacggcggcctttgctgccgatatcaccggcgccggcgcgacgttcccgttcccgatctattccaagtgggccgacgcctacaagaaagagaccggcaacggtctgaactaccagtcgatcggctccggcggcggcatcaagcagatccaggccaagaccgtgaccttcggcgccagcgacgcgccgctcaaggccgagcagctcgagaaggacggcctcgtccagtggccgatggtgatgggtgccatcgttccggtcgtcaacatcgagggcgtgaagccgggcgagatggtgttcgacggcgagacgctcgccagcatctatctcggcaagatcaccaagtgggacgatgccgcgatcaagaagctcaatccgaacctgaagctgccctcggacgcgatcaccgtggttcgccgctcggacggttcgggcaccaccttcaacttcaccaactacctctccaaggccagcgcggactggaagagcaaggtcggcgagggcacggccgtcgagtggccggtcggcgtcggcgccaagggcaacgagggcgtgtccggcaacatcggccagaccaagaactcgatcggttacgtcgagtacgcctatgccaagcagaacaagctgacctacaccggtctcgtcaacaaggccggcaagccggtgcagccgaccgtcgaggccttccaggcggccgcctcgaacgccgactgggccaaggcgcccggctactacgtcatcctgaccgaccagcccggcgagaagtcctggccgatcacggcggcgaccttcatcctcatgcacaaggatgccaccgacaaggcagcctcgcaggaagccatcaagttcttccgctgggccttcaagaacggcggcaaggcggccgaagagctcgactacatcccgatgcccgagggcgtcgtgaccctgatcgagaagacctgggctgccgagatcaagagctaa

SEQ ID NO: 15059 - protein, 341 aa, Bradyrhizobium japonicum USDA 110
METSMNFLKTIVAAGLVAASTTAAFAADITGAGATFPFPIYSKWADAYKKETGNGLNYQSIGSGGGIKQIQAKTVTFGASDAPLKAEQLEKDGLVQWPMVMGAIVPVVNIEGVKPGEMVFDGETLASIYLGKITKWDDAAIKKLNPNLKLPSDAITVVRRSDGSGTTFNFTNYLSKASADWKSKVGEGTAVEWPVGVGAKGNEGVSGNIGQTKNSIGYVEYAYAKQNKLTYTGLVNKAGKPVQPTVEAFQAAASNADWAKAPGYYVILTDQPGEKSWPITAATFILMHKDATDKAASQEAIKFFRWAFKNGGKAAEELDYIPMPEGVVTLIEKTWAAEIKS

SEQ ID NO: 15060 - DNA, 888 bp, Clostridium tetani E88
  CDS (1)..(888): transl_table=11
atggagggttttcatatgaaaaaaaacaacctaaaatttttgattgtaactctattaattataacaacatcaatagtatttgcagcctgtagtggaaaaaataattcttctaaaggagaaaaaataggaactattacttctttaggttccacagcattaaaaccgttagtagaagaatcagctaaaaaattcaaagaaaaaaatccaaaggttaatataaatgttcaaggaggaggaagtggtgctggaattagccaagtatctgaaggaacggtagaaataggaaattctgatgttccagcagaaacaaagttaaaagataaggagaaattaaagcaattagtagaccataaagtatgtgctataggcttttctgttgtgactcataaagatgtaaaagtggacaacttaacaaaggagcaaatacagggtatatttacaggaaaatatactaactggaaagaagtagggggagaagacttacaaataaatgtagtgaatagaccaaaatcttcaggaacaagagctacttttaaagatacaataatgggagatgagaatgaaaaggaagggcttggaatagttcaggactcaagtgatgcagtttctaaatcaatacaaagcactaaaggctcaataagttatcttgctttatcctatttaacagaagaaaaatcacaagaattaaaattattaaaaattgataatatggaagcttcaaaggaaaatataataaataaaaaatatcctttttggtcctatgaacacatgtacacaaaaggggaagcacaaggtttagtaaaagaatttcttgattatatgacaagtgatgacaataaagcagtagttgaaaaattaggctatattcctatgggaaatttaaaataa

SEQ ID NO: 15061 - protein, 295 aa, Clostridium tetani E88
MEGFHMKKNNLKFLIVTLLIITTSIVFAACSGKNNSSKGEKIGTITSLGSTALKPLVEESAKKFKEKNPKVNINVQGGGSGAGISQVSEGTVEIGNSDVPAETKLKDKEKLKQLVDHKVCAIGFSVVTHKDVKVDNLTKEQIQGIFTGKYTNWKEVGGEDLQINVVNRPKSSGTRATFKDTIMGDENEKEGLGIVQDSSDAVSKSIQSTKGSISYLALSYLTEEKSQELKLLKIDNMEASKENIINKKYPFWSYEHMYTKGEAQGLVKEFLDYMTSDDNKAVVEKLGYIPMGNLK

SEQ ID NO: 15062 - DNA, 876 bp, Lactobacillus plantarum WCFS1
  CDS (1)..(876): transl_table=11
atgagaaaaagtcgggtcatccaattaatcgtgttaatcgcgatcattggactagttggattagggtacacacatcgtgatcgaactagtgccagtgaatcaattaccgcggttggatcaacggccttacagccactggttgaagcagccggtgaacaatacagcagcaaccataccggtgtgtttatcaatgtgcagggtggtggctctggaacgggactcagtcaaattcaggcgggggccgtggcaatcggtaattctgatatttttgccgaagaacagtctggcattacagcgagcaagttaattgatcaccgggtagccgtcgtcggtattgcccccatcgttaataaaaaggcgggcattaccaatttgacgcagcagcaactcattcagatttttactggcaaggtcacgaattggcgtgaagttggtggacgtaatttaccgattacgttaattaaccgtgctcaaggctccggaacccggaagacatttgagcgatacgccttaaagggtaatcagagtgttgattcccaagaacaagattcgtcaggattagctcggtcaattgttgctagtacacctggcgcaattagttatgtggctttttcttacttagacaactcagtccagaccgtcaatgttgatggtattcggccaaccgaaaaaaatgtgcggaataatcgctggtacatctggtcctacgaacatttatatacggggaagcaccccaatcagttaaccaaaaaatttattgattacattttatcaaccgctgttcagcagaagttagtcaagcagttaggttatatttcggtccatgacatgcaagtacagcggaatgcggccggtaaagtttcagttatgaaatga

SEQ ID NO: 15063 - protein, 291 aa, Lactobacillus plantarum WCFS1
MRKSRVIQLIVLIAIIGLVGLGYTHRDRTSASESITAVGSTALQPLVEAAGEQYSSNHTGVFINVQGGGSGTGLSQIQAGAVAIGNSDIFAEEQSGITASKLIDHRVAVVGIAPIVNKKAGITNLTQQQLIQIFTGKVTNWREVGGRNLPITLINRAQGSGTRKTFERYALKGNQSVDSQEQDSSGLARSIVASTPGAISYVAFSYLDNSVQTVNVDGIRPTEKNVRNNRWYIWSYEHLYTGKHPNQLTKKFIDYILSTAVQQKLVKQLGYISVHDMQVQRNAAGKVSVMK

SEQ ID NO: 15064 - DNA, 1071 bp, Tropheryma whipplei str. Twist
  CDS (1)..(1071): transl_table=11
gtgtgtcgcttggatagaaagctttttctcgtatttgcttcagttgtaactcttttttctgtttcatgttttggaaactccaaaacctctttagaggggtcggtatcagtaactggggcttctagtcagagcgtggcccaatcagtttggatatcagaatttcgcaagatccatccgggtgtaacagtcaactatgaacctcaggggtctggtgcggggcgtagggcattcttgtctggtgcagttgatctggccgcgacagatgttccctttgctgaccccgagctcacgggggactttaagggttgtactgcggatggtccgcttcagcttcctgtctatatctctccgatcgcgatagcttataaccttccaggggtctctgacctaaaacttgacgcttccgtaattgctgggattttcagtggggcaataactacttgggattcgcctagaatttctgctctcaatcctggcatagagttgccgaataaaaagataaccgctgtgcaccgctcggataattcggggactacagagaatttttcagattatattcataccaatgcccccagtgattggccccataaaccatcaactaagttcccttatacatacggtgaggccgctaaaggtacctctggggtagcgcaggttttgaaagctacagttggctctataggttatttggatctctctttggctcgtggaatgtctcttgcgaccctgaaggttggttcgggcttttcaaaaccatcggccgagagtgctaccctgacagtgagcgactctgaatttccgagcaagaatccgaatagtttttctgtaaagataaatcgcaggacagagaaagctggcgcctggccccttatccttgtcagttatgtcgttgcttgcgttggctacaaaaaaggcaacaaagacgctattttctcgtatctcaagtttattctttctgaaaaagcccagggtcaagcagcacaacaggctggctctgctccattaccggaatctctttcaaagaaacttctcgagcttgtcaataaaatcgctgagaaaaacggcgcctaa

SEQ ID NO: 15065 - protein, 356 aa, Tropheryma whipplei str. Twist
MCRLDRKLFLVFASVVTLFSVSCFGNSKTSLEGSVSVTGASSQSVAQSVWISEFRKIHPGVTVNYEPQGSGAGRRAFLSGAVDLAATDVPFADPELTGDFKGCTADGPLQLPVYISPIAIAYNLPGVSDLKLDASVIAGIFSGAITTWDSPRISALNPGIELPNKKITAVHRSDNSGTTENFSDYIHTNAPSDWPHKPSTKFPYTYGEAAKGTSGVAQVLKATVGSIGYLDLSLARGMSLATLKVGSGFSKPSAESATLTVSDSEFPSKNPNSFSVKINRRTEKAGAWPLILVSYVVACVGYKKGNKDAIFSYLKFILSEKAQGQAAQQAGSAPLPESLSKKLLELVNKIAEKNGA

SEQ ID NO: 15066 - DNA, 1071 bp, Tropheryma whipplei TW08/27
  CDS (1)..(1071): transl_table=11
gtgtgtcgcttggatagaaagctttttctcgtatttgcttcagttgtaactcttttttctgtttcatgttttggaaactccaaaacctctttagaggggtcggtatcagtaactggggcttctagtcagagcgtggcccaatcagtttggatatcagaatttcgcaagatccatccgggtgtaacagtcaactatgaacctcaggggtctggtgcggggcgtagggcattcttgtctggtgcagttgatctggccgcgacagatgttccctttgctgaccccgagctcacgggggactttaagggttgtactgcggatggtccgcttcagcttcctgtctatatctctccgatcgcgatagcttataaccttccaggggtctctgacctaaaacttgacgcttccgtaattgctgggattttcagtggggcaataactacttgggattcgcctagaatttccgctctcaaccctggcatagagttgccgagtaaaaagataaccgctgtgcaccgctcggataattcggggactacggagaatttttcagattatatccatactaatgcccccagtgattggccccataaaccatcaactaagttcccttacacatacggtgaggccgctaaaggtacctctggggtagcgcaggttttgaaagctacagttggctctataggttatttggatctctctttggctcgtggaatgtctcttgcgaccctgaaggttggttcgggcttttcaaaaccatcggccgagagtgctaccctgacagtgagcgactctgaatttccgagcaagaatccgaatagtttttctgtaaagataaatcgcaggacagagaaagctggcgcctggcctcttatccttgtcagttatgtcgttgcttgcgttggttacaaaaaaggcaacaaagacgctattttctcgtatctcaagtttattctttctgaaaaagcccagggtcaagcagcacaacaggctggctctgctccattgccggaatctctttcaaagaaactcctcgagcttgtcaataaaatcgctgagaaaaacggcgcctaa

SEQ ID NO: 15067 - protein, 356 aa, Tropheryma whipplei TW08/27
MCRLDRKLFLVFASVVTLFSVSCFGNSKTSLEGSVSVTGASSQSVAQSVWISEFRKIHPGVTVNYEPQGSGAGRRAFLSGAVDLAATDVPFADPELTGDFKGCTADGPLQLPVYISPIAIAYNLPGVSDLKLDASVIAGIFSGAITTWDSPRISALNPGIELPSKKITAVHRSDNSGTTENFSDYIHTNAPSDWPHKPSTKFPYTYGEAAKGTSGVAQVLKATVGSIGYLDLSLARGMSLATLKVGSGFSKPSAESATLTVSDSEFPSKNPNSFSVKINRRTEKAGAWPLILVSYVVACVGYKKGNKDAIFSYLKFILSEKAQGQAAQQAGSAPLPESLSKKLLELVNKIAEKNGA

SEQ ID NO: 15068 - DNA, 1026 bp, Pseudomonas syringae pv. tomato str. DC3000
  CDS (1)..(1026): transl_table=11
gtgatactgctgactaaaaaacgcttgtcgcttctgatcgcttcgctgtgcctcagcggtgtggcccacgcgactgacgtaaccggcgctggttcgagtttcgttttcccggttatttcggcgtggtcccaggactacagcaaaagcaacgattccaaaaatcgcatcaactaccagtccatcggttcgggcggtggtatcgctcagatcaaggcggctaccgttgacttcggcgcatccgatgccccgatgtccgctgaggacctgcaagccggtggcctgggtcagttcccgagcgtgatcggcggtatcgtgccgatcgtcaacgtcgaaggcgttgaaagcggtgagttgaaactggacggcgcattgcttgccaagatcttcatgggcgaagtcaagaagtggaacgaccctgcaatcgtcgctctgaacccaggcgtcaagctgcctgagaccgcgatcactgttgttcaccgttcggacggctcgggcactacctacaacttcaccaactacctgagcaaagtcagcccggagtggaacgagaagctgaagtttggttcgaccgtgcaatggcctgccggtgtgggcggtaaaggtaacgaaggtgtttctgcctacgtgaagcagatcaagggttcgatcggctacgtcgagtactcgtacgcggtcaccaacaagctgtcctacacccagttgaagaacgctgccggcaaattcatcaagccagacgccaaggcttttgctgctgctgccgactcggccaagtgggaagatgccaaggacttcaacctgatcatgaccaacgctccgggtgacaccgcgtggccaatcaccgctaccacctggatcatcatgtacaagaaagccaagaacgaagagaaaagcgctgctgctttcgacttcttcaaatggtccctggaaaacggccagcaacaggccgagaaactggactatgtcgctttgccgaaatcgctggttgatcgcgtagagaactactggaaaacggaattcaccaagtaa

SEQ ID NO: 15069 - protein, 341 aa, Pseudomonas syringae pv. tomato str. DC3000
MILLTKKRLSLLIASLCLSGVAHATDVTGAGSSFVFPVISAWSQDYSKSNDSKNRINYQSIGSGGGIAQIKAATVDFGASDAPMSAEDLQAGGLGQFPSVIGGIVPIVNVEGVESGELKLDGALLAKIFMGEVKKWNDPAIVALNPGVKLPETAITVVHRSDGSGTTYNFTNYLSKVSPEWNEKLKFGSTVQWPAGVGGKGNEGVSAYVKQIKGSIGYVEYSYAVTNKLSYTQLKNAAGKFIKPDAKAFAAAADSAKWEDAKDFNLIMTNAPGDTAWPITATTWIIMYKKAKNEEKSAAAFDFFKWSLENGQQQAEKLDYVALPKSLVDRVENYWKTEFTK

SEQ ID NO: 15070 - DNA, 828 bp, Vibrio parahaemolyticus RIMD 2210633
  CDS (1)..(828): transl_table=11
atgttacgttttactgtggcaactttactagccatggctgtctcccttccttctgctatggcgaaagaagtcaacatttcaggttcaacttccgttgctcgcgtgatggacgtactcgccgaagaatacaacaagacacacccagataattacatcgctgtacagggcattggttctagtgcggggatcaccatggtgaacaaaggtgtcgtgaaacttggtatgagctctcgctatctgacagaaagcgaaaaaggcgaagacttgaatgtgtttccaattgcttacgatggccttgccgttgttgtgaaccgtacaaactctgtgactaacctttcagcacaacaactgtttgacatctacaaaggcgaaatcaaaaactggaaagaagtcggcggcgcggatcaaccgatagcagttgtcacgcgagaagcatcttctggctcgcgctacagctttgagagtttgttgggtctaaccaaaatcattaacgaccgtctggtttctgatatcagcccaaacaacttagttgtaaacagcaacagcatggttaaaaccattgtgaaccataacacacgtgcgattggttttatttcggtggggtctgtagacctttctgtgaaggcgattcagtttaacgggattgaaccaacagcagcgaacatcgcaaatcacaaatacaaactggctcgaccatttttggtgctttacaaagtcgactcgctagatcaagcaggcaaagactttgtcgcgttcctaaaatcggaagcgggacaaaaaaccattgctgactacgggtacataccggttaaaaactttaaccagtaa

SEQ ID NO: 15071 - protein, 275 aa, Vibrio parahaemolyticus RIMD 2210633
MLRFTVATLLAMAVSLPSAMAKEVNISGSTSVARVMDVLAEEYNKTHPDNYIAVQGIGSSAGITMVNKGVVKLGMSSRYLTESEKGEDLNVFPIAYDGLAVVVNRTNSVTNLSAQQLFDIYKGEIKNWKEVGGADQPIAVVTREASSGSRYSFESLLGLTKIINDRLVSDISPNNLVVNSNSMVKTIVNHNTRAIGFISVGSVDLSVKAIQFNGIEPTAANIANHKYKLARPFLVLYKVDSLDQAGKDFVAFLKSEAGQKTIADYGYIPVKNFNQ

SEQ ID NO: 15072 - DNA, 822 bp, Vibrio parahaemolyticus RIMD 2210633
  CDS (1)..(822): transl_table=11
atgaaaaagacagtaatcggtgcaatcgcacttctaggcgcaatggcagtgactcctgtttctgctaaagaaactatctctgcagtgggttctagcagcgtaactccactgatggaagttttctctgaaacatacatgaagacgaacccgaacgtattcatcgaggttcaaggccctggctcttcagctggcgttaaagcggcgaaaaatggttcagcagacttaggtatgtcttctcgtaacctgaaggaatcagaaaaagagccaacacttgttgaagaagtggttgctcgtgacggtatcgcggttgttgttaacccacaaaacaagctagcaggtctaactgctgagcaagtgacagcaatctacaaaggcgaagtatcaaactggaaagaagtgggtggcgaagacaagccaatcgtagcaatcactcgtgataccgcttctggtactcgtggtgcatttgaagacatcatggcgctgaaaatgaaaatttctggcaagaaagtttcagcaatctctcaacgtgctcaagttgctaacggtaacggcgcacttaaaacaatggttgcgtctaacccatacgcaatcggctacatctcactaggtacagtagacaacacagttaacgctctagcaatcgacggtgttgatgcaacagtcgctaacgttaaaaacggttcttacaaagtagctcgcccattccttgtgctttacaaagaaggcaagccatctgcagaaacgcaaaaattcctagattggatgctaactgaagatgcgcaaaagctagttgaccaaaacggttacatctcagttcactaa

SEQ ID NO: 15073 - protein, 273 aa, Vibrio parahaemolyticus RIMD 2210633
MKKTVIGAIALLGAMAVTPVSAKETISAVGSSSVTPLMEVFSETYMKTNPNVFIEVQGPGSSAGVKAAKNGSADLGMSSRNLKESEKEPTLVEEVVARDGIAVVVNPQNKLAGLTAEQVTAIYKGEVSNWKEVGGEDKPIVAITRDTASGTRGAFEDIMALKMKISGKKVSAISQRAQVANGNGALKTMVASNPYAIGYISLGTVDNTVNALAIDGVDATVANVKNGSYKVARPFLVLYKEGKPSAETQKFLDWMLTEDAQKLVDQNGYISVH

SEQ ID NO: 15074 - DNA, 1110 bp, Bacteroides thetaiotaomicron VPI-5482
  CDS (1)..(1110): transl_table=11
atggcaacaattagaaacaaagaaatcagtaaaacaggcggtgtatgcctgtcattcgtagctgtactggcaatagcggcagcaactttatttaccagtggaaaaccggttgaggagttatccgaaaatgccgctgtgggtcgtaaatcggtgattaccgccgccggagccacattgccgttacctttctacagcgaggcgttcaagatgtactgggagaagaacgacatccccgttacttatgccggtatcggtacggaacgcggattcagaagcctgaagaatcaacagatagactttgcaggtgtggacgttccacctaccaaagcggaactggacagtctgccggtaaaatctatccttgtacctacgtgcatgggggcagtgactatcgcctataacctggaaggtgtggataacctgcgcctgacgggagagctgatagcagatatctatatgggtaagatattgaaatggaatgatgcaaggattgcggcagtgaacgccggcaagcaattgcccgacaaggaaatctatcccgttttccgtctggacggtagcggaacgacttatatcttcagtgactacctgacgaaagtgagtacggactggaaggccaagattggcacgggaaaagccttgacctttccacgtggagtagcggctacgggaaatacgggcgtggccggactggtaggtaaagttccgggtgctatcggatacgtggcttcggaatatgcagccagcttcaatacgcagagtgcatggctgaaaaacgctgccggaaactttgtgcagcccacttcggaaagcgttaccgctgtcgcaagcgtgggggatgctacgggcatgattaccgattcagaggttgccgacgcttatcctatcagttgcttcacatgggtggtactttataaggagcagaactatgccgggcgtagtcgcagtgaagcggaagaaaccgtgaagctgctggaatggctgatcagcccggaagctcagactatcactacccaggtgcaatgttcaccgctgccggaaaaggctgtggaatatgccaagaacatgttgaaggaggtgacatacgacggaaaagcattgagaaagtaa

SEQ ID NO: 15075 - protein, 369 aa, Bacteroides thetaiotaomicron VPI-5482
MATIRNKEISKTGGVCLSFVAVLAIAAATLFTSGKPVEELSENAAVGRKSVITAAGATLPLPFYSEAFKMYWEKNDIPVTYAGIGTERGFRSLKNQQIDFAGVDVPPTKAELDSLPVKSILVPTCMGAVTIAYNLEGVDNLRLTGELIADIYMGKILKWNDARIAAVNAGKQLPDKEIYPVFRLDGSGTTYIFSDYLTKVSTDWKAKIGTGKALTFPRGVAATGNTGVAGLVGKVPGAIGYVASEYAASFNTQSAWLKNAAGNFVQPTSESVTAVASVGDATGMITDSEVADAYPISCFTWVVLYKEQNYAGRSRSEAEETVKLLEWLISPEAQTITTQVQCSPLPEKAVEYAKNMLKEVTYDGKALRK

SEQ ID NO: 15076 - DNA, 1107 bp, Streptomyces avermitilis MA-4680
  CDS (1)..(1107)
atgaaccggcgggccctcaccctcggtgctctcgccgtctccggcgccctggccctcacggcgtgcggctctgacgacaccggcaagagcaacaccgacgccacgacgtcgtccaacagcgccatcaagtgcgacaacgccaagggccagctccaggcctccggctcgtccgcgcagaagaacgcgatcgacgcgtgggtcaaggcgtacaccgcgagctgcaagggcgtgcagatcaactacaacccgacgggttcgggtgccggtgtcaccgcgttcacccagggccagacggcgttcgccggttcggactcgccgctgaagcccgaagaggtcacggcctccaagaaggcctgcggcggcagccaggccatcgacctgccgatggtcggcggcccgatcgcgatcggcttccacctgtccggcgtggacagcctgaccctggacgccgccaccctcgccaagatcttcgacggcaagatcacgaagtgggacgacgaggcgatcgcgaagctgaacccgagcgccaagctccccagcaccaagatccaggcgttccaccgctcggacgagtccggcaccacggacaacttcaccaagtacctgaaggccgtcgccccctccgactggaagtactccggcggcaaggcctggcaggccaagggcggccagtccgcgcagggctcctccggcctggcccagcaggtgaagcagaccgagggcgcgatctcgtacttcgagctctcgtacgccgccgacggcatcagcaccgtcgacctgaagacgggcgccgccaccccggtgaaggccagcgtcgagaacgccaccaaggccatctcgaccgccaaggtcgccggcaccggcaaggacctgtcgctgtccctgaactacaagccgaccgaggagggcgcctacccgctcaccctggtcacctacgagatcgtctgcgagaagggcaacaaggcggacaccctgcccgccaccaagtccttcctcacctacatcgcgagcgaggacggtcagaagctgctgaccgacgccaagtacgcgccgatccccgacgagatcatctccaaggtccgcacgaccatctcgagcctgagctga

SEQ ID NO: 15077 - protein, 368 aa, Streptomyces avermitilis MA-4680
MNRRALTLGALAVSGALALTACGSDDTGKSNTDATTSSNSAIKCDNAKGQLQASGSSAQKNAIDAWVKAYTASCKGVQINYNPTGSGAGVTAFTQGQTAFAGSDSPLKPEEVTASKKACGGSQAIDLPMVGGPIAIGFHLSGVDSLTLDAATLAKIFDGKITKWDDEAIAKLNPSAKLPSTKIQAFHRSDESGTTDNFTKYLKAVAPSDWKYSGGKAWQAKGGQSAQGSSGLAQQVKQTEGAISYFELSYAADGISTVDLKTGAATPVKASVENATKAISTAKVAGTGKDLSLSLNYKPTEEGAYPLTLVTYEIVCEKGNKADTLPATKSFLTYIASEDGQKLLTDAKYAPIPDEIISKVRTTISSLS

SEQ ID NO: 15078 - DNA, 1113 bp, Mycobacterium bovis AF2122/97
  CDS (1)..(1113): transl_table=11
gtgaagttcgcccgatccggcgcagcggtaagcctgttggccgccggcacactggtgttgacagcatgcggcggtggcaccaacagctcgtcgtcaggcgcaggcggcacgtctgggtcggtgcactgcggcggcaagaaggagctccactccagcggctcgaccgcacaagaaaatgccatggagcagttcgtctatgcctacgtgcgatcgtgcccgggctacacgttggactacaacgccaacgggtccggtgccggggtgacccagtttctcaacaacgaaaccgatttcgccggctcggatgtcccgttgaatccgtcgaccggtcaacctgaccgggcggcggagcggtgcggttccccggcatgggacctgccgacggtgttcggcccgatcgcgatcacctacaatatcaagggcgtgagcacgctgaatcttgacggacccactaccgccaagattttcaacggcaccatcaccgtgtggaatgatccacagatccaagccctcaactccggcaccgacctgccgccaacaccgattagcgttatcttccgcagcgacaagtccggtacgtcggacaacttccagaaatacctcgacggcgcatccaacggggcgtggggcaaaggcgccagcgaaacgttcaacgggggcgtcggcgtcggcgccagcgggaacaacggcacgtcggccctactgcagacgaccgacgggtcgatcacctacaacgagtggtcgtttgcggtgggtaagcagttgaacatggcccagatcatcacgtcggcgggtccggatccagtggcgatcaccaccgagtcggtcggcaagacaatcgccggggccaagatcatgggacaaggcaacgacctggtattggacacgtcgtcgttctacaggcccacccagcctggctcttacccgatcgtgctggcgacctatgagatcgtctgctcgaaatacccggatgcgacgaccggtactgcggtaagggcgtttatgcaagccgcgattggtccaggccaagaaggcctggaccaatacggctccattccgttgcccaaatcgttccaagcaaaattggcggccgcggtgaatgctatttcttga

SEQ ID NO: 15079 - protein, 370 aa, Mycobacterium bovis AF2122/97
MKFARSGAAVSLLAAGTLVLTACGGGTNSSSSGAGGTSGSVHCGGKKELHSSGSTAQENAMEQFVYAYVRSCPGYTLDYNANGSGAGVTQFLNNETDFAGSDVPLNPSTGQPDRAAERCGSPAWDLPTVFGPIAITYNIKGVSTLNLDGPTTAKIFNGTITVWNDPQIQALNSGTDLPPTPISVIFRSDKSGTSDNFQKYLDGASNGAWGKGASETFNGGVGVGASGNNGTSALLQTTDGSITYNEWSFAVGKQLNMAQIITSAGPDPVAITTESVGKTIAGAKIMGQGNDLVLDTSSFYRPTQPGSYPIVLATYEIVCSKYPDATTGTAVRAFMQAAIGPGQEGLDQYGSIPLPKSFQAKLAAAVNAIS

SEQ ID NO: 15080 - DNA, 1125 bp, Mycobacterium bovis AF2122/97
  CDS (1)..(1125): transl_table=11
gtgaaaattcgtttgcatacgctgttggccgtgttgaccgctgcgccgctgctgctagcagcggcgggctgtggctcgaaaccaccgagcggttcgcctgaaacgggcgccggcgccggtactgtcgcgactacccccgcgtcgtcgccggtgacgttggcggagaccggtagcacgctgctctacccgctgttcaacctgtggggtccggcctttcacgagaggtatccgaacgtcacgatcaccgctcagggcaccggttctggtgccgggatcgcgcaggccgccgccgggacggtcaacattggggcctccgacgcctatctgtcggaaggtgatatggccgcgcacaaggggctgatgaacatcgcgctagccatctccgctcagcaggtcaactacaacctgcccggagtgagcgagcacctcaagctgaacggaaaagtcctggcggccatgtaccagggcaccatcaaaacctgggacgacccgcagatcgctgcgctcaaccccggcgtgaacctgcccggcaccgcggtagttccgctgcaccgctccgacgggtccggtgacaccttcttgttcacccagtacctgtccaagcaagatcccgagggctggggcaagtcgcccggcttcggcaccaccgtcgacttcccggcggtgccgggtgcgctgggtgagaacggcaacggcggcatggtgaccggttgcgccgagacaccgggctgcgtggcctatatcggcatcagcttcctcgaccaggccagtcaacggggactcggcgaggcccaactaggcaatagctctggcaatttcttgttgcccgacgcgcaaagcattcaggccgcggcggctggcttcgcatcgaaaaccccggcgaaccaggcgatttcgatgatcgacgggcccgccccggacggctacccgatcatcaactacgagtacgccatcgtcaacaaccggcaaaaggacgccgccaccgcgcagaccttgcaggcatttctgcactgggcgatcaccgacggcaacaaggcctcgttcctcgaccaggctcatttccagccgctgccgcccgcggtggtgaagttgtctgacgcgttgatcgcgacgatttccagctag

SEQ ID NO: 15081 - protein, 374 aa, Mycobacterium bovis AF2122/97
MKIRLHTLLAVLTAAPLLLAAAGCGSKPPSGSPETGAGAGTVATTPASSPVTLAETGSTLLYPLFNLWGPAFHERYPNVTITAQGTGSGAGIAQAAAGTVNIGASDAYLSEGDMAAHKGLMNIALAISAQQVNYNLPGVSEHLKLNGKVLAAMYQGTIKTWDDPQIAALNPGVNLPGTAVVPLHRSDGSGDTFLFTQYLSKQDPEGWGKSPGFGTTVDFPAVPGALGENGNGGMVTGCAETPGCVAYIGISFLDQASQRGLGEAQLGNSSGNFLLPDAQSIQAAAAGFASKTPANQAISMIDGPAPDGYPIINYEYAIVNNRQKDAATAQTLQAFLHWAITDGNKASFLDQAHFQPLPPAVVKLSDALIATISS

SEQ ID NO: 15082 - DNA, 993 bp, Prochlorococcus marinus subsp. marinus str. CCMP1375
  CDS (1)..(993): transl_table=11
atgtccttctctaagaaggcgtcattatttgtatccattgccgctcttgcagctggcattgttgcttgtgggtcaaataattccgcaacaaacattaggcttagcggagcaggtgcttccttcccttccaaaatctacacccggtggtttgctgaccttaacaatgaaggtggtcctagggttaactaccaagctgttggctctggctctgggcgaaaagctttcattgatgaaaccgttgattttggagcatcggatgacccaatgaaagcccaagatatcgcaaaagttaaacgaggattagttcagatcccaatggtgggagggacagtcgcttttggatataacaatcctgattgcgaactcaagcttactcagagacaagcagttcgtattgcaataggcaaaatcaataattggagcgagcttgggtgccctgctcaaaagattacttggattcaccgttctgatggctctggcacaaccaaggcttttaccaattcaatggaagctttctctaaagagtggacattaggaactggtaaatccgtagcatggcctgtaggtattggagggaaaggcaatgcaggggttgctggagttattaaaaacacccccggtgctattggttatgtaaaccagtcttatatcaaaggaaatgtcagagccgctgctttacaaaatttgtctggtgagtttctaaaaccaaacataaattctggtgctaaagcccttaatggaatcactttagatccaaatctggctggtagcaacccaaacccaacagcaaaaggtgcctatccaattgctactttaacttgggtccttgcttatgaaactggcaatggctctaaaacagaggcaattatagcttccttaggataccttcttagcgacaaggctcaagccaaggctcctagcctaggatttgttcctctaacaggagatatccttatgaaagctcgtaaagctgtgaccagaattgggaagtaa

SEQ ID NO: 15083 - protein, 330 aa, Prochlorococcus marinus subsp. marinus str. CCMP1375
MSFSKKASLFVSIAALAAGIVACGSNNSATNIRLSGAGASFPSKIYTRWFADLNNEGGPRVNYQAVGSGSGRKAFIDETVDFGASDDPMKAQDIAKVKRGLVQIPMVGGTVAFGYNNPDCELKLTQRQAVRIAIGKINNWSELGCPAQKITWIHRSDGSGTTKAFTNSMEAFSKEWTLGTGKSVAWPVGIGGKGNAGVAGVIKNTPGAIGYVNQSYIKGNVRAAALQNLSGEFLKPNINSGAKALNGITLDPNLAGSNPNPTAKGAYPIATLTWVLAYETGNGSKTEAIIASLGYLLSDKAQAKAPSLGFVPLTGDILMKARKAVTRIGK

SEQ ID NO: 15084 - DNA, 1041 bp, Bordetella pertussis Tohama I
  CDS (1)..(1041): transl_table=11
atgttcaaacgtgtcttcaaacagatttcgatcggcgccgcgctgagcgcagccgttttcgccgcccaggccgccgatgtgaccggcgcgggcgcgtcgttcccgtaccccatctacgccaagtgggcctccgactacaaggctgccaccaacaacgccgtcaactaccagtccatcggttcgggcggcggccagcagcagatcaaggccaagacggtcgacttcggcgcctcggatgacccgctcaaggccgaagacctggaaaagaatggcctgctgcagttcccggccgtgatcggcggcaccgtgccggtgatcaacatcgacggcatcgcgccgggccagctgaagctgtcgggcgccgtgctggccgacatcttcctgggcaaggtcaagaagtgggacgacgccgccatcaaggcgctcaaccccgacctgaagctgccctcggccgacatcgtggtggtgcaccgttcggacggttcgggcacgaccttcggctggaccaactacctgtcgaaagtgtcgtccgcctggaaagagcaagtgggcgagggcaaggccgtcaagtggcccaccggccagggcggcaagggcaacgaaggcgtggccgcctacgtgggccagctgaagaactcgatcggttatgtcgagtacgcctacgccaagcagaacaagctggcctggacgcagctgcagaacaaggacggcaagttcgtccagcccgagcagaaggcgttcgccgccgccgccgccaatgccgactggaagagcgcgcccggcatgggcgtggtgctgaccaacgagccgggcgccgattcgtggcccgtgaccgccgctaccttcatcctggtgcacaagagccaggacaagccggtccagggccgcgcggtgctggagttcttcgactgggcgttcaagaacggcgccaagtcggccgaagcgctggactacgtgccgctgcccgaggccgtgaccacggaaatccgcgccgcctggggtgaagtcaagggcgccgacggcaaggccgtgtggcagtaa

SEQ ID NO: 15085 - protein, 346 aa, Bordetella pertussis Tohama I
MFKRVFKQISIGAALSAAVFAAQAADVTGAGASFPYPIYAKWASDYKAATNNAVNYQSIGSGGGQQQIKAKTVDFGASDDPLKAEDLEKNGLLQFPAVIGGTVPVINIDGIAPGQLKLSGAVLADIFLGKVKKWDDAAIKALNPDLKLPSADIVVVHRSDGSGTTFGWTNYLSKVSSAWKEQVGEGKAVKWPTGQGGKGNEGVAAYVGQLKNSIGYVEYAYAKQNKLAWTQLQNKDGKFVQPEQKAFAAAAANADWKSAPGMGVVLTNEPGADSWPVTAATFILVHKSQDKPVQGRAVLEFFDWAFKNGAKSAEALDYVPLPEAVTTEIRAAWGEVKGADGKAVWQ

SEQ ID NO: 15086 - DNA, 1041 bp, Bordetella bronchiseptica RB50
  CDS (1)..(1041)
atgttcaaacgtgtcttcaaacagatttcgatcggcgccgcgctgagcgcagccgttttcgccgcccaggccgccgatgtgaccggcgcgggcgcgtcgttcccgtaccccatctacgccaagtgggcctccgactacaaggctgccaccaacaacgccgtcaactaccagtccatcggttcgggcggcggccagcagcagatcaaggccaagacggtcgacttcggcgcctcggatgacccgctcaaggccgaagacctggaaaagaacggcctgttgcagttcccggccgtgatcggcggcaccgtgccggtgatcaacgtcgacggcatcgcgccgggccagctgaagctgtcgggcgccgtgctggccgacatcttcctgggcaaggtcaagaagtgggacgacgccgccatcaaggcgctcaaccccgacctgaagctgccctcggccgacatcgtggtggtgcaccgttcggacggttcgggcacgaccttcggctggaccaactacctgtcgaaagtgtcgcccgcctggaaagagcaagtgggcgagggcaaggccgtcaagtggcccaccggccagggcggcaagggcaacgaaggcgtggccgcctacgtgggccagctgaagaactcgatcggttatgtcgagtacgcctacgccaagcagaacaagctggcctggacgcagctgcagaacaaggacggcaagttcgtccagcccgagcagaaggcgttcgccgctgccgccgccaatgccgactggaagagcgcgcccggcatgggcgtggtgctgaccaacgagccgggcgccgattcgtggcccgtgaccgccgccaccttcatcctggtgcacaagagccaggacaagccggtccagggccgcgcggtgctggagttcttcgactgggcgttcaagaacggcgccaagtcggccgaagcgctggactacgtgccgctgcccgaggccgtgaccacggaaatccgcgccgcctggggtgaagtcaagggcgccgacggcaaggccgtgtggcagtaa

SEQ ID NO: 15087 - protein, 346 aa, Bordetella bronchiseptica RB50
MFKRVFKQISIGAALSAAVFAAQAADVTGAGASFPYPIYAKWASDYKAATNNAVNYQSIGSGGGQQQIKAKTVDFGASDDPLKAEDLEKNGLLQFPAVIGGTVPVINVDGIAPGQLKLSGAVLADIFLGKVKKWDDAAIKALNPDLKLPSADIVVVHRSDGSGTTFGWTNYLSKVSPAWKEQVGEGKAVKWPTGQGGKGNEGVAAYVGQLKNSIGYVEYAYAKQNKLAWTQLQNKDGKFVQPEQKAFAAAAANADWKSAPGMGVVLTNEPGADSWPVTAATFILVHKSQDKPVQGRAVLEFFDWAFKNGAKSAEALDYVPLPEAVTTEIRAAWGEVKGADGKAVWQ

SEQ ID NO: 15088 - DNA, 972 bp, Prochlorococcus marinus subsp. pastoris str. CCMP1986
  CDS (1)..(972): transl_table=11
atgagcattgcaaagaaagctctcctattcacttctgcgctagctcttatagctggtccaagtgtaaccgcttcaacaagattgagtggagctggtgcttcatttccagcaaaaatctatactagatggttttctgatttagcaaaatcaggtggaccaagagttaattaccaggcagttggttctggttctggaagaaaagcatttattgatcaaactgttaacttcggtgcatcagatgatccaatgaaagataaggatattgcaaaggttactagaggtctagttcaaattcctatggttggtggaactattgctttcggatacaactatgattgcgatttaaaacttactcaagaacaagcagtacaggttgcaatgggtatggttaaaaactggaaagaattaggttgtaaagccggcaaactaacttgggcacatcgctctgatggttcaggaactactaaggctttcacaaactctatggaagcattttcaccaacatggactctaggaactggtaaatcagttaagtggccagcaggtgttggagcaaaaggaaattcaggtgttgccggtgtaattcaaaatactccaggtgcaattggttatgttaaccagtcctatattaaaggtaatgttaaggcagcagcacttcagaatttatcaggtgaatttttaaaaccatctgttgaagctggagctaaagctcttaacggcattactttagatgaaaatcttgcgggtaagaatcctaatccaacagcaaaaggtgcatatccaattgcttctctaacatggatacttgcttatgaaaaaggcaatggtagaaatactaaagctatcaagaagtcattaagcacacttctaagtgatgaatatcaagataaagctccaactttaggatttgttccacttaaaggagatatccttgagaaatcaagagctgcagttaagaaaattggtagataa

SEQ ID NO: 15089 - protein, 323 aa, Prochlorococcus marinus subsp. pastoris str. CCMP1986
MSIAKKALLFTSALALIAGPSVTASTRLSGAGASFPAKIYTRWFSDLAKSGGPRVNYQAVGSGSGRKAFIDQTVNFGASDDPMKDKDIAKVTRGLVQIPMVGGTIAFGYNYDCDLKLTQEQAVQVAMGMVKNWKELGCKAGKLTWAHRSDGSGTTKAFTNSMEAFSPTWTLGTGKSVKWPAGVGAKGNSGVAGVIQNTPGAIGYVNQSYIKGNVKAAALQNLSGEFLKPSVEAGAKALNGITLDENLAGKNPNPTAKGAYPIASLTWILAYEKGNGRNTKAIKKSLSTLLSDEYQDKAPTLGFVPLKGDILEKSRAAVKKIGR

SEQ ID NO: 15090 - DNA, 1011 bp, Synechococcus sp. WH 8102
  CDS (1)..(1011): transl_table=11
atgcgtcgttccaacagctttcgtgccctggcggccatcgccggcctgagcgcctccatggctctcacctcctgctccagtggtggcagcggcggcggcgatgacaaggtcaccggaaagctcaacggcgctggcgcctccttcccggcagccatctaccagcgctggttccaggaactccagccggagggcgtcacggtgaactaccaatccgtgggatccggcgctggcgtgcgtcagttcatggccaacaccgttgatttcggtgcatcggacaaaccgatgaaggaagccgaaatcgccaaggtggagcgaggtgtgctgcagattccgatgacggctggagcgatcgctgtggcctacaacctcgaagggtgtgacctcaagctcaccaccgagcaactggcaggaatcttcctcggcaagatcaaaaacttcagtgaactgggctgcgcagaccagaaactcaccgtggtccgtcgctccgatggttccggcaccacctacaacttcaccaagcacctgtccgccatcagcgaagagtggaagaacggccccggcgccgctaaatccatcaagtggcccaccggtgttggctcgaaaggcaatgagggtgtggcggcccagctgaatcagatcccaggtggtgtgggctatgtggaagccgcctacgtaaaaggcaagctccaggctgcagccgttaccaacgcctcaggcgaacaggtgaagcccaccaacgaaaccgagagcactgccctcgactccatcgacatcggccccgacctcatcggtggcaaccccaacccccctgcgggctacccgatcgtgaccttcacctgggtgctggcctacgaaacgggcaatggcgacaagaccgctgctctgaagaagaccctcgagttcatgctctccgaaaaagcccaatcccaggctcccgagctgggctacgtcagcctgccgacgggtgtggtggagaagtccctggctgcggtcgaaaagatcagcgaatga

SEQ ID NO: 15091 - protein, 336 aa, Synechococcus sp. WH 8102
MRRSNSFRALAAIAGLSASMALTSCSSGGSGGGDDKVTGKLNGAGASFPAAIYQRWFQELQPEGVTVNYQSVGSGAGVRQFMANTVDFGASDKPMKEAEIAKVERGVLQIPMTAGAIAVAYNLEGCDLKLTTEQLAGIFLGKIKNFSELGCADQKLTVVRRSDGSGTTYNFTKHLSAISEEWKNGPGAAKSIKWPTGVGSKGNEGVAAQLNQIPGGVGYVEAAYVKGKLQAAAVTNASGEQVKPTNETESTALDSIDIGPDLIGGNPNPPAGYPIVTFTWVLAYETGNGDKTAALKKTLEFMLSEKAQSQAPELGYVSLPTGVVEKSLAAVEKISE

SEQ ID NO: 15092 - DNA, 1038 bp, Chromobacterium violaceum ATCC 12472
  CDS (1)..(1038): transl_table=11
atgaaacagtctgttcgtctggccgccatcctgggttccacgctgatcgcaggctcggtctacgcggctgacatcaccggcgccggcgcgaccttcccctacccgctgtacgccaagtgggcggcgacgtacaagggcagcaccggcaacaacatgaactaccagtccattggctccggcggcggcatcaagcagatccagtccaagaccgtggatttcggcgcctccgacatgccgctgaagccggaagagctggaaaaggccggcctgacccagttcccgaccgtgatgggcggcgtggtgccggtgtacaacatcccgggcatcgccgccggccagatcaagttcaccggcccgctgctggccgacatctacatgggcaaggtttccaaatggaacgacgccgccatcgccaagctgaacccgggcgtcaagctgcctgaccagcgcatctcggtggtgcgccgctccgacggctccggcaccaccttcatcttcaccaattacctgtccaaggtttcgccggaatgggcgaaagacgtcggctccaacaccgccgtcagctggaagggcagctcggtcggcggcaagggcaacgaaggcgtggccaactacgtgtcgcgcatcaagggcgccatcggctacgtcgaatacgcctacgccaagcagaacaagctggcctacggcctgctgcagaaccaggccggcgctttcgtgaagccggatgaggcctcgttcaaggccgccgcggccaacgccgactggaaaaaggccccgggcttctacctgctgctgaccaaccagccgggcaaggccagctggccgatcgccggcgccaccttcatcctgatgcacaagaagcaggacaagccggcccaagccgccgaagtgctgaaatacttcgactgggcttacaagaacggcgacaagaccgcgcaggagctggactacattccgatgcccgacaatgtgaagggcgtgatccgcaccagctggaaacagatcaccgacggcagcggcaaggctgtctggaactga

SEQ ID NO: 15093 - protein, 345 aa, Chromobacterium violaceum ATCC 12472
MKQSVRLAAILGSTLIAGSVYAADITGAGATFPYPLYAKWAATYKGSTGNNMNYQSIGSGGGIKQIQSKTVDFGASDMPLKPEELEKAGLTQFPTVMGGVVPVYNIPGIAAGQIKFTGPLLADIYMGKVSKWNDAAIAKLNPGVKLPDQRISVVRRSDGSGTTFIFTNYLSKVSPEWAKDVGSNTAVSWKGSSVGGKGNEGVANYVSRIKGAIGYVEYAYAKQNKLAYGLLQNQAGAFVKPDEASFKAAAANADWKKAPGFYLLLTNQPGKASWPIAGATFILMHKKQDKPAQAAEVLKYFDWAYKNGDKTAQELDYIPMPDNVKGVIRTSWKQITDGSGKAVWN

SEQ ID NO: 15094 - DNA, 840 bp, Wolinella succinogenes DSM 1740
  CDS (1)..(840): transl_table=11
atgaaaaagagtcctatttggcttattccctatttaatacccctttttttgggagcagcctcccttaaaatcacaggggcaagcacgattcagcctattatcgaaaaatccgcctcagaatacgccaaaaatcactctgtcgccttcaacattagcgccggcggaagcggaaaaggaatgaaagattcgattgaacacctcaacgacattggcatggcttctcgtagcctcagcgctaaagaggagcagtcactcatcaaggtgaccattggctttgacgctctggccatcatcgtcaatcaacacaaccccctgaccgccctcacccaaaagcaggtcgccgatatctatagcggcaagatcagggagtggcgagagcttggatggagcgaaggggggaagatcatgctgataaacaaagagattggacgaagtactctagagctctttgagggctactctaagctcacccaccccaatcgccccaatgccaaactcgaaaactccatcgctaaagagcgctttgatattggctccaatctcgaatccatcacactcaccgcaggcatgaagtccgccattggctatgtctcctcaggcacagccgatctctccattaaggcgggctcccctattaagattctctctctagatggaatcgttcccaccaaagagagcattcaaagcgagaaatatcctattgttcgaggtctcaatcttgcctatcataaaaatgccgaaaacccagaaatcgccccttttattgatttcatcctcagccaagaagggcaaaagatcgtccaatcttttggatttttgcccattacaaaggataaatga

SEQ ID NO: 15095 - protein, 279 aa, Wolinella succinogenes DSM 1740
MKKSPIWLIPYLIPLFLGAASLKITGASTIQPIIEKSASEYAKNHSVAFNISAGGSGKGMKDSIEHLNDIGMASRSLSAKEEQSLIKVTIGFDALAIIVNQHNPLTALTQKQVADIYSGKIREWRELGWSEGGKIMLINKEIGRSTLELFEGYSKLTHPNRPNAKLENSIAKERFDIGSNLESITLTAGMKSAIGYVSSGTADLSIKAGSPIKILSLDGIVPTKESIQSEKYPIVRGLNLAYHKNAENPEIAPFIDFILSQEGQKIVQSFGFLPITKDK

SEQ ID NO: 15096 - DNA, 927 bp, Wolinella succinogenes DSM 1740
  CDS (1)..(927): transl_table=11
gtgattctcatgcgcccttttccttttcttttggccttggccttgacctttttgcaagcaggcgaaaccctgcttggctcgggggcaaccttccccgctaatgcctatgcagagtggatcaaagagtatgaaaagagcacccaaaatcgtgtctcttatctctctattggatcaggcggaggaatcaaacagatcaaaagtggtgtggtcgattttggtgcaagcgaagagcctctcaaagagagtgaattggccgtaggatttcatcaattcccctctctaagaggctccattgccctagtctataacctcccctctctcaaagatggtgatctacgcctcacgcctgagctcatcagtgatatctacctgggccttatcactcactggcaagaccccaaaatcagagctctcaatcccaacatcccccttcccaatctccccatcaccccccttcatcgaaatgatggaagcggaaccacccttgccttcacaagctacatggatcaccaatccaagacttggagcgaaagcattgggaagggcaaggcgctcgcttggccaaaaggcatgggcgctaaaggcaacgcgggcatgagccagcttgtctcccaaaaagaggggagtctaggctatgtagagctctcctataaactccaagagaagctgagcgctgcccttctccctctctcctctgatctcaaagagtggctctctcccgtggatgtcgaaaaaggatacccgcttatcactacaagctacatcatttttcccctcaaaagcaaaaaagcacgcgaggtggtccacttttttgactactcgtttaagcagggagatgcaacccttagaagacttggattcatccctttgaataaagaagaaaaaggattgatccaaaagcgttggcaagaacttgggctcttataa

SEQ ID NO: 15097 - protein, 308 aa, Wolinella succinogenes DSM 1740
MILMRPFPFLLALALTFLQAGETLLGSGATFPANAYAEWIKEYEKSTQNRVSYLSIGSGGGIKQIKSGVVDFGASEEPLKESELAVGFHQFPSLRGSIALVYNLPSLKDGDLRLTPELISDIYLGLITHWQDPKIRALNPNIPLPNLPITPLHRNDGSGTTLAFTSYMDHQSKTWSESIGKGKALAWPKGMGAKGNAGMSQLVSQKEGSLGYVELSYKLQEKLSAALLPLSSDLKEWLSPVDVEKGYPLITTSYIIFPLKSKKAREVVHFFDYSFKQGDATLRRLGFIPLNKEEKGLIQKRWQELGLL

SEQ ID NO: 15098 - DNA, 1014 bp, Gloeobacter violaceus PCC 7421
  CDS (1)..(1014): transl_table=11
atgaagaataaaccacttgctgtcgccgccagtatcgtggcgcttgctgcgggtgcgaccctggcgcaggggcttcccgcgcaggcaccgtccgttaagatcgatggatcgagcacggtctacccgatcacccgcgccgccgtcaaagccttcgaggccgaacacaagcaattccagggcaaaatcgccgtcaacttctccggcaccggcggtggatttcgcaagttctgcagcggtgagaccgatatttccgacgcttcgcggccgatcctccaaagggagatggatgagtgccgacgggcaaacgtcgcctttatggaactgccggtggccttcgacgcgctcacggtcgtcgtccaccccaaaaatacctgggctagcgagatcaccgtcgccgagctcaaaaaaatctgggagcgcgcctcccagggcaaaatcacccgctggagtcaggtgcgccccggctttcccgaccggccgctcaggctgtatggccccgggcgcgactcagggacgtatgactactttgctgaagccattctgggctccgccgacaccgacacccgcagcgattacgaggcatctgaggacgacgacgtgctggtagaaggagtagctgcggatcccaacgcgctgggttattttggctacgcctactacgaagcgaacctgaacagactgaagaccctggccgtcgatagcggcaaaggcccggtagcccctaccgacaaaaacgtcgagaagggcacctatgctccgctgtcgcgaccgctgttcatctacgtcaacatcgtctcggcgcaaaaaaaagcggaagtgcgcgaatttgtagacttttaccttgaaaacggcgcgaagctcgcttccttggtgggctatgtacccttaccggcggaaggctatcacatcgccaacaaccacttccatcggggcaagcgcggcacggtgtacggtgggcgggcctacctggggctgaccatccgcgaggtgctcctcaaaaccgccagcttctag

SEQ ID NO: 15099 - protein, 337 aa, Gloeobacter violaceus PCC 7421
MKNKPLAVAASIVALAAGATLAQGLPAQAPSVKIDGSSTVYPITRAAVKAFEAEHKQFQGKIAVNFSGTGGGFRKFCSGETDISDASRPILQREMDECRRANVAFMELPVAFDALTVVVHPKNTWASEITVAELKKIWERASQGKITRWSQVRPGFPDRPLRLYGPGRDSGTYDYFAEAILGSADTDTRSDYEASEDDDVLVEGVAADPNALGYFGYAYYEANLNRLKTLAVDSGKGPVAPTDKNVEKGTYAPLSRPLFIYVNIVSAQKKAEVREFVDFYLENGAKLASLVGYVPLPAEGYHIANNHFHRGKRGTVYGGRAYLGLTIREVLLKTASF

SEQ ID NO: 15100 - DNA, 1017 bp, Gloeobacter violaceus PCC 7421
  CDS (1)..(1017): transl_table=11
atgaacatgtcaaaaaacctgttggccactgctgcgctcgcggtgggcgcggtgggcgcggccctggcccagaacgcttccgacgagcaagtcaaagtcaaaattgatggatcgagcacggtctacccgatcacccgcgctgccgccaaggccttcgaggagcaaaacaagccgtaccaggggacgattgccgtcgccttttccggtaccggcgggggcttcaaaaagttctgcgccggcacaaccgatatcagcgacgcctcgcggccgatactccaaaaagaaatcgacgcctgccgcaacaacaacgtcgcctttatggaactgccggtggccttcgacgcgctcacggtcgtcgtccaccccaaaaatacctgggctagcgagatcaccgtcgccgaactcaaaaaaatctgggagcgcgcctcccagggcaaagtcacccgctggagccaggtgcgagcgggctttcccgaccggccgctcaagctctacggacccggccgcgactcgggcacctacgattactttgccgaggcgattttgggctccgccaacaccgacacccgcagcgactatgtcgacagcgaggacgacgatgtgctggtcaaaggggtcagcgaagatcccgacgccctgggctacttcggctacgcctactacgaagcgaacaaagataaattgaaggcgctcgccgtcgacggcggcaaaggcccggtgcctcctaccgacaagaatgttgagaaggggacctacgccccgctctcgcggccgctgttcatttacgtcaacatcgtctcgacccagaaaaagcccgaagtgcgcgaatttgtaaagtattatctggacaacggcgagaagctcgcggcttcagtgggctacgtgcccttgccggaggagggctaccacatcgcgagcaaccactttttccgcggcaagcgtggcacggtctacggcgggcgggcctatctggggctgagtatccgcgaggtgctcctcaagaccgccagtttctga

SEQ ID NO: 15101 - protein, 338 aa, Gloeobacter violaceus PCC 7421
MNMSKNLLATAALAVGAVGAALAQNASDEQVKVKIDGSSTVYPITRAAAKAFEEQNKPYQGTIAVAFSGTGGGFKKFCAGTTDISDASRPILQKEIDACRNNNVAFMELPVAFDALTVVVHPKNTWASEITVAELKKIWERASQGKVTRWSQVRAGFPDRPLKLYGPGRDSGTYDYFAEAILGSANTDTRSDYVDSEDDDVLVKGVSEDPDALGYFGYAYYEANKDKLKALAVDGGKGPVPPTDKNVEKGTYAPLSRPLFIYVNIVSTQKKPEVREFVKYYLDNGEKLAASVGYVPLPEEGYHIASNHFFRGKRGTVYGGRAYLGLSIREVLLKTASF

SEQ ID NO: 15102 - DNA, 1044 bp, Gloeobacter violaceus PCC 7421
  CDS (1)..(1044): transl_table=11
atgcagaccaacaagtggacccgcagggcttttgtttcggtagtggctctggcttcactcgcttctcccctgttgacgcaggtcgcccacgccctgaccctcagcggcgccggcgcaacgttcccgcagccactctatgaaaagtggttcttcgagtacaacaagaagaaccccgatgtcaaaatcaactaccagggcatcggcagcggcggcggcatcaaccagatcaccaacaagacggttgatttcggcgcttccgacgcggcaatgaacgacgagcagctcgccaaggtcggcggctcctcgaagatgctgatgctgcccatgaccgccggtgcagtggctatcacctttaacgtgcccggtgtgaagtcgggtttgcggatcacccgcgtggctttgaccgatatttttctgggcaaggtcaccaagtggaacgacccggccatcgcctcggtcaaccgcgacgtcaagctgccggatttgcccatcgccgtggtgcgccgctccgacagctccggtacgacctttatcttcaccaaccacctgtcggcgatcaaatcctcggattggtccgagaaagtcggcaagggcacctcggtgaactggcccaccggcatcggcgccaagggcaaccagggcgtctccgcccaggtccagcagactcccggtgcgattggctatgtcgagtacgcctacgccaccgagaacaacctgccggtggccgcggtcgaaaaccgcgaaggcaagttcgtgctgccgacggtcaaggcgaccgagaccgccctcgacgggaccaagtaccccgaaaatttccgcgtcttcatcgaagatccggacggggccggttcctatccgatcgtgggcctcacctggctgctggtgtacaaagaaggcaacgacaaggccaaggccgctgaactgaagaagttcgtcaactgggccttgaccgaggggcaacagtacgtcgagcccctcaagtacaccccgctgcctgccgccgtctccaaaaacgtgatcaaggcggccgagcagatcaagtaa

SEQ ID NO: 15103 - protein, 347 aa, Gloeobacter violaceus PCC 7421
MQTNKWTRRAFVSVVALASLASPLLTQVAHALTLSGAGATFPQPLYEKWFFEYNKKNPDVKINYQGIGSGGGINQITNKTVDFGASDAAMNDEQLAKVGGSSKMLMLPMTAGAVAITFNVPGVKSGLRITRVALTDIFLGKVTKWNDPAIASVNRDVKLPDLPIAVVRRSDSSGTTFIFTNHLSAIKSSDWSEKVGKGTSVNWPTGIGAKGNQGVSAQVQQTPGAIGYVEYAYATENNLPVAAVENREGKFVLPTVKATETALDGTKYPENFRVFIEDPDGAGSYPIVGLTWLLVYKEGNDKAKAAELKKFVNWALTEGQQYVEPLKYTPLPAAVSKNVIKAAEQIK

SEQ ID NO: 15104 - DNA, 1050 bp, Gloeobacter violaceus PCC 7421
  CDS (1)..(1050): transl_table=11
atgctgggagcaaaccttttgttgtcccagtgccagtcttccccaccggagggtcccagtgccaccgcccctagccccggcggcgcaccggccggtgcggtgaccctctccggcgccggggccaccttcccggcaccgctctatcagcggtggttctacgattatggccaggccaacccgaacgtcaaagtcagctaccagggcgtgggcagcggcgccggcatcaagcagtttcaaagcaaaaccgtcgattttgccgcgagcgacgtggcaatgagcgacgaggagattgccgcggtgccggcggatcgaggcgtggtgctattgccgatgaccgccggtagcgtcgtgctcatctacaacgtaccgggtgcgccggagaatcttaaactctcccgcgccgtctacagcgatatgttcctgggcaagattaaaaactggaacgacccgaagattgccgcactcaacccgggtgtcaaactgccggatctggccgccacggtggtgcgccgcgccgacggcagcggcacgaccggcgtgttcactcgccacctgagtgccgtcagccccgagtggaaaacgaaagtcggcgaaggcatcgccgtcaaatggcccacgggtgtaggcggcaagggcaacgacggtgtgacggctcaggtccagcagaaccccggctcgatcggctacgtggaatacggctacgccaccaacaacaagttgccctacgcttcgcttgaaaacaaagagggcaactatgtcctgccgacgctggaaaattccgccgcggccctcgcctcggtagagttgccgcccaacctgcgcgcttttatcgccgatccgcccggtaaggattcgtatccactggtcacttacacctggatcctcgcacccaagacaatggacacccccgaaaaggcgacggctttgaaggaagttctcaagtggtgcctcaccgaagggcaaaagtcgagcgaatccctcggatacattgaactgcccaaaccggttaccgagcgcgtcctggcggctgtcgagcaaattggcagctaa

SEQ ID NO: 15105 - protein, 349 aa, Gloeobacter violaceus PCC 7421
MLGANLLLSQCQSSPPEGPSATAPSPGGAPAGAVTLSGAGATFPAPLYQRWFYDYGQANPNVKVSYQGVGSGAGIKQFQSKTVDFAASDVAMSDEEIAAVPADRGVVLLPMTAGSVVLIYNVPGAPENLKLSRAVYSDMFLGKIKNWNDPKIAALNPGVKLPDLAATVVRRADGSGTTGVFTRHLSAVSPEWKTKVGEGIAVKWPTGVGGKGNDGVTAQVQQNPGSIGYVEYGYATNNKLPYASLENKEGNYVLPTLENSAAALASVELPPNLRAFIADPPGKDSYPLVTYTWILAPKTMDTPEKATALKEVLKWCLTEGQKSSESLGYIELPKPVTERVLAAVEQIGS

SEQ ID NO: 15106 - DNA, 1041 bp, Photorhabdus luminescens subsp. laumondii TTO1
  CDS (1)..(1041): transl_table=11
atgaaactgatgcgtaccaccgtaaccggcataatggcagcggcgttttctttgacaaccctgcctgtatttgctgccactagtttaaccggggcaggtgcgacatttcccgcaccggtgtatgccaagtgggcggattcttatcaaaaagagacaggtaataaagtcaattatcaaggcatcggttcttccggtggcgtaaaacaaattctggcaaataccgttgatttcggggcttccgatgcccctttatctgatgaaaagttagctgctgatggtttgtttcaattcccgaccgtcatcggtggggtggtactggcggttaatatcccggggattaaatctggtgaattgacattggatggtaaaactttaggcgatatttacttaggtaaagtgaaaaagtggaatgatccagcaattactcaattgaatccgggagtcaaactgccggaacaagatattgctgtgatacgtcgtgctgacggttccggtacttcctttgtatttactcgctacctctctaaagtgaataaagcgtggcaagaaaaagttggcgtgggttccaccgtaagctggcctattggtttgggtggtaaaggtaatgatgggattgccgcatttgttcaacgtctgacgggttccattggttatgttgaatatgcttacgctaaacagaatcatctggcttataccaaattggtatctgctaatggcaacattgttagcccgacagaagagagtttcagtgccgcagcgaagaaagcagaatggcataaaacgtttgctcaggatttgacaaaccagcaaggtgaaaatgtgtggccgatgacttccactacatttgttctggttcatcaacagcaaaaagatgcagtgaaaggggcagaaatattgaaattctttgactgggcttatgagaaaggcagtaaacaggcaaacgatctggattatgcaactctgcctaaagaggtgattgagcaagttcgtgcggcttggaaaacccagataaaagatagcaatggcaaggccctgtattaa

SEQ ID NO: 15107 - protein, 346 aa, Photorhabdus luminescens subsp. laumondii TTO1
MKLMRTTVTGIMAAAFSLTTLPVFAATSLTGAGATFPAPVYAKWADSYQKETGNKVNYQGIGSSGGVKQILANTVDFGASDAPLSDEKLAADGLFQFPTVIGGVVLAVNIPGIKSGELTLDGKTLGDIYLGKVKKWNDPAITQLNPGVKLPEQDIAVIRRADGSGTSFVFTRYLSKVNKAWQEKVGVGSTVSWPIGLGGKGNDGIAAFVQRLTGSIGYVEYAYAKQNHLAYTKLVSANGNIVSPTEESFSAAAKKAEWHKTFAQDLTNQQGENVWPMTSTTFVLVHQQQKDAVKGAEILKFFDWAYEKGSKQANDLDYATLPKEVIEQVRAAWKTQIKDSNGKALY

SEQ ID NO: 15108 - DNA, 825 bp, Vibrio vulnificus YJ016
  CDS (1)..(825): transl_table=11
gtgatgaaaaagacagtaatcggtgcaatcgctcttatgagtgctctgacagtgacaaccgcttcggcaaaagaaacgatctctgcagtgggttcaagcagcgtaactccactgatggaagttttctctgaaacatacatgaagaaaaacccagaagtttttattgaagttcaaggaccaggttcatcggcaggtgttaaagcggcaaaaaatggctctgcagatcttggtatgtcttcacgtgacctaaaatcgtctgagaaagaaaccgctttggttgaagaagtgattgctcgcgacggtatcgcagtggttgttaacccaaaaaacacgctgaaaggcctcactgctgagcaagtttctgccatctataaaggtgaagtgacgaactggaaacaagttggtggtgaagacaaacctatcgttgcgattactcgtgatacagcatcaggtactcgtggcgcatttgaagacattcttaaactgaagaagaaaatctcgggtaaagaagtgtctgccatctctcaacgtgctcaagtggcaaacggtaacggtgcactgaaaacgatggttgcttcaaacccttacgcgattggttacatctcgctaggtactgttgatgagtcggttcacccgctagctatcgatggcacggatgcgtctattccaaacgtgaaaaacggttcatacaaagtagctcgtccattccttgttctttacaagcagggcaaaccatctgctgaaacgcagaagttccttgattggatgctgacccctgaagcacaagccattgtagagaagaaaggctacatctcagttaactaa

SEQ ID NO: 15109 - protein, 274 aa, Vibrio vulnificus YJ016
MMKKTVIGAIALMSALTVTTASAKETISAVGSSSVTPLMEVFSETYMKKNPEVFIEVQGPGSSAGVKAAKNGSADLGMSSRDLKSSEKETALVEEVIARDGIAVVVNPKNTLKGLTAEQVSAIYKGEVTNWKQVGGEDKPIVAITRDTASGTRGAFEDILKLKKKISGKEVSAISQRAQVANGNGALKTMVASNPYAIGYISLGTVDESVHPLAIDGTDASIPNVKNGSYKVARPFLVLYKQGKPSAETQKFLDWMLTPEAQAIVEKKGYISVN

SEQ ID NO: 15110 - DNA, 1086 bp, Corynebacterium diphtheriae NCTC 13129
  CDS (1)..(1086): transl_table=11
gtgaactcctctgtcaccatcaagcgccttagcgcctccattgcctttgtcagcgcagcaggtattgcactgacaggatgctcggaaactgaatcgtcctcttccgctgcgtttactggtgcgtcgggcgaactcgtcgcagaaggtgcatcttcgcaacaaaacgcgatggattatttcaatgtgcgctaccaagaagccttctcgggttcctctttagcctataacgcctcaggttctggatctgggcgcaagaactttattgcaggccaagtagctttcggtggttcggattcaccactggcacaagagcagattcagccagcgacggatcgttgtaatggcaacgacgcctggcatttgccaatggtggtgggccctgtggctgtggcttataacttgtcgggtgtagatcatctgaacttgcctacggcggtgattgccaagatctttgctggcaagatcacccagtggaatgaccctgcgattgcagaggctaacaagggtgtctcgcttcccgataccaagatttctgttatttatcgctcggatgagtctggtacctcggataatttccaaaagttcttaactactgcggccccgcaggagtggaccacgtctggttcggcattccctgcgtctgttggctcgggtgcgaatggttctaatggtgtggcctcggaaaccaagactatcgacggcgccattacctacgtggaatccggttttgcccgccagcaaggcctcaacgttgccgccatcgacttcggtgccggtcccgtagaactcaattctgcttcggtgggcaaggcccttgatgctttgagcttcaagactgagggccacgacatggtggtggacaccaaagcactgttcgcacaaaaagcagaaggcacatatccgctggttttgaccacctacgagattgtttgctcggcaggatacgacgaagctacccgcaccaatgtgaaaaacttcttgtcccaggtgctgaaatcccaagattccaaactggaagaactcggctatatccctgttcaaggcaaacacctcgagcgccttaccgctgccgtggacgcgctataa

SEQ ID NO: 15111 - protein, 361 aa, Corynebacterium diphtheriae NCTC 13129
MNSSVTIKRLSASIAFVSAAGIALTGCSETESSSSAAFTGASGELVAEGASSQQNAMDYFNVRYQEAFSGSSLAYNASGSGSGRKNFIAGQVAFGGSDSPLAQEQIQPATDRCNGNDAWHLPMVVGPVAVAYNLSGVDHLNLPTAVIAKIFAGKITQWNDPAIAEANKGVSLPDTKISVIYRSDESGTSDNFQKFLTTAAPQEWTTSGSAFPASVGSGANGSNGVASETKTIDGAITYVESGFARQQGLNVAAIDFGAGPVELNSASVGKALDALSFKTEGHDMVVDTKALFAQKAEGTYPLVLTTYEIVCSAGYDEATRTNVKNFLSQVLKSQDSKLEELGYIPVQGKHLERLTAAVDAL

SEQ ID NO: 15112 - DNA, 1005 bp, Rhodopseudomonas palustris CGA009
  CDS (1)..(1005): transl_table=11
atgcgtgtacttcgcaccgctttgatggcgctcgccatcggctcgtccggcgtgacggccggtcatgccgagacgccggtgatggggaccggttcggcgttcgccgcgccgatctacatcaaatgggccgaacaactgaaagcgaccaagggtgtcgcgatcaactatcaaccttcggggtcttcggtcgggcaactccaggtgctgaagggcctgacggatttcggtgcgtcggatgtgccgatggaggacagcaagctcaaggaaggggacatcatgcagttccccaccgtcgtgggtggctacgccgttgtggtcaacattcccggtgtcctgcccggcaagctgcggctcaccgcgccggtgctggccgacatcttcatgggcggcatcaggtcgtgggatgaccagcagatcgtgcagctcaatcccggtttggcgctgcccaacctgccgatttcgctgctgtatcatgctggcggctcgggcggcacctacgcgatctcccgctatctgtcgaagaacagcgcggcgtggcgcgacaagatggggatcggcatgacgctgagttggccggtcggcgccggcgtcaagggcagctatggctcggcctcgacggtaccgatgacgtccggcgggatcggctatgccgagctgtcctatgtcaccgccaacaatcttgcgaccgtgcaacttcagaataggtcgggccggttcgtactgccgaacggaagcagtttcgctgccgccgccgagaatggcgattggtcggtgccgaactatgcggtcgatctcaccgacatgccgggcgagcacgcctggccgatcgtgacggcgacctttgcgctggtgccacgaggtcctgcgaaacgcgccacgtcggccgccgttctggacttcttccgatgggccttcgcgcatggcgacggcatcgcgcggtcgctgcagttcgttcctctgccgggcaaggtcaaagccgacatcgtcaagcatctgatgaactga

SEQ ID NO: 15113 - protein, 334 aa, Rhodopseudomonas palustris CGA009
MRVLRTALMALAIGSSGVTAGHAETPVMGTGSAFAAPIYIKWAEQLKATKGVAINYQPSGSSVGQLQVLKGLTDFGASDVPMEDSKLKEGDIMQFPTVVGGYAVVVNIPGVLPGKLRLTAPVLADIFMGGIRSWDDQQIVQLNPGLALPNLPISLLYHAGGSGGTYAISRYLSKNSAAWRDKMGIGMTLSWPVGAGVKGSYGSASTVPMTSGGIGYAELSYVTANNLATVQLQNRSGRFVLPNGSSFAAAAENGDWSVPNYAVDLTDMPGEHAWPIVTATFALVPRGPAKRATSAAVLDFFRWAFAHGDGIARSLQFVPLPGKVKADIVKHLMN

SEQ ID NO: 15114 - DNA, 1011 bp, Rhodopseudomonas palustris CGA009
  CDS (1)..(1011): transl_table=11
atgaatttcatcaaggcaatcgtcgcggccggtatggttgcggcgtcgacctcggccttcgccgccgacatcacgggcgctggcgccactttcccgtacccggtctactcgaagtgggcggacacctataagaaggacaccggcaacggtctgaactaccagtcgatcggttcgggcgccggcatcaagcagatcattgccaagaccgtgacgttcggcgcaaccgacgcgccgttgaagccggagcagctcgagaaggaaggcctggtgcagtggccgatggtgatgggcgccatcgtgccggtcgtgaacctcgaaggcgtgaagccgggtgagatggtgctcgacggcgagaccctggccaacatctacatcggcaagatcaccaagtgggacgacccggcgatcaagaagctgaacccgaaggtcagcctgccgggcgacgcgatcaccgtggttcgccgctccgacggttcgggcaccaccttcaacttcaccgactacctgtccaaggtcagcgctgactggaagaccaaggttggttcgggcaccgcggtcgagtggccggtcggcgtcggcgccaagggcaacgaaggcgtcgccggcaacgtcggtcagaccaagaattcgatcggctacgtcgaatacgcctacgccaagcagaacaagctgacctacaccggcctggtgaacagcgctggcaagaccgttcagccgacgattgcggccttccaggctgccgcggcgaatgccgattgggccaaggctccgggctactacctgatcctgaccaaccagccgggcgaagcctcgtggccgatcaccgccgcgaccttcatcctgatgcacaaggagccggtcgacaaggcggcttccggcgaagccgtgaagttcttcaagtgggcgttcgagaagggcggcaaggctgccgaagagctcgactacatcccgatgccggaaccggtcgtcaagctgatcgagaagacctgggccgcggacatcaagagctga

SEQ ID NO: 15115 - protein, 336 aa, Rhodopseudomonas palustris CGA009
MNFIKAIVAAGMVAASTSAFAADITGAGATFPYPVYSKWADTYKKDTGNGLNYQSIGSGAGIKQIIAKTVTFGATDAPLKPEQLEKEGLVQWPMVMGAIVPVVNLEGVKPGEMVLDGETLANIYIGKITKWDDPAIKKLNPKVSLPGDAITVVRRSDGSGTTFNFTDYLSKVSADWKTKVGSGTAVEWPVGVGAKGNEGVAGNVGQTKNSIGYVEYAYAKQNKLTYTGLVNSAGKTVQPTIAAFQAAAANADWAKAPGYYLILTNQPGEASWPITAATFILMHKEPVDKAASGEAVKFFKWAFEKGGKAAEELDYIPMPEPVVKLIEKTWAADIKS

SEQ ID NO: 15116 - DNA, 1029 bp, Geobacter sulfurreducens PCA
  CDS (1)..(1029): transl_table=11
atgaaaaaactcacgttgggcggaaagatcggccggattacccctgccctggcggccgccgtcatgggcctcacgatcacggcgagtccggtccttgccgcggacaaactcgtgaagatcgacgggtccagcaccgtctaccccatcaccgaggcggttgccgaggaattccagaaggccaagagaggcgccgtcaaggtaacggtcggcatttccggcaccggcggcgggttcaagaagttttgccgcggcgagattgacctatccggagcctcccgccccatcctcaagaaggagatggaagcgtgcaagcaggctggtatccagtacatcgagctgcccgtagcctatgacgccctcaccgtggtggtgaacccccagaacacctgggtcaagagcatgaccgtggacgagctcaagaagatttgggagcccgccgcccaggggaagatcacgaagtggaaccaggtcaaccccgcgtggccgaaccaacccctcaagctcttcgggccgggcgccgactcgggcaccttcgactacttcaccgaggcggtggtgggcaaggccaaatccagccgcggcgactttaccgccagcgaagacgacaacgtgctcgtgcagggcgtgtcccgcgacaggggtggactgggctacttcggctatgcctactacgccgagaacagcaagaagctcaaggcagttcccattgttgagaaggctggcaagccggcggtttccccgtccattgacaccgtcaagaacggcagctaccagcccctgtcccgtcccatcttcatctacgtgaacgccaagtcggtggacaagcccgaggtgaaggaattcgtagacttctacctgaatcaggcgccgaagctctccaaagcagtcaagtacgtgccgcttcccgacaaggcctatgcccttgccaagtcgaacttcgccaagaagaagaccggcaccggtttcggcggggagcctgaagtgggtgtctcggtggaggaactcctccagcgcgaaggaaagcactga

SEQ ID NO: 15117 - protein, 342 aa, Geobacter sulfurreducens PCA
MKKLTLGGKIGRITPALAAAVMGLTITASPVLAADKLVKIDGSSTVYPITEAVAEEFQKAKRGAVKVTVGISGTGGGFKKFCRGEIDLSGASRPILKKEMEACKQAGIQYIELPVAYDALTVVVNPQNTWVKSMTVDELKKIWEPAAQGKITKWNQVNPAWPNQPLKLFGPGADSGTFDYFTEAVVGKAKSSRGDFTASEDDNVLVQGVSRDRGGLGYFGYAYYAENSKKLKAVPIVEKAGKPAVSPSIDTVKNGSYQPLSRPIFIYVNAKSVDKPEVKEFVDFYLNQAPKLSKAVKYVPLPDKAYALAKSNFAKKKTGTGFGGEPEVGVSVEELLQREGKH

SEQ ID NO: 15118 - DNA, 1137 bp, Mycobacterium avium subsp. paratuberculosis str. k10
  CDS (1)..(1137): transl_table=11
ttggtggccccggccgtcgggggcgggaggagttgcgtgagtttcgctcgatctggcgccgtactgagcctgctggccgccgccgcgttgacgctgacggggtgcggcggcgactccaagtcgtcgtcggggtcgggcgcgcacgtggactgcggcggtaagaaggtgctcaaggacagcgggtccaccgcccagcagaacgcgatcgagcaattcgtctacgcctacgtccgggcctgcccgggctacacgctggactacaacgcgaacggctccggcgccggtgtcacgcagttcctcaacaatcagaccgacctcgcgggttcggacatcccgctggaccgcaccaccggccagaccgaccgggcggcggcgcggtgcaattcgcccgcctgggacctgccgaccgtgttcggtccgatcgcggtgacctaccacctcaccggggtgagcgggctcaaactggacgggccgaccgtcgcgaagatcttcaacggcgccatcaccaagtgggacgacccggcgctcaaggcggtcaatccgggcctcaacctgccgtcgacgcccatcgcggtgatcttccgcagcgacaagtccggcaccaccgccaactttcagaagtacctggacggggcgtccaacggcgcctggggcaagggcaccagcgagatgttcaccggcggcgtcgggcagggggccagcggcaacaacggcacctcggcgctgctgcagaacaccgaggggtcgatcacctacaacgagtggtcgttcgcggtcggcaagcagctgagcatggcgtcgatcatcacctcggcggggccggacgcggtgcccatcaccaaggagtccgtcgaaaagaccatcgccggggccacctttcaggggcagggcaacgacctggtgctggacacctcgtcgttctaccggcccacccagcagggcgcgtacccgatcgtgctggcgacctacgaaatcgtctgctcgaaatatccggacgcggcgacggggtccgcggtgaaggcgttcatgcaggccgcgatcggtcccggccaggacggtctggaccagtacggttccatcccgctgccgggttcgttcacggcgaagctgtcgagcgcggtcaatgcgatttcctga

SEQ ID NO: 15119 - protein, 378 aa, Mycobacterium avium subsp. paratuberculosis str. k10
MVAPAVGGGRSCVSFARSGAVLSLLAAAALTLTGCGGDSKSSSGSGAHVDCGGKKVLKDSGSTAQQNAIEQFVYAYVRACPGYTLDYNANGSGAGVTQFLNNQTDLAGSDIPLDRTTGQTDRAAARCNSPAWDLPTVFGPIAVTYHLTGVSGLKLDGPTVAKIFNGAITKWDDPALKAVNPGLNLPSTPIAVIFRSDKSGTTANFQKYLDGASNGAWGKGTSEMFTGGVGQGASGNNGTSALLQNTEGSITYNEWSFAVGKQLSMASIITSAGPDAVPITKESVEKTIAGATFQGQGNDLVLDTSSFYRPTQQGAYPIVLATYEIVCSKYPDAATGSAVKAFMQAAIGPGQDGLDQYGSIPLPGSFTAKLSSAVNAIS

SEQ ID NO: 15120 - DNA, 879 bp, Desulfovibrio vulgaris subsp. vulgaris str. Hildenborough
  CDS (1)..(879): transl_table=11
atgtcacgcgtcatctccacccgtctctccacgtaccgcgaccgtctcgttcgtgccgcgggccacgccttcgtcgtctgcgccttcgtcgtccttgcgcaggttgcccatgccgcctcaccgctggaagccttcaagggcatgtccggcaatctcgatatcgccggaggtacggcgcacatccccgtcatgaaagaggccgcgaagcgcatcatgacgcagaatgccgccatccggatttccgtcgcgggcggcgggtccggcgtcggggtccagcaggtgggcgagggccttgtggccatcggcaacaccgggcgtgcgctttcggaggccgaggtcgccaagtacggtctcgtctcgttccccttcgccatcgacggcgtggccgtggttgtgaaccccgccaaccctgtcggcgcgctcactgcggcacaggtacgcgacatctacgcgggcaaggtgaccaactggaaggcactcggcggtgcggacagggccatcaccctctatacgcgtgacgaggccagcggcacgcgcgaggtgttcgacggcaagctgcttgccaagggcgccgtcgcagcctcggccaatgtcgtgccctccaatggcgcgatgaagaccgccgtggcgcaggatgccggggccataggctatgtgggcatcggccacatcgacacttcggtgaaggccccggtgctcgacggcatggtggctacgcaggagaacgccgccaacggcagttatacggtcacccgcaagctctacatgaacaccaagggtcagcccaccggacttgtccgcgccttcatcgactatctgttcaccgacgaaggtgccgatatcatccgcgccagcggctacatccccacaggccggtga

SEQ ID NO: 15121 - protein, 292 aa, Desulfovibrio vulgaris subsp. vulgaris str. Hildenborough
MSRVISTRLSTYRDRLVRAAGHAFVVCAFVVLAQVAHAASPLEAFKGMSGNLDIAGGTAHIPVMKEAAKRIMTQNAAIRISVAGGGSGVGVQQVGEGLVAIGNTGRALSEAEVAKYGLVSFPFAIDGVAVVVNPANPVGALTAAQVRDIYAGKVTNWKALGGADRAITLYTRDEASGTREVFDGKLLAKGAVAASANVVPSNGAMKTAVAQDAGAIGYVGIGHIDTSVKAPVLDGMVATQENAANGSYTVTRKLYMNTKGQPTGLVRAFIDYLFTDEGADIIRASGYIPTGR

SEQ ID NO: 15122 - DNA, 1041 bp, Erwinia carotovora subsp. atroseptica SCRI1043
  CDS (1)..(1041)
atgaaactgatgcgtaccactcttgccagtgttgttgcggcaaccttttctttgacggcattttctgcttttgctgctgctaacctcaccggtgccggtgcgacattcccagcgcctgtttatgctaaatgggctgactcctatcaaaaagaaaccggcaataaagttaactatcaaggaatcggttcttctggcggtgtaaaacagattatcgctaaaacggtagactttggtgcttctgatgcgccgctggctgacgacaaattagcacaggatggtttattccagttcccaaccgttatcggtggcgtggtactggcagtgaacgttcctggtatcaaatctggtgaattgacgctggatggtaaaacactgggtgatatctacctgggtaaaatcaaaaaatggaacgacccggcgattaccaagctgaacccgaatgccaagctgccggatcaggatattgctgtggttcgtcgtgctgacggttctggtacttctttcgtgttcaccagctatctggcgaaagtgaacccagaatggaaagagaagattggtgctggttctactgtgaactggccgaccggtctgggcggtaaaggtaacgatggtatcgcggcgttcgtacagcgtctgcctggttctatcggttacgtagaatatgcgtatgccaagcagaacaacctggcttacaccaaactgatttctgccgatggcaaagcggttagcccgactggcgcaagtttcagcaacgcggccaaagagatcgactggagcaagtctttcgctcaggatctgactaaccagaaaggcgctgatgcatggccgatcacgtcaaccacgttcatcctggttcataccaaacaggaaaaacctgagcagggcgctgaagtgttgaaattcttcgactgggcgttcaagaaaggcggtgagcaagcagaagcactggattacgccacactgccaaaagaagtgactgagcaaatccgtgctgcctggaaaactcaggtcaaagacagcagcggtaaagcactgtactga

SEQ ID NO: 15123 - protein, 346 aa, Erwinia carotovora subsp. atroseptica SCRI1043
MKLMRTTLASVVAATFSLTAFSAFAAANLTGAGATFPAPVYAKWADSYQKETGNKVNYQGIGSSGGVKQIIAKTVDFGASDAPLADDKLAQDGLFQFPTVIGGVVLAVNVPGIKSGELTLDGKTLGDIYLGKIKKWNDPAITKLNPNAKLPDQDIAVVRRADGSGTSFVFTSYLAKVNPEWKEKIGAGSTVNWPTGLGGKGNDGIAAFVQRLPGSIGYVEYAYAKQNNLAYTKLISADGKAVSPTGASFSNAAKEIDWSKSFAQDLTNQKGADAWPITSTTFILVHTKQEKPEQGAEVLKFFDWAFKKGGEQAEALDYATLPKEVTEQIRAAWKTQVKDSSGKALY

SEQ ID NO: 15124 - DNA, 1152 bp, Propionibacterium acnes KPA171202
  CDS (1)..(1152): transl_table=11
gtgaatcgtttcgccaaaatcactgccctggctgctatcagcgccatctccctcaccgcttgtggtgccaatggtgacaagggttccagttctgcctcgtcctccaagaccacctcgactgccagctccgccgcccagcccagcgattcctcggctgacgctgtctcgttcaagcccgcctgccctggtggcagcatctccggtgctggttcctcggctcagctgaacgccatcaaccaagttatttccgactacaaggctgcctgttcctcagcaaccgtcaactactcccccaccggctccggcgctggcgtgaagtccttcatcggtaggcaaaccgactgggccggttctgactccgtcctcaacgctgacaagggggagcctgataaggccaagcagcgctgcaacgccgacccatggcacctcccgatggctgctggcccgattgccgtggtctacaacgtcgacggcgtcaaagatctaaccctctccaccgcgaccctcgccaagattttctccggcgccatcacaaactggaacgacgacgccatcaagaaggagaacccgaaagccgcgttgccgtcggcccagatcgaggtgttttaccgcaaggacgagtcgggcaccaccgacaacttcaccaagttcctcaacaaggcggccggtgacatctggactgagaagcactccaagacatggaaaggtgcgggcaagggcgccgataagtcggccggcatcgcccaggctgtcaagagcaccaagaactcgatctcgtacgacgagtggtcctacgctacaaagaacagcctcgacatggccgccatcgataacggaaacggtccggtcaagctgaccggtgagtctgccggtaaggccgtctcggccgctaaggtcgtcggacagggccatgacctgcagctcgagctccagtacaagaacaccccggcgggcgtgtatccggccgttctcgtaacctacgagatcgcttgttccaagggccaggactccggcaaggccgcgctcttgaaggacttcctgtccttctacgcttctgagagggagcagaagaagatccaggaccttggttacgctccgctaccctccgacgttgcttcgaaggttctgggttccgcccaggccctctcctga

SEQ ID NO: 15125 - protein, 383 aa, Propionibacterium acnes KPA171202
MNRFAKITALAAISAISLTACGANGDKGSSSASSSKTTSTASSAAQPSDSSADAVSFKPACPGGSISGAGSSAQLNAINQVISDYKAACSSATVNYSPTGSGAGVKSFIGRQTDWAGSDSVLNADKGEPDKAKQRCNADPWHLPMAAGPIAVVYNVDGVKDLTLSTATLAKIFSGAITNWNDDAIKKENPKAALPSAQIEVFYRKDESGTTDNFTKFLNKAAGDIWTEKHSKTWKGAGKGADKSAGIAQAVKSTKNSISYDEWSYATKNSLDMAAIDNGNGPVKLTGESAGKAVSAAKVVGQGHDLQLELQYKNTPAGVYPAVLVTYEIACSKGQDSGKAALLKDFLSFYASEREQKKIQDLGYAPLPSDVASKVLGSAQALS

SEQ ID NO: 15126 - DNA, 867 bp, Streptococcus pyogenes MGAS10394
  CDS (1)..(867): transl_table=11
atgaaaatgaaaaaaaaattctttttgttaagtctcttggccctatcaactttctttttatccgcatgttctagctggattgataaaggtgagtcaataaccgctgtaggatcaacagcactacaacccttagtagaagcagtagctgatgaatttggaagcagtaatctaggcaagactgtcaatgttcaaggtggtggttcaggtacagggttgtctcaagttcaatcaggagctgtccaaattggaaatagtgatgtctttgcagaagaaaaagatggtattgatccttctaaattagttgatcatcaagtagctgttgcaggacttgcagttattgccaatcctaaagtcaaggtttccaatctcagtagtcagcagttgcaaaagattttttcaggagaatataccaattggaaacaagttggaggagaagatcttgcgatttcagtgatcaaccgagcagcaagttctggctcacgagcaacctttgacagtgttatcatgaaaggggtcaacgctaaacaaagtcaagagcaagactccaatgggatggttaaatcgattgtttcacaaataccaggtgccatttcttacctttcctttgcctacgttgattcatctgttaaatctttgcaattaaatgggtttaaggcaaatgctaagaatgtggctacaaatgattggccaatctggtcctacgaacacatgtacaccaaagataaaccaacagggttgaccaaggaatttcttgattatatgttttcagatgaagtacaacagaacattgttacacatatgggatatatttcgataaatgatatggaagtggtcaaatctcatgatggaaaagtaacaaaaaggtaa

SEQ ID NO: 15127 - protein, 288 aa, Streptococcus pyogenes MGAS10394
MKMKKKFFLLSLLALSTFFLSACSSWIDKGESITAVGSTALQPLVEAVADEFGSSNLGKTVNVQGGGSGTGLSQVQSGAVQIGNSDVFAEEKDGIDPSKLVDHQVAVAGLAVIANPKVKVSNLSSQQLQKIFSGEYTNWKQVGGEDLAISVINRAASSGSRATFDSVIMKGVNAKQSQEQDSNGMVKSIVSQIPGAISYLSFAYVDSSVKSLQLNGFKANAKNVATNDWPIWSYEHMYTKDKPTGLTKEFLDYMFSDEVQQNIVTHMGYISINDMEVVKSHDGKVTKR

SEQ ID NO: 15128 - DNA, 1095 bp, Leifsonia xyli subsp. xyli str. CTCB07
  CDS (1)..(1095): transl_table=11
gtgaaactgaagcgccttggcgttcccgtggccctcctggccgcggccgctctttccctcaccgcctgcgcagccaacgaaggcagcagcccggcggccacctcggcgaagccgtcgaatctctccggcaccctcaacggcatcggctcttccgcccagggagccgcccagaccgtctggatcgccggcttccagcaggacaacccgaaggcgaccgtcaactacgacccgcaaggctccggcgccggtcgcaagagtttcatcgcgggcgcaaccgacttcgccggctcggacgccgcgctcaacgacaccgagctctcctccacgttcgcgggttgcgccgcaggcagcaaggccatcgacctgccagtctacgtctccccgatcgcgatcgcgtacaacatcgacggtgtgaaggacctcaagctcgacgccgccaccatcgcgggcatcttctcgggcaagatcgccacttgggacgacgcgaagatcaaggggctgaacgcggacgcctcgctcccgtccgccccgatcactgtcgtacaccgttccgacgactcgggcaccacgcagaacttcaccgactacctcgcagcgaacgcgcccgacgtgtggaccgctcccgcgtcgcagacgttcccgttccagatcggtgacgcggcgaagggcacctcgggcgtcgcagaagccacgaagaacgccaagaactcgatcacctacatcgacgagtcgggctcggccggcctgtccatcgcacagctgaaggtcggcgacagcttcgaaaagatcagcgccgatggcgcagccgctgtggtcgccgcctccccgatcgccgctggccgcggcagcaacgacctcgccatcaagatcgaccgcaaggacaccgccaagggagcctggccgctggtcctcgtctcgtacgtcatcgcctgccaggagtacaaggactccgccaaggccgatctggtgaagggctacatcgactacttggtctccggccacgcccagaaggccgccgcaaagcaggccggctccgctccgctcgcgagcgatctctccgacaaggtctccaaggccgtcgccagcatcaagtaa

SEQ ID NO: 15129 - protein, 364 aa, Leifsonia xyli subsp. xyli str. CTCB07
MKLKRLGVPVALLAAAALSLTACAANEGSSPAATSAKPSNLSGTLNGIGSSAQGAAQTVWIAGFQQDNPKATVNYDPQGSGAGRKSFIAGATDFAGSDAALNDTELSSTFAGCAAGSKAIDLPVYVSPIAIAYNIDGVKDLKLDAATIAGIFSGKIATWDDAKIKGLNADASLPSAPITVVHRSDDSGTTQNFTDYLAANAPDVWTAPASQTFPFQIGDAAKGTSGVAEATKNAKNSITYIDESGSAGLSIAQLKVGDSFEKISADGAAAVVAASPIAAGRGSNDLAIKIDRKDTAKGAWPLVLVSYVIACQEYKDSAKADLVKGYIDYLVSGHAQKAAAKQAGSAPLASDLSDKVSKAVASIK

SEQ ID NO: 15130 - DNA, 855 bp, Symbiobacterium thermophilum IAM 14863
  CDS (1)..(855): transl_table=11
atggctgtgcttcgcagtcgcccgctggcggccatcctgctcgcggcaacgctgctcctcgccggctgtggcagccgcccgcaggccgatcccaacgaccccctggcggggaccatcacggccagcggctccaccgccctcctgccgctcgcctcgctggcggctgagatcttcatggaggagcacctcaacgtgacggtgaacgtcagcggcggcggctcgtacaacggcctgcagcaggtggcggtcggcgccgtggacatcggcaactccgacatcccggccaccggggagctggccgacgtgctggtggagcaccgggtcgccatcgccccgttcgtcatcatcgtccaccccgagaaccccgtggacgggctgacgatggagcagctggccgggatcctccggggcgagatcaccaactggcaggaggtcggcggtcccgacctggagatcgtggtcgtcagccggcagcagtcgtcgggttcgcgggcgaccatcgtggagaaggtgctggccggcgaaggcgacatctcgccccaggccctggtgcaggactccaacggcaaggtggtgaccaccgtgcagtatacccccggggccatcggctacatcgacgcgtcctatcaccggccgtcgaaggtgaaggccctggcgctggacggcgtcgcctactccccggacgccgtgctggagggtcggtggccgatctggacctacgagtatatgtacaccaagggggaacctgccgggcttgcgcgcgcgttcctggagttcgtgctgagccccgagttccaggaggagtacgtggcggagctgggcttcgtgcccatcacccgggagactgcccgctga

SEQ ID NO: 15131 - protein, 284 aa, Symbiobacterium thermophilum IAM 14863
MAVLRSRPLAAILLAATLLLAGCGSRPQADPNDPLAGTITASGSTALLPLASLAAEIFMEEHLNVTVNVSGGGSYNGLQQVAVGAVDIGNSDIPATGELADVLVEHRVAIAPFVIIVHPENPVDGLTMEQLAGILRGEITNWQEVGGPDLEIVVVSRQQSSGSRATIVEKVLAGEGDISPQALVQDSNGKVVTTVQYTPGAIGYIDASYHRPSKVKALALDGVAYSPDAVLEGRWPIWTYEYMYTKGEPAGLARAFLEFVLSPEFQEEYVAELGFVPITRETAR

SEQ ID NO: 15132 - DNA, 918 bp, Bacillus licheniformis ATCC 14580
  CDS (1)..(918): transl_table=11
gtgaaaccatttaaaaaaatcacactgatgttcatcatgtccgttttagttgtcttcgcagcagcttgtggaagcagcagtacaaacaacaatgcagacgaaggcaaacaaagcgataaaacagagaataaggcttcaggttctttgacgatttcgggttcttcggcgatgcagcctcttgtcttagcagcggctgaaaaattcatggatgaaaatcctgatgccgatattcaagttcaggctggaggttctggtacaggcctttcccaagtggctgaaggcacagtccaaatcggaaactccgatgtctttgccgaagaaaaagaaggcattcctgccaaagaacttaccgatcatcaagttgcggttgtcggaatggcagctgccgttaaccctgaagtaggcatcgatgacatttcgttagaagatctcaaaaaggtattcacaggtaaaatcaaaaactggaaagaactaggcgggaaagatcaaaagatcacccttgtcaaccgtcctgattcttcaggaacccgcgcgacttttgtcaaatatgcacttgatggagagactccagctgaaggaatcacggaagattcttcaaacacagtgaaaaagttaatcgctgaaacgcctggtgcaatcggatatcttgcgttctcgtatatcaaggatgatactgtcactccgctttcaatcgacggcgttaagccgacagccgaaaatgtacaaaaaggcaaattcccgatctgggcttaccagcattcttatacgaaaggcgaacctgaaggcttggcgaaagaattcctcgactatttgatgagcgatgacattcaaaaatccatcgtgacggagcagggctacattccagtaacagacatggaagtaaaacgcgacgcggatggaaagcaaactgataaataa

SEQ ID NO: 15133 - protein, 305 aa, Bacillus licheniformis ATCC 14580
MKPFKKITLMFIMSVLVVFAAACGSSSTNNNADEGKQSDKTENKASGSLTISGSSAMQPLVLAAAEKFMDENPDADIQVQAGGSGTGLSQVAEGTVQIGNSDVFAEEKEGIPAKELTDHQVAVVGMAAAVNPEVGIDDISLEDLKKVFTGKIKNWKELGGKDQKITLVNRPDSSGTRATFVKYALDGETPAEGITEDSSNTVKKLIAETPGAIGYLAFSYIKDDTVTPLSIDGVKPTAENVQKGKFPIWAYQHSYTKGEPEGLAKEFLDYLMSDDIQKSIVTEQGYIPVTDMEVKRDADGKQTDK

SEQ ID NO: 15134 - DNA, 1113 bp, Nocardia farcinica IFM 10152
  CDS (1)..(1113): transl_table=11
gtgaatttcaagcgcagcagcgccctggtgggtgctctggccgtcgtcgccatgcctctcgccgcctgtggcagtgacgacaacaccagcggtgacaccagcaacgcggccaacagcagcgtcgcctgcggcggcaaggagtcgctgaaggccagcggcgcctcctcccagaagaacgcgatggagcgcttcatcgccgcctacgaagccaactgcgacggctacaccctcaactacacctccagcggctccggcgcgggcgtcaacgagttcctcggcggccagaccgacttcggtggctcggactccccgctcagccagtccaagggcgagcctgccaaggcccaggaacgctgcggcgccccggcctggaacctgccgaccgtgttcggccccatcgccatcacctacaacatcgacggcgtgaccgacctcgtgctggacggcccgaccgcggcgaagatcttcaacggcaccatcaagacctgggacgcccccgagatcaaggcgctgaacccgaacgcgcagctgcccgccgcgccgatcgcggtgatcttccgctccgacgagtcgggtaccaccgacaacttccagctctacctggacgcggcctcgggcggcgcctggggcaagggcggcggcaagaccttcaacggcggtgtcggtgagggcgccaagggcaacgagggcacctcggccgcgatcaagaacaccaagaactcgatcacctacaacgagtggtccttcgccaagtcgcagaacctctcggtcgcccagatcgtcacctcggccgggccggagccggtgaagctctcggtcgagaccgcgggcaaggccatcgacggcgtgaagatcaagggcgagggcaacgacctggtcctcgacaccagctcgttctaccagccgaccgtggcgggctcctacccgatcatgatggcgacctacgagatcgtgtgctcgaagtacgccgatgccgccaccggccaggccgtcaaggcgttcctgacctcggcggtgaccaacgggcagaacggcctggaggacaacgggtacatcccgatccccgagcagttcaagacccggctgaccacggcgatcaacgccatctcctga

SEQ ID NO: 15135 - protein, 370 aa, Nocardia farcinica IFM 10152
MNFKRSSALVGALAVVAMPLAACGSDDNTSGDTSNAANSSVACGGKESLKASGASSQKNAMERFIAAYEANCDGYTLNYTSSGSGAGVNEFLGGQTDFGGSDSPLSQSKGEPAKAQERCGAPAWNLPTVFGPIAITYNIDGVTDLVLDGPTAAKIFNGTIKTWDAPEIKALNPNAQLPAAPIAVIFRSDESGTTDNFQLYLDAASGGAWGKGGGKTFNGGVGEGAKGNEGTSAAIKNTKNSITYNEWSFAKSQNLSVAQIVTSAGPEPVKLSVETAGKAIDGVKIKGEGNDLVLDTSSFYQPTVAGSYPIMMATYEIVCSKYADAATGQAVKAFLTSAVTNGQNGLEDNGYIPIPEQFKTRLTTAINAIS

SEQ ID NO: 15136 - DNA, 825 bp, Photobacterium profundum SS9
  CDS (1)..(825): transl_table=11
atgaaaacaaaggttatcggtgcactagctcttgcaggttcaatggcattcagtgttgctgcagttgcaaacgaaactatctctgttgtaggttcaagttcagttacaccattaatggaagtgtttggtgaaacttacagccaagcacactctaatgtttttgttgaagttcaaggcccaggttcatcagctggtgttcgtgccgcaaccgatggttctgctgatttaggtatgagttctcgtaatcttaaagattcagagaaatcagatgatttaaaagaaattgtcgttgcacgtgatggtatcgctgttgtagttaacaacaagaacccaatcactgacttatcaaaagaagacgtaacgaagatttacaaaggtgaaatcactaactggaaccaagttggcggtgaagataagccaatcgtagtggtaacacgtgacacagcatctggtacacgcggtgctttcgaagacatcatgtcgctgaagaaaaaaattaacgacatcacagtatcagctatctctcagcgtgctcaggttacaagtggtaacggccaacttaaaacaacagttgctaacaacccgtttgcaattggttatatctctcttggtactgttgatgattcactaaaagcactatcaatcgacggtcacgtaccttcagttgcagctatcaaatctggtgaataccaagttcaacgtcctttccttgtgctttacaagacaagcaaaattaacccaaccacgcagtctttcttagattggacgctaaccactgaagcacagaaaattgtttcagctaaaggctacattgcagttaactaa

SEQ ID NO: 15137 - protein, 274 aa, Photobacterium profundum SS9
MKTKVIGALALAGSMAFSVAAVANETISVVGSSSVTPLMEVFGETYSQAHSNVFVEVQGPGSSAGVRAATDGSADLGMSSRNLKDSEKSDDLKEIVVARDGIAVVVNNKNPITDLSKEDVTKIYKGEITNWNQVGGEDKPIVVVTRDTASGTRGAFEDIMSLKKKINDITVSAISQRAQVTSGNGQLKTTVANNPFAIGYISLGTVDDSLKALSIDGHVPSVAAIKSGEYQVQRPFLVLYKTSKINPTTQSFLDWTLTTEAQKIVSAKGYIAVN

SEQ ID NO: 15138 - DNA, 858 bp, Photobacterium profundum SS9
  CDS (1)..(858): transl_table=11
gtgaaatctaacttattacggagaaagtcaatgttttttagggcaactacccttgtggcattgtgtgcaagcgtggcgtttagtgcacaagccaaaacagatactgtcacaattactggatcaacatcagtaagccatgtgatggaaatcttagcagaagcttattcaacctctcatatagatacttttattgctgttcaaggcataggttcttctgctggcatttctgcagtaaaacaagatgccacagaaataggtatgagctctcgccgtctgagtgaagatgagataaaccctgatgtgaaaatggtaacaattgcacatgatggcattgctttggtcgtcaatcaaaacaaccctgttaacaacctcacaaaagagcaagtatcaaagatttaccatggggaaattaaaaactggcaggaagtcggtggtccaaatctaaaaatggctgttgttagccgtgaaaatgcttctggctcacgcttttcttttgaagactttatgggcttaacccaaaacattgaaggtcaaagggtatctgatataaacccacaactcttagtagttaacactaatggcatggtgaaaagtttagtctctcgtaatgtacatgcacttggctatatgtctttaggttctgtggatgactctattaagccgttgtcttttgaaggcgttaagccaaccattgataacctcgaatcaggagagtatttaatctctcgcccttttttaatgttatataaagagaagaacgtatcaaaaaatgcacaagcgtttttaaactacgttatttctaatgaagggcagaatattatcggtgaacgtggatacattacgaaccataaaagttaa

SEQ ID NO: 15139 - protein, 285 aa, Photobacterium profundum SS9
MKSNLLRRKSMFFRATTLVALCASVAFSAQAKTDTVTITGSTSVSHVMEILAEAYSTSHIDTFIAVQGIGSSAGISAVKQDATEIGMSSRRLSEDEINPDVKMVTIAHDGIALVVNQNNPVNNLTKEQVSKIYHGEIKNWQEVGGPNLKMAVVSRENASGSRFSFEDFMGLTQNIEGQRVSDINPQLLVVNTNGMVKSLVSRNVHALGYMSLGSVDDSIKPLSFEGVKPTIDNLESGEYLISRPFLMLYKEKNVSKNAQAFLNYVISNEGQNIIGERGYITNHKS

SEQ ID NO: 15140 - DNA, 4956 bp, Acanthamoeba polyphaga mimivirus
  CDS (1)..(4956)
atgaaaagtattggtatatttgtagtagccttatggctaactcatttttgtgacggaggacaattaggagctcgtatttatagttccggaagtgaatcatcagttttattgtttgatcaatacatcaataaatatgcatttacaaatggagatgttaagattatctatgagggaaaatctatttttgaaattttgtctgaaacttatgttacggattttaatatattcgacagagctatttcacaagacaatttggatatgtttcaaattgtccaatttcctttggcaggtcaagcaattgtaatgacatacaatctacctgaactagttaattcaagttacagattagtgattgatagagaaactttgggaaaaatctggtatggtgctattagtaaatggaatgatacagctattcaaaatctcaatccgactgttggtcatttattacctgatactgatattatacttggatacagcgacgattacattatgacaatttcaggattgataaaaatggcattgagtagttttagtccagaatttgataccgaacttaaatatgctaataatacttttaatggtatgaatccgacaaaaaatggtagaggacataatatcggtgaaacatctaccgtccgattagaatggctcaaaaaaacatcttatggtttaacatatattaattatgctgatgtgtataataatggtacagattcaactgtacctatgaacatgtataataaagccggatattttgtcgagccaaatttagttagtgttcaagcggctatgtccgatttcaagatattttatgccaataacaattctactattgatatttacgatgctcctggtaataaatcttggccattggcttacgtaaattatcttggatgttcaagtgcttttggacctatggcagattgcacacgtacaattcaaatgactaattttattgcttggatatacactaatgatgcagcttctgaatctgcaattgaacttcaattttatcctttggataaaacactacaaaaagtagctattgacaatttatacaatatcaaatgtaataacatagcagttttatctcaacagtatttaataggttttggagcacccattagcgttatgtcgttatggcctaattcatggactacagttgcatctactgcacgatattatagtgctccatcatctcaagctcttgaattacaagaaacttatggtgccgattttggaataactgtgaccggagttcctaatacatatttcaataaaatgcccgatttaggtgttatgccattagctgcttttactattgttccagcctataatattccagcaatcaatggaacaaacggaacattaattcttgattatgagattattacggatatttatttaggaatcataaataattggaatgacagtcgaattagggctctcaatggaattgaaatcaatagaaaacttccaaacgttagtataacagtaatttatcaggctgtttcatcggattataatttcatgtttactgatttcatgagtaagaaatcaccaaaatttgcgaaaaaaattggttcaacatattttccaatactaacacttccaaataattctatgataattacaacagatatttatgatgttggtaatcaacttattagtaattccaattcttttgcattttggccttattttggtataactatgttgtcaagacaaccgacagttcaagcggcatcaattcgaactgaaaagggtaatattattagttctaattcaacaactttagaaaaagccatcaataattttataagtaaaggtggttcaattgaagacgctccatacataatgggtgaaaatgatgaatcttggccgttatcagctttaatgacaatgatttacagacaatctacaatacattacgctgcgaaagcagctgctgttgcagactttgcatattggactcagtccaatccaactgctataaatattgccactattcaaggaatgtatgtagcatccaataatcctacactcaaaagtcgcaatttaaatttattgaaaaattttgtagttgatggagaacctattagttctattgcaaactgtatttaccaaggtacaatttgttcggatatgggtacttgtaataataatagttgtttatgtaattcttatcgcaaaggtatttattgtgaaaatattgtttctagttctggagaaagtattggaatcattttggctattgttatacctgtttcatttgtcatttgttgtattattattgtactagtaattgcactcattgtttctatcaggcttcatcaacgcgttgaagacgaatgggaagtagattttcatgaattggatttcatggaatcacttggatccggaggatcaggggaagtgtttaaggcaatgtggaaaggaacagaagttgctgtcaaaaaattagtaaattccaacattactaaagatgcagaaagaaatttcaaacaagaaatccatcgtatgacttcacttcgacatccaaatgttgtgttatttatggcagcttctacgagacctcccaatatgtgtattgtcatggaatttatgtctctaggttctctgtatgatcttcttggtaacgaacttgttactgaaattcctcctgttcttagaattagaattgcttatcaagcagcaaaaggtatgcattttctacattcttccgatattgtccacagagatcttaagtctcttaatttgcttcttgattccaaatggaatgtcaaagttagtgattttggtttaactaaaattaaagacaataataaaggaaaatcttccacaaaagaagattcagtttgttctattcaatggactgctcctgaagtactttcagaaaaacaagatattgattatattttagcagatgtttattcatttggtattattatgtgggaattaatgactcgattaagaccctatattggtttatctccagccgctatagcggttgctgttataagagataatttaagacctgaaattcaagaagaagacattaatctcatgtcttccgattacgtggaattagttaatatttgctggcacaaagacacaatgattcgtccgagttttcttgaaatcatgactaaattgtctactctcattggaggttcaggtattacaactggtacttcaacttcttcatcaaatcaatcaagtgattacataggaccaaatataattactcgaacaaaaaatattcacaataatgacgaaacaaaaaattcattcggctctacaacatatggatctaatacaatttcaagttcttcgaacacggagtctgataaaatcttgtcgaaattaaacaagaaaaaaattccaactggtgaagtaatcattgtttttaccgatattatttcggcagaacaactctggcatcataatccactagcaatgaaaaatgcaacggttctttataatgcagtaataagagaaacgttagataaaattggtggatatgaaagttttatttacaaagatcataatagtggagaaggatctttttgtctagtttttcaagaagcaatagacgctatagatttttgttcaattagtcaaaaaaagttactagaaatagattggcctgaagaattattggatcatccagctgcagcgagtgaaaaagacattaatgggacaatgatttttgctggtcctcgtgttaggatgggattgcatgctggaacagtcaaaattatgcaagatccagttactcgtagatatgaatattctggtgttaccgttaatattgcggctaagattactatgatgacacatggtggtcaagttattatgagtgagcaagttaccgataaaatctccaataatgattgttccaatattaaatcgttaggacaaattgagattactgatactaataactacaaagtaaatatatttgaattaaggattgagggattaataggtagattctttggaggtgttgcattttataattatgattcggtcacagaatcaacagatcttgatgatacttatccagacagtcttaatttctcgacaaatggaatactttatgggggtattaaacaagaaaatgagtatctttcatctgctggattatgtagatggattattaactacgatgatattcaaataggtaaacaaattggagtaggatcttatggaattgttaatatgggtaaatggaaaaatattaatgttgctgttaaaaaatttgtcaaacaaaaaatagatgaaaaacaaatgcttgaatttagagctgaaattgcttttctttcacaattacgtcatcctcatatcatcttaatgattggagcttgtctaaaacgtccaaatatttgcattgtgactgaatttatgggaaacggtagtttgagaaatgtcataaaaacaactaagccagagtggaaactcaaaatcaaaatgttgtatcaaacagctttaggaattggatatttgcataattctgatccaattattattcatcgtgacattaaaccatccaatattctagttgatgatagtatgaatgtgaaaattgctgattttggatttgcacgtatcaaagaggaaaattccgtaatgacacgttgtggaactccttgttggactgctcctgaaattattcgtggagaaaaatatacagagaaagtagatgtattctcttttggaattgttatgtgggaagttctcacttgcaaagaaccattttctggttgtaattttatgaaagtttcaatggacattttagagggagcgcgtcctcaaattccttcggattgtcctattgattttaccaaattaatgaaacaatgttggcatgctaaacctgataaaagacctagtatggaagatgttattatgggtttgaatgatatgcttggaccagaaaaatctttgtaa

SEQ ID NO: 15141 - protein, 1651 aa, Acanthamoeba polyphaga mimivirus
MKSIGIFVVALWLTHFCDGGQLGARIYSSGSESSVLLFDQYINKYAFTNGDVKIIYEGKSIFEILSETYVTDFNIFDRAISQDNLDMFQIVQFPLAGQAIVMTYNLPELVNSSYRLVIDRETLGKIWYGAISKWNDTAIQNLNPTVGHLLPDTDIILGYSDDYIMTISGLIKMALSSFSPEFDTELKYANNTFNGMNPTKNGRGHNIGETSTVRLEWLKKTSYGLTYINYADVYNNGTDSTVPMNMYNKAGYFVEPNLVSVQAAMSDFKIFYANNNSTIDIYDAPGNKSWPLAYVNYLGCSSAFGPMADCTRTIQMTNFIAWIYTNDAASESAIELQFYPLDKTLQKVAIDNLYNIKCNNIAVLSQQYLIGFGAPISVMSLWPNSWTTVASTARYYSAPSSQALELQETYGADFGITVTGVPNTYFNKMPDLGVMPLAAFTIVPAYNIPAINGTNGTLILDYEIITDIYLGIINNWNDSRIRALNGIEINRKLPNVSITVIYQAVSSDYNFMFTDFMSKKSPKFAKKIGSTYFPILTLPNNSMIITTDIYDVGNQLISNSNSFAFWPYFGITMLSRQPTVQAASIRTEKGNIISSNSTTLEKAINNFISKGGSIEDAPYIMGENDESWPLSALMTMIYRQSTIHYAAKAAAVADFAYWTQSNPTAINIATIQGMYVASNNPTLKSRNLNLLKNFVVDGEPISSIANCIYQGTICSDMGTCNNNSCLCNSYRKGIYCENIVSSSGESIGIILAIVIPVSFVICCIIIVLVIALIVSIRLHQRVEDEWEVDFHELDFMESLGSGGSGEVFKAMWKGTEVAVKKLVNSNITKDAERNFKQEIHRMTSLRHPNVVLFMAASTRPPNMCIVMEFMSLGSLYDLLGNELVTEIPPVLRIRIAYQAAKGMHFLHSSDIVHRDLKSLNLLLDSKWNVKVSDFGLTKIKDNNKGKSSTKEDSVCSIQWTAPEVLSEKQDIDYILADVYSFGIIMWELMTRLRPYIGLSPAAIAVAVIRDNLRPEIQEEDINLMSSDYVELVNICWHKDTMIRPSFLEIMTKLSTLIGGSGITTGTSTSSSNQSSDYIGPNIITRTKNIHNNDETKNSFGSTTYGSNTISSSSNTESDKILSKLNKKKIPTGEVIIVFTDIISAEQLWHHNPLAMKNATVLYNAVIRETLDKIGGYESFIYKDHNSGEGSFCLVFQEAIDAIDFCSISQKKLLEIDWPEELLDHPAAASEKDINGTMIFAGPRVRMGLHAGTVKIMQDPVTRRYEYSGVTVNIAAKITMMTHGGQVIMSEQVTDKISNNDCSNIKSLGQIEITDTNNYKVNIFELRIEGLIGRFFGGVAFYNYDSVTESTDLDDTYPDSLNFSTNGILYGGIKQENEYLSSAGLCRWIINYDDIQIGKQIGVGSYGIVNMGKWKNINVAVKKFVKQKIDEKQMLEFRAEIAFLSQLRHPHIILMIGACLKRPNICIVTEFMGNGSLRNVIKTTKPEWKLKIKMLYQTALGIGYLHNSDPIIIHRDIKPSNILVDDSMNVKIADFGFARIKEENSVMTRCGTPCWTAPEIIRGEKYTEKVDVFSFGIVMWEVLTCKEPFSGCNFMKVSMDILEGARPQIPSDCPIDFTKLMKQCWHAKPDKRPSMEDVIMGLNDMLGPEKSL

SEQ ID NO: 15142 - DNA, 4974 bp, Acanthamoeba polyphaga mimivirus
  CDS (1)..(4974)
atgaggttgaatagtcaaatagttttctgcattgttgtggttataagttgtctgagtatgattgaatgcaaaatgggttctaggatttactgttctggatcattgtcatctgttgaattgtttagtcaatacatcagtaattatgctcttcgcaatgatgatgtcacaatcatctacgctggaatgtcagttgatgaaatcaacgctgatgtttatattgccgattgtagcgcttatgatagagccattccgcaaatttatatgatttcgtatggattgattcaatttcccatagtcggacaagctattgtcatcatttataatgttcctggtctgtctagtcacaatatgattattgatagagaaacacttggtagaatttggactggtaacattagaaagtggaatgatattcaaatccaaaatttgaatcctgatattgcttctcaactgcctaacgaaacaattacattgggatacaatgatgcatactatctgtcaatttcagagataatgcagttggctctacgaaattttagcgaagaatttgctaatgcccatactattgcaggaggtaaatttggaaatatgattccggcaaaacaaggatatgcgattgatgctggtgaagcatcagaaagcagaattgattgggttaaaaatactccgttcagtcttagttttgccgattttgcgacagtttatcctcgaaatgtatcctacatgcatatgtacaataaggccggaaaactcgttgaacctaatattacgacagtacaatccgcgatggcagatttcaaggaaatttataccactaatgatttcaccattgatatttttgacgcatcaggagaaaactcttggccaatctcatgggtaaactatatttctatgacttcgacttttcaacaagctgattgtattagaaccaaagaacttttggattttattgcttggttctacatgaacaatgaaatcgctgaaatcattaaggaatatcaatattatcctcttgataacacaattaaaaagattgccattgacaatatgtacaatgtaacttgtaatggaaaagtttcgcaagagcatcagtatttgattgcatttggatcacctctctcgattatggcgtcatggcccaatacatgggcatcatctatgacaactgtaaaatactatgcttctttgtctgatcaagcgattgaattgcaaaaaactttcagtggtgattttggaattactatcaaagattttgacaaaaataagtatttgtcatctacaatggaagatattggagtttcacatttagctgcttttaacattgtacctgcatacaatattcctgaattcattggtcttaatgagacattggtattgaattatgaaactattgttgacatttatttgggacttgtcacaaactggaatgattctagcatccgaaattcaaacaatccgtatattaacagtctattgcctaacaagacaatcactgttgttgtccaaaaagtagaatcggatgttaatgagttgttcacaaattttttgagttgtaaatcagacaaattcaacaatgctattggacctacaaatcttcctgaattcgattttgtttcaaacaatgttgtttatactgaagacgtgtacggagttggaaatacacttgttagtaccgattattcattcgcattttggcctgaacctggaattagattgttgtctcacatggcaattgttcaagctgctagtattcaaacatcgactggaacaatcatcaaaccgactaatgaaactcttagtaaagctgttgataataagattaatagtattaatcgtagagatattgaagatggtagttggccatttattgcgatgatgtcattggtatatcatcaaaaaactatgcaatctttctccaaggcttcagcacttgctgattttatttattggacacaatttgatgatacagcagcgagtatcgctgatactcaaggatattatgtggctagtattcatccaacgattttgagagaaaatctcgaacttcttcaatcatttacttttgaagatcgcacagttagtaaagtcgccaattgtatttttgaaggaacaatttgttacaacaaaggaacttgtaacaataatgtttgtttgtgtaatattgatcgcgaaggacagttttgtgaattggaaaaaacacaatcagacacaaatattgttacaattattttggctgttgtaattccaattgcatttattattgtgtgtattatttgtatccttgttgtagctctaatcttttcacttaggtttagaaaaggaatcagtgatgactgggaaattgatttccacgaattggaacttggagaacaacttggtactggagcttttggtgaagttcataaaggaacctggagaggtactgaagttgctgtcaaaatgatatcgccagataaaaccatcaccaaagatattgaaagaaatttcaaggatgaagtcagagtaatgacaactttgcgacatcctaacgttgttcttttcatggctgcttcaacaaaaccacccaaaatgtgtattgtaatggaattcatggctcttggctcattgcatgatttgttgaaaaacgaactcatcccagatataccttttgctctcaaagtcaaaatcgcatatcaagcatcaaagggtatgcatttcctgcattcatcaggaatcactcatcgtgatctcaagtctttgaatctacttcttgacattaagtggaatgttaaagttagtgattttggattgactaaattcaaatcagatgttaagtccattaatcctgaaaaatttgcaggtactattcaatggacagctcctgaaattcttagtgaagatagagaagtggactacattttgtctgatgtttattcgtttggcattattatgtgggaattgataactcgtgatcaaccctattttggtatgagtccggctgcaattgctgtttcagttattcgagacaattatagaccagttatctcagaccaactcagatcagaagttgctccagaatacattgaactactcacaagttgctggcactttgatccaaccattcgtccaacttttttggaaattatgacaagattgtctaatttgatgggagattctggtatgactggtatgtcatcatcttcatccaatagttctaaatttgattacaatagtttcggaaaagttcaacaattcgcaattaatcgtactgatcctgatggaatagttcaaaattcatacaatagaacagatagttatgatttgggttctaataattctcactcatccataacatccgataccaacaaatctaataaatatttgaggcagacaaatattcaacatcctactggagaagtagtagttgtatttactgatattatttcagctgctcaattgtgggaatttgatgcatccgaaatgaagaacgccacaattttgtataacaaacttgtaagatccatttgtaacgaatgtggtggatatgaaagtcttatttccaaagaaagaaatagtggagaaggatctttttgtttgattttttcagatgtgcaaaatgccattaccttttgtgaagaactacagaaacaactagtcggtgtgaattggtctcctaaacttttggaacatccgattaccgctattgagaaagatattaatggtacaatcatatatgccggacttcgtgtcagaataggattgcattttggatcaacaaagattaattacgatcctataagtcgtaagtatgagtatatcggccctactgtcactacagcagctgctgtaacaactataactcacggtggccaaattataatgacagaagatgttgctaataagctttcaaccgaaaattcaaacaaaccggtatgtttgggacgagtagatattgatggtattccggattctctggtattgtacgaatatgtaatttctgcattgattggtcgctttttcggcggagtgactcgaaaaaatgctagttttgtcagtaatgagacatcaactgattatgacgatatggatactgacaattctacattttcagcaagggttccgcatcaagcttaccaatatcatgcagctattgaaaacaacgagcgctatcttacatccgctggactttgtagttgggtcattaattatgatgagattaagatgggtgaacagatcggattgggatcctatggcgtagtttatcgtggtaaatggaaaaatgtcgatgtggctattaagaaattcatcaagcaaaaaatcgatgaaaatcatcttctgggtattagagaagagatcgcatttttgaagaaactacatcatcccaacatcattacaatggttggtgcttctctaaagaagcccaatatttgtattgttactgaatatatggcaaaaggtaatttgagggatgctatgcgaacttgtacccccaaactagaatggcaccaaaaaatcaaaattctagttaacattgctaaaggaatcagttatcttcacagtttcgatcctccgattattcatcgtgacattaagccatcaaatattctcatcgatgaaaattggaatgtcaaaattgccgattttggatttgctcgcatcaaagaagagaacgccatcatgactcgttgtggtactccttgttggactgctcctgaaattattcgtaatgatatctatgacgaaaaggtcgatgtattttcttttggaattgttatgtgggaagtattgacttgtaaagaaccttttattggagcaaacttcatgaagattaccatggatattttggaagatgtgagacctaaaattcctcaagattgtcccgaagaatttgccaaacttatgagaaaatgctggcatgctaagtcaaccaagagaccgacaatggacgatgttattattgtacttgctaagttttgtcctgatattagtgtgtaa

SEQ ID NO: 15143 - protein, 1657 aa, Acanthamoeba polyphaga mimivirus
MRLNSQIVFCIVVVISCLSMIECKMGSRIYCSGSLSSVELFSQYISNYALRNDDVTIIYAGMSVDEINADVYIADCSAYDRAIPQIYMISYGLIQFPIVGQAIVIIYNVPGLSSHNMIIDRETLGRIWTGNIRKWNDIQIQNLNPDIASQLPNETITLGYNDAYYLSISEIMQLALRNFSEEFANAHTIAGGKFGNMIPAKQGYAIDAGEASESRIDWVKNTPFSLSFADFATVYPRNVSYMHMYNKAGKLVEPNITTVQSAMADFKEIYTTNDFTIDIFDASGENSWPISWVNYISMTSTFQQADCIRTKELLDFIAWFYMNNEIAEIIKEYQYYPLDNTIKKIAIDNMYNVTCNGKVSQEHQYLIAFGSPLSIMASWPNTWASSMTTVKYYASLSDQAIELQKTFSGDFGITIKDFDKNKYLSSTMEDIGVSHLAAFNIVPAYNIPEFIGLNETLVLNYETIVDIYLGLVTNWNDSSIRNSNNPYINSLLPNKTITVVVQKVESDVNELFTNFLSCKSDKFNNAIGPTNLPEFDFVSNNVVYTEDVYGVGNTLVSTDYSFAFWPEPGIRLLSHMAIVQAASIQTSTGTIIKPTNETLSKAVDNKINSINRRDIEDGSWPFIAMMSLVYHQKTMQSFSKASALADFIYWTQFDDTAASIADTQGYYVASIHPTILRENLELLQSFTFEDRTVSKVANCIFEGTICYNKGTCNNNVCLCNIDREGQFCELEKTQSDTNIVTIILAVVIPIAFIIVCIICILVVALIFSLRFRKGISDDWEIDFHELELGEQLGTGAFGEVHKGTWRGTEVAVKMISPDKTITKDIERNFKDEVRVMTTLRHPNVVLFMAASTKPPKMCIVMEFMALGSLHDLLKNELIPDIPFALKVKIAYQASKGMHFLHSSGITHRDLKSLNLLLDIKWNVKVSDFGLTKFKSDVKSINPEKFAGTIQWTAPEILSEDREVDYILSDVYSFGIIMWELITRDQPYFGMSPAAIAVSVIRDNYRPVISDQLRSEVAPEYIELLTSCWHFDPTIRPTFLEIMTRLSNLMGDSGMTGMSSSSSNSSKFDYNSFGKVQQFAINRTDPDGIVQNSYNRTDSYDLGSNNSHSSITSDTNKSNKYLRQTNIQHPTGEVVVVFTDIISAAQLWEFDASEMKNATILYNKLVRSICNECGGYESLISKERNSGEGSFCLIFSDVQNAITFCEELQKQLVGVNWSPKLLEHPITAIEKDINGTIIYAGLRVRIGLHFGSTKINYDPISRKYEYIGPTVTTAAAVTTITHGGQIIMTEDVANKLSTENSNKPVCLGRVDIDGIPDSLVLYEYVISALIGRFFGGVTRKNASFVSNETSTDYDDMDTDNSTFSARVPHQAYQYHAAIENNERYLTSAGLCSWVINYDEIKMGEQIGLGSYGVVYRGKWKNVDVAIKKFIKQKIDENHLLGIREEIAFLKKLHHPNIITMVGASLKKPNICIVTEYMAKGNLRDAMRTCTPKLEWHQKIKILVNIAKGISYLHSFDPPIIHRDIKPSNILIDENWNVKIADFGFARIKEENAIMTRCGTPCWTAPEIIRNDIYDEKVDVFSFGIVMWEVLTCKEPFIGANFMKITMDILEDVRPKIPQDCPEEFAKLMRKCWHAKSTKRPTMDDVIIVLAKFCPDISV

SEQ ID NO: 15144 - DNA, 4875 bp, Acanthamoeba polyphaga mimivirus
  CDS (1)..(4875)
atgcattctgtctacactaaatacaccattattttgatactgttggttatttatcaaggattacctacaaatacgcaagtagcatccagaatttttggcgttggtagtaaatcatccgggcctctttatcgtcaattgattgatatttattcgtatacttacgataatgccgtgttcattttcgaggacttacctattgatgttatattgacccaagtcgattatattgattatgtgggtcttgacagatgtatttctcatgaatatgaagaaatatttaatctggtgcaatttcccctggctggtcaagctattgtgatgacttacaacattcctgaactggcgaatctcgatactagaattgtcattgatagacaaaccttgggaaaaatttggactggtgaaatttccaagtggaatcatccagatattatcgcacttaatcctactcttaacggtactttacctgacaaagaaattaaattaggttacaatgatgatggtaacgtatcaatttctggtattgttcaagctgcattatcaagtttttatggtaattttgcaactgaatttaataatgccggacagttattcgcgaatatgtctttcgcaaatgaatctcgatgtgtaaatattggaccatcttctcgggagcgctttgattgggttaaaaacactacttacagtttgacttttgtaaattatgctgacgttttcaataataccaatcctaatatttccgttatgaacatgtacaataaggccggaaatttggttgaaccttctcttgaaagtgtacaattcgcaatggctgatttcaaagatgaatatagtaacaacaactttgctcttgatgtttttgatgctcccggtaataattcgtggcctctatcttatgtcaattatattgtgatgagcaagagatttttccaattggattgtagtcgagctgatgttgttttaaagtttatcgcatgggtttatactaataccgctgctagtaaggcactaacacaaaaccaattctatccacttgataataccctaaagaaagtatcgattgataacatttacattgtcaagtgtaataatgtttcggtttctgagcaacagtatctaatctcttttggaggttcaacatctattgtaccatcatggttgactgcctttacttcaggttcaattgtggcaaagtattattcaacactatcttcgaattcaatcgaactacttacaacacacggttgtgattttgcggttacgattaatggtgtagatcagaaattttatcaggaaattgaagatttggcagttatgccattggctgcattttcaattgttccagcctataatatccctgaaattgttggaaaaacacttgttctagatatcgatgtcattgtgaaaatttatttgggcgagattaccaattggaacgatacaaagattcgtaatctcaatccagaaatatccaattatctacccaatgcaataatcaatgttgttgttcaaaacattgaatccgatatcaatcaaatttttactaaatttttgagtcaagaaagtgaaattttttctcaagaaatcgggcaaacatataatccggatctatcattgtttaattcaagtgtaatttttgttgatgatattgacggtttgggagatgaacttattgacaataaatactcatttggtttttggactgattttggtgtaagattgttgtccagagttcaaaccgtccaaatggctagtttgaaaatcaatgatgacattattgaacccaattatgacactctcaaaaatgccattagttctgaatctaaccaaattgcacgatctactaattctaatgtctggcctattacatctatgatatctattgtttaccctgaaactactatgaaaaacaaagataaagctgttgctattgcagaatttatgtactggacacaatatgatcctctggctattaatagcgccaataacaagggatactatttggcatcatcagatcctcaattaaggagcgttgttttggatttgttgaaaaattttaagttcgaggatgaaagtgttagtagctatgctaactgtatttatcaaggtagtatttgtagtaattttggtacttgtattgaaagtgcttgtatttgtaattctagtagaactggaacttattgcgaaaagattataactgattcagaaaataatactctaattattattcttgcaacagtcattccaattgcttgtatttttggattactgctactaactctacttatcgttattattttcttgttgaaacatcgtaacacaacaaataatgattgggaaattgatttttctgaactggaaattggtgaaaccctaggaacaggaggttatggagaagtttacaaatccatttggaagggaacagaagttgcagtcaagttgatctccagtaaacatgtttctaaagatatggaacgttctttctttgaagaagttaaaataatgactagtctacgtcatcccaatgtggttttgtttatggctgctagtacaaaatcaccaaatatgtgtattgtgatggagtttatgtctcttggatctctttacgatcttcttggtaacgaacttattccagaaattccttatgctcttaaaattaagatggcttatcaggcttcaaaaggtatgcattttcttcattcatcaggtattgttcatcgagatttgaagtcgcttaatttgcttttggattcaaaatggaatgtcaaggtcagtgattttggtcttactaaagtcaaatctgaacttgacaaaaagaaaaccaatgataacattattggaactattcattggattgctccagagattctaaatgatagtactgaagttgattatattctggcagatgtttattcgttcggaatcattctttgggaattattgacacgtgaacaaccgtacaagggaatgactcctgctgccatagctgtatctgttattcgagatggaatgagaccaccaatttcagatgaggctgttaccgcgcattctattgaatacattgatcttatcaaacagtgttggcattctgatactattattagacctacattccttgaaattatgacaagattgtctaatattcttggagattctagtaatatgacgtctggaacaagttcatccagtctatcaagtggtggaattggaaaatctatcacggatagtaagtcaagtaatagtaggtccagtgttgaatcatctaatacaagcaatacattcagaggaatagatagacataattcgcatcctactggagaagttacggttgcatttattgatattatttctgccagtaaactatgggaatacgatcctgatggtatgtgtgaatcaaccaaaatgtataacgagattatacgccgagtaaccaagaaatatggtggttatgaaagtttcatttccaaagacagaaacagtggtgaaggatcattctgtctggtattttcggacgctattcaagccattaactcttgtgaagagatgcaacttcaactactcaatgctaactggcccaaaaagattctgcaacatccggcagcagcagaagaatttgatagaactgatcaactcatattccgtggactcagggttcgaatggctcttcattgtggatctgtaaagatttctcaagatccaatgacccgaaaatatcaatattcaggatcaactgtcaatattacaggaaaaattactaccctaacacatggtggacaaattattgtttctgaaaatctttatcaaaaagtaaataatgatttcacatttattacggtaggaaagatcgatattcctgattatccaagcaaaatgaccctttatgaaatcaagttcgagattctcaaaaatagattctttggaggtatcacatatgttaattataatgatgatactgattcaggaacagctgatgattcaaattatgattctggaaagattatcgatattgattacatggctgatatcgataaagaagattcattcttgacttcagctaatatgtgtagatggatcattaattacgatgaaatcagtattggaaaacaaattggtctcggatcttatggaattgttttcaacggtaaatggaaaggagttgatgttgcagtcaagaaatttgtcaaacaaaaactttctgaaactcaactccttgaattcagggcagagatggcatttttgtctgaattgaaacattctaatattgttacctttatcggagcttgtatcaagaaaccaaacatttgcattgtgactgaatatatgagaatgggtaatttgagagatgttttgaaaaatcctgacattaaaattacttttgccaacaaattaaaattgctttatggagcggctatgggtattgattatcttcattcatcaaacccaatgattgttcatcgagacattaagccagcaaacattcttgttgatgaacatttcaatgtcaaaattgccgattttggatttgctcgtatcaaagaagacaataccacaatgactcgttgtggtactccttgttggactgctcctgaagttattcgtggagaaaaatattgtgaaaaggctgatgtattttcctttggtgtagttatgtgggaagttttgactggtaaagaaccttttgctgaatgtaattttatgaaggtttcattggatattttggaaggaggtcgtcctataattccatccgattgtccacatgaatttgctaaactcatcaagaaatgttggcatgctaaagcacacaaaagacctactatgacggaagtagttcaacaactaatgttgattaccgaacagtttgatcataaagtttaa

SEQ ID NO: 15145 - protein, 1624 aa, Acanthamoeba polyphaga mimivirus
MHSVYTKYTIILILLVIYQGLPTNTQVASRIFGVGSKSSGPLYRQLIDIYSYTYDNAVFIFEDLPIDVILTQVDYIDYVGLDRCISHEYEEIFNLVQFPLAGQAIVMTYNIPELANLDTRIVIDRQTLGKIWTGEISKWNHPDIIALNPTLNGTLPDKEIKLGYNDDGNVSISGIVQAALSSFYGNFATEFNNAGQLFANMSFANESRCVNIGPSSRERFDWVKNTTYSLTFVNYADVFNNTNPNISVMNMYNKAGNLVEPSLESVQFAMADFKDEYSNNNFALDVFDAPGNNSWPLSYVNYIVMSKRFFQLDCSRADVVLKFIAWVYTNTAASKALTQNQFYPLDNTLKKVSIDNIYIVKCNNVSVSEQQYLISFGGSTSIVPSWLTAFTSGSIVAKYYSTLSSNSIELLTTHGCDFAVTINGVDQKFYQEIEDLAVMPLAAFSIVPAYNIPEIVGKTLVLDIDVIVKIYLGEITNWNDTKIRNLNPEISNYLPNAIINVVVQNIESDINQIFTKFLSQESEIFSQEIGQTYNPDLSLFNSSVIFVDDIDGLGDELIDNKYSFGFWTDFGVRLLSRVQTVQMASLKINDDIIEPNYDTLKNAISSESNQIARSTNSNVWPITSMISIVYPETTMKNKDKAVAIAEFMYWTQYDPLAINSANNKGYYLASSDPQLRSVVLDLLKNFKFEDESVSSYANCIYQGSICSNFGTCIESACICNSSRTGTYCEKIITDSENNTLIIILATVIPIACIFGLLLLTLLIVIIFLLKHRNTTNNDWEIDFSELEIGETLGTGGYGEVYKSIWKGTEVAVKLISSKHVSKDMERSFFEEVKIMTSLRHPNVVLFMAASTKSPNMCIVMEFMSLGSLYDLLGNELIPEIPYALKIKMAYQASKGMHFLHSSGIVHRDLKSLNLLLDSKWNVKVSDFGLTKVKSELDKKKTNDNIIGTIHWIAPEILNDSTEVDYILADVYSFGIILWELLTREQPYKGMTPAAIAVSVIRDGMRPPISDEAVTAHSIEYIDLIKQCWHSDTIIRPTFLEIMTRLSNILGDSSNMTSGTSSSSLSSGGIGKSITDSKSSNSRSSVESSNTSNTFRGIDRHNSHPTGEVTVAFIDIISASKLWEYDPDGMCESTKMYNEIIRRVTKKYGGYESFISKDRNSGEGSFCLVFSDAIQAINSCEEMQLQLLNANWPKKILQHPAAAEEFDRTDQLIFRGLRVRMALHCGSVKISQDPMTRKYQYSGSTVNITGKITTLTHGGQIIVSENLYQKVNNDFTFITVGKIDIPDYPSKMTLYEIKFEILKNRFFGGITYVNYNDDTDSGTADDSNYDSGKIIDIDYMADIDKEDSFLTSANMCRWIINYDEISIGKQIGLGSYGIVFNGKWKGVDVAVKKFVKQKLSETQLLEFRAEMAFLSELKHSNIVTFIGACIKKPNICIVTEYMRMGNLRDVLKNPDIKITFANKLKLLYGAAMGIDYLHSSNPMIVHRDIKPANILVDEHFNVKIADFGFARIKEDNTTMTRCGTPCWTAPEVIRGEKYCEKADVFSFGVVMWEVLTGKEPFAECNFMKVSLDILEGGRPIIPSDCPHEFAKLIKKCWHAKAHKRPTMTEVVQQLMLITEQFDHKV

SEQ ID NO: 15146 - DNA, 891 bp, Geobacillus kaustophilus HTA426
  CDS (1)..(891): transl_table=11
atgtggagcaaacgagtcaaattgggattggccgccttgttgatgaccggcgttttggccggctgcgggcagactgaaaagaacaacgcgggcggcaatgaaggaacggcaaagaaagaagaaacctactccggcaccattgcactagcgggatctacagcgcttcagccgctggcagaggaagcggcaaacgcgtttatggaaaagtatccggacgtatcgatcaccgttcaaggcggcggcagcggtacgggcgtcaaccaagtggcagccggcgccgtgcaaatcggcaactcggatgtgccggcggcggagaagctggacgacaaatcgaaagcgtcagagcttgttgaccataaagtggccggcatcgcctttgcgattgtggtcaacgacgatgtgaaggtcgataatttaacgacgaagcaaattcaagatattttcagcggaaagattaaaaactggaaagaagtcggcggaccagatgaagccattcacgtgatcaaccgtccggcgtcatcgggtacgcgggcgacatttgagaaaacgatcatgaaaggcgtaaaaatcgatgattccatcggtacggtgcaagattcgaacggagcggtcgaacaggcgatcagctcgacgccgggcgctgtcagctatgtagccatgtcgtatttaattggggaaaagaaaaacttgaaaacggtcaaaattgacggcgcggaaccgacggtggaaaacatccgcacggaaaagtacccgttttggtcgtatgaatacatgattaccaaaggggaagcgaaggaagaagtgcgagcgtttatcgactttgtcaagagcgaagaatttgcgccgaccgttaaaaagatggggtatatcccgatgacggaattggagtag

SEQ ID NO: 15147 - protein, 296 aa, Geobacillus kaustophilus HTA426
MWSKRVKLGLAALLMTGVLAGCGQTEKNNAGGNEGTAKKEETYSGTIALAGSTALQPLAEEAANAFMEKYPDVSITVQGGGSGTGVNQVAAGAVQIGNSDVPAAEKLDDKSKASELVDHKVAGIAFAIVVNDDVKVDNLTTKQIQDIFSGKIKNWKEVGGPDEAIHVINRPASSGTRATFEKTIMKGVKIDDSIGTVQDSNGAVEQAISSTPGAVSYVAMSYLIGEKKNLKTVKIDGAEPTVENIRTEKYPFWSYEYMITKGEAKEEVRAFIDFVKSEEFAPTVKKMGYIPMTELE

SEQ ID NO: 15148 - DNA, 1041 bp, Salmonella enterica subsp. enterica serovar Paratyphi A str. ATCC
  CDS (1)..(1041): transl_table=11
atgaaagttatgcgtaccactgtcgcaactgttgtcgccgcgaccttatcgatgagcgcgttctctgcctttgcagcagcaagcctgacaggtgccggtgcaacgtttcctgcgccggtgtatgccaaatgggcggatacctaccagaaagaaaccggtaacaaagtcaattaccaggggataggctcttccggcggcgtgaaacaaattaccgcgaataccgttgattttggcgcttccgatgcgccgctgtctgacgaaaaactgaatcaggaaggcctattccagtttccgacggtgatcggcggcgtggtgctggcggtgaatattccaggcctcaaatccggcgaactggtgctggatggtaaaacgctgggtgacatctacctcggtaaaatcaagaagtgggatgatgaagccatcaccaaactgaacccaggcgtgaagctgccctcacagaatatcgctgtggtgcgtcgcgctgacggttccggtacctccttcgtgttcaccagttacctggcgaaagtcaacgacgagtggaaatcgaaagtgggcgcgggttctaccgtgaactggccaaccggtctgggcggtaaaggtaacgacggcatcgcggcatttgtacagcgtctgccaggcgctatcggctacgttgaatacgcttacgctaagcagaacaacctggcctacaccaaactggtttccgccgacggcaaaccggtaagcccgacggaagagagcttctctaatgcggcgaaaggcgcagactggagcaaaaccttcgcgcaggatctgaccaaccagaaaggtgacgatgtgtggccaatcacctccaccacgtttatcctggtccacaaagcgcagaagaaacctgagcagggtgctgaagtgttgaagttcttcgactgggcctacaaaaatggcgctaagcaggcgaatgatctggactacgccagcctgccggataacgttgttgagcaggttcgtaccgcctggaagaccagtataaaagacagcaacggtaaggcgctgtattaa

SEQ ID NO: 15149 - protein, 346 aa, Salmonella enterica subsp. enterica serovar Paratyphi A str. ATCC
MKVMRTTVATVVAATLSMSAFSAFAAASLTGAGATFPAPVYAKWADTYQKETGNKVNYQGIGSSGGVKQITANTVDFGASDAPLSDEKLNQEGLFQFPTVIGGVVLAVNIPGLKSGELVLDGKTLGDIYLGKIKKWDDEAITKLNPGVKLPSQNIAVVRRADGSGTSFVFTSYLAKVNDEWKSKVGAGSTVNWPTGLGGKGNDGIAAFVQRLPGAIGYVEYAYAKQNNLAYTKLVSADGKPVSPTEESFSNAAKGADWSKTFAQDLTNQKGDDVWPITSTTFILVHKAQKKPEQGAEVLKFFDWAYKNGAKQANDLDYASLPDNVVEQVRTAWKTSIKDSNGKALY

SEQ ID NO: 15150 - DNA, 1041 bp, Zymomonas mobilis subsp. mobilis ZM4
  CDS (1)..(1041): transl_table=11
atggttaagaaaatagctgcccttgttggtttcgtcagcctttttggcagcacggcctatgcaacgactatttccggtgcaggcgcaacatttccagcacctgtttatggaaaatgggccaattcctatcgcaaccagacgggtgctgttatcaattatcagcctattggttccggtggcggtattaagcaaattaaagcctctaccgttgatttcggagcgtctgacaagcctttgaaaaccgaagagctttcaaaagatggtctttatcagttcccgaccgtgatgggaggcattgtgcctatcattaacttgccgggtttgcggtcaggtcgcttgcatttaacaggcagcattcttgccgatatttatcttggtaaaattacccgttggaatgacccgcggatcgcgtctatcaacccgtggttaaaattaccgccagtaccgattacggtggtgcatcgcgcggatggttccggcacgtccttccagtttacgtcttatctgtcgctgaaaagtcctgaatggacctcccgcgtcggtgccagcgatgccgtgcaatggccgattggtcttggtggtaaaggcaatgatggggtagccgcctttgttaaacagacaatcggttcaatcggctatgtcgaatatgcctatacccgtcaaagcacggtgccttatgctttgattgccaatcgtgacggtcgcttcccgcatccttccactgaaagtttcaaagccgcctcggcttctgcggattggacgcatgcagctgggaataatatttcccttctggatcagaagggcgctgaaagctggccaatcgtttcaacgacctatattcttttacatcgcacccccagcaaacctgaaaccacggctgaaatcctaaaattctttgattggggatatcagaatggcgatcaggatgctttatctcttgactatgcgccattaccgaaagaagtgaagacgttcatccgccagcaatggggatcgaacattcaagttaacgggaaagccgtctataacgctgcccgctag

SEQ ID NO: 15151 - protein, 346 aa, Zymomonas mobilis subsp. mobilis ZM4
MVKKIAALVGFVSLFGSTAYATTISGAGATFPAPVYGKWANSYRNQTGAVINYQPIGSGGGIKQIKASTVDFGASDKPLKTEELSKDGLYQFPTVMGGIVPIINLPGLRSGRLHLTGSILADIYLGKITRWNDPRIASINPWLKLPPVPITVVHRADGSGTSFQFTSYLSLKSPEWTSRVGASDAVQWPIGLGGKGNDGVAAFVKQTIGSIGYVEYAYTRQSTVPYALIANRDGRFPHPSTESFKAASASADWTHAAGNNISLLDQKGAESWPIVSTTYILLHRTPSKPETTAEILKFFDWGYQNGDQDALSLDYAPLPKEVKTFIRQQWGSNIQVNGKAVYNAAR

SEQ ID NO: 15152 - DNA, 921 bp, Bacillus clausii KSM-K16
  CDS (1)..(921): transl_table=11
atgaaaaaagtccaattaggagcagtatttgcgtcgtttttgtttgttgccaccgcttgcggaggcggaaacgcaaatgagccagcagagacagattcggcagaaggcaataatactgaagaaaacgaagcgtcaggcagcatcttagtgtcaggctcaagtgcaatggagccactaattgcagccgcaagtgaagagtttatgaatgaaaatatcgatgcaagcatttcagtgcaagcaggtgggtctggccaagggctgtcatctgttgcaagcggacaagtccaaattggaaactccgatgtgtttgctgaagaaaaagaagatattcccgctgaagaacttgtcgaccaccgtattgccgttgtaggcatggggccggcaacgcatcctgaagtaggcgttgaagatatttcgactgaagatttaattgctgtatttacaggggaagtaaccaattggagcgaacttggtggcgctgaccaagaaatcgtgattgtgaaccgcccagattcttctgggacgagggatacatttgtgaaatatggccttgaagacaacgagcctgttccaggagacattacggaggactcttccaatgccgtgatgaaaatcattagtgaaacacctggggccatcggttatctcgctttctcttattatgacgaacaaggaacggttttgccgctttccgtagatggcgttgaacaaacagatgaaaacgtcatttcaggtgaatacccaatttgggcgtatatgcattcttacacgaaaggcgaacctgaaggcttaacggcacagttcattgagtatttgcaaggtgattttgtacaaggcacgttgatcccagaaatgggctacattcctgaagcggacatgcaagttgaacgagatgcggaaggaaacgatacaccaaaataa

SEQ ID NO: 15153 - protein, 306 aa, Bacillus clausii KSM-K16
MKKVQLGAVFASFLFVATACGGGNANEPAETDSAEGNNTEENEASGSILVSGSSAMEPLIAAASEEFMNENIDASISVQAGGSGQGLSSVASGQVQIGNSDVFAEEKEDIPAEELVDHRIAVVGMGPATHPEVGVEDISTEDLIAVFTGEVTNWSELGGADQEIVIVNRPDSSGTRDTFVKYGLEDNEPVPGDITEDSSNAVMKIISETPGAIGYLAFSYYDEQGTVLPLSVDGVEQTDENVISGEYPIWAYMHSYTKGEPEGLTAQFIEYLQGDFVQGTLIPEMGYIPEADMQVERDAEGNDTPK

SEQ ID NO: 15154 - DNA, 1152 bp, Thermococcus kodakarensis KOD1
  CDS (1)..(1152): transl_table=11
atgaagaaagccatctcggtgtttatcgtcctgctgctggggctttccctggtggcaagcggctgcatatctagtgaaaagagccctagcacaagcccgtccagcacggcacgggcttcaagccagggcacttcccagaccaaggtaataaccatccgcaccacaggtgcaaccttcccccagtaccagatacagaagtggattgagatatacatgaagagccaccccaacgtcaagatcgagtacgaaggtggaggaagcggacacgggcaggaggcgttcctcaagggcctcacccacataggcaggacagatccacccgttaaggagtcaacctggaagaagttcctcgcaactggcgaccagcccctccagttccccgaaatcgttggtgcggttgtcgttgccttcaacgttccaggcgttgacgagctgaagctcgacggggagaccctcgccaagatattcatgggtgagatagagtactgggacgacgatgccatcaaggccttcaaccccagcgcgaacctcccgcacgaaaagataatagtcgtccacaggagtgattcaagcggaactactgcaatcttcaccacctacctgagtctcgtcaacaaggagtgggcagataaggttggagcgggaaagaccgttgactggcccgttgacaaggttggaaggggcattggtggaaagggcaaccctggagtcgtccaggcccttaagaacaccaagtacagcatagcctacaccgagctctccttcgccatagaggagaacctcaaggttgtggcactcaaaaacaaagccggaaacttcgttaagcccactgacgatgcgataaaagccgccgtcgccggtgttaaagctttcataccaagcccaaccgagggctacaaggaggacctcaaccagctcctcaacgccccgggagagaactcctacccgatagttgccttcacccacctcctcgtatggcagaacaagggtggaaagcactacagcaaggaagaggtccaggccatcaaggagttccttaggtgggtcttaacagagggacagaagccagagaaccttgcccccggctacgtcggtcttccaccagaggtcgccaagataggcctccaggcagttgacatgatagagggctga

SEQ ID NO: 15155 - protein, 383 aa, Thermococcus kodakarensis KOD1
MKKAISVFIVLLLGLSLVASGCISSEKSPSTSPSSTARASSQGTSQTKVITIRTTGATFPQYQIQKWIEIYMKSHPNVKIEYEGGGSGHGQEAFLKGLTHIGRTDPPVKESTWKKFLATGDQPLQFPEIVGAVVVAFNVPGVDELKLDGETLAKIFMGEIEYWDDDAIKAFNPSANLPHEKIIVVHRSDSSGTTAIFTTYLSLVNKEWADKVGAGKTVDWPVDKVGRGIGGKGNPGVVQALKNTKYSIAYTELSFAIEENLKVVALKNKAGNFVKPTDDAIKAAVAGVKAFIPSPTEGYKEDLNQLLNAPGENSYPIVAFTHLLVWQNKGGKHYSKEEVQAIKEFLRWVLTEGQKPENLAPGYVGLPPEVAKIGLQAVDMIEG

SEQ ID NO: 15156 - DNA, 984 bp, Staphylococcus aureus subsp. aureus COL
  CDS (1)..(984): transl_table=11
atgaaaaaatggcaatttgttggtactacagctttaggtgcaacactattattaggtgcttgtggtggcggtaatggtggcagtggtaatagtgatttaaaaggggaagctaaaggtgatggctcatcaacagtagcaccaattgtggagaaattaaatgaaaaatgggctcaagatcactcggatgctaaaatctcagcaggacaagctggtacaggtgctggtttccaaaaattcattgcaggagatatcgacttcgctgatgcttctagaccaattaaagatgaagagaagcaaaaattacaagataagaatatcaaatacaaagaattcaaaattgcgcaagatggtgtaacggttgctgtaaataaagaaaatgattttgtagatgaattagacaaacagcaattaaaagcaatttattctggaaaagctaaaacatggaaagatgttaatagtaaatggccagataaaaaaataaatgctgtatcaccaaactcaagtcatggtacttatgacttctttgaaaatgaagtaatgaataaagaagatattaaagcagaaaaaaatgctgatacaaatgctatcgtttcttctgtaacgaaaaacaaagagggaatcggatactttggatataacttctacgtacaaaataaagataaattaaaagaagttaaaatcaaagatgaaaatggtaaagcaacagagcctacgaaaaaaacaattcaagataactcttatgcattaagtagaccattattcatttatgtaaatgaaaaagcattgaaagataataaagtaatgtcagaatttatcaaattcgtcttagaagataaaggtaaagcagctgaagaagctggatatgtagcagcaccagagaaaacatacaaatcacaattagatgatttaaaagcatttattgataaaaatcaaaaatcagacgacaagaaatctgatgataaaaagtctgaagacaaaaaataa

SEQ ID NO: 15157 - protein, 327 aa, Staphylococcus aureus subsp. aureus COL
MKKWQFVGTTALGATLLLGACGGGNGGSGNSDLKGEAKGDGSSTVAPIVEKLNEKWAQDHSDAKISAGQAGTGAGFQKFIAGDIDFADASRPIKDEEKQKLQDKNIKYKEFKIAQDGVTVAVNKENDFVDELDKQQLKAIYSGKAKTWKDVNSKWPDKKINAVSPNSSHGTYDFFENEVMNKEDIKAEKNADTNAIVSSVTKNKEGIGYFGYNFYVQNKDKLKEVKIKDENGKATEPTKKTIQDNSYALSRPLFIYVNEKALKDNKVMSEFIKFVLEDKGKAAEEAGYVAAPEKTYKSQLDDLKAFIDKNQKSDDKKSDDKKSEDKK

SEQ ID NO: 15158 - DNA, 978 bp, Staphylococcus epidermidis RP62A
  CDS (1)..(978): transl_table=11
atgaaaaagtggcaattagtcggtactactgtattaggagcttcggttttacttggcgcttgtggcggaaatgatggaggttcaggagacggcaaagatcttaaaggttctgctaaaggtgaaggatcgtctacagtagctcctatcgttgaaaaattaaacgaaaaatgggctaaagatcataaagacgctaaaatttcttcaggtcaagctggtacaggtgctggtttccaaaaatttattgctggcgaaactgatttctcagacgcttcaagacctattaaagacgaagaaaagaaaaaattagaagataaagggattaaatatcacgaattcaaaattgcacaagatggtgtaacaattgcagttaataaagataacgactttgttaaagaattaactaaatcacaattaaaagatatttactctggaaaagctaaaacatggaaagacgttaactctagttggccagataaaaaaatcaatgctgtttcacctaactcaagtcatggtacttacgacttctttgaagaagaagttatggataaacaagatatcaaagctgagaagaatgctgatactaacgcgattgtatcttcagtaactaaaaacaaagaaggtatcggttacttcggttataatttctacgaacaaaataaagataaattaaaagaagtaaaaatcaaagatgacaatggcaaagttacagaaccaactaagaaaacaattcaaaacggttcatacgcactaagcagaccattatttatctatgctaaagacaaatcattaaaagacaataaagtaatgtcagaattcatgaaatttgtacttgaagatgaaggtcaagcagctgaagacgctggttatgtagcttcacctaagaaaacttataaatctcaattagatgacttaaaagattttttagataaacatcaaaagtctgataagaaagacgacaaaacatcagaagataaataa

SEQ ID NO: 15159 - protein, 325 aa, Staphylococcus epidermidis RP62A
MKKWQLVGTTVLGASVLLGACGGNDGGSGDGKDLKGSAKGEGSSTVAPIVEKLNEKWAKDHKDAKISSGQAGTGAGFQKFIAGETDFSDASRPIKDEEKKKLEDKGIKYHEFKIAQDGVTIAVNKDNDFVKELTKSQLKDIYSGKAKTWKDVNSSWPDKKINAVSPNSSHGTYDFFEEEVMDKQDIKAEKNADTNAIVSSVTKNKEGIGYFGYNFYEQNKDKLKEVKIKDDNGKVTEPTKKTIQNGSYALSRPLFIYAKDKSLKDNKVMSEFMKFVLEDEGQAAEDAGYVASPKKTYKSQLDDLKDFLDKHQKSDKKDDKTSEDK

SEQ ID NO: 15160 - DNA, 990 bp, Gluconobacter oxydans 621H
  CDS (1)..(990): transl_table=11
atgtttcatcgtgtggggtttatcgcgcgcggccttgcggtcgctcttgttgtcatggtcttcgggacggcgcattccgccactctcacagggggcggatcgagcttcgccgcgcccctttaccgagcctggagcgctgaactccaccgccagaccggcttttccctgacataccgcagcgtcggttccggcgagggacagaggctcatcatggcgggagccgtggatttcggggcgtcggatctcccgctttcgggggacgttctggatgaacgggggctttaccagttcccgacggcgatcggcgcgatcgtggtggtcatcaatgttcccggcatcgcgtccaaccagatgaagctggacggaccaacgcttgccgccctgtttgacggcaggatcacgtcatgggccgatccgcgcatccgtgcgctcaatcccggcctgcgcctgccggatctggatgtgctgcccatccatcgtgaggaggcctcgggcaccagtcaggtcttcagcgactatcttcatgccgtcgcccccgactggaaagccgggatgtggggtgatggctcggaagcgcggggcaatgacggggttgcggccagcgtgcggcagtccatcggcgggatcggctttgtggaatacgccttcgcgcgtcgggacaggctgaataccgttcggctgaaaaaccatgccgggcagttcgtcgcccccggcaaagcggctttcacaggtgcggccagcagcgcggactggctccatgcggaccattatgccgtcaatcttctggccgcaccgggggctcaggcctggccgatcatgagcgcgaccttcgccctcgttcccgtccatccggcggccccagcaacgcgcgccgccgtaaaagcatttttcagatacggcctgaaacagagcgatgatgccacgcgggatctggattacgtgccgttaccgacgcccgtaaaagaaaggattctggccagctggccctga

SEQ ID NO: 15161 - protein, 329 aa, Gluconobacter oxydans 621H
MFHRVGFIARGLAVALVVMVFGTAHSATLTGGGSSFAAPLYRAWSAELHRQTGFSLTYRSVGSGEGQRLIMAGAVDFGASDLPLSGDVLDERGLYQFPTAIGAIVVVINVPGIASNQMKLDGPTLAALFDGRITSWADPRIRALNPGLRLPDLDVLPIHREEASGTSQVFSDYLHAVAPDWKAGMWGDGSEARGNDGVAASVRQSIGGIGFVEYAFARRDRLNTVRLKNHAGQFVAPGKAAFTGAASSADWLHADHYAVNLLAAPGAQAWPIMSATFALVPVHPAAPATRAAVKAFFRYGLKQSDDATRDLDYVPLPTPVKERILASWP

SEQ ID NO: 15162 - DNA, 1029 bp, Gluconobacter oxydans 621H
  CDS (1)..(1029): transl_table=11
atgatcaagagcagagctccgctattcggtcttctcgtcgccacggcccttggcacggctgccatgaccccgttcgtgtcgtcggcgcaggctgcggacatcacgggcgcagggtccagcttcgccgcaccgatctatggtgcgtggggcacggcggccaagagccaggccggtatcgccgtgaactaccagagcgtgggctccagcgccggtcaggatcaggtcattgcccgcacggttgactttggtgcctccgacaagccgatgagcggtgatcgtctggccaaggaaaagctgtaccagttcccaaccgtcatgagcggtatcgtggtcgtggcgaacgtgccgggtattgctccgggccagctccgtctcgatggcccgacgctggccggtctgtatgacggcgagatcacgacctgggatgacgaccgcatcaaggccctgaacccgggtctgaagctgccggatacggatgtcgcgccgatccaccgtgcggatggttcgggcacgagctacgtcttcacgtcctatctgtcgcaggtttccccgacctggaagcagaagcttggtgccggcacgtccatcgcctggccgggtggttcgggtgcacgtggcaatgacggcattgccgccatggtgcgtcagacggaaggtggcgtgggttacgtcgagtattcctatgccgcgcagaaccacctgaacatcgcccagatgaagaaccacagcggtgccttcgttgccccgacgctggccagcttcgcggaagccgccaaggctgctgactgggcccatgccgatcactatgcggtgaacctgctggacacggatggcgcatcgtcctggccgatcgtgacggcaacgttcgttctggtgccggttgatgccgcccagaaggagtccggcaaggctgtgcgcaacttctttacgtggggttttcagcatggtgacgcggacaatgcccgcctcgactatgtcggtctgccgcagaacgtgaagacggacattctggccaactggccgaagtaa

SEQ ID NO: 15163 - protein, 342 aa, Gluconobacter oxydans 621H
MIKSRAPLFGLLVATALGTAAMTPFVSSAQAADITGAGSSFAAPIYGAWGTAAKSQAGIAVNYQSVGSSAGQDQVIARTVDFGASDKPMSGDRLAKEKLYQFPTVMSGIVVVANVPGIAPGQLRLDGPTLAGLYDGEITTWDDDRIKALNPGLKLPDTDVAPIHRADGSGTSYVFTSYLSQVSPTWKQKLGAGTSIAWPGGSGARGNDGIAAMVRQTEGGVGYVEYSYAAQNHLNIAQMKNHSGAFVAPTLASFAEAAKAADWAHADHYAVNLLDTDGASSWPIVTATFVLVPVDAAQKESGKAVRNFFTWGFQHGDADNARLDYVGLPQNVKTDILANWPK

SEQ ID NO: 15164 - DNA, 1119 bp, Xanthomonas oryzae pv. oryzae KACC10331
  CDS (1)..(1119): transl_table=11
atggctttgtcatttctcagacaccgcatggtcatgtcgttacactgcaatggcaccactgcgggacgttcttcatcccttcactccaggagctgttccgtgatccactccttcaagacccgtctggccgttggcgtactcgccgcttcgctggctctgtgcgcccaggctgccgatgtcaccggcgctggcgcgtcgtttatttacccggtgatgtccaagtggtcggccgactacaacgctgccaccaagaagcaggtcaactatcaatcgatcggttcaggcggcggtattgcccagatcaaggcggccagcgtggacttcggctcgtccgatgccccgctcaagccggaagaactggccgcagccggcctggcgcagtttccctcggtgatcggcggcgtggtgccggtggtcaacgtgccgggcgtggccgccggtgcgctcaagctggacggcaagaccctgggcgacatcttcctgggcaaggtcagcacctggaacgatccggccatcgccgcgctcaatccaggcgtgaagctgccggaaggcaagatcaccgtggtgcatcgctccgacggctcgggcaccagcttcaacttcaccaactacctgtccaaggtcaatccggactggaagagcaaggtgggcgaaggcactgccgtgcagtggccgaccggtatcggcggcaagggcaacgagggcgtcgctgcctacgtgaagcagatcaagggcggcatcggctacgtcgagctgtcgtacgcgctgcagaacaagatggcctacaccgcgatgaagaatgctgccggcaagttcgtgcagccgtccgatgaaaccttcgccgccgctgccaacagcgccgattggggcagcagcaaggacttctatctggtgatgaccaatgcggcgggcgacaacgcctggccgatcacggcgaccaattttatcttggtgcagaagaagccgaagaacccgaccggcctgaaaaacacgctggacttcttccgctgggtctatagcaagggcgacgcccaggccaagcagctggactacgtaccgctgccggacgcgctggtgacccagatcgaggcctactgggccacgaatctgcccaaataa

SEQ ID NO: 15165 - protein, 372 aa, Xanthomonas oryzae pv. oryzae KACC10331
MALSFLRHRMVMSLHCNGTTAGRSSSLHSRSCSVIHSFKTRLAVGVLAASLALCAQAADVTGAGASFIYPVMSKWSADYNAATKKQVNYQSIGSGGGIAQIKAASVDFGSSDAPLKPEELAAAGLAQFPSVIGGVVPVVNVPGVAAGALKLDGKTLGDIFLGKVSTWNDPAIAALNPGVKLPEGKITVVHRSDGSGTSFNFTNYLSKVNPDWKSKVGEGTAVQWPTGIGGKGNEGVAAYVKQIKGGIGYVELSYALQNKMAYTAMKNAAGKFVQPSDETFAAAANSADWGSSKDFYLVMTNAAGDNAWPITATNFILVQKKPKNPTGLKNTLDFFRWVYSKGDAQAKQLDYVPLPDALVTQIEAYWATNLPK

SEQ ID NO: 15166 - DNA, 1137 bp, Xanthomonas oryzae pv. oryzae KACC10331
  CDS (1)..(1137): transl_table=11
gtgggatctgccggataccccggccaatccagcctcggagcctccatgaaactgcagtcggccagcctgaccgccctgtcccttaccatcgccatcgcccttgccgcgtgttcgcccggcaaggacgcacaatccggcgacgccgcaaagggcgcgccgaccgcaggcgctaccgccagcgacaccaagggtgctgaaatctccggcgccggcgcttccttcatctacccgctggtgtccaagtggtcggccgactacaacgccgccaccggcaacaaggtcaattaccagtcgatcggctccggcggcggcattgcgcagatcaaggccggcaccgtggatttcggctcgaccgacaagccgctggacagcgccgaactgcagcaggcaggcctgggccagttcccgtccgccatcggcggcgtggtgccggtggtcaatctggacggcatcgcaccgggcaagctgcgcctgaccggcgccctgctgggcgacatcttcctgggcaaggtcacgatgtggaacgacgcggccattgtcgcggccaacccgggcgtgaccctgccggccaccaagatcaatctggtgcatcgttcggacggttcgggcaccaccttcaacttctccaactacctgtccaaggtcagcccggagtggaagagcaaggtcggcgaaggtacctcggtgcagtggccgggcggcgtgggtggcaagggcaacgaaggcgttgcctcgtatgtgcagcagatcaagggctcgatcggttacgtcgagctggcctacgccctgcagaacaagatgccgtacacctcgctgcagaacgcagccggccagtggatcgagccgaacgcggaaagctttgccgccgccgctgccagcgccgactgggccaacgccaaggacttcaatctggtgattaccaatgctccgggcgaaaaggcgtggccgatcaccgccaccaacttcatgctgatgcacaagcagcccaaggacgcggcgcgcagcaaggcgacgctggacttcttcaagtgggcgttggaaaacggccaggcccaggccagcgaactgcattacgtgccgctgccgccggagctggtgaagcagatcgaagcctattggggcagcgagttcaagtaa

SEQ ID NO: 15167 - protein, 378 aa, Xanthomonas oryzae pv. oryzae KACC10331
MGSAGYPGQSSLGASMKLQSASLTALSLTIAIALAACSPGKDAQSGDAAKGAPTAGATASDTKGAEISGAGASFIYPLVSKWSADYNAATGNKVNYQSIGSGGGIAQIKAGTVDFGSTDKPLDSAELQQAGLGQFPSAIGGVVPVVNLDGIAPGKLRLTGALLGDIFLGKVTMWNDAAIVAANPGVTLPATKINLVHRSDGSGTTFNFSNYLSKVSPEWKSKVGEGTSVQWPGGVGGKGNEGVASYVQQIKGSIGYVELAYALQNKMPYTSLQNAAGQWIEPNAESFAAAAASADWANAKDFNLVITNAPGEKAWPITATNFMLMHKQPKDAARSKATLDFFKWALENGQAQASELHYVPLPPELVKQIEAYWGSEFK

SEQ ID NO: 15168 - DNA, 813 bp, Vibrio fischeri ES114
  CDS (1)..(813): transl_table=11
atgttcaaagcgtttagttacaccaccatatttacagcgttactttttagctcctcaacttttgctgcaaatacagtaattgcaggttctacatctgtttctacactattggaaccctttattgatgaatacaataaagacaataaaccacttgttgatttgcaaagtattggttcaagtgcaggcattaaactactggttgatgacacagtaaatcttgctatcagctctcgtgagttaacagacaaagaaaaagagacattaagttcaactcttatcgcttatgatgccatcgcaattgttgtccaccctgacaacccaattactgaattatctacagagaacatctggaaaatctatcacggtgatattaaaaactggaaagaattgggtggcaccgatcgtaagatctctgtaatttcacgtgaaattgcttcaggctctcgcttctcgtttgaaaaacactttggtttaacacaagaaatcaactcattcactgtatcagatattagcgataacgctcttgttgttaatggtacgggtatggttaagagcattgtttcacgcaacccttatgctattggctatgtatctgctggaacacttggtgatcttgctcaactccgtgtactaaaagtagataacgtactaccaagccaagaagctattatggaaaataaatattctctttcccaccctttcttatttgtatacaagaaccaaacagtatctaaagaatcgacagagtttatgaattacattgcttcaccagaagcaactaaaaccatccaatcacttggttatatcaagtaa

SEQ ID NO: 15169 - protein, 270 aa, Vibrio fischeri ES114
MFKAFSYTTIFTALLFSSSTFAANTVIAGSTSVSTLLEPFIDEYNKDNKPLVDLQSIGSSAGIKLLVDDTVNLAISSRELTDKEKETLSSTLIAYDAIAIVVHPDNPITELSTENIWKIYHGDIKNWKELGGTDRKISVISREIASGSRFSFEKHFGLTQEINSFTVSDISDNALVVNGTGMVKSIVSRNPYAIGYVSAGTLGDLAQLRVLKVDNVLPSQEAIMENKYSLSHPFLFVYKNQTVSKESTEFMNYIASPEATKTIQSLGYIK

SEQ ID NO: 15170 - DNA, 852 bp, Bacteroides fragilis NCTC 9343
  CDS (1)..(852): transl_table=11
gtgttactctgtggtgaatcaaactcaaaacttaatcatatgaaagttagaactatcttattcgccgccctctcactcgcagcattgcatgccaacgctcagcgcatcaaaggcagtgacaccgtactgcccgtagcccagcaaaccgccgaacgcttcatgaaccgtgaacccgacgcccgtgtcacagtcaccggaggcggtacaggggtaggcatctccgccctgatggacaacaccactgacatcgccatggcttcacgccccatcaaattcagcgaaaagatgaaagccaaagccgccaaacgggatatagacgaagtgatcgtcgcttacgatgcgctggctgtcgttgtacacccgtccaatccggtgaaaaaactcacccgccggcaactggaagacatcttccgcggaaaaataaccaactggaaacaagtgggaggcgacgaccgcaagatcgtggtttactctcgcgagacctcttccggcacctacgagttcttcaaagagagcgtcctcaagaacaagaattatatgagcagcagtctctccatgcccgccaccggagccattatccaatccgtcagccagaccaaaggggcaatcggctatgtagggctcgcttatgtgtcgccgcgcatcaagactctgtccatctcgtatgatggcgagcactatgccaccccgaccgtagagaacgccaccaacaagacttatcccatcgtccgccccctctactactattatgatgcaaagaacaaaacacaaatcgctcccctgctcgagtttattctctctcccgaaggacaggatattataaaaaagagtggatatatacccgtgaaataa

SEQ ID NO: 15171 - protein, 283 aa, Bacteroides fragilis NCTC 9343
MLLCGESNSKLNHMKVRTILFAALSLAALHANAQRIKGSDTVLPVAQQTAERFMNREPDARVTVTGGGTGVGISALMDNTTDIAMASRPIKFSEKMKAKAAKRDIDEVIVAYDALAVVVHPSNPVKKLTRRQLEDIFRGKITNWKQVGGDDRKIVVYSRETSSGTYEFFKESVLKNKNYMSSSLSMPATGAIIQSVSQTKGAIGYVGLAYVSPRIKTLSISYDGEHYATPTVENATNKTYPIVRPLYYYYDAKNKTQIAPLLEFILSPEGQDIIKKSGYIPVK

SEQ ID NO: 15172 - DNA, 966 bp, Cyanophage P-SSM4
  CDS (1)..(966): transl_table=11
atgaaagcattcgcagttgccctgctcggtctgtttacgatcacaccgatagcagaagcatcaaccagactaagtggagcaggagcatctttccctgccaaaatttacactcgttggttcgctgaccttgcaaaagaaaaaggtgcagcaagagtaaactatcaggcagttggttctggtagtggaagaaaagcatttattgaccagacagtaaattttggtgcgtctgatgatcctatgaaggacaaggacattgccaaagtgacaagaggattagttcaaattcctatgacaggtggaactattgcatttggatataacaatcctggttgtgagttaaaacttacacaacaacaggcagttgaagttgctatgggtatgattgacaactggaaggaacttggttgtgatgaccagaaactaacttgggcacatcgctcagatggttctggaacaactaaggcattcacaaatagtatggaagcattctctcctacatggacactaggtacaggtaaatctgtagcgtggcctaaaggagttggtggtaaaggtaatgcaggagtagcaggagtaattaaaaatacacctggtgctatcggttatgtgaatcaatcttatattgatgacactgttagagcagcagcacttcaaaacttaaacggtgagtttctaaaaccatctgttgaagcaggagcaaaggcacttaatggtattgagttagatgagaatctagcaggaaagaatcctaacccaacagcagaaggagcatatcctattgctacattgacatggatacttgcatatgaaactggtaatggtagaaacactgaagcaatcaagtcttcattgagcagactactaagtgatgagtatcaggacaaagcacctaagttagggtttgttcctcttaaaggtgacattcttgagaaggcaaaatcagctgttgacaagattggcaaatag

SEQ ID NO: 15173 - protein, 321 aa, Cyanophage P-SSM4
MKAFAVALLGLFTITPIAEASTRLSGAGASFPAKIYTRWFADLAKEKGAARVNYQAVGSGSGRKAFIDQTVNFGASDDPMKDKDIAKVTRGLVQIPMTGGTIAFGYNNPGCELKLTQQQAVEVAMGMIDNWKELGCDDQKLTWAHRSDGSGTTKAFTNSMEAFSPTWTLGTGKSVAWPKGVGGKGNAGVAGVIKNTPGAIGYVNQSYIDDTVRAAALQNLNGEFLKPSVEAGAKALNGIELDENLAGKNPNPTAEGAYPIATLTWILAYETGNGRNTEAIKSSLSRLLSDEYQDKAPKLGFVPLKGDILEKAKSAVDKIGK

SEQ ID NO: 15174 - DNA, 1041 bp, Salmonella enterica subsp. enterica serovar Choleraesuis str
  CDS (1)..(1041): transl_table=11
atgaaagttatgcgtaccactgtcgcaactgttgtcgccgcgaccttatcgatgagcgcgttctctgcctttgcagcagcaagcctgacaggtgccggtgcaacgtttcctgcgccggtgtatgccaaatgggcggatacctaccagaaagaaaccggtaacaaagtcaattaccaggggataggctcttccggcggcgtgaaacaaatcaccgcgaataccgttgattttggcgcttccgatgcgccgctgtctgacgaaaaactgaatcaggaaggcctgttccagtttccgacggtgatcggcggcgtggtgctggcggtgaatattccaggcctcaaatccggtgaactggtgctggatggtaaaacgctgggtgacatctacctcggtaaaatcaagaagtgggatgatgaagccatcaccaaactgaacccaggcgtgaagctgccttctcagaacatcgctgtggtgcgtcgcgctgacggttccggtacctccttcgtgttcaccagttacctggcgaaagtcaacgacgagtggaaatcgaaagtgggcgcgggttctaccgtgaactggccaaccggtctgggcggtaaaggtaacgacggcatcgcggcatttgtacagcgtctgccaggcgctatcggctacgttgaatacgcttacgctaagcagaacaacctggcctacaccaaactggtttctgccgacggcaagccggtaagcccgacggaagatagcttctctaatgcggcgaaaggcgcagactggagcaaaaccttcgcgcaggatctgaccaaccagaaaggtgacgatgtgtggccaatcacctccaccacctttatcttggtccacaaagcgcagaagaaacctgagcagggtgctgaagtgctgaagttcttcgactgggcctacaaaaatggcgctaaacaggcgaatgatctggactacgccagcctgccggataacgttgttgagcaggttcgtaccgcctggaagaccagtataaaagacagcaacggtaaggcgctgtattaa

SEQ ID NO: 15175 - protein, 346 aa, Salmonella enterica subsp. enterica serovar Choleraesuis str
MKVMRTTVATVVAATLSMSAFSAFAAASLTGAGATFPAPVYAKWADTYQKETGNKVNYQGIGSSGGVKQITANTVDFGASDAPLSDEKLNQEGLFQFPTVIGGVVLAVNIPGLKSGELVLDGKTLGDIYLGKIKKWDDEAITKLNPGVKLPSQNIAVVRRADGSGTSFVFTSYLAKVNDEWKSKVGAGSTVNWPTGLGGKGNDGIAAFVQRLPGAIGYVEYAYAKQNNLAYTKLVSADGKPVSPTEDSFSNAAKGADWSKTFAQDLTNQKGDDVWPITSTTFILVHKAQKKPEQGAEVLKFFDWAYKNGAKQANDLDYASLPDNVVEQVRTAWKTSIKDSNGKALY

SEQ ID NO: 15176 - DNA, 747 bp, Leptospirillum ferrooxidans
  CDS (1)..(747): transl_table=11
atgagaagaacacaaggtctcctcctccggagcgcagtctttgggatttttttgcttctgatctctttttccggggcgcatgcggaggagctcttgctgtctggctcttccatgcttcttcctttgaatcgtgtctgggcccaggcctatggaaaagaccattccgatgtcaggattctagcttcgggacccggatccggagcgggaattgtttccgcagtttcaggagatgcgagtatcggagcctccgatgtcttcctgacagagaaggatcgcaaaaaggacaggaatattctcctgataccagtcgctctcgagggcacgattcctgtggtcaatttgcctcttcaggggaagatgcccctgaaaatgaacgggactgttcttgccgatctctttttgggaaaaatccacttctggaatgatcctgcactggccaaactcaatccggggcggactcttccccatcttcctgtccgggtttttcaccggtccgattcttccggaacgaccttcgtactgacagactatctcgaaaggacctcgacctcgtggcacgatttggtcggccgggatgttcttcccatatggcctgtctttgcaggagcttcgggggttttgggatcggcagccatggctaaggccgtccgggaccattccggttcgatcggttatgtcggcctgggatgggtccgggcatcgcatctttctcctgtggcacttaaaacagggagggacgctttgtag

SEQ ID NO: 15177 - protein, 248 aa, Leptospirillum ferrooxidans
MRRTQGLLLRSAVFGIFLLLISFSGAHAEELLLSGSSMLLPLNRVWAQAYGKDHSDVRILASGPGSGAGIVSAVSGDASIGASDVFLTEKDRKKDRNILLIPVALEGTIPVVNLPLQGKMPLKMNGTVLADLFLGKIHFWNDPALAKLNPGRTLPHLPVRVFHRSDSSGTTFVLTDYLERTSTSWHDLVGRDVLPIWPVFAGASGVLGSAAMAKAVRDHSGSIGYVGLGWVRASHLSPVALKTGRDAL

SEQ ID NO: 15178 - DNA, 1104 bp, Corynebacterium jeikeium K411
  CDS (1)..(1104): transl_table=11
gtgaagttcaccatgaagcgcgccagcgctgcagctgcgactctgttcgctggttccctgattctgaccggctgctccaatgctgacaacaacgaaggcggcggcagcagcagcgaaggctctcgcccgatggaggaggctaccggcgaactgcgtggcgaaggcgcttcctcgcaggacaacgcaatccagaacatcttcggtccggcgttctctgagactggcgcaaccctggcttacaacgcgtctggttccggtgacggccagaagaagttcatcgctggccaggccgattttgcgggttccgactctccgctgaaggatgaccagattgcggacgctaagaagcgttgcgatggaaacgacgcatggcacctgccgatggttatcggcccggttgcaatcgcttaccacctggagggcgtggacgaactgaacctgtccaccaagaccgttgccaagatcttcaagggcgagatcaagaagtgggacgacgaggccatcaaggctgagaacgagggcgttgacctgccgtccgacccgatcgaggttgtgtaccgctctgacgagtccggcacctccgacaacttccagaagttcctggctgcttccagcggcgagtgggactctgagggtaagaacttcccgaccaaggttggcaccggtgctccgaagtccaagggtgttgctgaccaggttgcagctaccaacggtgcaatcacctacgttgagtccggctttgctgaggagctcgacgcagtcaacatcgccaagatcgacttcggttccggcccggttgagctgaacaaggagaacgtgaacaaggctctggctgaggctgagttcaagggcgagggtaacgacctggtcgttgactctgagaagctgtacagcatgaacggcgagggcgagtacccgctggttctgaccacctacgagatcgtctgctccgctggttacgacgacaacacctcgaagctggtcaagaacttcctgaacaccatcctgaacaaccagaacgatgagctggctgaccagggctacattccggtggacggcgagttcaagtccaagctggagaagtctgtcgacgctctgaagtaa

SEQ ID NO: 15179 - protein, 367 aa, Corynebacterium jeikeium K411
MKFTMKRASAAAATLFAGSLILTGCSNADNNEGGGSSSEGSRPMEEATGELRGEGASSQDNAIQNIFGPAFSETGATLAYNASGSGDGQKKFIAGQADFAGSDSPLKDDQIADAKKRCDGNDAWHLPMVIGPVAIAYHLEGVDELNLSTKTVAKIFKGEIKKWDDEAIKAENEGVDLPSDPIEVVYRSDESGTSDNFQKFLAASSGEWDSEGKNFPTKVGTGAPKSKGVADQVAATNGAITYVESGFAEELDAVNIAKIDFGSGPVELNKENVNKALAEAEFKGEGNDLVVDSEKLYSMNGEGEYPLVLTTYEIVCSAGYDDNTSKLVKNFLNTILNNQNDELADQGYIPVDGEFKSKLEKSVDALK

SEQ ID NO: 15180 - DNA, 1095 bp, Xylella fastidiosa Ann-1
  CDS (1)..(1095)
atgaaagtacattttgctggtttcactctcctttgtttatgcactgccgtaacaatcaccggctgtaaaccttccaacgataaccagtcaagaggtgtcagtcaggatgcgaacagtacgactccaccctctgccgagcaaaccaagagtgtgaagatttcaggcgcaggtgcctcatttatctatccactgatctcgcaatggtcagccgactacaacgccgccactggcaataaaattaactatcagtcaatcggctcaggcggtggtattgcccaaatcaaagccgccacaatcgattttggttcttctgacaagccacttgacagcagcgaactgacccaagcgggtctagggcagtttccatcggccataggcggcgtcgtgccggtggtcaatctagacaacatcgaaccaggcaaactacgcctaacaggccccctgcttgcagatattttcctggggaagatcagtaagtggaatgacgcagcaatcatcagcgccaatccggggctacatcttccagacactaaaatcaacatcgtgcatcgttccgatggctctggcacgacattcaatttcagcaactatttatcaaaagtcagcgcggaatggaaacagaaagtgggtgaaggcacttcagtgcagtggcccggaggcgtcggcggtaaaggcaacgaaggtgtagcctcatatgttcaacagattaaaggctcgatcggctacgttgaactggcgtatgcgcttcagaacaaaatgtcatatacagcactccagaacgctgctggtcaatgggtacaaccaagcgcagaaagctttgcagcggccgcatccaacgcagactggagcaatgcaaaggatttcaatttggtcatcaccaacgctactggggaaggcgcttggccaatcacagccacaaactttatattgatgcgcaagcaaactaaggatgcagcgcaaagaaaagccactctagacttcttcaagtggtgctttgaaaatgggcagaagcaagccaatgaattacactacgtgccattgccaccaaatctggtgaagcaaatcgaagcttattgggcaagcgaattcaagtaa

SEQ ID NO: 15181 - protein, 364 aa, Xylella fastidiosa Ann-1
MKVHFAGFTLLCLCTAVTITGCKPSNDNQSRGVSQDANSTTPPSAEQTKSVKISGAGASFIYPLISQWSADYNAATGNKINYQSIGSGGGIAQIKAATIDFGSSDKPLDSSELTQAGLGQFPSAIGGVVPVVNLDNIEPGKLRLTGPLLADIFLGKISKWNDAAIISANPGLHLPDTKINIVHRSDGSGTTFNFSNYLSKVSAEWKQKVGEGTSVQWPGGVGGKGNEGVASYVQQIKGSIGYVELAYALQNKMSYTALQNAAGQWVQPSAESFAAAASNADWSNAKDFNLVITNATGEGAWPITATNFILMRKQTKDAAQRKATLDFFKWCFENGQKQANELHYVPLPPNLVKQIEAYWASEFK

SEQ ID NO: 15182 - DNA, 1044 bp, Nostoc punctiforme PCC 73102
  CDS (1)..(1044)
atgattttttcgaccaccaccttgaatcgtgtcattgctacttcattggtgacaacttctgttgcacttagtccattttttggtgcgatcgcacaagctgaaactctcaatggtgcaggagcaacttttccggctccgctttacgaacggtatgctcgtgaagtgaagaagaaatatccagacttgaaaattaactatcaagcaattggtagtggcggcggtattcgtcaagtcaccgctggaaccgttgactttggtggtagtgatgctgcaatgaaagatgatgaaatcagtaaagtcaagaacggtgtaatcttagtacctacagcaggtggtgccgtttctgttgtttataatcttccaggtgttaacgatctcaagttgtcccgtaagacactaccagaaattttctcaggtcaaattaccaaatgggatgacgcaaaaattaaagctgataatcccggtgtcaatctaccaagtcaagcaattaaatttgttgttcgcgctgatggtagcggtacaactttcattttcactaaccacttaagtgctaccagcggttattttaaaggcagagttggagctaacactgctccaaaatggaatctgccaaacgtcctgaaaggcaaaggcaatccaggcgtagctgctatagtatctcgtactcctggttctattggttatgtagaatatgcctacgccgtcaaaaacaatctgaaatcagcactagtacaaaataagaaaggagaatttgttgctccttctttagagtctgcaaatgcagctttgtcaactgtcacttttccagacaattaccgtgtttttgtaggagaaccagcacaaggttatccgatcgttggccttacttggatgatggtttacaaacagtatgctaatgctgctaaagctgatgcaattaagaaatggattaattgggtattgaaggacggtcaacagtataacgatgacctcaactacaccaaaattccatctgatgtagcaaatcgggtgcttcaaacagtgaatagctctgtcaaaccttaa

SEQ ID NO: 15183 - protein, 347 aa, Nostoc punctiforme PCC 73102
MIFSTTTLNRVIATSLVTTSVALSPFFGAIAQAETLNGAGATFPAPLYERYAREVKKKYPDLKINYQAIGSGGGIRQVTAGTVDFGGSDAAMKDDEISKVKNGVILVPTAGGAVSVVYNLPGVNDLKLSRKTLPEIFSGQITKWDDAKIKADNPGVNLPSQAIKFVVRADGSGTTFIFTNHLSATSGYFKGRVGANTAPKWNLPNVLKGKGNPGVAAIVSRTPGSIGYVEYAYAVKNNLKSALVQNKKGEFVAPSLESANAALSTVTFPDNYRVFVGEPAQGYPIVGLTWMMVYKQYANAAKADAIKKWINWVLKDGQQYNDDLNYTKIPSDVANRVLQTVNSSVKP

SEQ ID NO: 15184 - DNA, 801 bp, Bifidobacterium longum DJO10A
  CDS (1)..(801): n means a or g or c or t/u, s means g or c
atgcagaagaacatcctcgttcgctccattgccgctctgtccggcattgtgatgctcgcttccgtggccgcctgcggcgataacactgccgccacgaccgacaacagctcctcctccgattccacttccaagtccaccccgatctccggcaacttctcgggcgccggcgcctcctctcagcaggccgccgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggtcttcaacctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgaaaactggccgaacgaggttggccnnnnnnnnnnnnnnnnnnnnnnnnnnnnnnnnnnnnnnnnnnnnnnnnnntgccaagggcacttccggcgtgatctccaccgtcaagcaggccgacggcaccatcggctacgctga

SEQ ID NO: 15185 - protein, 266 aa, Bifidobacterium longum DJO10A
  Xaa in position 239-245 is unknown
MQKNILVRSIAALSGIVMLASVAACGDNTAATTDNSSSSDSTSKSTPISGNFSGAGASSQQAAVEAWIAGFQGTNPEAKIAYNPSGSGAGVQTFLTGATAWAGSDKALADDEVEQSKSVCTEGTAFDVPVYISPIAVVFNLKGVSDAGKHINMDAATIAKIFDGKITKWNDPAIADQNKDLKLPDTAITVVHRSDKSGTTQNFVSYFKDVTPDNWTYDLSENWPNEVGXXXXXXXXXXXXXXXXXCQGHFRRDLHRQAGRRHHRLR

SEQ ID NO: 15186 - DNA, 996 bp, Pseudomonas syringae pv. syringae B728a
  CDS (1)..(996)
ttgtcgcttctgatcgcatcgctgtgccttagcggtgtggctcacgcgactgatgtaacaggcgctggttcgagtttcgtctacccggttatttcggcgtggtcccaggactacagcaagagcaaggataaccgtatcaactatcagtccatcggttcgggtggtggtattgcccagatcaaggctgcgaccgttgacttcggtgcatccgatgctccgatgtccgcagaagacctgcaggccggcggtctgggtcagtttccgagcgtgatcggcggtatcgtgccgatcgtcaacgtcgaaggcgtcgaaagtggcgagctgaagctggacggtccaaccatcgccaagatcttcatgggcgagatcaagaagtggaacgaccctgcaatcactgcgctgaactcgggcgtcaaactgcctgataccgccatcaccgtcgttcaccgttcggacggttcgggcaccacgtacaacttcaccaactacctgagcaaagtcagccccgagtggaacgagaagctgaagttcggttcgaccgtacagtggccagcaggcgtgggcggcaagggtaacgaaggtgtttcggcctacgtgaagcagatcaagggttcgatcggctacgtcgagtactcctacgcgaccaccaacaagctgtcctacactcagctgaaaaacgcggctggcaaatttatcaaaccagacgccaaggctttcgcagcagctgctgacaccgccgactgggcgagcgccaaagacttcaacctgatcatgaccaacgcgccgggtgaggctgcatggccgatcaccgcgaccacctggatcatcatgtacaagaaagccaagaacgaagagaaaagcaccgcggctttcgacttcttcaagtggtccctggaaaacggccagaagcaggccgagaaactggaatacgtagcattgcctaaatcgctggttgatcgcgtggaaagctactggaaaacggaattcaccaagtaa

SEQ ID NO: 15187 - protein, 331 aa, Pseudomonas syringae pv. syringae B728a
MSLLIASLCLSGVAHATDVTGAGSSFVYPVISAWSQDYSKSKDNRINYQSIGSGGGIAQIKAATVDFGASDAPMSAEDLQAGGLGQFPSVIGGIVPIVNVEGVESGELKLDGPTIAKIFMGEIKKWNDPAITALNSGVKLPDTAITVVHRSDGSGTTYNFTNYLSKVSPEWNEKLKFGSTVQWPAGVGGKGNEGVSAYVKQIKGSIGYVEYSYATTNKLSYTQLKNAAGKFIKPDAKAFAAAADTADWASAKDFNLIMTNAPGEAAWPITATTWIIMYKKAKNEEKSTAAFDFFKWSLENGQKQAEKLEYVALPKSLVDRVESYWKTEFTK

SEQ ID NO: 15188 - DNA, 810 bp, Desulfovibrio desulfuricans G20
  CDS (1)..(810)
atgcgtatgaaacatcttgccatcgtcgccgccctggtgctcggcctcacttcttccgcttttgccggacagaagatcaaaatcgccggttccacaaccattctgcccatcatgcagcgtgtggttgaagcatacatgaaagccaaccccgatgtggaaatcgcagtttccggcggcggttcttccaacggcatcaaagcgctgctggacggcaccaccgacatcgccatggcatcgcgcaccatgaaagacaaagaaatcaaaatggccgccgaaaaaggcatgaaccccaagcaggttgtcatcgcccttgatgccgtgattcccattgtcaacaaaagcaaccccgtcaacgacctgaccattgaccagctgcaggccatctatgcaggcaaggtcaccaactggaaagaagtcggcggcaaagacgaaggcattgtggtggtttcgcgcgacacgtcttccggcacctacgagacctggagccactttgtaatgggtaaaacccgcgtgttccccggtgcgcttctgcaggcatcttccggcgcagtgctgcaggccgtggccaaaaacccccgcgccatcagctacgacggcatcggctacgttgacaactcggtcaagccgctgaccgtgaacggtgtggaaggcaacgcaaccaccgccaaggacaaaagcttccccgtcgcccgcaccctgcaggtatatgtagacggcagcgtttccggtgcggccaagggccttatcgacttcatcctgtcgcccgaaggccagaacattgtggaagaagccggcttcatcaagctgtaa

SEQ ID NO: 15189 - protein, 269 aa, Desulfovibrio desulfuricans G20
MRMKHLAIVAALVLGLTSSAFAGQKIKIAGSTTILPIMQRVVEAYMKANPDVEIAVSGGGSSNGIKALLDGTTDIAMASRTMKDKEIKMAAEKGMNPKQVVIALDAVIPIVNKSNPVNDLTIDQLQAIYAGKVTNWKEVGGKDEGIVVVSRDTSSGTYETWSHFVMGKTRVFPGALLQASSGAVLQAVAKNPRAISYDGIGYVDNSVKPLTVNGVEGNATTAKDKSFPVARTLQVYVDGSVSGAAKGLIDFILSPEGQNIVEEAGFIKL

SEQ ID NO: 15190 - DNA, 1044 bp, Actinobacillus pleuropneumoniae serovar 1 str. 4074
  CDS (1)..(1044)
atgttattggtaaaaacagctaaaaaattcgttgttatcggactttcattaggcgtaatggcatcaagttatgctgaaacgattaccggtgcaggcgcttcattcccctatccgatttatgcgaaatgggcttcactttatgaaaaagaaacgggtaataaagtgaattatcaatctatcggttccggcggaggtcagcaacaaattatcgcaaaaacgattgatttcggtgcgtcggacgatccgatgaaagcggaattattggatcaacacaaattattacaattcccggcaattatcggcggtacggtaccggtggtgaacttaccggaatttaaagcgggtgaattaaaattatccggtacggtattggcggatattttcctcggtaaaattactaaatggaatgacccggcgattaaagcgttaaacgcatcgttaaatttaccggataaaagtattgtcgttgtacgtcgttcggacggttcgggtacaacattcggttggactaactatttatcgaaagtgtcgctggaatggaaagaaaaagtcggtgaaggtaaatcggttaaatggcctaccggtcaaggcggtaaaggtaatgaaggcgtagccgcttatgtgaaacaacttaaatattccatcggttatgtcgaatatgcttatgcgaaacaaaataacttagcttgggcttcgttacaaaaccaagcgggtaaatttgtacaaccgtcacgcgaaagttttatggcggcggctgcaaatgcgcagtgggataaagcgaaaggtatgggcattatgcttaccaatgaaagcggcgataattcatggcctgtgacggcggcaagtttcatccttgttcaccaacaggcggataatccgaccgcaaccaaagcggtgtttgacttcttcgattgggcttttgaaaaaggtaaaaatgcggcgtcggagttagattatgtgccgttaccggatgaagtcgtaacgaaaatcaaacaaaaatggcaaaacgaagtaaaagataaagacggtaaagcggttcgctaa

SEQ ID NO: 15191 - protein, 347 aa, Actinobacillus pleuropneumoniae serovar 1 str. 4074
MLLVKTAKKFVVIGLSLGVMASSYAETITGAGASFPYPIYAKWASLYEKETGNKVNYQSIGSGGGQQQIIAKTIDFGASDDPMKAELLDQHKLLQFPAIIGGTVPVVNLPEFKAGELKLSGTVLADIFLGKITKWNDPAIKALNASLNLPDKSIVVVRRSDGSGTTFGWTNYLSKVSLEWKEKVGEGKSVKWPTGQGGKGNEGVAAYVKQLKYSIGYVEYAYAKQNNLAWASLQNQAGKFVQPSRESFMAAAANAQWDKAKGMGIMLTNESGDNSWPVTAASFILVHQQADNPTATKAVFDFFDWAFEKGKNAASELDYVPLPDEVVTKIKQKWQNEVKDKDGKAVR

SEQ ID NO: 15192 - DNA, 1179 bp, Pseudomonas aeruginosa UCBPP-PA14
  CDS (1)..(1179)
atgtacaagcgctctctgatcgctgcctcgctgagcgtggccgccctcgtatccgcccaagccatggccgacatcaacggcggtggcgccaccctgccgcaacagctgtaccaggagcccggcgtcctgaccgccggctttgccgcctacatcggcgtaggcagtggcaacggcaaggcggccttcctgaacaacgactacaccaagttcgtcgccggcaccaccaacaagaacgtgcattgggctggtagcgactccaaactgagcaagaccaacgaaaccaacccctatctgagcgcccatggctccgcctggggtccgctgatccaggtgccgtcggtagccacttctgtcgctctgccgttcaacaagtcaggtagcaacgccgtcaacttcgcagacgtgaacaccctttgcggtgtcttctccggccgtctgaccgattggagtcagattcctggctcgggccgtagcggcgccatcacagtggtctaccgttccgagagcagcggcaccaccgaactgttcacccgcttcctcaacgcctcctgctccagcaccctcgaaggtggcaccttcgccatcaccaccagcttcggtagcagcttctccggcggcctgccggctggcgccgtatcggcccagggcagccaggccgtgatgaatgcgctcaacgccgcccaaggccgcatcacctacatgagcccggacttcgccgcgccgaccctggccggtctcgacgacgccaccaaggtcgcccaggttcgcggcgtatccccggcgccggccaacgtttcggcggccatcggcgccgttactccgccgactactgcccagcgttccgatccgaacaactgggtaccggtcttcgctgccaccgccaaccccaacgacccgagcgtgcgtccgtatccgaccagcggctacccgatcctcggcttcaccaacctgatcttcagccagtgctacgccaacgccacccagacccagcaggtgcgcgacttcttcacccgtcactacggcgccaccgccaacaacgacaccgcgatcaccaaccatcgcttcgtgccgctgccggcttcctggaagcttgccgtacgccagtcgttcctgacctccaccaacaacttgtacatcggccattccaacgtctgcaacggcatcggccgtccgctctaa

SEQ ID NO: 15193 - protein, 392 aa, Pseudomonas aeruginosa UCBPP-PA14
MYKRSLIAASLSVAALVSAQAMADINGGGATLPQQLYQEPGVLTAGFAAYIGVGSGNGKAAFLNNDYTKFVAGTTNKNVHWAGSDSKLSKTNETNPYLSAHGSAWGPLIQVPSVATSVALPFNKSGSNAVNFADVNTLCGVFSGRLTDWSQIPGSGRSGAITVVYRSESSGTTELFTRFLNASCSSTLEGGTFAITTSFGSSFSGGLPAGAVSAQGSQAVMNALNAAQGRITYMSPDFAAPTLAGLDDATKVAQVRGVSPAPANVSAAIGAVTPPTTAQRSDPNNWVPVFAATANPNDPSVRPYPTSGYPILGFTNLIFSQCYANATQTQQVRDFFTRHYGATANNDTAITNHRFVPLPASWKLAVRQSFLTSTNNLYIGHSNVCNGIGRPL

SEQ ID NO: 15194 - DNA, 1155 bp, Psychrobacter sp. 273-4
  CDS (1)..(1155)
atgcgttattcattcatggcagtagcaatcgctagcactttggtattagccgcttgtaaccaaacgaccagcaacaacgagagcgataaaaccaacgagcctgctacagcagcgccagcaaatgccgctgctagtggcgacgctagtgctagctcagctgaaagtgcatcgatgaacattactggtgctggtgcctcttttccgcagcctatctatgctaaatggtcagatgcttacaataaagccaccggtggtcaggtgaactatcagtccattggctcatctggcggtatcaaacaaatcgttgcgaagaccgtggattttggagcatctgatgcgcctatgacaccagaagagttaaacgaagctggtctgattcagttcccaactgtcattggtggcgtagtgcctatcgtcaatatcgatggcatcaaggctggtcagttaaagctcgatggcaaaatgcttgccgatatttatttgggcaaaatcagtaaatggaacgaccctgccatcgcggctatgaatccagaacttaaattaccagacgctgccattaccacggtatttcgctcggatggttctggtacgacttttaacttcactgactatctagcaaaagtttcaagcgattggaatgacagtgtgggtgtcgataaaacagtcaaatggccaacatcggctaccggtgctggtggtaaaggcaacgagggtgtgtcgagctacgtcacacgcatgaaaaactctatcggctatgttgaatatgcttacgctaagcaaaacggtatggcacacgtcgcccttaaaaacgctgcaggcaatatcgtacaaccttctgcccaaacttttgcagcggcaggcgacattgactggtcaaagcaagaaggcttctataaagttattaccaactctgaaacagcgcaagcttggccaatcgccgcggcgacttttatcttagtacataagcagccacaagatgccaagcaagtcgccggcgtattaaagttctttgactgggcttatactcaaggtgatgacgatgcaatggcgcttgattacgtgccgttttctgatactgccgttgctttgtttaaagcaaaatggaatgaggtaaaaggcagcgacggccaacctgtctataagcctgcacaataa

SEQ ID NO: 15195 - protein, 384 aa, Psychrobacter sp. 273-4
MRYSFMAVAIASTLVLAACNQTTSNNESDKTNEPATAAPANAAASGDASASSAESASMNITGAGASFPQPIYAKWSDAYNKATGGQVNYQSIGSSGGIKQIVAKTVDFGASDAPMTPEELNEAGLIQFPTVIGGVVPIVNIDGIKAGQLKLDGKMLADIYLGKISKWNDPAIAAMNPELKLPDAAITTVFRSDGSGTTFNFTDYLAKVSSDWNDSVGVDKTVKWPTSATGAGGKGNEGVSSYVTRMKNSIGYVEYAYAKQNGMAHVALKNAAGNIVQPSAQTFAAAGDIDWSKQEGFYKVITNSETAQAWPIAAATFILVHKQPQDAKQVAGVLKFFDWAYTQGDDDAMALDYVPFSDTAVALFKAKWNEVKGSDGQPVYKPAQ

SEQ ID NO: 15196 - DNA, 975 bp, Dechloromonas aromatica RCB
  CDS (1)..(975)
atgaccggtgccgggtcgtctgccgcctacccgatctacaagctgtgggcggatcaactgaaacgtgaaggcggtttcgtgctgaactacgatcccgtcggctcatcggccggggtcgagagagctcgcgcccgtcaggccgatttcggcgccacggatgtcgcactcaaaagtgagcaactggccaaggacaaccttatcctctttccaacggtcatcaccggcgcagttcccgtcatcaacctgcccaagatggaaaaaccgcttgttctggacggccccacgctggccagaatcttcctgggggaaattgagcactgggatgcacctgagatccgcgccttgaatcccggcctgagccttcccgcaaaaccgatagtcgcggtcgtccgcagcgatggctctggcaccacttacaactttgccgattatctggccaaggtcagtccggcatggaaacagaagatgggcgttgccacgaacctcaaatggccagcctcgttcacgtcggtcaagggcagcaagggcgttgccgaagcagtgaaatcgacgcccgggagcatcagttacgtggattacaactacgtactggattacaagctcacgggggcagccatgaagaatgcggacggcgccatcgtcgaagccgggccttacaccttccgtgaagcgcttgcccagagcgtctggaagcaaaccggcgacttcactcagacgctgaccaatcagaccgggaaaagcagctggcccatcacgatgggcacttttatcgtcatgccccgagtctccaacaatccggaacggaccatccaggtcacccgtttcttcaccgaggcattcatgcgcggtgacgaccttgcgaaacaggccaacttcgtccgcctgccgtcgatcatccaggggaaagccttccgggtgatttcggaaatcgtcgatgcaaagggcgttcccatcggcataaacagcctccgataa

SEQ ID NO: 15197 - protein, 324 aa, Dechloromonas aromatica RCB
MTGAGSSAAYPIYKLWADQLKREGGFVLNYDPVGSSAGVERARARQADFGATDVALKSEQLAKDNLILFPTVITGAVPVINLPKMEKPLVLDGPTLARIFLGEIEHWDAPEIRALNPGLSLPAKPIVAVVRSDGSGTTYNFADYLAKVSPAWKQKMGVATNLKWPASFTSVKGSKGVAEAVKSTPGSISYVDYNYVLDYKLTGAAMKNADGAIVEAGPYTFREALAQSVWKQTGDFTQTLTNQTGKSSWPITMGTFIVMPRVSNNPERTIQVTRFFTEAFMRGDDLAKQANFVRLPSIIQGKAFRVISEIVDAKGVPIGINSLR

SEQ ID NO: 15198 - DNA, 1014 bp, Haemophilus influenzae R2846
  CDS (1)..(1014)
atgcataaaatgaaaaaaaatcttattatcgttttaaccttaggtacgttaccttttgctcaagctaatagcatcactggtgctggagcgtctttcccttatccaatttatgcgaagtgggcatctttatatgagaaagaaactgggaataaagttaattatcaatccatcggttcgggcggcggacaacagcaaattattgcaaaaacggttgattttggtgcctctgacgatccgatgaaatccgaattattacaacaacaccaactagtccaattccctgcggttatcggtggtatagtgcctgttgttaatttgcctgaaattaaacctggtaaattaaagttatcaggtaagctgttagcagaaatcttccttggtaagattaaaaaatggaacgatcctgacttagttgcattaaatccaacgcttcctttaccaaataaaaacattattgtgattcatcgttcagacggctctggaacaacatttggcttcactaattatctatctaaagtttcgaacgattggaaaaatcaagttggtgaaggtaaatcagtgaagtggttaacaggtcaaggtggaaaggggaatgagggaattgcttcttatgttcgccaaatgaaatacaccattggttatgtagagtatgcctatgccaaacaaaatcagcttgcttggatttcattacaaaatcaagcagggcaatttgtacagccttctaatgaaagtttcatggcagctgcaagtcacgcaaaatggcacgaaaaggcgggaatgggtgttatattaaccaatgaaacgggggaaaaatcttggccaattacggcagcgagttttattttattaaataaatattctgacaatcctgaaacaactaaaaatgtattagccttttttgattgggcattctcaagagggcaagatgcggcaactgaattagattatgtgccaattccagctgatgtggtatctaccattaaaagtcaatggaaaacagagctaaaacaataa

SEQ ID NO: 15199 - protein, 337 aa, Haemophilus influenzae R2846
MHKMKKNLIIVLTLGTLPFAQANSITGAGASFPYPIYAKWASLYEKETGNKVNYQSIGSGGGQQQIIAKTVDFGASDDPMKSELLQQHQLVQFPAVIGGIVPVVNLPEIKPGKLKLSGKLLAEIFLGKIKKWNDPDLVALNPTLPLPNKNIIVIHRSDGSGTTFGFTNYLSKVSNDWKNQVGEGKSVKWLTGQGGKGNEGIASYVRQMKYTIGYVEYAYAKQNQLAWISLQNQAGQFVQPSNESFMAAASHAKWHEKAGMGVILTNETGEKSWPITAASFILLNKYSDNPETTKNVLAFFDWAFSRGQDAATELDYVPIPADVVSTIKSQWKTELKQ

SEQ ID NO: 15200 - DNA, 1182 bp, Anabaena variabilis ATCC 29413
  CDS (1)..(1182)
atgctctcatatatcaagagaattaaaaataaccgcattccagtatcaattaccgtattaacactggcgatgagtttagctgcttgtggtgggcagcaaggctcagacaatactgcaactcaagatggttcatctggtacagctaaagatgctacagcttccagcccagtaaaattggatcttggtggcaatgtcacattaactggagctggtgcatcgtttcctgcaccgttatatcaaagttggttcacggaattaaacaaaaagtaccccaatttacaagttaactatcagtcagtaggtagcggcgctggagttgaacaatttatccaaggtacggtagatttcggtgctagtgacgtagccatgaaggatgaagaaatccaaaaagtaccgcaagacaaaggtactttattactaccaatgactgctggtagtattgtcttggcttataatctccctgatgttgctgacctgaaactaccaagggcagtttacacagacattttgctaggtaatattaaaacttggaacgacaaaaaaattgctgatgccaaccctggtgtaaatcttcctaatcagccaattacagttgtatatcgttccgatggtagtggaactacaggggtatttactaaacacctcagtgccatcaatccagattggaaaagcaaagtaggcgatggtaaaactgtcaattggcctgtgggtgttggtgcgaagggaaatgaaggtgtaacagctcaagtccaacaaacccaaggctctattggttacatagaatatggctacgccaaacaaaacggactcaagtttgcggcgttagaaaataaagatggtaaatttgtgatacccacagaagaatcagcatctaaaactttagaagctgtcaccttaccaacagacctccgcgcttttattgcagacccagaaggtgcagaatcttatcctatagtcacctacacttggattatgacttataaaaaatatgctgatccagtgaaagcgaaagcagtggaagccgcaattgagtatggtttaacagaagggcaaaaggtcgccgcagaactggggtatgttcccctacctcaaaatgtggtggcaaaggtagcggctgtggctgaccaaattagtccagattataaaattgcagtaagtggcaacacaagcgctagcaagtaa

SEQ ID NO: 15201 - protein, 393 aa, Anabaena variabilis ATCC 29413
MLSYIKRIKNNRIPVSITVLTLAMSLAACGGQQGSDNTATQDGSSGTAKDATASSPVKLDLGGNVTLTGAGASFPAPLYQSWFTELNKKYPNLQVNYQSVGSGAGVEQFIQGTVDFGASDVAMKDEEIQKVPQDKGTLLLPMTAGSIVLAYNLPDVADLKLPRAVYTDILLGNIKTWNDKKIADANPGVNLPNQPITVVYRSDGSGTTGVFTKHLSAINPDWKSKVGDGKTVNWPVGVGAKGNEGVTAQVQQTQGSIGYIEYGYAKQNGLKFAALENKDGKFVIPTEESASKTLEAVTLPTDLRAFIADPEGAESYPIVTYTWIMTYKKYADPVKAKAVEAAIEYGLTEGQKVAAELGYVPLPQNVVAKVAAVADQISPDYKIAVSGNTSASK

SEQ ID NO: 15202 - DNA, 1044 bp, Anabaena variabilis ATCC 29413
  CDS (1)..(1044)
atgaatttttccaccaccgtcttacagcgtgtatttactactgctgtggtaacatctgctgttgttgttactcctatttttacagcgatcgctcaagctcaaactctcaacggtgcaggagcgacttttccggctccactttatgaacggtatgctcgtgaagttagaaaaaagcatccagaactgagaattaactatcaaggaattggtagtggtggtggtattcggcaagtaacagccggaactgttgacttcggtggtagtgatgcggcaatgacagatgctgaaattgctaaagtcaaaaatggtgtcatccttgttcccacagccggcggtgctgtttccgtcgtctataacgttccgggtgtcaataatctgagattatcccgtactacactaccagcaattttttctggtcaaattaccaactggaatgatgccaaaattaaagctgataatcctggtgtaaatctgccaaaccagccaattagatttgctgtgcgtgcggatagtagtggtaccacattcatttttacaaaccacttgagtgctattagtggttatttcaaaggcagaattggcgctaatactgcacccaaatggactttacctaatgtcctcaaaggtaaaggaaaccctggtgtagcatcattagtggctcgtactcctggctctattggttatgttgaatatgcttatgcagccaaaaataacctcaaatcagcgcagattcaaaacaaaaaaggagaatttgtagccccttctctccaatctgctaacgctgctttatcagctgtcagtttcccagacaatttccgcgtttttgtgggagatccaggacaaggttatcccattgtgggactcacctggatgatggtttatagacaatatgctgatgcggctaagtctcaagccatcaagaaatggatcaattgggttctaaaagacggtcaacaattcaatgatgaccttaattacacaagaattcctgatgctgtagctaatcgtgtgttgcaaacagtcaatagcaacgtcaaaccatag

SEQ ID NO: 15203 - protein, 347 aa, Anabaena variabilis ATCC 29413
MNFSTTVLQRVFTTAVVTSAVVVTPIFTAIAQAQTLNGAGATFPAPLYERYAREVRKKHPELRINYQGIGSGGGIRQVTAGTVDFGGSDAAMTDAEIAKVKNGVILVPTAGGAVSVVYNVPGVNNLRLSRTTLPAIFSGQITNWNDAKIKADNPGVNLPNQPIRFAVRADSSGTTFIFTNHLSAISGYFKGRIGANTAPKWTLPNVLKGKGNPGVASLVARTPGSIGYVEYAYAAKNNLKSAQIQNKKGEFVAPSLQSANAALSAVSFPDNFRVFVGDPGQGYPIVGLTWMMVYRQYADAAKSQAIKKWINWVLKDGQQFNDDLNYTRIPDAVANRVLQTVNSNVKP

SEQ ID NO: 15204 - DNA, 1032 bp, Ralstonia eutropha JMP134
  CDS (1)..(1032)
atgaagctggtcaagactgccgtggcaggcatcgtttcgatggtcgtagcgggtactgcgttcgcggcggaaattaccggtgcaggcgcttccttcccggcgcccgtctattccaagtgggccgacgcataccaaaaagcaacgggcaacaaggtcaactatcaatccatcggctcgtcgggcggcatcaagcagattggcgccaagacggtcgatttcggcgcttcggatgccccgctgaaggacgaagatctgaacaagcagggtctggtccagttcccgactgtgatcggcggcgtggtgccggtgatcaacctgcaaggtgtgaagccgggcgacctgaccatcacgggcgaagtgctggccaatatctacctgggcaagatcaagaagtgggacgatccggccatcaaggcactgaacccgcacgccaagctgccgaaccaggacatcctgccggtgcgccgcgctgacggttcgggcaccaccttcatcttcacgaactacctgtcgaaggtcagccccgaatggcagaagtcggtgggcgaaggcaccaccgtcaactggccgggcggtggcacgggcggcaagggcaacgaaggcgttgccgctttcgtgcagcgtctgaatggcgcgatcggctacgtcgagtacgcctacgccaagcagaacaagatgacgcacgtgaacatgaagaacgcggccggcgccgtggttcagcccggtgacgacgccttcaaggctgccgccgccggtgcggactggagcaagagctactaccagatcctgacgaaccagccgggcaaggcggcatggccgatcgccggcgcgaccttcatcctggtccacaagaaccaggaaaaggctgcgcaaggcgcggaagtgctgaagttcttcgactgggcctacaagagcggcaccaacatggccgccgacctggactacgtgccgctgccggatgcggtcgtgaaccagattcgcacgacctggaagacgagcgttaaggacgcgtcgggcaaggcgctgtactaa

SEQ ID NO: 15205 - protein, 343 aa, Ralstonia eutropha JMP134
MKLVKTAVAGIVSMVVAGTAFAAEITGAGASFPAPVYSKWADAYQKATGNKVNYQSIGSSGGIKQIGAKTVDFGASDAPLKDEDLNKQGLVQFPTVIGGVVPVINLQGVKPGDLTITGEVLANIYLGKIKKWDDPAIKALNPHAKLPNQDILPVRRADGSGTTFIFTNYLSKVSPEWQKSVGEGTTVNWPGGGTGGKGNEGVAAFVQRLNGAIGYVEYAYAKQNKMTHVNMKNAAGAVVQPGDDAFKAAAAGADWSKSYYQILTNQPGKAAWPIAGATFILVHKNQEKAAQGAEVLKFFDWAYKSGTNMAADLDYVPLPDAVVNQIRTTWKTSVKDASGKALY

SEQ ID NO: 15206 - DNA, 1026 bp, Burkholderia cepacia R18194
  CDS (1)..(1026)
atgaacatccggatcttgattccctgcaccctggttcttgttgccctcagtgctcacgctgcggatatcaccggcgcgggcagcacatttgccgcaccgatctacgcaaagtgggccgatgcgtacaagaagtcgggcggtggcaaggtcaactatcaaggtatcggctcgtcgggcggcttgaagcaaatcaacgcgaagaccgtcgattttgccggttcggacgctccgctgaaggatgacgagctcgcgaaggcaggcctgttccagttcccgacggtggtcggtggcgtggtgcccgtcgtcaacgtgccgggcgtgaaggccggcgaactgacactgtcgggcccggtgctcggcgacatctacctcggcaagatcacgaagtggaacgaccccgccatcaccgcactgaacccgaaggtcaagctgtcggatacggacatcgctgtagttcgccgcgccgacggttcgggcacgagcttcatctggacgaactacctgtcgaaggtgaacggcacatggaagtcgaaggtcggcgaaggcacgacggtcaactggccgacgggcaccggcggcaagggcaatgacggcgttgcagcgttcgtgcagcgcctgccgggcgcgatcggctacgtcgaatgggcatacgcgaagaagaacaacatggtctacaccgcgctgaaaaactcgacgggcacggtggtcgagccgaagacggaaacgttcaaggccgctgcggcaggtgcgaactggtcgaagtcgttctaccagatcctgacggacgagccgggcaaagacgcgtggccggtcgtcggcgcgacgttcgtgctgctgcacgcaacgcaagagaaaccggcacaaggtgcagaaacgctcaagttcttcgactgggcatttcacaacggcaatcaggccgcctcggatctggactacatctcgcttcccgattccgtggtggccgaaattcgcaagcaatggaaagcgaaggtcaaggatgcctccggtaagccggttgcaaactga

SEQ ID NO: 15207 - protein, 341 aa, Burkholderia cepacia R18194
MNIRILIPCTLVLVALSAHAADITGAGSTFAAPIYAKWADAYKKSGGGKVNYQGIGSSGGLKQINAKTVDFAGSDAPLKDDELAKAGLFQFPTVVGGVVPVVNVPGVKAGELTLSGPVLGDIYLGKITKWNDPAITALNPKVKLSDTDIAVVRRADGSGTSFIWTNYLSKVNGTWKSKVGEGTTVNWPTGTGGKGNDGVAAFVQRLPGAIGYVEWAYAKKNNMVYTALKNSTGTVVEPKTETFKAAAAGANWSKSFYQILTDEPGKDAWPVVGATFVLLHATQEKPAQGAETLKFFDWAFHNGNQAASDLDYISLPDSVVAEIRKQWKAKVKDASGKPVAN

SEQ ID NO: 15208 - DNA, 915 bp, Burkholderia cepacia R18194
  CDS (1)..(915)
atgcaaaccgcgattgccggcctggctggcgcgcttttcgccgtcgccgctcacgctgccgacatcacgggcgcaggcagcacgttcgcgatgccgatctatacgaaatgggctgctgactaccagcagaccggcggcgcgaaggtcaactaccaaggtatcggctcgtcgggcggcctgaagcagatcgtcgcgaagacggtcgattttgccggttcggacgctccgctgaaggatgacgagcttgcaaaggaaggcctgttccagttcccgacggtggtcggcggcgtggtgccggtcgtcaacgtgccgggcgtgaaggccggtgaactgacgctgtcgggcccggtgctcggcgacatctacctcggcaagatcaagaagtggaacgacccggcgatcgccgcgctgaacccgaaggtcaagctgccggacacggacatcgccgtggttcgccgcgctgacggctcgggcacgagcttcatctggacgaactacctgtcgaaggtcaacgacgagtggaagtcgaaggtcggcgaaggcacgacggtcaactggccgacgggcacgggcggcaagggcaacgacggcgtcgcagccttcgtgcagcgcctgccgggcgcagtcggctacgtcgaatgggcgtacgcgaagaagaacaacatggtctacacggccctgaagaattcgacgggcacggtggtcgagccgaagacggaaacgttcaaggccgctgctgcaggcgcgaactggtcgaagtcgttctaccatgacgaaccagccgggcaaggaagcatggccggtcgtcggcgcgacgttcgtgctgctgcacgcaaagcaggacaagccggagcagggcgcggaaacgctgaagttcttcagctgggcgttcaagaacggcgagaaggctgctga

SEQ ID NO: 15209 - protein, 304 aa, Burkholderia cepacia R18194
MQTAIAGLAGALFAVAAHAADITGAGSTFAMPIYTKWAADYQQTGGAKVNYQGIGSSGGLKQIVAKTVDFAGSDAPLKDDELAKEGLFQFPTVVGGVVPVVNVPGVKAGELTLSGPVLGDIYLGKIKKWNDPAIAALNPKVKLPDTDIAVVRRADGSGTSFIWTNYLSKVNDEWKSKVGEGTTVNWPTGTGGKGNDGVAAFVQRLPGAVGYVEWAYAKKNNMVYTALKNSTGTVVEPKTETFKAAAAGANWSKSFYHDEPAGQGSMAGRRRDVRAAARKAGQAGAGRGNAEVLQLGVQERREGC

SEQ ID NO: 15210 - DNA, 1041 bp, Rubrivivax gelatinosus PM1
  CDS (1)..(1041)
atgaacgtttctctcctccgctccaccctcgcggcggtcgcgctgatcgccgtggccggcactgcctcggcgcaggacatcaccggcgccggcgcctccttcccggccccggtctattcgaagtgggccgatgcgtacaacaaggccaccggcgcgcgcctcaactaccagtcgatcggttcgggcggcgggatcaagcagatcaaggccaagacggtcgatttcggtgcgtccgatgcgccgctgaaggacgaagagctggccaaggacggcatggtgcagttcccgaccgtgatcggcggcgtggtcccggtcgtcaacatcaagggcatcgccccaggccagatgaagctgaccggccaggtgctgggtgacatctatctggggaagatcaccaagtggaacgaccccgcgatcgccgcgctcaacgccggcgtgacgctgcccgatgcctcgatcgccgcggtgcgccgcgccgacggttcgggcaccaccttcctgttcacgaactacctgtccaaggtcaacgcggaatggaagaccaaggtcggtgaaggcaccgcggtcaactggccgaccggcgctggcggcaagggcaacgagggcgtgtcggctttcgtgcagcgtctgccgaactcgatcggctatgtcgagtacgcgtacgccaagcagaacaagatgtcgcacgtgatgctgaagaacagggacggccagttcgtcggtccggacgaagacaacttcaaggccgccgccgccggcgcggaatgggcgaagagcttctaccaggtcctgaccgagcagccgggcaaggaagcctggccgatcaccggcgcgaccttcatcctgatgcacaagtctcaggacaagcccgagagtgcctccaacgcgctgaagttcttcgagtgggcctacagcagcggcgacaagatggcggccgacctcgactacgttccgatgcccgacaccgtcaagacgatgatccgcaagctgtgggcggacaacatcaaggacgcctccggcaaggccgtcgcctacaagtga

SEQ ID NO: 15211 - protein, 346 aa, Rubrivivax gelatinosus PM1
MNVSLLRSTLAAVALIAVAGTASAQDITGAGASFPAPVYSKWADAYNKATGARLNYQSIGSGGGIKQIKAKTVDFGASDAPLKDEELAKDGMVQFPTVIGGVVPVVNIKGIAPGQMKLTGQVLGDIYLGKITKWNDPAIAALNAGVTLPDASIAAVRRADGSGTTFLFTNYLSKVNAEWKTKVGEGTAVNWPTGAGGKGNEGVSAFVQRLPNSIGYVEYAYAKQNKMSHVMLKNRDGQFVGPDEDNFKAAAAGAEWAKSFYQVLTEQPGKEAWPITGATFILMHKSQDKPESASNALKFFEWAYSSGDKMAADLDYVPMPDTVKTMIRKLWADNIKDASGKAVAYK

SEQ ID NO: 15212 - DNA, 1110 bp, Pseudomonas fluorescens PfO-1
  CDS (1)..(1110)
atgttcaagcgcactctgatcgcagcttccctgaccgtcgctgccctggcttccgcccaggccatggccgccaacgtaaccggtggtggcgcgactctgcctgccgctctgtacaaaggttctgccaacagcatcctgccagccaacttcagctacctgggtaccggtagcggcaccggcaagaccgctttcctgaccaacaactcggcactgttcaacaccaccggttcggttcacttcgccggtagcgactcgatcctcagcgcttcggaaatcagcacctacaacaccaacttcggcgcttcgtacggcccgctgattcaactgccttcggtggctacttcggttgccattccgtacaaaaaatccggtcagaccgctctgaacctgaccagcgctcagctgtgcgacgccttctccggcgccaaaaccacctggggcgctctgctgggcacttccgacaccacgccgatccgcgttgtttatcgcaacgtttccagcggcaccacggaaatcctgacccgtcacctgaactcgatctgcccgaccaagttcgccaccaactccaccttcgccagcgctcgtctgccagccggttcgaccctgcctacgacctgggtaggcgttgccggtactgctgacgtggccactcaagtcaacgccgttgacggctccatcggttacgttggtccggacggtgtgaacgccgccagcaacgccgtggttgctcgcgtcaacggcgtacagccaaccaccgccaacgtttcgctggcactgggttcggcgactctgccaaccgcgccttcgaaccctgcccagtgggtaccggtcgttcctaacccagccagcggttacccgatcgtggcttacaccaacttcatcttcggccagtgctacaaggacgcaaccgtggccgctgacgtcaaatccttcctgaccactcactacagcaacccgggcaacaacgctgccaccatcgctcacagcttcactccggttccaaccaactggaaagcggccgtgactgccaacttcatcaccaacacctcgggcaacaacctggacatcaacaacgccagcgtctgcaacgctgtcggccgtcctttgtaa

SEQ ID NO: 15213 - protein, 369 aa, Pseudomonas fluorescens PfO-1
MFKRTLIAASLTVAALASAQAMAANVTGGGATLPAALYKGSANSILPANFSYLGTGSGTGKTAFLTNNSALFNTTGSVHFAGSDSILSASEISTYNTNFGASYGPLIQLPSVATSVAIPYKKSGQTALNLTSAQLCDAFSGAKTTWGALLGTSDTTPIRVVYRNVSSGTTEILTRHLNSICPTKFATNSTFASARLPAGSTLPTTWVGVAGTADVATQVNAVDGSIGYVGPDGVNAASNAVVARVNGVQPTTANVSLALGSATLPTAPSNPAQWVPVVPNPASGYPIVAYTNFIFGQCYKDATVAADVKSFLTTHYSNPGNNAATIAHSFTPVPTNWKAAVTANFITNTSGNNLDINNASVCNAVGRPL

SEQ ID NO: 15214 - DNA, 1014 bp, Burkholderia fungorum LB400
  CDS (1)..(1014)
ttgaccggtgtggtcggcgctctattggcggtcacggcgcacggcgccgacattgccggcgccggcagcaccttcgccgcgccgatttatacgaaatgggccggcgcataccagcaggcaggcggcggcgcggtgagctatcgcgctgtcgggtcgaccgaaggcgtgaaggaaatcatggagagccaggtcgatttcgccgggtcggacgcgccgttgagcgacgacgaacttgccaggaacggcttgctccagtttccaatggtgatcggcggggtcgtgccggtcgtcaatctgcccggtatcaagcccggtgagttgattctctccgggcgtgtgctcgcggatatctacctgggcaaaatcatcaactgggacgcgccggccattgccgccatcaatcccaggatcaagctgccggatacgcctatcgccgttgtccgccgccttgacggttccggtaccacgctgatctggacgcactatctcgcgcaggccaattctgaatggaagagccggatcggcgaagggacttcggtgcgctggccacgcggtataggcggaagaggtaatgaaggggtggccactttcgtccagcatttgccaggtgcgatcggctacgttgcgtgggatttcacgaagcagaaccatatgtcgtacacggcgatggaaaatgcctcgggtgccgtggttcagcctggaccggagacattcaaggcggccgccgcgagcgcggactggtccagatctcttttcccaatcctgaccaatgagccgggcgcgaacgcgtggcctgtggtcggtgcgacatatgtactgcttcacagtacgcagaacaaaccggagcgcggcgaggcgacactgaagttcctggagtgggcgctgaccaacggcgaccaggctgcggaggatctggactatgtgccgctgccgccgccggtggtgagcgaaattcgcacgcagttgcatgcgcgggtgaagaatccgtcgggtaaggcaattgccggcgaatga

SEQ ID NO: 15215 - protein, 337 aa, Burkholderia fungorum LB400
MTGVVGALLAVTAHGADIAGAGSTFAAPIYTKWAGAYQQAGGGAVSYRAVGSTEGVKEIMESQVDFAGSDAPLSDDELARNGLLQFPMVIGGVVPVVNLPGIKPGELILSGRVLADIYLGKIINWDAPAIAAINPRIKLPDTPIAVVRRLDGSGTTLIWTHYLAQANSEWKSRIGEGTSVRWPRGIGGRGNEGVATFVQHLPGAIGYVAWDFTKQNHMSYTAMENASGAVVQPGPETFKAAAASADWSRSLFPILTNEPGANAWPVVGATYVLLHSTQNKPERGEATLKFLEWALTNGDQAAEDLDYVPLPPPVVSEIRTQLHARVKNPSGKAIAGE

SEQ ID NO: 15216 - DNA, 1026 bp, Burkholderia fungorum LB400
  CDS (1)..(1026)
atgaatctcaagcaacttacgctgattctatgtgcgttgtgtgccagcgccgcgcacgccgcagacatcaccggcgcgggcagcacctttgccgcgccgatttacacgaagtgggccgacgcctatcagaaaacgggcggcggcaaagtcaattatcagggtattggttcgtcgggcggcatcaagcagatcctcgccaagacggtggacttcgccggctcggacgccccgctgaaagacgacgaattagccaaagacggcctgttccagtttcccacggtggttggcggcgtggtgcctgccatcaacgtgccgggactgaaggcgggcgaactggtgctgtcgggtgaagtactcggcgacatctatctgggcaagatcaagaagtggaacgatccccagatagccgcgttgaacccgaagatcaagttgccggatacggacattgccgtggttcgccgtgccgatggttcgggtacgagcttcatctggacgaactacctgtccaaggtgaatccggagtggaaatccaaagtgggcgaaggcgcgacggtgaactggcctaccggcactggcggcaagggtaacgacggcgtcgccgcattcgttcagcgcctgccgggcgcgataggctatgtcgaatgggcgtatgcgaagcagaaccacatgacctacgcctcgatgaaaaatgcttcgggcaccatagtcgagccgacaaccgacaccttcaaggccgcagcggcgggcgccgactggtcgaagtcgttctatcagatcctgacgaacgagccgggcaagaacgcgtggcccgtggtcggcgcaacattcgtgctgctgtatacgacgcaggacaaagcagcgcaaggcgccgaaacgctgaagttcttcgattgggcgttcaggaacggcggcaaggcagccgacgatctcgactatatttcgctgccggaatcggtaacggctgaaatccgcgcgcagtggaagcagaaggtgaaggacgcgtcgggcaagccggtcgcgccataa

SEQ ID NO: 15217 - protein, 341 aa, Burkholderia fungorum LB400
MNLKQLTLILCALCASAAHAADITGAGSTFAAPIYTKWADAYQKTGGGKVNYQGIGSSGGIKQILAKTVDFAGSDAPLKDDELAKDGLFQFPTVVGGVVPAINVPGLKAGELVLSGEVLGDIYLGKIKKWNDPQIAALNPKIKLPDTDIAVVRRADGSGTSFIWTNYLSKVNPEWKSKVGEGATVNWPTGTGGKGNDGVAAFVQRLPGAIGYVEWAYAKQNHMTYASMKNASGTIVEPTTDTFKAAAAGADWSKSFYQILTNEPGKNAWPVVGATFVLLYTTQDKAAQGAETLKFFDWAFRNGGKAADDLDYISLPESVTAEIRAQWKQKVKDASGKPVAP

SEQ ID NO: 15218 - DNA, 1032 bp, Burkholderia fungorum LB400
  CDS (1)..(1032)
atgaaattgatgcaaaccgtgttcgctggcgtcgctggcgcgcttttcgcgatcgcagcgcaagccgcagacatcaccggcgcgggcagcaccttcgcagcaccgatttacacgaagtgggctgacgcctaccagaagtccggtggcggcaaggttaactatcagggcatcggttcgtcgggcggcgtgaagcagatcgtcgcgaagaccgtcgacttcgccggttcggacgctccgctgaaggacgacgagctcgccaaggaaggcctgttccagttcccgacggtggtcggcggcgtggtgccggtcgtcaacgtgccgggcgtgaagccggctgaactgacgctgtcgggcgaagtgctcggcgacatctacctgggcaagatcaagaagtggaacgatccggcgatcgttgcgctgaacccgaaggtcaagctgccggataccgacatcgccgtggtccgccgcgccgatggttcgggcaccagcttcatctggacgaactacctgtcgaaggtcaacgcagactggaagtcgaaggtgggtgaaggttcgacggtcaactggccgacgggcacgggcggcaagggcaacgacggcgtcgcggccttcgtgcaacgtctgccgggcgcaatcggctacgtggaatgggcgtatgcgaagcagaaccacatgacgtacgtcgcactgaagaactcgtcgggtgcagtggtcgagccgaagacggacacgttcaaggcagcggcagcaggcgcggactggtcgaagtcgttctaccagatcctgacgaacgagccgggcaagaacgcatggccgatcgtcggcgcaacgttcgtgctggttcacacggcacaggacaagccggcgcaaggcaccgaaacgctgaagttcttcgactgggcattcaagaacggcacgcaagccgcgaacgatctggactacatctcgctgccggattcggtcgtgtcggaaatccgcacgcagtggaagtcgaaggtgaaggacacgtcgggcaaggcaatcgccgagtaa

SEQ ID NO: 15219 - protein, 343 aa, Burkholderia fungorum LB400
MKLMQTVFAGVAGALFAIAAQAADITGAGSTFAAPIYTKWADAYQKSGGGKVNYQGIGSSGGVKQIVAKTVDFAGSDAPLKDDELAKEGLFQFPTVVGGVVPVVNVPGVKPAELTLSGEVLGDIYLGKIKKWNDPAIVALNPKVKLPDTDIAVVRRADGSGTSFIWTNYLSKVNADWKSKVGEGSTVNWPTGTGGKGNDGVAAFVQRLPGAIGYVEWAYAKQNHMTYVALKNSSGAVVEPKTDTFKAAAAGADWSKSFYQILTNEPGKNAWPIVGATFVLVHTAQDKPAQGTETLKFFDWAFKNGTQAANDLDYISLPDSVVSEIRTQWKSKVKDTSGKAIAE

SEQ ID NO: 15220 - DNA, 1119 bp, Thermobifida fusca
  CDS (1)..(1119)
atgaagctcattaggtacggcaagatcgcgggcgtgaccctcgccagcgcccttgcgctctccgcctgcggcagtgaccaggcagtcgctcccgaggagaccggcggcacggccgcgggcagtgtcgactgtgtccaaggcggcgggaccctggccggagccggcgccagctcccaagaaaaggcgatggcggcgtgggtcgctgcgtacaccagcgcctgcgcggacaccaccgtcaactacgactcggtgggctccggtgccggacgctcccagttcatcgagggcgccgtctccttcgccgggtccgactccccgatggacgaagaggagaccgcgcaggccaccgagcgctgcggcggctccgaagccgtccacctgcccgcctacatcagcccgatcgccatcatcttcaacctcgagggcgtcgactcgctcaacctgcgccccgaggtgatcgctgacatcttcaaccagaagatcaccaagtggaacgacgaggcgatcgccgcggacaaccctgatgtcgacctccccgacgccgacatcatcccggtcaaccgctccgacgagtccggcaccaccgagaacttcgtgcagtacctgtccgaggccgcccccgaccactggccgcacgaagtcagcggtgactggccgattcccccggtcgaagccgcccagggatcctctggcgttgtctccgctgtccaaggcggtaccgggacgatcggctacgtcgacgcctcgcacgccacggaattcggcaccgtggccgtcggcgtgggcgacagcttcgtcccctacagcccggaggccgccgcagcgatcgtcgactccgcagaaccgcgggaaggcaacaccgaaaacgacctggcagtcagcctcaactacgccaccgacgaggacggcgtctacccgatcgtgctcgtcagctacgagatcgtgtgcctggagtacgaggaccagaccgaagccgacctggtgaagagcttcatcggctacgtgatcagcgaagagggccagcaggccgccgctaacgaagccggctctgcgccgctctccgatgccacccgcgacaagatccaagccgtactggacaagatccaggttgcgagctga

SEQ ID NO: 15221 - protein, 372 aa, Thermobifida fusca
MKLIRYGKIAGVTLASALALSACGSDQAVAPEETGGTAAGSVDCVQGGGTLAGAGASSQEKAMAAWVAAYTSACADTTVNYDSVGSGAGRSQFIEGAVSFAGSDSPMDEEETAQATERCGGSEAVHLPAYISPIAIIFNLEGVDSLNLRPEVIADIFNQKITKWNDEAIAADNPDVDLPDADIIPVNRSDESGTTENFVQYLSEAAPDHWPHEVSGDWPIPPVEAAQGSSGVVSAVQGGTGTIGYVDASHATEFGTVAVGVGDSFVPYSPEAAAAIVDSAEPREGNTENDLAVSLNYATDEDGVYPIVLVSYEIVCLEYEDQTEADLVKSFIGYVISEEGQQAAANEAGSAPLSDATRDKIQAVLDKIQVAS

SEQ ID NO: 15222 - DNA, 1056 bp, Thermobifida fusca
  CDS (1)..(1056)
ttgacactggtagccgggtgcggcagcgacaacgcggtacgcggcggcgcgcagatcccggtgcccgaagacctggagtgtttcgacggcgccattcgcggcgccggctccagtgcccaggaactggccatgcaggtgtggatctccgcactccagaccgcctgcgacgatgcgcggatctactacgacgcgatcggctcaggcggcggacggaaccagttcatcgacggcgcggtggacttcgccgggtccgacgcggccatggacgaaggcgaacaggaggaggcccgccagcgctgcgactccgacgtcatccacctgcccgcctacgtggtaccgatcgcggtggccttcaacctggagggcatcgactcgctcaacctgacccccgacacgcttgcccgcctgttcagcggcgacatcacccggtggaacgacccggcgatcgcggagaccaaccccgacgtcgacctccccgaccttcccgtggtcccggtcagccgttcagacgagtccggcactacggagaacttcacggcctacctggcggctgctgctcctgacgcatggcctcacgaccctgacgggcagtggccctttcccccggtggaagccgggcagggcaacagcggcgtggcccaggcgatccgtggcggtcagggcacgatcggctacctggaggcgtcccacgctgaaggcatggccacggtccgcgtgggctcgggggacagcttcgtcgccccgtcgccggagtctgcggcacggatcgtatcggtctccccgcggcgggacagcaccaccccgcacgaccacgccatggagttggactactccgctaccgaagccgacgcctaccccatcgtgctggtcagctacgagatcgcctgcctgtcgtacgcggacgccgccaccgcggagggagtgcgcaccttcctgtcctacctgctcagcgcggaaggccaggaagcagcgtctcaggaatccgggtcggctccgctcgacgcggaactgcgcgcagagctgctggagtccgtggcggcgatcggcacccactga

SEQ ID NO: 15223 - protein, 351 aa, Thermobifida fusca
MTLVAGCGSDNAVRGGAQIPVPEDLECFDGAIRGAGSSAQELAMQVWISALQTACDDARIYYDAIGSGGGRNQFIDGAVDFAGSDAAMDEGEQEEARQRCDSDVIHLPAYVVPIAVAFNLEGIDSLNLTPDTLARLFSGDITRWNDPAIAETNPDVDLPDLPVVPVSRSDESGTTENFTAYLAAAAPDAWPHDPDGQWPFPPVEAGQGNSGVAQAIRGGQGTIGYLEASHAEGMATVRVGSGDSFVAPSPESAARIVSVSPRRDSTTPHDHAMELDYSATEADAYPIVLVSYEIACLSYADAATAEGVRTFLSYLLSAEGQEAASQESGSAPLDAELRAELLESVAAIGTH

SEQ ID NO: 15224 - DNA, 867 bp, Oenococcus oeni PSU-1
  CDS (1)..(867)
atgaagaaatggttagtgagtttacttgcgttggcagctattggcggtgcgtcattgacgagcgctaatctgggtacaagcgccttcgcagcttctaagtcaaagttgactggaaaggtcttagctgttggttcaacagcacttcagcccctcgccgaacaactcggtgagcgtttttcaagtgcgaattcttcagtccaaatcacggttcaaggtggtggctctggtgccggcttaacacaagttcaagctggctcggtccaaattggtgattcggatatctttgcttctcaagaagatggaattgatcctagtaagattgtcgatcacaaggttgctgttattggaattgcgcccgtggtcaataaggacgttggtgtaaagagtttgacgaaaagtcagttaaagaagatttttaccggtaaagttacaaattgggaccaagtcggtggtaaagatcaaaagatcgatttaattaatagagcttctggttctggtacacgtaccgtttttgaaaatgctattttaggcaatgcaactgctgcaagttctcaggaacaagacagtaacggaacggtccagaagattgtttcaaccactccaggcgctatctcttatttggcttttagttatattaaaggtcaaagtggtttaaaagcacttaaaattaatggtgtttccccaaccaataaaaatgttgaaaacaacaagtggaaagtctggggttatgagcatatgtacaccaagggcaaagcgaccggtgctaccaaagcttttatcaattatttctacaaatctagtaacaaaagtttaattaaaaaacttggttatattcctttgccaagtatgaaagtcgttaaacgataa

SEQ ID NO: 15225 - protein, 288 aa, Oenococcus oeni PSU-1
MKKWLVSLLALAAIGGASLTSANLGTSAFAASKSKLTGKVLAVGSTALQPLAEQLGERFSSANSSVQITVQGGGSGAGLTQVQAGSVQIGDSDIFASQEDGIDPSKIVDHKVAVIGIAPVVNKDVGVKSLTKSQLKKIFTGKVTNWDQVGGKDQKIDLINRASGSGTRTVFENAILGNATAASSQEQDSNGTVQKIVSTTPGAISYLAFSYIKGQSGLKALKINGVSPTNKNVENNKWKVWGYEHMYTKGKATGATKAFINYFYKSSNKSLIKKLGYIPLPSMKVVKR

SEQ ID NO: 15226 - DNA, 1077 bp, Trichodesmium erythraeum IMS101
  CDS (1)..(1077)
atgaaattttgtataaatctttctaggataactcatcttactgcaaaagtatctgccgttgtcctaacaattggtttaacagcttgtagtagtagtgatcttggaagttctcaagtaagccttttaggtgcgggagcttcttttccatcacctatatatcaacgttggtttcaagacttggggaacagtggcctaaacctacaagtagattatcagtcagtaggtagcggcgctggtgttgagagatttactcaagaactagtagattttggtgcttctgacgtcgcaatgaaagatgaggaaatttccaaagtaaaccgaggagttatcctgctaccaatgactgcaggtagtattgttttagcttacaacttgccgaatgtttctaatctcaaactttccagggaagcttatgtagatatccttttgggtaaaattaaaaaatggaatgacccgaagatcaaagcaattaaccctggcgtaactctcagagatcaaaaaattacagttatatatcgctctgatggtagtggtacaactggagttttcacaaagcatttgagtgctattagtccagaatggaaacagacagtaggggaaggtaaaaccgttcaatggcctgtaggtattggtggtgccaagaacgatggtgtaactgctcaaattactcaaactgaaggagcaataggatatgttgagtatggttatgctaagaatgctggtttgaatatggcttccctacaaaacaaatctggtaaatatataaatcctacttttgaatcagcagaagcaactttaggagcagttgcactacctgaaaatttacgagcttttattagtgacccagaaggggataattcttatccaattgtaacttacacttggattcttgcctatagtaaatatgatgacgcagccaaagctcaaggtgtggaaaaaatgattgaatatggtttaaatgaaggtcaaaaagttagttctgagttaggttatattcctttacctaagaatgtacgtcaaaaagttctagaaactgcggataaaattagtcaagattacaacatgaccctcaaatag

SEQ ID NO: 15227 - protein, 358 aa, Trichodesmium erythraeum IMS101
MKFCINLSRITHLTAKVSAVVLTIGLTACSSSDLGSSQVSLLGAGASFPSPIYQRWFQDLGNSGLNLQVDYQSVGSGAGVERFTQELVDFGASDVAMKDEEISKVNRGVILLPMTAGSIVLAYNLPNVSNLKLSREAYVDILLGKIKKWNDPKIKAINPGVTLRDQKITVIYRSDGSGTTGVFTKHLSAISPEWKQTVGEGKTVQWPVGIGGAKNDGVTAQITQTEGAIGYVEYGYAKNAGLNMASLQNKSGKYINPTFESAEATLGAVALPENLRAFISDPEGDNSYPIVTYTWILAYSKYDDAAKAQGVEKMIEYGLNEGQKVSSELGYIPLPKNVRQKVLETADKISQDYNMTLK

SEQ ID NO: 15228 - DNA, 1086 bp, Trichodesmium erythraeum IMS101
  CDS (1)..(1086)
atggtatttagtcttaattttcgtcagataatttgtaatacttctaaattctctgcagtagccttaaccattggtctagttactacaattgctggagttaagtacagtctcgctaaacaaagagtcaaccttataggtgcaggtgcatcttttccagctccactataccaacgttggtttagtgatatgagaaataataattttgaggttcaagtagattatcaatcagttggtagtggtgctggtgttgaaagatttactcaaggactagtagatttcggtgcttctgatgtggcaatgaaagatagtgaaatagccaaggtctctcgaggagttatgatgctgcccatgactgcaggtagtgttgtattggcttacaatttaccaggtatatccgacctgaagttatccaggaaagtttatgtagatatccttttgggtaggattaagaattggaatgactcagaaattgctactattaattccggtgtaaatttgccagatctaccaattaccgtagtttatcgttccgatggtagtggaactacaggagtgtttacaaagcatctaaattctattagtcaggagtggaaaaagaaagtaggagaaggtaaaactgttcagtggcctgtaggcataggtggccaaaaaaatgatggcgtaagtgctttaattcgtcaaacaaaaggtgctataggttacgtagagtttggttttgctaaaaatgctaaacttaatactgcagctttagagaataaatctggtaattatattaaggcttctttagagtctgctaagtctactctagcagcagtaaaattacctaaaaatctccgtgcttttattagtgacccagaaggtagtaattcttatcctattgttacttatacttggatgctaatttataatcaatataatgatgcagctaaagctcagggtatagaaaaaatgattgaatatggattaaatgaagggcaaaaggtaagtgctgatttaggttatattccactacctaacaatgttcgtcaaacagttgcggcagctgcagataaaatcagctctagccatcaaattagccttaagtaa

SEQ ID NO: 15229 - protein, 361 aa, Trichodesmium erythraeum IMS101
MVFSLNFRQIICNTSKFSAVALTIGLVTTIAGVKYSLAKQRVNLIGAGASFPAPLYQRWFSDMRNNNFEVQVDYQSVGSGAGVERFTQGLVDFGASDVAMKDSEIAKVSRGVMMLPMTAGSVVLAYNLPGISDLKLSRKVYVDILLGRIKNWNDSEIATINSGVNLPDLPITVVYRSDGSGTTGVFTKHLNSISQEWKKKVGEGKTVQWPVGIGGQKNDGVSALIRQTKGAIGYVEFGFAKNAKLNTAALENKSGNYIKASLESAKSTLAAVKLPKNLRAFISDPEGSNSYPIVTYTWMLIYNQYNDAAKAQGIEKMIEYGLNEGQKVSADLGYIPLPNNVRQTVAAAADKISSSHQISLK

SEQ ID NO: 15230 - DNA, 870 bp, Streptococcus suis 89/1591
  CDS (1)..(870)
atgaaaaaaaagcagaagcttggaattgcagctttgtttcttttgagtagtatggctctttctggttgttcttcttggatcgatcgaggagagtctattacagccgtaggttcgacggcgcttcaaccacttgttgaggcagcagcagatgaatttggtagtgtcaatatcggtaaatccgtcaacgttcagggtggtggatcaggtactggcttgtcacaagttcagtctggagctgttcagattggtaactctgacgtatttgctgaggaaaaagatggtattgatgcaagtaaacttgttgaccatcaagtagcagtagctggtttggccgttattgtaaatgagcaggtatcggttaaagatattactacagaagatctgcgtaaaatttttactggtgagattaccaactggaaagaactaggtggtaaggatttggaaatttcaatcattaaccgtgcagctagttcaggttcacgtgcgacctttgatagtgttatcatggatggacaaaccgcaactcagagtcaagaacaagattctaacggtatggtaaaatctattgttgctcagacaccaggtgcaatttcctacctatcatttgcttatctagatgattccgttaaaacaattaagttaaacggttttgaaccaactgctgaaaatgtagcaacaaatgattggccaatttggtcctatgagcatatgtatacgatgggaaaagcgactgatttgacagaagaatttttagattacatgatgtcagatgaagttcaaaatggtatcgttgaaagtatgggatacatttctatcaacgatatgaaagttgtgaaaagtgctgatggcacggtgactgagaaggagtaa

SEQ ID NO: 15231 - protein, 289 aa, Streptococcus suis 89/1591
MKKKQKLGIAALFLLSSMALSGCSSWIDRGESITAVGSTALQPLVEAAADEFGSVNIGKSVNVQGGGSGTGLSQVQSGAVQIGNSDVFAEEKDGIDASKLVDHQVAVAGLAVIVNEQVSVKDITTEDLRKIFTGEITNWKELGGKDLEISIINRAASSGSRATFDSVIMDGQTATQSQEQDSNGMVKSIVAQTPGAISYLSFAYLDDSVKTIKLNGFEPTAENVATNDWPIWSYEHMYTMGKATDLTEEFLDYMMSDEVQNGIVESMGYISINDMKVVKSADGTVTEKE

SEQ ID NO: 15232 - DNA, 1026 bp, Thiobacillus denitrificans ATCC 25259
  CDS (1)..(1026)
atgttcggttcgaaacacctgtatttcaagcttgccggggcggcggccgccgtcgcgatgagcgttgcggccttgccggcgctggccgtcgacatcaccggcgcgggggcgaccttcccctacgccgtctacactaaatgggcggaagcctacaaggccgcttccggcaaccaggtcaactaccagggcatcggctcttcggggggcgtcaagcagatcaaggccaagaccgtcgacttcgcaggcaccgacgcgccggtcaaggaaagcgatctcgatgccgcgcatctggttcagtttcctaccgtcatgggcggcgtgaccatcgtcgtcaacctgcctggcgttgcctcggggcagctcaagctcgacggcgccaccgccgccgacatcttccgcggcacgatcaccaagtggaacgacccgcgcatcgccaagctcaaccccggcgtcaagctgcccggcacggcgatcacgatttcgcatcgctcggacggctccggcactaccttcgtcttcaccaactatctcgccaagcagtcggccgatttcaagcgtgacgtcggcgccggcaacaccgtcaactggcccgccaatgccgtcggcggcaagggcaacccgggcgtcgcggcgaacgtgatgaagatcccaggtgcgatcggctacgtcgacatcgccgacgcgatgaagaacaagatgactttcgttgcgctgaagaacaaggccggcaattacatcgtcccgaaccaggacgcggtcgccgacgccgctgcgggcgcgaacttccacgtccgcggcatggcgcccgacctgctcgaccagtcgcacaagaacgcctggccgatcacctcggcgacctacgtgctcgcctacgagcaggccgacgcgacgaagcagaaggcggtcgtcgatttcttcaagtggtcgctcaacaatgggcagaaaatggccgaggaactcggtttcgtcgccttgccgccgaacgtcgtcaagatggtcgaagccgaaatgaagaacatcaagtga

SEQ ID NO: 15233 - protein, 341 aa, Thiobacillus denitrificans ATCC 25259
MFGSKHLYFKLAGAAAAVAMSVAALPALAVDITGAGATFPYAVYTKWAEAYKAASGNQVNYQGIGSSGGVKQIKAKTVDFAGTDAPVKESDLDAAHLVQFPTVMGGVTIVVNLPGVASGQLKLDGATAADIFRGTITKWNDPRIAKLNPGVKLPGTAITISHRSDGSGTTFVFTNYLAKQSADFKRDVGAGNTVNWPANAVGGKGNPGVAANVMKIPGAIGYVDIADAMKNKMTFVALKNKAGNYIVPNQDAVADAAAGANFHVRGMAPDLLDQSHKNAWPITSATYVLAYEQADATKQKAVVDFFKWSLNNGQKMAEELGFVALPPNVVKMVEAEMKNIK

SEQ ID NO: 15234 - DNA, 1131 bp, Brevibacterium linens BL2
  CDS (1)..(1131)
atgttctcatattcgaaaggcatcttcgtgaagctgaagcacctggcaccctccgctgcaatcctcgcagtcggcgcactcaccctgtcggcatgcggcggaacctccgccaccggagaggaagcaagcagcggtggcgacagcgacctgcagggcaccctcaccggcatcggcgcttcatcgcagaaggctgcgatggacgcatggaccgccgacttcgcctcggagaactccggcgtgaccgtcaactactcccccgatggctcgggtgcaggccgcgagcagttcctggctggcaacgctcagttcgccggctctgacgctcacctcgacgatgacgaagtcgagcagggcaaagaagcttgcggcgccgatggagcctacgagttccccgtctacatctccccgatcgcggtggcgttcaacgtcgagggcgtcgacgaactcaacctctcccctgcaacgatcgccaagatcttcaagggcgaaatcagcacgtggaacgacgaggcaatcaaggccgataacccggatgctgatctgcctgacacgaagatcaccgccgtgcaccgttccgatgactccggcaccacggagaacttcgccgagtacctcaaggccacagccgagaaggactgggacgctgaggtcagcggagacttcccgaaggacttcggtggcgaagctgcacagggcaccgatggtgtcgtgcagaccgtttccgacaccgatggagccatcggctacgccgacgcttccgctgtcggttcactgggcaaggccaaggtgaaggtcggcgaggaattcgtcgagctctccgccgatgccgcctcgaaggtcgtcgacgcttccgagaaggtcgaaggccgcagcgaaggcgacctcgccttcgatctggctcgcgacaccaccgagtcgggcgcctacccgatcgtcctcgtgtcctaccacgtcgtctgctcgtcctacaaggaccaggagaccgtggacatggtcaaggcctgggagaagttcgtcgtctccgaagaaggacagaagtcggcagcggattccgctggctcggctccactgtctgacgacctgcgttcgcagatcgaaacagtcatcgattcgatcaaggttgaaggctga

SEQ ID NO: 15235 - protein, 376 aa, Brevibacterium linens BL2
MFSYSKGIFVKLKHLAPSAAILAVGALTLSACGGTSATGEEASSGGDSDLQGTLTGIGASSQKAAMDAWTADFASENSGVTVNYSPDGSGAGREQFLAGNAQFAGSDAHLDDDEVEQGKEACGADGAYEFPVYISPIAVAFNVEGVDELNLSPATIAKIFKGEISTWNDEAIKADNPDADLPDTKITAVHRSDDSGTTENFAEYLKATAEKDWDAEVSGDFPKDFGGEAAQGTDGVVQTVSDTDGAIGYADASAVGSLGKAKVKVGEEFVELSADAASKVVDASEKVEGRSEGDLAFDLARDTTESGAYPIVLVSYHVVCSSYKDQETVDMVKAWEKFVVSEEGQKSAADSAGSAPLSDDLRSQIETVIDSIKVEG

SEQ ID NO: 15236 - DNA, 1023 bp, Deinococcus geothermalis DSM 11300
  CDS (1)..(1023): transl_table=11
atgaagaagtttttccttctgggcctgattctcaccggcacggctgcggcacaaacgaccatcacgggtgcgggcgcttcttttccctatcccctctacagcaagatgttcgccgaatacaagaacgccaccggcgtcaatgtgaactatcagtcggtggggagtggtgccggtcagaagcagattctggagcgcacggttgactttgcgggctcggacaaccccatgagtgatgagaccctcaaaagtgctccggcgcccctgctgcacattcccaccgccattggtgcggtggtacccgcctacaacctgccgggcgtgacccagcccctgaagtttaccgggcgggtgctggccgacatctacctgggcaagatcaagaactggaacgacaaggccatcgccgcgctgaatcctggtgtgaccctgccgccgctgcccatcacggtcgctcgccgcagcgacggttcaggcacgacctacgtcttctcggactacctgagcaaagtgtcgccggagtggaaaagcaaggtgggcgtgggcaacagcctccagtggccggtagggacaggcgcgaagggcaatgacggcgtggcgggcgttgtgaagagtacccccggcgcgattggctacgtggaactggtgtatgccaagcagaacaaactgacctttgggagcgtgcagaaccgcgccgggaaatttgtgctggccgataatggcccggctgcggccgccgcgctgggtgtggtgattcctgccgacacccgcgtgagcctgaccaacagcgcgaacgcagaggcttaccccattgccagcttcacctacgtgatcttctatcaggaccaaaagtacgggaaccgcaccgaagcgcaggccaaggccctcaagaatctgctgacctggatggtcactaccgggcagcagtacaacgaggggctggattacgccaagctgcccgccaatgtggtcaataaggccaagagcatcatcaattcgatgacctacggcggcaagcggctctga

SEQ ID NO: 15237 - protein, 340 aa, Deinococcus geothermalis DSM 11300
MKKFFLLGLILTGTAAAQTTITGAGASFPYPLYSKMFAEYKNATGVNVNYQSVGSGAGQKQILERTVDFAGSDNPMSDETLKSAPAPLLHIPTAIGAVVPAYNLPGVTQPLKFTGRVLADIYLGKIKNWNDKAIAALNPGVTLPPLPITVARRSDGSGTTYVFSDYLSKVSPEWKSKVGVGNSLQWPVGTGAKGNDGVAGVVKSTPGAIGYVELVYAKQNKLTFGSVQNRAGKFVLADNGPAAAAALGVVIPADTRVSLTNSANAEAYPIASFTYVIFYQDQKYGNRTEAQAKALKNLLTWMVTTGQQYNEGLDYAKLPANVVNKAKSIINSMTYGGKRL

SEQ ID NO: 15238 - DNA, 819 bp, Anaeromyxobacter dehalogenans 2CP-C
  CDS (1)..(819): transl_table=11
atgaagcgcatgctgctcgccctcgccgcggtcgtcgcggtggtcccggccctcgcctccgccgccgtgaccgtgaagggctccgacacgatggtgatcctcgcccagcgctgggccgaggactacatgaacaagaaccccggcaagaaggtgcaggtcaccggcggcggctccggcaccggcatcgcggcgctcatcaacggcaccaccgacatcgcgaacgcgtcgcgctcgatgaagtcggacgagaagggcaaggtccgcgagcgctacagcgtgctcccgaccgagatcccggtcgcccaggacggcgtggcgctgtacgtgaacgaggcgaacccggtgagccagctcaccatcgaccagctgcaccagatctacgtgggcgacgtcaccaactggaagcaggtgggcgggcccgaccagcgcatcgtcctctactcccgcgagaactcctcgggcacctacgtgttcttcaaggagcacgtgctgaagggcgacgactacgccccggccgcgcagacgctccccggcaccgccgcggtggtgaacgcggtcgcgaaggagaagggcggcatcggctacggcggcgccgcctacgccaagggggtgaaggaggtcaaggtggtgggcgccgacggccaggcgtacgcgcccagcgcggagaacgtgaagagcgggaagtacccgctggcccgcccgctgttcatgtacacgcgcgccaagccggccggcgaggtgaaggcgttcatcgactactgcctctcgcccgagggccagcagctcgtcaccaaggtcggctacttcccgatcaagtag

SEQ ID NO: 15239 - protein, 272 aa, Anaeromyxobacter dehalogenans 2CP-C
MKRMLLALAAVVAVVPALASAAVTVKGSDTMVILAQRWAEDYMNKNPGKKVQVTGGGSGTGIAALINGTTDIANASRSMKSDEKGKVRERYSVLPTEIPVAQDGVALYVNEANPVSQLTIDQLHQIYVGDVTNWKQVGGPDQRIVLYSRENSSGTYVFFKEHVLKGDDYAPAAQTLPGTAAVVNAVAKEKGGIGYGGAAYAKGVKEVKVVGADGQAYAPSAENVKSGKYPLARPLFMYTRAKPAGEVKAFIDYCLSPEGQQLVTKVGYFPIK

SEQ ID NO: 15240 - DNA, 1122 bp, Arthrobacter sp. FB24
  CDS (1)..(1122): transl_table=11
gtgaaggcactccgcttcggccgccacgcggctatcgctgtcatcgcagccggcgcactcgcgctcaccgcctgcggttccgacaacgccacgaatacggcacagtccggcgccccgtctgccacgggagcgaaggtcaccggcacgctgaccggcatcggttcctccgcccagggtgcagccatggacgtatggaagaccaacttcgcatccgcaaaccagggtgccaacgtgcagtactccccggatggctccggcgccggacgcaaggccatcatcgacggttcggcccagttcgccggttccgacgcctacctcaaggacgaggagctcgccagctccaaggaaaagtgcggccccgagggtgcgatcaacattccggtgtacatctccccgatcgccatcgccttcaacattccggatgtcaaggaactgaagctggatgccgccaccgtggccaagatcttccgcggcgaaatcgccaactggaacgatcccgcgatcgcagcaatgaacccggacgccaagctgccggacctcaaggtcacgccggtcaaccgttccgatgactccggcaccaccagcaacttcaccgattacctggccgccgcagctcctgaggtctggaccgacaaggctgccggcgtctggcccgcatccctgaagggcgagaacgccaagggcacctccggcgtggtcaagaccgtcaccgacaccccgggcgccgtaacctacgccgatgactcggccgtcagcggcaagcttggcatcgcccaggtcaaggtgggcgataccttcaccaagatctccgccgaggctgcggccaaggccgtggacgccggcaagcccgttgaaggccgttccgccaacgacctgtccatcaagctggaccgcaagaccaccatcgagggcgcctacccggttgtcctggtctccttccacgtggtctgctccacctacgccacccaggaaaccgttgacctggtgaaggccttcgaaaactacgtggtttccgacgccggccagcaggctgcagcagacgccgcgaagtccgctcccctctccaaggaactccaggagaaggctgccaaggccatcgagaccatcaaggtcaagtcctag

SEQ ID NO: 15241 - protein, 373 aa, Arthrobacter sp. FB24
MKALRFGRHAAIAVIAAGALALTACGSDNATNTAQSGAPSATGAKVTGTLTGIGSSAQGAAMDVWKTNFASANQGANVQYSPDGSGAGRKAIIDGSAQFAGSDAYLKDEELASSKEKCGPEGAINIPVYISPIAIAFNIPDVKELKLDAATVAKIFRGEIANWNDPAIAAMNPDAKLPDLKVTPVNRSDDSGTTSNFTDYLAAAAPEVWTDKAAGVWPASLKGENAKGTSGVVKTVTDTPGAVTYADDSAVSGKLGIAQVKVGDTFTKISAEAAAKAVDAGKPVEGRSANDLSIKLDRKTTIEGAYPVVLVSFHVVCSTYATQETVDLVKAFENYVVSDAGQQAAADAAKSAPLSKELQEKAAKAIETIKVKS

SEQ ID NO: 15242 - DNA, 1026 bp, Burkholderia vietnamiensis G4
  CDS (1)..(1026): transl_table=11
atgcaaaccgcgattgctggcctggctggcgcacttttcgcagttgctgcgcacgctgccgacatcacgggcgcaggcagcacgttcgctatgccgatctatacgaaatgggctgccgactaccagcagtcgggcggcgcgaaggtgaactaccaaggtatcggctcgtcgggcggcctgaagcagatcatcgcgaagacggtcgattttgccggctcggacgctccgctgaaggatgaggacctcgcgaaggacggcctgttccagttcccgacggtggtcggcggcgtggtgccggtcgtcaacgtgccgggcgtgaaggccggcgaactgacgctgtcgggcccggtgctcggcgacatctacctcggcaagatcaagaagtggaacgacccggcgatcgccgcgctgaacccgaaggtcaagctgccggatacggacatcgcggtcgtgcgccgcgccgacggctcgggcacgagcttcatctggacgaactacctgtcgaaggtcaacgatgagtggaagtcgaagatcggcgaaggcacgacggtcaactggccgacgggcacgggcggcaagggtaacgacggcgtcgcggcgttcgtgcagcgcctgccgggcgcgatcggctacgtcgaatgggcgtacgcgaagaagaacaacatgatctacaccgccctgaagaactcgacgggcacggtggtcgagccgaagacggaaacgttcaaggccgctgcagccggcgcgaactggtcgaagtcgttctaccagatcctgacgaaccagccgggcaaggaagcatggccggtcgtcggcgcgacgttcgtgctgctgcacgcgaagcaggacaagccggagcagggcgccgaaacgctgaagttcttcagctgggcgttcaagaacggcgagaaggcagcggacagcctcgactacatctcgctgccgccggcagtcgaagcggaaatccgcaagcagtggaagaccaaggtgacggacgcagcgggcaagccggtcgccaccgagtaa

SEQ ID NO: 15243 - protein, 341 aa, Burkholderia vietnamiensis G4
MQTAIAGLAGALFAVAAHAADITGAGSTFAMPIYTKWAADYQQSGGAKVNYQGIGSSGGLKQIIAKTVDFAGSDAPLKDEDLAKDGLFQFPTVVGGVVPVVNVPGVKAGELTLSGPVLGDIYLGKIKKWNDPAIAALNPKVKLPDTDIAVVRRADGSGTSFIWTNYLSKVNDEWKSKIGEGTTVNWPTGTGGKGNDGVAAFVQRLPGAIGYVEWAYAKKNNMIYTALKNSTGTVVEPKTETFKAAAAGANWSKSFYQILTNQPGKEAWPVVGATFVLLHAKQDKPEQGAETLKFFSWAFKNGEKAADSLDYISLPPAVEAEIRKQWKTKVTDAAGKPVATE

SEQ ID NO: 15244 - DNA, 1335 bp, Burkholderia vietnamiensis G4
  CDS (1)..(1335): transl_table=11
atgaaatccagcaagcgcaagatctgtcaggtcctggctctcgtcgtcgcgggcatgggcgcatcggtggcgatggccgccggcccggtgattcagggcggcggctcgtcgctcgtcgcaccgacgatcggcgccgtgtcgccggcgtccggtgaaatcggcctgttcggcacgtccgaaggcacgttcacgtactactcggtcggctcgggcgccggccagaacgcgttcctgaacaaccagccgaccttcttcggctcgggcgtgaccggcacggtgcatttcgccaacagcgatgccgcgctcacgaccgctcaggtcagcgcgtacaacaacacgggcctcggcaccagcaacggcccgctgatccagatcccgtacatcgtgacggccatcacggtgccggtcgtcaacggccctgccgtgacgagcacgacgacgccgcaaacgacgccgggtcaggcgcacagcgtcgcgctgaacgacgacgacctgtgcggcatcttctcgggcaagctgacgaactggaaccaggtcaccaacccggaaaccggctcggcctatccgctgaacaaggcgatctcggtcgtctaccgtgcggacggcagcggcacgaccgaactgctgacccgccatctgcacgcggtttgcacgacggccaataccaagaccggcgtgtcgttcgtcgattcgctgacgttcgcgaacacggtcgcattcccgtccggcgtgccggcgaacttcgtcgcggcgtcgggcagcggcggcgtgcgcgcttcgctcgcgtcgttgtcggctgccggtacggccgccgtcgcgtatctgagcccggactacacgaacacgttcctcgcgtcgcaaagctcggtcgtcacgtcgtcgggcgcgctgcaactgccgatcgcgagcctgtacaacacggcggccaaggcgtactacgccccgacgtatacgaacgccaagacggcgctcggcacgatcgctccgccttcgggcattgccgccagcgatccgaccaactgggtgccggtgtcgggctcggcgtataccgcattggcgaaccctgcatccggttatccggtctccggcacgagccagatcatcctgagccagtgctatgcgaacggcgccgcggctacggcgatccacgacttcctcaacaaccactacacgaacgcgagctacgcgtcggtcgtgcacggcaacggcttcgacaccgttccgtcgagcttccagaccgcgatttccgcgaacttcctgagcaactcgagcggcaacttcctcgacatcaacgactcgaccatctgcggttcgggtggctacgcgggccggtaa

SEQ ID NO: 15245 - protein, 444 aa, Burkholderia vietnamiensis G4
MKSSKRKICQVLALVVAGMGASVAMAAGPVIQGGGSSLVAPTIGAVSPASGEIGLFGTSEGTFTYYSVGSGAGQNAFLNNQPTFFGSGVTGTVHFANSDAALTTAQVSAYNNTGLGTSNGPLIQIPYIVTAITVPVVNGPAVTSTTTPQTTPGQAHSVALNDDDLCGIFSGKLTNWNQVTNPETGSAYPLNKAISVVYRADGSGTTELLTRHLHAVCTTANTKTGVSFVDSLTFANTVAFPSGVPANFVAASGSGGVRASLASLSAAGTAAVAYLSPDYTNTFLASQSSVVTSSGALQLPIASLYNTAAKAYYAPTYTNAKTALGTIAPPSGIAASDPTNWVPVSGSAYTALANPASGYPVSGTSQIILSQCYANGAAATAIHDFLNNHYTNASYASVVHGNGFDTVPSSFQTAISANFLSNSSGNFLDINDSTICGSGGYAGR

SEQ ID NO: 15246 - DNA, 1026 bp, Burkholderia cenocepacia AU 1054
  CDS (1)..(1026): transl_table=11
atgcaaaccgcgattgccggcctggctggcgcgcttttcgccgtcgccgcccacgctgccgacatcacgggcgcaggtagcacgttcgcgatgccgatctatacgaaatgggctgcggactaccagcagtccggcggttcgaaggtcaactaccagggcatcggctcgtcgggcggcctgaagcagatcgtcgcgaagacggtcgattttgccggttcggacgctccgctgaaggatgaagaactcgcgaaggaaggcctgttccagttcccgacggtggtcggcggcgtggtgccggtcgtcaacgtgccgggcgtgaaggccggcgaactgacgctgtcgggcccggtgctcggcgacatctacctcggcaagatcaagaagtggaacgatccggcgatcgccgcgctgaacccgaaggtcaagctgccggatacggacatcgccgtggtccgccgcgctgacggctcgggcacgagcttcatctggacgaactacctgtcgaaggtcaacgacgagtggaagtcgaagatcggcgaaggcacgacggtcaactggccgacgggcacgggcggcaagggcaacgacggcgtcgcggccttcgtgcagcgtctgccgggcgcgatcggctacgtcgagtgggcgtacgcgaagaagaacaacatgacctacactgcgctgaagaattcgacgggcacggtggtcgagccgaagacggaaacgttcaaggccgcagcagcaggcgcgaactggtcgaagtcgttctaccagatcctgacgaaccagccgggcaaggaagcgtggccggtcgtcggcgcgacgttcgtgctgctgcacgcgaagcaggacaagccggagcagggcgcggaaacgctgaagttcttcagctgggcgttcaagaacggcgagaaggctgccgacagcctcgactacatctcgctgccggcgacggtcgagacggaaatccgcaagcagtggaagacgaaggtgacggacgcttcgggcaagccggtcgccgccgagtaa

SEQ ID NO: 15247 - protein, 341 aa, Burkholderia cenocepacia AU 1054
MQTAIAGLAGALFAVAAHAADITGAGSTFAMPIYTKWAADYQQSGGSKVNYQGIGSSGGLKQIVAKTVDFAGSDAPLKDEELAKEGLFQFPTVVGGVVPVVNVPGVKAGELTLSGPVLGDIYLGKIKKWNDPAIAALNPKVKLPDTDIAVVRRADGSGTSFIWTNYLSKVNDEWKSKIGEGTTVNWPTGTGGKGNDGVAAFVQRLPGAIGYVEWAYAKKNNMTYTALKNSTGTVVEPKTETFKAAAAGANWSKSFYQILTNQPGKEAWPVVGATFVLLHAKQDKPEQGAETLKFFSWAFKNGEKAADSLDYISLPATVETEIRKQWKTKVTDASGKPVAAE

SEQ ID NO: 15248 - DNA, 1044 bp, Polaromonas sp. JS666
  CDS (1)..(1044): transl_table=11
atgaaattgagtttcaaagcttctgcgactgctgtgatgggtgttgccatcatgtcgtttgccacgttgtcggccgcgcaggatgtcacgggcgctggagccagtttccccgctccgctgtattccaaatgggctgctgactacaacaaggccaccagcatcaagattaattaccagtcggtcggctctggcgcgggtttgcggcagattgaggccaagaccgtggactttggcgcatcagacgctcccctgaaggatgaagagctcgccaaaaaagggctggtgcagtttccgaccgtgattggtggcgtggttcctgtggtcaatatcaagggcgtcgctccgggccaactgaagctgagcggtcaggtcctgggtgacatctacctgggcaagatcaccaagtggaccgaccccgccatcaaggcgatgaatcctgcactggccttgccggatgcggccatcgcgccggtccgccgagctgatggttcaggtaccagcttcattttcaccaattatttgagcaaggccaacgccgagtggaaggccaaagtgggtgaaggtacggcggtgaactggccggcgggtgctggcggcaagggtaacgagggcgtcgcggcgtttgtcggtcgcctgcccaactcgattggctatgtggagtacgcctatgtcaagcagaacaagatgacgtttgtccagctgaagaatgctgccggcaatttcgtgtcgccggatgatgcggcattcaaggctgctgctgcaggcgccgactggtccaagagtttttaccagatactgactgagcagcccggcaaggatgcatggcctatcacgggcgccacctttatcctgatgcagaaggcgcaggacaagcccgcgcaggccgctgcctcgctcaaattcttcgagtgggcctataagaacggcgacaagatcgctgacgacctggactatgtgcccatgcccgccagcgtgaagacgatcatcgaaaaatcgtgggctgacatcaaggacacgtcgggcaaggctgttgcttacaaataa

SEQ ID NO: 15249 - protein, 347 aa, Polaromonas sp. JS666
MKLSFKASATAVMGVAIMSFATLSAAQDVTGAGASFPAPLYSKWAADYNKATSIKINYQSVGSGAGLRQIEAKTVDFGASDAPLKDEELAKKGLVQFPTVIGGVVPVVNIKGVAPGQLKLSGQVLGDIYLGKITKWTDPAIKAMNPALALPDAAIAPVRRADGSGTSFIFTNYLSKANAEWKAKVGEGTAVNWPAGAGGKGNEGVAAFVGRLPNSIGYVEYAYVKQNKMTFVQLKNAAGNFVSPDDAAFKAAAAGADWSKSFYQILTEQPGKDAWPITGATFILMQKAQDKPAQAAASLKFFEWAYKNGDKIADDLDYVPMPASVKTIIEKSWADIKDTSGKAVAYK

SEQ ID NO: 15250 - DNA, 1080 bp, Polaromonas sp. JS666
  CDS (1)..(1080): transl_table=11
atgaagaaaaatttattcgctattttcacggccttcacggccgttttgttttttgcgcaggccggcgctgcctcggctgagacgatttccggcgccggatcttcggctgccgcacccatctaccaggcttgggctcgcgcctaccagaaatcgacaggtgcggccctggcctatgagccggttggctcgtccgccggcctgaagaaaattcgtgcccatgagacgggtttcggcgcctcggacgtcgcgcccaccgaggccgagctggccgcgagcgggctgcttgtcttccccgttgcgattaccggcatctcgccggtcgtgaatttgcccaaggtaggggacggccagttgcgattgaccggcgaggtccttgcgcgcatctttctgggcgagatcacgcagtggaatgcggccgagatcgtgcagctgaacccgggcctgaagctgcccgatctgccggtcaaggtggtggtgcgcggtgacggctccggaaccacctacaacttcgccgactatctggccaagctgagccccacctggaaagccaaatacggggtcaagaccagtgtcgattggccggccacctttgtggcggtcaagggcagcgacgctgtcgtcaaaaacgtcagggaaacggttggcacgatcggctatgtggaccacggctacgtcagggaccataagctcacgacggtgcagctgaagaacctcgacggcgagtttgtcagcccgtccatcgtcgcgtttcgggccgcgctttccagcagcgaatgggccagcaccggatcgtttaccagcacgctgaccaacaaggccggcaaggcaacatggccgatcaccatgggcaccttcgcgcttgtgcctaaggttgcggaccagcccgcccaaaccctgcccgcgctcaggttcttcgtgtgggcgtttctcaatggcgacgcactggtccaggaaaacaacttcgtgcggcttcccgatcgtgtgcaggccacggcgttcaaggcgatcacgtccgtaaaggacaaggcgggtaacgccattgccatggggctgatgacttcttccggctcggctcgctag

SEQ ID NO: 15251 - protein, 359 aa, Polaromonas sp. JS666
MKKNLFAIFTAFTAVLFFAQAGAASAETISGAGSSAAAPIYQAWARAYQKSTGAALAYEPVGSSAGLKKIRAHETGFGASDVAPTEAELAASGLLVFPVAITGISPVVNLPKVGDGQLRLTGEVLARIFLGEITQWNAAEIVQLNPGLKLPDLPVKVVVRGDGSGTTYNFADYLAKLSPTWKAKYGVKTSVDWPATFVAVKGSDAVVKNVRETVGTIGYVDHGYVRDHKLTTVQLKNLDGEFVSPSIVAFRAALSSSEWASTGSFTSTLTNKAGKATWPITMGTFALVPKVADQPAQTLPALRFFVWAFLNGDALVQENNFVRLPDRVQATAFKAITSVKDKAGNAIAMGLMTSSGSAR

SEQ ID NO: 15252 - DNA, 1149 bp, Crocosphaera watsonii WH 8501
  CDS (1)..(1149): transl_table=11
atgttcacaactgtgaaatcaagtaaacgcaccataataacatccctatcaattctgagtttagcggtcagtttgggagcttgtggtggcggttcttctgatactggcactgcccctagtggtggtggtaaccaaggcacaactacagctttaaaccctcccctagatggtgatgtggctttaactggtgccggtgcctctttcccagcccccctatatcaaaactggtttgtgcaactcaacacagcagtccccaaattaaaagttaactatcagtccgttggtagtggtgctggtgtggaacagtttacccaaggaaccgttgactttggggctagtgatgtggccatgacagacgaagaaattggcaaaatcgaaagaggaacaattttactccccgtcactgctggtagtatcgtgatggcttataacttacctggattagagggactgaaactctcaagagacgcttacgttggtattttcaaaggggatattaccaactggaatgatcccaaaattgctgaagctaaccctgatttagaactaccaaatcaaccaatcaccgtagttcaccgttccgatggtagtggtaccactggggtatttaccaagcatctcagttctatcagcccagaatgggaagcttccattggtcaaggtaaaagtgtggaatggcctacaaacaaaggtaaatttattggtggtaaaggaaacgaaggggtaaccgcttctattcaacagaatcaaggttctattggctacattgagtatggttacgccaaacaaaatagtatccctgtagcaaccctacaaaattcctctggtaactttattgttcctaccgatgacagtgcttcggcaactttagacgctgttaccctacctgagaatttacgggcatttatcaccgatcccgaaggagataattcttatcccatcgttacctacacttggattttagcctacgaaaactacgacgacccccaaaaggcgatcgcagtagaaagcatgatccaatacgctttaaccgaaggacaagaacaaagcaaggcattaggttatgttcccttacctcctagtgtgagagaaaaagtagctgctgctgctgatgtcattagtcctgattatgaaattaaattgaactaa

SEQ ID NO: 15253 - protein, 382 aa, Crocosphaera watsonii WH 8501
MFTTVKSSKRTIITSLSILSLAVSLGACGGGSSDTGTAPSGGGNQGTTTALNPPLDGDVALTGAGASFPAPLYQNWFVQLNTAVPKLKVNYQSVGSGAGVEQFTQGTVDFGASDVAMTDEEIGKIERGTILLPVTAGSIVMAYNLPGLEGLKLSRDAYVGIFKGDITNWNDPKIAEANPDLELPNQPITVVHRSDGSGTTGVFTKHLSSISPEWEASIGQGKSVEWPTNKGKFIGGKGNEGVTASIQQNQGSIGYIEYGYAKQNSIPVATLQNSSGNFIVPTDDSASATLDAVTLPENLRAFITDPEGDNSYPIVTYTWILAYENYDDPQKAIAVESMIQYALTEGQEQSKALGYVPLPPSVREKVAAAADVISPDYEIKLN

SEQ ID NO: 15254 - DNA, 1029 bp, Geobacter metallireducens GS-15
  CDS (1)..(1029): transl_table=11
atgctcaaagcattacggaaaagtctcgcgatcctcgcgactctggcagtaaccgccgcggccggccaggccggtgcggaaaccctcatcaacggcgcaggcgccaccttcccctacccgctctactccaagtggttcagcgagtacgccaagatcgatccctcggtgaaattcaactaccagtccatcggcagcggcggcggcatcaagcagatcactgcccagaccgtcgacttcggcgccagcgacaagttcctgagcgatgcggaactgaaggcggcccccggcaagctcctccacattccgaccgtcatgggtgcggtcgtcgtaacctacaaccttccgggcgctccgaaggggctgaagctcaaggctgaagacgtggccgacatcttcctcggcaagatcagcaagtggaacgatccgcgcatcgcagacgacaaccccggcgtcaagcttcccaatagcccgatcatcgtcgtgcaccgctccgacggcagcggcaccaccagcatcttcaccgacttcctctccggcgtgaaccaggagtgggccaagaaggtcggcaaaggtgcctcggtcaagtggcccatcggcctcggcggcaaggggaacgagggtgttgccggccagatcaagaccactgcaaactccatcggctatgttgagcttgcctatgccttcgagaacaagctcccctacgcgaccctcaagaacaagagcggcagctgggtagtcccctccatccagacgacgagcgcagcggcagccgcagccgtcaaacacatgccggctgattaccggatctccctggtgaaccagccgggcaaggacgcctaccccatcgtcggcttcacctggctcctcgtgtacgaaaagcagaaagacgccgtcaaagggaaaaagctggtggaattcctgaactggagcctccgcaacggccagaagatggcagcaccgctcctctacgcgccgctccccgagaacgtcaagaagatggtggagaagaccatcaagaccgtcaagtaa

SEQ ID NO: 15255 - protein, 342 aa, Geobacter metallireducens GS-15
MLKALRKSLAILATLAVTAAAGQAGAETLINGAGATFPYPLYSKWFSEYAKIDPSVKFNYQSIGSGGGIKQITAQTVDFGASDKFLSDAELKAAPGKLLHIPTVMGAVVVTYNLPGAPKGLKLKAEDVADIFLGKISKWNDPRIADDNPGVKLPNSPIIVVHRSDGSGTTSIFTDFLSGVNQEWAKKVGKGASVKWPIGLGGKGNEGVAGQIKTTANSIGYVELAYAFENKLPYATLKNKSGSWVVPSIQTTSAAAAAAVKHMPADYRISLVNQPGKDAYPIVGFTWLLVYEKQKDAVKGKKLVEFLNWSLRNGQKMAAPLLYAPLPENVKKMVEKTIKTVK

SEQ ID NO: 15256 - DNA, 930 bp, Moorella thermoacetica ATCC 39073
  CDS (1)..(930): transl_table=11
gtgctgagtaaaggtaaatggctggcgatcttagtgattgccctggtggcggtactggctgtagcgggctgcggtaagaaagagttcccggctccccagcagggtagcagccagcaaaacagcaaccagcagtccggcgggagcggcgccataacagcagcgggttctacggccctgcaacccctggtagatgaagcggccaagcagtatatggaaaagaacccgggtgttcgcatcgtcgtcaacggcggcggcagcggtaacggcctctctcaggtgttccagggtgccgtccagataggcaactccgatatctttgccgaggaaaaggacggtatcgacgcctcccaactggtggatcacaaggtagccgttgtgggcatggcggccgttgttaatcctgacgtcaaagtggacaaccttacccagcagcagcttattgacatctttaccggtaaaattaccaactggaaagacgtcggcggtcctgaccagaagatcaacatcgtcaaccggcccaagggttccggtacccgggcgacctttaaaaaatatgccttaaacggtgcggaagaagcccagggtatcgccatggagcaggatgcctccggtaccgtgcgcaagaccattgccgaaaccccaggcgctatcggctacctggctctctcctacattgattccagcgtccagcccctcaaaattgacggggttgaacctacggcagccaatattgtggacaacaagtacaaggtctgggcatacgagcatatgtacaccaaaggccagccgacgggggaagtcaagaaattcctggatttcataatgagcgacgaagtccagaagaacctggtaaccaagatgggctacatccccgtaaccgacatgaaggttgaacgcgacgcccagggaaatgtgactcccaagaagtag

SEQ ID NO: 15257 - protein, 309 aa, Moorella thermoacetica ATCC 39073
MLSKGKWLAILVIALVAVLAVAGCGKKEFPAPQQGSSQQNSNQQSGGSGAITAAGSTALQPLVDEAAKQYMEKNPGVRIVVNGGGSGNGLSQVFQGAVQIGNSDIFAEEKDGIDASQLVDHKVAVVGMAAVVNPDVKVDNLTQQQLIDIFTGKITNWKDVGGPDQKINIVNRPKGSGTRATFKKYALNGAEEAQGIAMEQDASGTVRKTIAETPGAIGYLALSYIDSSVQPLKIDGVEPTAANIVDNKYKVWAYEHMYTKGQPTGEVKKFLDFIMSDEVQKNLVTKMGYIPVTDMKVERDAQGNVTPKK

SEQ ID NO: 15258 - DNA, 873 bp, Pelodictyon phaeoclathratiforme BU-1
  CDS (1)..(873): transl_table=11
atgattaaccaaatttttcagtttattcttactaactcaatgataacaatcactatgaaactttttaaaaaaatacttttaagtgcgactgttttcggtctcatggcttcaggcactgcacaggctgctggtaaaatcgttatcgacggttcaaccacagtaggaccaatcgccaaagccttcgccgatcactataccaaaacaaccggtgtacaggtatccgtcagtgagtcgggttcaggcaacggcgcaaaaagcctgatcaacaaaacctgtgacatcgcaaccatgtcaagagcaatgaaagaccaggaactggctgccgccagaagcaaaggcgtcaatcccgtcgaacatgtcgtcgcgcttgatggtctctcaattgttgtgcatccgagcaatcgcatcaatgcgctcaccaaagcacagatccgcggtatttacatgggcaaatacaccaactggagccaggttggtggaccaaattctgcaatcgtgattatccagcgtgaatcgaacagcggtactgccgacacatttaaagagctcgttatgggcaaagataacccgatttccaagagagcagagacccagtcaagcaacggcgccatcaagagccgtgtagcatcaacaccttctgcgatcagctatatcggactcggttttgttgactcgtcggtcaaggctgttctggttgatggaatcgaagctgatgtcaagaccgtcaagaacaacacgtacccgatccatcgtccgcttttcatgtacaccaatggccagccaacaggcgctgtcaagcagttcattgatctgccaaaaactgctgaagggaaacgcatcatcagcgagaccggttttgtgaacgtctattaa

SEQ ID NO: 15259 - protein, 290 aa, Pelodictyon phaeoclathratiforme BU-1
MINQIFQFILTNSMITITMKLFKKILLSATVFGLMASGTAQAAGKIVIDGSTTVGPIAKAFADHYTKTTGVQVSVSESGSGNGAKSLINKTCDIATMSRAMKDQELAAARSKGVNPVEHVVALDGLSIVVHPSNRINALTKAQIRGIYMGKYTNWSQVGGPNSAIVIIQRESNSGTADTFKELVMGKDNPISKRAETQSSNGAIKSRVASTPSAISYIGLGFVDSSVKAVLVDGIEADVKTVKNNTYPIHRPLFMYTNGQPTGAVKQFIDLPKTAEGKRIISETGFVNVY

SEQ ID NO: 15260 - DNA, 819 bp, Prosthecochloris aestuarii DSM 271
  CDS (1)..(819): transl_table=11
atgaagatgctgaaaaaactctttatgctctttactgtgcttagctttgcagctgcagggccggttcaggctggagatgctattgtcatggacggttctactacggtaggtccgatcgctaaatcatttgccgcgtactttaccaagaaatacggtgttcaggtcacggtcagtgagtctggcagcggtaacggtgcaaaaagtatcatcaatggtgcttgtgatatcgccaacatgtctcgcggtatgaaggatgctgaggttgcagcagcaaagagcaaaggcgttgatcctgtttctcacgttgtcgctcttgacggtattgccgtcgtcgttcatccgagcaactttgtcaatgcactctcaaaagctcagattatggacatctaccgcggcaaggttaccaactggagccaggtcggcggaccttcagccaatatcgttgtgatccagcgtgaatcgaacagcgggacccaggactctttccgctcgctggttatcggtaaaggcaataccattaccaagagagctgaaacgcaggccagcaacggtgctgtcaagagccgtgtttctacaacaccggcagctatcggttttatcggcctcggttttgtagatgattctgtcaaagctcttaacgtcgatggtgttactccaagcgttgaaaccgtcaaaagcggtcagtatccggttgcccgccctcttttcatggtgaccaatggagagccgaccggcaatgtcaagaagttcatcgatcttccgaaaactgccgacggtaagcagatgatcagtgaacttggtttcgttaacaaatactga

SEQ ID NO: 15261 - protein, 272 aa, Prosthecochloris aestuarii DSM 271
MKMLKKLFMLFTVLSFAAAGPVQAGDAIVMDGSTTVGPIAKSFAAYFTKKYGVQVTVSESGSGNGAKSIINGACDIANMSRGMKDAEVAAAKSKGVDPVSHVVALDGIAVVVHPSNFVNALSKAQIMDIYRGKVTNWSQVGGPSANIVVIQRESNSGTQDSFRSLVIGKGNTITKRAETQASNGAVKSRVSTTPAAIGFIGLGFVDDSVKALNVDGVTPSVETVKSGQYPVARPLFMVTNGEPTGNVKKFIDLPKTADGKQMISELGFVNKY

SEQ ID NO: 15262 - DNA, 1002 bp, Ralstonia metallidurans CH34
  CDS (1)..(1002): transl_table=11
atgggcagacacatcgcggcgctggcgctgctattcgccgcggtcagtgcatttgccggagatgtcactggggctggttccacattcgtctacccgctgatggcgaaatgggcggccacgtattacgccaggacaggccggcagatcgattaccaacccatcggctcaggcaacggcatccggcagatcaaggcggcaagcatcacgttcggcaccacggacatgccgctcaaacccgaagagctcgagcgcgcaggactggcccagtttcccatcgcggtaggcggcgtcgtgccggtgatcaacctgcagggcattggcgcggggcagatccacatgacgggcgcgctgctggccgatatctatcgcggcaagatcgccaactggaacgatgcggccattgcgtcggccaatcccggcgtgcagtttcccgacctgaagatcacggtggtccatcgcagcgacggctcgggcaccacgttcaactggaccgactacctttccaaggtcagccccgaatggaaggcggcagtcggggcaggcaccacggtgcgttggcccatcgggatgaacgcgagcggcaatgagggcgtatcgctctatatccacaatattcgcggcgcgatcggctatgtggaactgacctacgcgctgcagaagagcctgccctatgcgttggtccagaaccgcgatggtctctacgtgaagccttcgcgcgaatcgttcagcgccgcggtgacggccgtggaatggaacccgcggctcgacttctatcaggtgctgaccaatgcgccgggcccgaacgcgtggccgatcacgggcacggtcttcgtgctgatgcagcgttccgccgcgcacccgtcgaatacgaaggatgcgctggcgttctttcagtgggcgcttgccgaagggcaatccgatgcgtcggccgagcactacgtggcactgccgccggaactggtgaagcaggtgatcgcgtactgggcggagaccttcaagtag

SEQ ID NO: 15263 - protein, 333 aa, Ralstonia metallidurans CH34
MGRHIAALALLFAAVSAFAGDVTGAGSTFVYPLMAKWAATYYARTGRQIDYQPIGSGNGIRQIKAASITFGTTDMPLKPEELERAGLAQFPIAVGGVVPVINLQGIGAGQIHMTGALLADIYRGKIANWNDAAIASANPGVQFPDLKITVVHRSDGSGTTFNWTDYLSKVSPEWKAAVGAGTTVRWPIGMNASGNEGVSLYIHNIRGAIGYVELTYALQKSLPYALVQNRDGLYVKPSRESFSAAVTAVEWNPRLDFYQVLTNAPGPNAWPITGTVFVLMQRSAAHPSNTKDALAFFQWALAEGQSDASAEHYVALPPELVKQVIAYWAETFK

SEQ ID NO: 15264 - DNA, 1032 bp, Ralstonia metallidurans CH34
  CDS (1)..(1032): transl_table=11
atgaagctagtcaagactgccgtagcaggcatcgtgtcgattgtggtggcgggtactgcgttcgcggcggaaattaccggtgctggcgcttccttcccggcgcctgtgtattccaagtgggctgatgcctaccaaaaagcaacgggcaacaaggtcaactatcaatctatcggctcgtcgggtggtatcaagcagattggcgccaagaccgtcgatttcggcgcttcggacgctccgctgaaggacgacgagctggcaaagggcaacctgatccagttcccgaccgtgatcggtggcgtggtgccggtgattaacctgcaaggcgtgaagccgggcgagctcatcatcacgggtgacgtgctggccaacatctacctgggcaagatcaagaagtgggacgatcccgcgatcaaggccctgaacccgaaggtccacctgccgagccaggacatcctgccggtgcgtcgtgccgacggctcgggcacgacgttcatcttcacgaactacctctcgaaggtcagtcctgactggaagaactcggtgggcgaaggcaccacggtgaactggccgggcggtggcacgggcggcaagggtaacgaaggcgttgccgccttcgtgcagcgtctgaatggcgccatcggctacgtcgagtatgcctatgccaagcagaacaagatgacgtacctgacgatgaagaactcggccggcgagatcgtcaagcctagcgacgaagccttcaaagcggccgctgccggcgctgactggagcaagtcgttctaccagatcctgacgaacgagccgggcaagaccgcatggccgatcgctggcgccaccttcatcctgctgcacaagacgcaggataaggcggcacaaggccaggaagtcatgaagttcttcgactgggcctacaagagcggtggcacgatggctgctgagctggactacgtaccgctgccggaatcggtcgtgaaccagattcgctcgacctggaagagcagcgtcaaggacggttcgggtaaggcactgtactaa

SEQ ID NO: 15265 - protein, 343 aa, Ralstonia metallidurans CH34
MKLVKTAVAGIVSIVVAGTAFAAEITGAGASFPAPVYSKWADAYQKATGNKVNYQSIGSSGGIKQIGAKTVDFGASDAPLKDDELAKGNLIQFPTVIGGVVPVINLQGVKPGELIITGDVLANIYLGKIKKWDDPAIKALNPKVHLPSQDILPVRRADGSGTTFIFTNYLSKVSPDWKNSVGEGTTVNWPGGGTGGKGNEGVAAFVQRLNGAIGYVEYAYAKQNKMTYLTMKNSAGEIVKPSDEAFKAAAAGADWSKSFYQILTNEPGKTAWPIAGATFILLHKTQDKAAQGQEVMKFFDWAYKSGGTMAAELDYVPLPESVVNQIRSTWKSSVKDGSGKALY

SEQ ID NO: 15266 - DNA, 1113 bp, Rubrobacter xylanophilus DSM 9941
  CDS (1)..(1113): transl_table=11
ttgagcggactcaagggttggaagctggtctgtgccggtttggcgctctcctcgctgctgcttgcgggctgcgccaccgtcgacgaggcctcgccccagcagggcggcggttccggaggcggctcgcagggggcggcccagcggataaacggcgccggggcctccttccccgcgcccttctactcggcggtcttccagcgcttcgcgcaggaggaggggatagaggtcaactaccagtccatcggctcgagcggcggtcgcgagcagttcatccagaagaccgtcgccttcggcgcctcggacgagccgatgagcgaggaggagatgcgggaggccgggggcaacccgctccacatcgccaccgtgggcggggcggtggtccccgtgtacaacatcgagggggtggacagcgggctcaacttcaccggccgggtgctcgccgacatctacctcggcaacatcacccgctggaacgacccggccatagcggagctcaacccgggcgtggagctgccggacgccaagatagcggtcgtccaccgctccgacggctcgggcaccaccaacatctggaccagctacctggccgcggtgagccccgagtggaagagcgggcccggcgcgggcggcgagataaagtggccgaccggcatcggcggcgacggcaacgagggcgtggccgggctcgtcaagcagacccccaactccatcggctacgtggggctggagtacgcggtgcagaacgagctggcctacggcgacgttggcgaggagggggccttcgtccggcccagcgtcgagagcgcccgggcggccatcgcggcggccggggacgagatcccggaggacctcaggttcaccatctcctcggccaacccgcagggcgagggggtctacccgatcacgggcctcacctggatcctcgtgcgccagcagatggacgacccggcgcagtgcagggccgtggcgcaggctgcctggtacctgacccacgaggggcagagcctcgctcccgacctcaactacgtgccgctcccggagaacatcgtctcccgggacgaggagctgatccggagcatggaggccgggggcgagaagtgctacgcgggctag

SEQ ID NO: 15267 - protein, 370 aa, Rubrobacter xylanophilus DSM 9941
MSGLKGWKLVCAGLALSSLLLAGCATVDEASPQQGGGSGGGSQGAAQRINGAGASFPAPFYSAVFQRFAQEEGIEVNYQSIGSSGGREQFIQKTVAFGASDEPMSEEEMREAGGNPLHIATVGGAVVPVYNIEGVDSGLNFTGRVLADIYLGNITRWNDPAIAELNPGVELPDAKIAVVHRSDGSGTTNIWTSYLAAVSPEWKSGPGAGGEIKWPTGIGGDGNEGVAGLVKQTPNSIGYVGLEYAVQNELAYGDVGEEGAFVRPSVESARAAIAAAGDEIPEDLRFTISSANPQGEGVYPITGLTWILVRQQMDDPAQCRAVAQAAWYLTHEGQSLAPDLNYVPLPENIVSRDEELIRSMEAGGEKCYAG

SEQ ID NO: 15268 - DNA, 891 bp, Enterococcus faecium DO
  CDS (1)..(891): transl_table=11
atgaaaaaagtattgtttactctaggtatgatgggaattcttttagccggatgcggctcaggatcaggaaatacagatggctctgccacacaaaataattcaagtgactcaaatgaacaagtaaaaatcgttgcggtaggttcgacagcattacagccgttagtcgatgcagcacaagaaagctttgtacaagaaaatccaaattatcaaatctctgtacaaggaggaggaagcggaactggtttgagccaagtcgaagctggagcagttactatcggaaactctgatgtatttgcagaagaaagagacggagttgatgcttcaaaattagtggatcataaagtagcagtggtcgggatggcaccaatcgtcaataaagatacagatgtcaaagatatcaccaaacaggaattgattgatatctttacaggaaaaatcactaactggaaggaagttggcgggaaagatcaaaaaatcaacgtcgtgaaccgtgcaaacggcagcggtacccgcgcgacattcgaaaaatggggactggatggtgctacccctgtgcagtcccaagaacaagattcatcaggaacagttcggcagctggtaagtcaaacaccaggagcaatcagctatttagctttctcatatctcgatgattccacacaagcactaagtatcgacggtgtagaaccaaaagaagagaatgtagcagataacagctggggaatctggtcatatgaacatatgtacacgaacggaaaaccttcccctgaagtccaaaaattcttagactacatgatgacagaagaaatccaagaaggacctgtcaaagaattgggctatttaccaatcacaatgatggaagtagaacgtgatcacgaaggaaatatcaaataa

SEQ ID NO: 15269 - protein, 296 aa, Enterococcus faecium DO
MKKVLFTLGMMGILLAGCGSGSGNTDGSATQNNSSDSNEQVKIVAVGSTALQPLVDAAQESFVQENPNYQISVQGGGSGTGLSQVEAGAVTIGNSDVFAEERDGVDASKLVDHKVAVVGMAPIVNKDTDVKDITKQELIDIFTGKITNWKEVGGKDQKINVVNRANGSGTRATFEKWGLDGATPVQSQEQDSSGTVRQLVSQTPGAISYLAFSYLDDSTQALSIDGVEPKEENVADNSWGIWSYEHMYTNGKPSPEVQKFLDYMMTEEIQEGPVKELGYLPITMMEVERDHEGNIK

SEQ ID NO: 15270 - DNA, 1113 bp, Kineococcus radiotolerans SRS30216
  CDS (1)..(1113): transl_table=11
gtgacgttctcgacagcctcccgcctcctcggcctcgccgccgtgggtgttctcgccctcgccggttgcggctccgacgacaacaccgcaggcagcacgaccgaaggctcggcctcgtcgtcggcttcgaccgccatcgactgcgcccccggcaccctgaacggcgaggggtccagcgcgcagaagaacgccatcgaccaggtcacccaggccggctaccaggcccagtgcaccgacgccacgatcaactacaacgcgaccggctccggcgcgggccgcaagcagttcacctccggccaggtcgactgggccggctcggactccgcgctcaaggaggaggaggtcgccgcggcgaccgcccgctgcgagggcaaccaggcctggaacctgccgatggtcgccggcccgatcgccatcgcctacaacgtcgacggcgtggacgacctcgtcctcgacgccgccaccgccgcgaagatcttctccggcaccatcaccacctggaacgacccggccatcgccgcgctgaaccccgacgcgacgctgcccagcaccgcgatcagcgtgttcttccgcaccggtacctccggcaccaccgagaacttcaccaagtacctgcacgccgcggcccccgaggcgtggaccgccgagggcaaccaggagtgggccggcaagggcgagggccgcgagggctccgccggtgtcgcgcaggccgtcgccggcgcccccggcggcatcacctacgtcgagtggtcctacgcccaggacaacaacctggccgtcgcccagatcgacaacggctccggcgccgtcgagctgaccggcgagtccgccggcaagaccgtcgccaccgccacccagaccggcaccggcaacgacctgtcgctgaagatcgactacgcgaccaaggaggcgggcgcctacccgatcgtcctggtcacctacgagatcgtctgctccaagggcctggacgccgagaagaccgccctgctgaagtccttcctcacctacttcgccgaggacgagacccaggagggcctgcaggagatcggctacgcgccgctccccgccgaggtctccgagaaggtccggaccgccatcgaagccatcgcctga

SEQ ID NO: 15271 - protein, 370 aa, Kineococcus radiotolerans SRS30216
MTFSTASRLLGLAAVGVLALAGCGSDDNTAGSTTEGSASSSASTAIDCAPGTLNGEGSSAQKNAIDQVTQAGYQAQCTDATINYNATGSGAGRKQFTSGQVDWAGSDSALKEEEVAAATARCEGNQAWNLPMVAGPIAIAYNVDGVDDLVLDAATAAKIFSGTITTWNDPAIAALNPDATLPSTAISVFFRTGTSGTTENFTKYLHAAAPEAWTAEGNQEWAGKGEGREGSAGVAQAVAGAPGGITYVEWSYAQDNNLAVAQIDNGSGAVELTGESAGKTVATATQTGTGNDLSLKIDYATKEAGAYPIVLVTYEIVCSKGLDAEKTALLKSFLTYFAEDETQEGLQEIGYAPLPAEVSEKVRTAIEAIA

SEQ ID NO: 15272 - DNA, 1026 bp, Nitrobacter hamburgensis X14
  CDS (1)..(1026): transl_table=11
atgagttttattaaggccatcgtcgccgccggcctcgttgccgcctcggcgtccgccttttcgcttccggcgagggcggccgacatcaccggtgcgggcgcgaccttcccgttcccggtctattccaaatgggccgatgcctacaagaaagagaccggcaatagcgtgaattatcagtcgatcgggtcgggcgccggcatcaagcagatcctcgccaagaccgtgaccttcggcgcgaccgacgcgccgctgaaggccgacaagctcgacaaggacggcctgctgcagtggccgatggtgatgggcgcgatcgtccccgtcgtgaacgtcgaaggcgtgacgcctggcgagttggtcctttcgggtgaactgctcggcgacatctatctcggcaaggtcaccaggtgggacgaccctgcgatcgcaaagctcaacccgaagctcaagctgccttcggccccgatcgcggttgtgcatcgttcggacgggtcgggcacctcgttcaacttcaccaattatctgtccaaggtgaacgccgagtggaaatccaaggtcggcgagggcactgcggtcgagtggccggcgggcgtcggcgccaagggcaacgaaggcgtctccggcaatgtcggccagaccaagaactcgatcggctatgtcgagtatgcctatgccaagcagaacaagctgacctacgccgcgctcatcaacaaggccggcaagatcgtgcagccgaccgtcgcctccttccaggccgcggccggcaacgccgactgggcgcacgcgccgggctactacgtgatcctgaccgatcagccgggcgaggcttcctggccgatcaccgcggcgacgttcatcctgatgcacaaggagccgatcgacaaaacggcctccgccgaagccatcaagttcttcaagtggtcgttcgagaagggcggcaagatggccgaggatctcgactacattccgatgccggaccaggtcttaaagcagatcgagaaaacctggacctccgagatcaagagctga

SEQ ID NO: 15273 - protein, 341 aa, Nitrobacter hamburgensis X14
MSFIKAIVAAGLVAASASAFSLPARAADITGAGATFPFPVYSKWADAYKKETGNSVNYQSIGSGAGIKQILAKTVTFGATDAPLKADKLDKDGLLQWPMVMGAIVPVVNVEGVTPGELVLSGELLGDIYLGKVTRWDDPAIAKLNPKLKLPSAPIAVVHRSDGSGTSFNFTNYLSKVNAEWKSKVGEGTAVEWPAGVGAKGNEGVSGNVGQTKNSIGYVEYAYAKQNKLTYAALINKAGKIVQPTVASFQAAAGNADWAHAPGYYVILTDQPGEASWPITAATFILMHKEPIDKTASAEAIKFFKWSFEKGGKMAEDLDYIPMPDQVLKQIEKTWTSEIKS

SEQ ID NO: 15274 - DNA, 873 bp, Burkholderia mallei FMH
  CDS (1)..(873)
atgcaaaccgcgttcgccggtctcgccggcgcgcttttcgcggtcgccgcacacgccgacatcacgggcgcgggcagcaccttcgccatgccgatttacacgaaatgggcagccgactatcagcagtcgggcggcgcgaaggtcaactatcagggcatcggctcgtcgggcggcctcaagcagatcgtcgcgaagacggtcgatttcgccggctcggatgcgccgctcaaggatgacgagctcgcgaaggaaggcctgttccagttcccgacggtggtcggcggcgtcgtgcccgtcatcaacgtgccgggcgtgaaggcgggcgaactgacgctgtcgggcgcggtgctcggcgacatctatctcggcaagatcaagaagtggaacgatccggccatcgcggcgctgaacccgaaggtcaagctgccggatacggacatcgcggtcgtgcgccgcgcggacggctcgggcacgagcttcatctggacgaattacctgtcgaaggtcaacgacgagtggaagtcgaaggtcggcgaaggcacgacggtcaactggccgaccggcacgggcggcaagggcaacgacggcgtcgcggcgttcgtgcagcgtctgccgggcgcgatcggctatgtcgagtgggcgtacgcgaagaagaacaacatggtctacaccgcgctgaagaactcgacgggcacggtggtcgagccgaagacggagacgttcaaggcggctgccgccggcgcgaactggtcgaagtcgttctaccagatcctgacgaaccagccgggcaaggaagcgtggccggtcgtcggcgcgacgttcgtgctgctgcacgcgaagcaggacaagccggcacagggcgcggaaacgtag

SEQ ID NO: 15275 - protein, 290 aa, Burkholderia mallei FMH
MQTAFAGLAGALFAVAAHADITGAGSTFAMPIYTKWAADYQQSGGAKVNYQGIGSSGGLKQIVAKTVDFAGSDAPLKDDELAKEGLFQFPTVVGGVVPVINVPGVKAGELTLSGAVLGDIYLGKIKKWNDPAIAALNPKVKLPDTDIAVVRRADGSGTSFIWTNYLSKVNDEWKSKVGEGTTVNWPTGTGGKGNDGVAAFVQRLPGAIGYVEWAYAKKNNMVYTALKNSTGTVVEPKTETFKAAAAGANWSKSFYQILTNQPGKEAWPVVGATFVLLHAKQDKPAQGAET

SEQ ID NO: 15276 - DNA, 879 bp, Burkholderia mallei JHU
  CDS (1)..(879)
atgcaaaccgcgttcgccggtctcgccggcgcgcttttcgcggtcgccgcacacgccgacatcacgggcgcgggcagcaccttcgccatgccgatttacacgaaatgggcagccgactatcagcagtcgggcggcgcgaaggtcaactatcagggcatcggctcgtcgggcggcctcaagcagatcgtcgcgaagacggtcgatttcgccggctcggatgcgccgctcaaggatgacgagctcgcgaaggaaggcctgttccagttcccgacggtggtcggcggcgtcgtgcccgtcatcaacgtgccgggcgtgaaggcgggcgaactgacgctgtcgggcgcggtgctcggcgacatctatctcggcaagatcaagaagtggaacgatccggccatcgcggcgctgaacccgaaggtcaagctgccggatacggacatcgcggtcgtgcgccgcgcggacggctcgggcacgagcttcatctggacgaattacctgtcgaaggtcaacgacgagtggaagtcgaaggtcggcgaaggcacgacggtcaactggccgaccggcacgggcggcaagggcaacgacggcgtcgcggcgttcgtgcagcgtctgccgggcgcgatcggctatgtcgagtgggcgtacgcgaagaagaacaacatggtctacaccgcgctgaagaactcgacgggcacggtggtcgagccgaagacggagacgttcaaggcggctgccgccggcgcgaactggtcgaagtcgttctaccagatcctgacgaaccagccgggcaaggaagcgtggccggtcgtcggcgcgacgttcgtgctgctgcacgcgaagcaggacaagccggcacagggcgcggaaacgctgaagtag

SEQ ID NO: 15277 - protein, 292 aa, Burkholderia mallei JHU
MQTAFAGLAGALFAVAAHADITGAGSTFAMPIYTKWAADYQQSGGAKVNYQGIGSSGGLKQIVAKTVDFAGSDAPLKDDELAKEGLFQFPTVVGGVVPVINVPGVKAGELTLSGAVLGDIYLGKIKKWNDPAIAALNPKVKLPDTDIAVVRRADGSGTSFIWTNYLSKVNDEWKSKVGEGTTVNWPTGTGGKGNDGVAAFVQRLPGAIGYVEWAYAKKNNMVYTALKNSTGTVVEPKTETFKAAAAGANWSKSFYQILTNQPGKEAWPVVGATFVLLHAKQDKPAQGAETLK

SEQ ID NO: 15278 - DNA, 1041 bp, Enterobacter cloacae
  CDS (1)..(1041): transl_table=11
atgaaagttatgcgtaccactgtcgcaactgttgtcgccgcgaccttatctctgagcgcgttctctgtatttgcagaagcaagcctgactggcgctggtgcaaccttccctgcgccggtgtatgccaaatgggcggatacctaccagaaagaaaccggtaacaaggttaactatcagggtatcggctcctccggtggcgttaaacaaattaccgcgaacactgttgatttcggcgcatcagacgctccgctgtctgatgacagactggctcaggaaggcctgttccagttccctaccgtgatcggtggtgtggttctggccatcaacctgccgggcgtgaagtcaggtgagctggtgttggacggcaagacgctgggtgacatctacctgggcaaaatcaaaaaatgggatgacgaagcgatcgctaaactcaacccaggcctgaagctgccttctcagaacatcgccgtggttcgccgcgcggatggttccggtacctcttttgtgttcaccagctacctggcaaaagtgaacgaagagtggaaatctaaagtcggctccggctctaccgttaactggccaaccggtctgggcggtaagggtaacgacggtatcgccgcgttcgtacagcgtctgcctggctcaattggttacgtagagtatgcgtacgctaagcagaacaacctgtcctacaccaaactggtatcagccgacggcaaaccggttagcccgaccgaagagaactttgctaacgcggcgaaaggcgctgactggagcaaatccttcgcgcaggatctgactaaccagaaaggcgaaggtgcatggccaatcacctctaccaccttcatcctggttcacaaagagcagaagaaacctgagcagggcgccgaagtgctgaagttcttcgactgggcgtacaaaaacggcggcaaacaggctaacgccctggattacgccaccctgccggacaacgtggttgagcagattcgcgctgcatggaaaaccaacgtgaaagacagcagcggtaaagcgctgtactaa

SEQ ID NO: 15279 - protein, 346 aa, Enterobacter cloacae
MKVMRTTVATVVAATLSLSAFSVFAEASLTGAGATFPAPVYAKWADTYQKETGNKVNYQGIGSSGGVKQITANTVDFGASDAPLSDDRLAQEGLFQFPTVIGGVVLAINLPGVKSGELVLDGKTLGDIYLGKIKKWDDEAIAKLNPGLKLPSQNIAVVRRADGSGTSFVFTSYLAKVNEEWKSKVGSGSTVNWPTGLGGKGNDGIAAFVQRLPGSIGYVEYAYAKQNNLSYTKLVSADGKPVSPTEENFANAAKGADWSKSFAQDLTNQKGEGAWPITSTTFILVHKEQKKPEQGAEVLKFFDWAYKNGGKQANALDYATLPDNVVEQIRAAWKTNVKDSSGKALY

SEQ ID NO: 15280 - DNA, 540 bp, Pectobacterium carotovorum
  CDS (1)..(540): transl_table=11
atgaaaccgatgcgtaccactcttgccagtgttgttgcggcaaccctttctctgacggcattttctgctttagctgctaacctcaccggtgccggtgcgacattccctgcgcctgtttatgcgaaatgggctgactcctatcaaaaagaaaccggtaataaagttaactatcaaggcatcggttcttctggcggtgtaaaacagattatcgctaaaacggtcgatttcggtgcttctgacgcccctctggctgacgacaaattagcacaggatggtttattccagttcccaaccgttatcggtggcgtggtgctggcagtgaacgttcctggtatcaaatctggcgatttaacgctggatggtaaaacgctgggtgatatctacctgggtaacatcaacaaatggagcgacccagcaatcactaaactgaacccgaatgccaagctgccggatcaggacattgctgtggttcgtcgtgctgacggctctggtacgtctttcgtgttcaccagctatctggccaaagttaacccggaatag

SEQ ID NO: 15281 - protein, 179 aa, Pectobacterium carotovorum
MKPMRTTLASVVAATLSLTAFSALAANLTGAGATFPAPVYAKWADSYQKETGNKVNYQGIGSSGGVKQIIAKTVDFGASDAPLADDKLAQDGLFQFPTVIGGVVLAVNVPGIKSGDLTLDGKTLGDIYLGNINKWSDPAITKLNPNAKLPDQDIAVVRRADGSGTSFVFTSYLAKVNPE

SEQ ID NO: 15282 - DNA, 996 bp, Prochlorococcus marinus
  CDS (1)..(996): transl_table=11
atgacatccatgaacatagctaagaaagctttggttttcacttctgcagtagccattgctgctggtacaagtgttcctggcacaagtgtttctgctaaaacaagattaagtggtgctggagcatcatttcctgccaaaatttacacccgttggttcaaagatttagcctcttcaggggggccaagagttaattaccaagctgttggttctggttctggaagaaaagcttttattgaccagaccgtaaactttggtgcctcagatgatcctatgaaagataaagatatcgccaaggttacaagaggtttagttcaaatcccaatggtgggtggaactattgcatttggttataactacgactgtgatttaaaacttactcaagagcaagccgtgcgagttgcaatgggtatggttaaaaactggaaagaattaggctgtaaatctggtaaattaacttgggcacatcgttctgatggttcaggaactactaaggctttcacaaactctatggaagcattttcaccaacatggactttaggaactggtaaatcagttaagtggccagcaggtgttggagcaaaaggaaattcaggtgtcgctggagttatacaaaacactcctggcgcgattggttatgttaaccagtcttatataaaaggtaatgtcaaagctgctgcacttcagaatttgtcaggtgaatttttgaaaccatctgtagaagctggagctaaggctcttaatggtattactttagatgaaaatcttgctggtaaaaatcctaatccaacagcaaaaggagcatatcctatagcttcattaacatggatacttgcttatgaagaaggtaacggtagaaacactaaagctattaagcaagcctttaatacattgttaagtgatgagtatcaagataaagctccatcactaggatttgttcctttgaaaggcgatattcttgagaaatcaagagctgccgttaagaaaattggtagataa

SEQ ID NO: 15283 - protein, 331 aa, Prochlorococcus marinus
MTSMNIAKKALVFTSAVAIAAGTSVPGTSVSAKTRLSGAGASFPAKIYTRWFKDLASSGGPRVNYQAVGSGSGRKAFIDQTVNFGASDDPMKDKDIAKVTRGLVQIPMVGGTIAFGYNYDCDLKLTQEQAVRVAMGMVKNWKELGCKSGKLTWAHRSDGSGTTKAFTNSMEAFSPTWTLGTGKSVKWPAGVGAKGNSGVAGVIQNTPGAIGYVNQSYIKGNVKAAALQNLSGEFLKPSVEAGAKALNGITLDENLAGKNPNPTAKGAYPIASLTWILAYEEGNGRNTKAIKQAFNTLLSDEYQDKAPSLGFVPLKGDILEKSRAAVKKIGR

SEQ ID NO: 15284 - DNA, 981 bp, Synechococcus sp
  CDS (1)..(981): transl_table=11
atgagcttcgccaagaaggctctcattttttcctctttgctggctcttggagctggcgtttccgcatctgccgctgatcgtctgaacggtgcaggtgcgtctttcccagccaagatctaccagcgctggttcgctgaactggccaaggccggtggccctcaggtcaactatcaggctgttggatccggttccggccgtaaggctttcatcgaccagaccgtgaacttcggtgcttctgacgatccgatgaagcccaaggacatggccaaggtgaagcgcggtgtcgtgcagatccccatggtgggcggcaccatcgccttcggttacaacaagcccggttgcaacctcaagctgacccagaagcaggctgttcaggtggcgatcggcaagatcaccaactggaagcagctcggttgcgcccccggcaacatcacctgggtgcaccgttccgacggttctggcaccaccaaggccttcaccaactccatgcaggccttctcctctgagtggaccctgggtaccggcaagtccgtcaagtggcccggtaagaacgctgtgggtgccaagggcaactccggcgtcgctggcaccattcagaacaaagttggcgccatcggttacgtcaaccagtcctacatcaagggcaaggttgtggctgcagccctgcagaacaagtccggtgaattcctcaagccttctgtgaaggccggtgccaccgcactgaacggcatcaagctggattccaacctggctggcaagaaccccaacccttctgccaagggtgcttaccccatcgccaccctcacctgggtgctggcttacaagaccggcaacggcaagaacaccgctgccatcaaggaagccttcaacttcatgctgagcaacaaggctcaggaccaggctcccagcctcggtttcgttcccctgaagggcggcatcctcagcaaggccaaggctgctgtgaacaagatcggcaagtga

SEQ ID NO: 15285 - protein, 326 aa, Synechococcus sp
MSFAKKALIFSSLLALGAGVSASAADRLNGAGASFPAKIYQRWFAELAKAGGPQVNYQAVGSGSGRKAFIDQTVNFGASDDPMKPKDMAKVKRGVVQIPMVGGTIAFGYNKPGCNLKLTQKQAVQVAIGKITNWKQLGCAPGNITWVHRSDGSGTTKAFTNSMQAFSSEWTLGTGKSVKWPGKNAVGAKGNSGVAGTIQNKVGAIGYVNQSYIKGKVVAAALQNKSGEFLKPSVKAGATALNGIKLDSNLAGKNPNPSAKGAYPIATLTWVLAYKTGNGKNTAAIKEAFNFMLSNKAQDQAPSLGFVPLKGGILSKAKAAVNKIGK

SEQ ID NO: 15286 - DNA, 1125 bp, Mycobacterium intracellulare
  CDS (1)..(1125): transl_table=11
gtgaagagtcgtctgggtacgctgctgggtctggtggccatcgcgccgccggtcctcgggatcgcggcttgcggtgcgcacgcgacgcggggggcgccgagcaccgggccggccgccggcagcgtcgccaccgccccggcgacgtccacgatcgagctctccgagaccggcagcacgctgctctacccgctgttcagcgagtggggcgccgcctaccgcgccaagcacccgaacgtcaccgtcaccacccagggcagcggctcgggcgccgggatctcccaggccgccgccggggcggtcgtcatcggcgcctccgacgcctacctgtccgcgggcgacatggccgcgcacaaggggctgatgaacatcgcgctggccatctcggcgcagcaggtcaactacaacctgcccggggtgcatcagcacctcaagctcaacggcaaggtgctggccggcatgtaccggggcacgatcaagacctggaacgacccgcagatcgccggcatcaaccccggcctgcagctccccgcgaccccggtggtgccgctgcaccgctccgatgggtccggcagcacgtttcagttcacccagtacctgtccaagcaggaccccgacggctggggccgctcgcccgggttcggcaccaccgtctccttcccggccgtgcccgaagcgctgggcgagaacggcgacggcgccatggtgaccggctgcgccgcgaacccgggctgtgtggcctacaccagcatcggctcgctcgacgaggccgaccagcacggcctcggcgaggccaagctgggcaacgcctccggcaaatacctgctgcccaacgccaagagcatccaggccgcggccgccggattcgcctcgaaaaccccggcgaaccaggcgatctcgctgatcaacggccccgccacggatgggtacccgatcgtcaactacgagtacgcgatcgtcaacgcggaccagcgcgacgacgccaccgcccaaacgctgcaggcgttcctgcactgggcgatcaccgagggcaacggcccgtcgtttttggacaaggttcacttccagccgctgccggccgaggtggtgacgctgtcggacgcccagatcgccaagatcggcggatga

SEQ ID NO: 15287 - protein, 374 aa, Mycobacterium intracellulare
MKSRLGTLLGLVAIAPPVLGIAACGAHATRGAPSTGPAAGSVATAPATSTIELSETGSTLLYPLFSEWGAAYRAKHPNVTVTTQGSGSGAGISQAAAGAVVIGASDAYLSAGDMAAHKGLMNIALAISAQQVNYNLPGVHQHLKLNGKVLAGMYRGTIKTWNDPQIAGINPGLQLPATPVVPLHRSDGSGSTFQFTQYLSKQDPDGWGRSPGFGTTVSFPAVPEALGENGDGAMVTGCAANPGCVAYTSIGSLDEADQHGLGEAKLGNASGKYLLPNAKSIQAAAAGFASKTPANQAISLINGPATDGYPIVNYEYAIVNADQRDDATAQTLQAFLHWAITEGNGPSFLDKVHFQPLPAEVVTLSDAQIAKIGG

SEQ ID NO: 15288 - DNA, 873 bp, Lactobacillus reuteri
  CDS (1)..(873): transl_table=11
atgaaaaaaacgattatcggggttgttatcgtcgcaatagtttgttggttaggtgggtcatgggtactcgctaagcaacaaccatcacaagaaaaaattaccattgtcggctcaacagctcttcaaccattagctgaagcagttgcaaataattaccgaactaagcatccccaaaccagcattattgtacagggtggtggttcaggaaccggtcttagtcaggtacaagcaggagcagtaaatatcggatctgctgatatctttgctgaccagcaagatgggattaatgccaataaattagatgacaatattgttgctgtttcgggaatagtaccaattgttaatgaagagcttggcattaagaatttaacaatgaaacagcttcaacaaatttttactggtcaaattacgaattggcaagaagttggcggacctgatttgccaattacagttattaatcgtgctcatggaagtggaaccagggttgcgtttgaacagacggtattgaaaccggggatgcaggcagtaaatgctcaagaacaagattcaaacgggacagtcaaagaaattattagaaatacaccaggggcaatcacctatattgcatttgcttatcttaatgaccaagttcagtcagttagccttgatggagtagcgccaactgctgataacattacgactaataagtggccattatggtcatatgagcacatgtatacgcaaaaacagccatcccaatcaactgcaaatttcattaagtatatgcaaagcgagaaagttcaaaagacgcttgtaacagaagctcactatattagcattcatgatatgaaagttgaaaaaacaccaactgggaaagtaactgaaaggaaatag

SEQ ID NO: 15289 - protein, 290 aa, Lactobacillus reuteri
MKKTIIGVVIVAIVCWLGGSWVLAKQQPSQEKITIVGSTALQPLAEAVANNYRTKHPQTSIIVQGGGSGTGLSQVQAGAVNIGSADIFADQQDGINANKLDDNIVAVSGIVPIVNEELGIKNLTMKQLQQIFTGQITNWQEVGGPDLPITVINRAHGSGTRVAFEQTVLKPGMQAVNAQEQDSNGTVKEIIRNTPGAITYIAFAYLNDQVQSVSLDGVAPTADNITTNKWPLWSYEHMYTQKQPSQSTANFIKYMQSEKVQKTLVTEAHYISIHDMKVEKTPTGKVTERK

SEQ ID NO: 15290 - DNA, 1041 bp, Erwinia amylovora
  CDS (1)..(1041): transl_table=11
atgacttcgatgcacaaaactctggctcaatgcgttgcattaaccctttctctgagcgctgtttctgcgctggctgcgacgaatctgaccggcgctggcggcacctttccggctccggtttataacaagtgggcggcagagtaccacaccgccacgggcagccaggttaactatcagggtatcggctcttccggcggcgtgaagcaaattatcgcgaaaaccgccgactttggtgcgtcagatgcaccgatgaaagacgaagatttggctaaaaatggcctgttccagttcccgacggtgattggcggggtggtactggcggtcaatattcctggtatcaaatccggggagctgacgctggatggtaaaaccgtgggggatatctaccttggtactgtcaagaagtggaacgatccggctatcaccaaactcaacccgggcgtaaagttgcctgatgccaatatcaacgtggtacgccgcgctgatggttccgggacctcatttgtctttaccagctatctgtctaaagtgaacaaagactggagcagcaaagtcggcaaaggcagcaccgttaactggccggtgggcctgggcggtaaaggtaatgacggcgttgctgcattcgtacagcgtttgccaggatctgtcggctatgtcgaatacgcctatgctaaacagaacagcctcgcctacaccaaactggtcgatgccgacggcaaagcgattgccccgagcgagaaaagcttcagcgatgcggctaaaggcgcagactggagcacctcgttcgctcaggatctgaccttccagaaaggcgataacgcctggccgatcacctctaccacctttatcctggttcataaagagcaggccaacaccgcgaagggcgcagccgtgttgcagttctttgactgggcttataaaaacggtggcaaaaccaccagcgcgctggactatgcatcgctgccagctcccgtcgtggagcagatccgcgccgcctggaaaagcaacgtgaaagacagttccggcaaggcgttgtactga

SEQ ID NO: 15291 - protein, 346 aa, Erwinia amylovora
MTSMHKTLAQCVALTLSLSAVSALAATNLTGAGGTFPAPVYNKWAAEYHTATGSQVNYQGIGSSGGVKQIIAKTADFGASDAPMKDEDLAKNGLFQFPTVIGGVVLAVNIPGIKSGELTLDGKTVGDIYLGTVKKWNDPAITKLNPGVKLPDANINVVRRADGSGTSFVFTSYLSKVNKDWSSKVGKGSTVNWPVGLGGKGNDGVAAFVQRLPGSVGYVEYAYAKQNSLAYTKLVDADGKAIAPSEKSFSDAAKGADWSTSFAQDLTFQKGDNAWPITSTTFILVHKEQANTAKGAAVLQFFDWAYKNGGKTTSALDYASLPAPVVEQIRAAWKSNVKDSSGKALY

SEQ ID NO: 15292 - DNA, 987 bp, Mycobacterium leprae
  CDS (1)..(987): transl_table=11
gtgagctgcggtgggaagccgacactgaaagctagcgggtcgacagcccaggccaacgcgatgacccgctttgttaatgcgttcgaacggtcatgtccaggacagacgttgaactatacggctaatggttccggtgcgggggttagcgaattcaacggtaatcaaacagatttcggtggctcagactcaccgttgagtaggaaggagtatgccgcagcagagcaacgttgtggctcgcaggcgtggaatttaccggtggtcttcggccccatcgcgatcacttacaacgtgaacggcctgagttcactgaacctggacggtccgacaaccgcgaagatcttcaatggttccatcgccagttggaacgatcccgcgatccaagcgctgaacactggcgtcgcccttccggctgagccgattcatgtcgtgttccgcaacgacgagtccggtaccacggataatttccagaggtaccttgacgtcgcatcaaacggtgagtggggcaaaggtatcggcaagacctttaaaggcggtgttggtgagggtgccaagggcaatgacggtacgtcggcggccgtcaagtccactgaagggtcgatcacctacaacgaatggtcgttcgcttcggcgcggaagctgaacacggccaagatcgccacgtcggccgatccagaacccattgcgatcagcgtcgactcggtcggcaagacaatttctggggctacgatcattggagagggtaacgatttagtgcttgacacggtctcgttttacaagccggctcagcccggctcctacccaatcgtgctggcgacctacgagattgtctgctcgaagtatcccgatgcccaggtcggtagggctgtgaaggcattcctgcagagcaccatcggtggaggccagaatggcctaggggacaacggatatgtacctattccggattctttcaaatccagattgtcgactgcggctaatgccatcgcttga

SEQ ID NO: 15293 - protein, 328 aa, Mycobacterium leprae
MSCGGKPTLKASGSTAQANAMTRFVNAFERSCPGQTLNYTANGSGAGVSEFNGNQTDFGGSDSPLSRKEYAAAEQRCGSQAWNLPVVFGPIAITYNVNGLSSLNLDGPTTAKIFNGSIASWNDPAIQALNTGVALPAEPIHVVFRNDESGTTDNFQRYLDVASNGEWGKGIGKTFKGGVGEGAKGNDGTSAAVKSTEGSITYNEWSFASARKLNTAKIATSADPEPIAISVDSVGKTISGATIIGEGNDLVLDTVSFYKPAQPGSYPIVLATYEIVCSKYPDAQVGRAVKAFLQSTIGGGQNGLGDNGYVPIPDSFKSRLSTAANAIA

SEQ ID NO: 15294 - DNA, 765 bp, Escherichia coli
  CDS (1)..(765): transl_table=11
atgaaagttatgcgtaccaccgtcgcaactgttgtcgccgcgaccttatcgatgagcgctttctctgtgtttgcagaagcaagcctgacaggtgcaggtgcaaccttccctgcgccggtgtatgccaaatgggctgacacttaccagaaagaaaccggtaataaagttaactaccagggtatcggttcttccggtggcgtaaaacagattatcgctaataccgttgattttggtgcctctgacgcgccgctgtctgacgaaaaactggctcaggaaggtctgttccagttcccgaccgtgattggcggcgtggtgctggcggttaacattccagggctgaagtctggcgaactggtgctggatggtaaaaccctcggcgacatctacctgggcaaaatcaagaagtgggatgatgaagccatcgccaaactgaatccgggtctgaaactgccttcacaaaacattgctgtagtacgccgcgcagatggctccgggacttccttcgtcttcaccagctacctggcgaaagtgaacgaagagtggaaaaacaacgttggtactggctctaccgtaaaatggccgatcggtctgggcggtaaaggtaacgacggtatcgccgcgttcgttcagcgtctgccgggtgcaattggttatgttgaatatgcttacgcgaagcagaacaacctggcgtacaccaaactgatctccgctgatggtaaaccggttagtccgaccgaagaaaacttcgctaatgcagcaaaatag

SEQ ID NO: 15295 - protein, 254 aa, Escherichia coli
MKVMRTTVATVVAATLSMSAFSVFAEASLTGAGATFPAPVYAKWADTYQKETGNKVNYQGIGSSGGVKQIIANTVDFGASDAPLSDEKLAQEGLFQFPTVIGGVVLAVNIPGLKSGELVLDGKTLGDIYLGKIKKWDDEAIAKLNPGLKLPSQNIAVVRRADGSGTSFVFTSYLAKVNEEWKNNVGTGSTVKWPIGLGGKGNDGIAAFVQRLPGAIGYVEYAYAKQNNLAYTKLISADGKPVSPTEENFANAAK

SEQ ID NO: 15296 - DNA, 1020 bp, Xanthomonas oryzae
  CDS (1)..(1020): transl_table=11
gtgatccactccttcaagacccgtctggccgttggcgtactcgccgcttcgctggctctgtgcgcccaggctgccgatgtcaccggcgctggccggtcgtttatttacccggtgatgtccaagtggtcggccgactacaacgctgccaccaagaagcaggtcaactatcaatcgatcggttcaggcggcggtattgcccagatcaaggcggccagcgtggacttcggctcgtccgatgccccgctcaagccggaagaactggccgcagccggcctggcgcagtttccctcggtgatcggcggcgtggtgccggtggtcaacgtgccgggcgtggccgccggtgcgctcaagctggacggcaagaccctgggcgacatcttcctgggcaaggtcagcacctggaacgatccggccatcgccgcgctcaatccaggcgtgaagctgccggaaggcaagatcaccgtggtgcatcgctccgacggctcgggcaccagcttcaacttcaccaactacctgtccaaggtcaatccggactggaagagcaaggtgggcgaaggcactgccgtgcagtggccgaccggtatcggcggcaagggcaacgagggcgtcgctgcctacgtgaagcagatcaagggcggcatcggctacgtcgagctgtcgtacgcgctgcagaacaagatggcctacaccgcgatgaagaatgctgccggcaagttcgtgcagccgtccgatgaaaccttcgccgccgctgccaacagcgccgattggggcagcagcaaggacttctatctggtgatgaccaatgcggcgggcgacaacgcctggccgatcacggcgaccaattttatcttggtgcagaagaagccgaagaacccgaccggcctgaaaaacacgctggacttcttccgctgggtctacagcaagggcgacgcccaggccaagcagctggactacgtaccgctgccggacgcgctggtgacccagatcgaggcctactgggccacgaatctgcccaaataa

SEQ ID NO: 15297 - protein, 339 aa, Xanthomonas oryzae
MIHSFKTRLAVGVLAASLALCAQAADVTGAGRSFIYPVMSKWSADYNAATKKQVNYQSIGSGGGIAQIKAASVDFGSSDAPLKPEELAAAGLAQFPSVIGGVVPVVNVPGVAAGALKLDGKTLGDIFLGKVSTWNDPAIAALNPGVKLPEGKITVVHRSDGSGTSFNFTNYLSKVNPDWKSKVGEGTAVQWPTGIGGKGNEGVAAYVKQIKGGIGYVELSYALQNKMAYTAMKNAAGKFVQPSDETFAAAANSADWGSSKDFYLVMTNAAGDNAWPITATNFILVQKKPKNPTGLKNTLDFFRWVYSKGDAQAKQLDYVPLPDALVTQIEAYWATNLPK

SEQ ID NO: 15298 - DNA, 1122 bp, Mycobacterium smegmatis
  CDS (1)..(1122): transl_table=11
atgggccggaaggttggcaggccggttggtatcgccgcggcggccatcgcggcgctcacgctcagcgcgtgcggcagcgacaacaacgctccggccaccggcacctccggcgcggccccctccggcagcgccgcctcggccgagtgcggtggcaagaactcgctgacggccgaggggtcgaccgcgcaacagaacgcgatcgccgagttcaacaaggcgtggggccaggtgtgcgggggcaagaacctctcctacaaccccaccggatccggcgcgggccgcgagcagttcatcgccaagcaggtcgacatcgcgggttctgactccgcgctcagcggtgatcaggtggcggccgcggccgaacgctgcggtggcaatccggcctggaacctgccgctggtgttcggtccggtggcgatggcgtacaacctcgagggcgtcgacaagctggtactcaacggcgacctgctggccaagatcttccaaggccagatcaccaagtggaacgatccggcgatcgcggggctcaacgagggcacctcgctgcccgacgccgcgatcacacccatctaccgctcggattcctccggcaccaccgacaacttccagaagtacctcactgccgccgcgccgcagtcgtggaccaagggtgacggcagcgagttcaacggcggcgcaggcgagggcgcccagaagtcgtcgggcgtggtgcaggccgtgcaggcgacgccgggttcgatcggctacgtcgagaagggcttcgccgagcaggcgggcctgcccttcgcgcagatcgacagcggtgccggtgcggtcgagctgaccgacgagtcggccgcaaaggccatcgacgccgcgaagttcgcggccgagggcaacgaccttgcactcgacctgaactcgctgtacggcacgaaggaggccggcgcgtacccgctggtgctcgccacctacgagatcgtgtgctccaagggttatgacgccgacaccgcggccgcggtgaagtcgttcctgaccgtcgccgccaacgaggggcaggccaacctctcggccgccggctatgtgccgctgcccaacgccttcaaagagcgtttgctcacttccatcgatgcgatcagctag

SEQ ID NO: 15299 - protein, 373 aa, Mycobacterium smegmatis
MGRKVGRPVGIAAAAIAALTLSACGSDNNAPATGTSGAAPSGSAASAECGGKNSLTAEGSTAQQNAIAEFNKAWGQVCGGKNLSYNPTGSGAGREQFIAKQVDIAGSDSALSGDQVAAAAERCGGNPAWNLPLVFGPVAMAYNLEGVDKLVLNGDLLAKIFQGQITKWNDPAIAGLNEGTSLPDAAITPIYRSDSSGTTDNFQKYLTAAAPQSWTKGDGSEFNGGAGEGAQKSSGVVQAVQATPGSIGYVEKGFAEQAGLPFAQIDSGAGAVELTDESAAKAIDAAKFAAEGNDLALDLNSLYGTKEAGAYPLVLATYEIVCSKGYDADTAAAVKSFLTVAANEGQANLSAAGYVPLPNAFKERLLTSIDAIS

SEQ ID NO: 15300 - DNA, 1113 bp, Mycobacterium tuberculosis
  CDS (1)..(1113): transl_table=11
atgaaactcaaccgatttggtgccgccgtaggtgtcctggctgcgggtgcgctggtgttgtccgcgtgtggtaacgacgacaatgtgaccgggggaggtgcaaccactggccaggcgtcggcgaaggtcgattgcggggggaagaagacactcaaagccagtgggtcgacggcgcaggccaacgcgatgacccgctttgtcaacgtgttcgagcaggcctgccccggccaaaccctgaactacacggccaatggttcgggcgctggaatcagcgaatttaatggcaaccaaaccgatttcggtggctcagatgtacccctgagcaaggacgaggccgcagcggcgcagcggcgttgcggctcgccggcgtggaatctgccggtggtgttcggcccgatcgcggttacctacaacctcaacagcgtttcctcgctaaatttggacggccccacgttggcgaagatcttcaacggctccattacgcagtggaacaatcccgcgatccaggcgctgaaccgcgacttcacgctgccaggtgagcggattcacgtggtgttccgcagcgatgagtcggggaccacggacaacttccagaggtacctgcaggccgcgtccaacggtgcgtggggtaagggcgctggaaagtcgttccaagacggcgtcggtgagggcgcgcggggtaacgatggcacgtcagcggccgcgaagaacaccccggggtcgatcacctacaacgagtggtcgttcgcccaggcgcaccacctgaccatggccaacatcgtcacttcggctggtggggacccggtggcgattactatcgactcggtcggccagacgatcgccggggccaccatctccggggtgggcaacgacctggtgctcgacacggactcgttctaccggccgaagcgtcccggctcctatccgatcgtgttagcgacatacgaaatcgtttgctcgaagtatcccgactcgcaggttggcacggctgtgaaggcgttcctgcagagcactatcggcgccggtcaaagcggcctgggggacaacggatacatcccaattccggacgagttcaaatcgaggctgtcgactgcggtcaacgcgatcgcctga

SEQ ID NO: 15301 - protein, 370 aa, Mycobacterium tuberculosis
MKLNRFGAAVGVLAAGALVLSACGNDDNVTGGGATTGQASAKVDCGGKKTLKASGSTAQANAMTRFVNVFEQACPGQTLNYTANGSGAGISEFNGNQTDFGGSDVPLSKDEAAAAQRRCGSPAWNLPVVFGPIAVTYNLNSVSSLNLDGPTLAKIFNGSITQWNNPAIQALNRDFTLPGERIHVVFRSDESGTTDNFQRYLQAASNGAWGKGAGKSFQDGVGEGARGNDGTSAAAKNTPGSITYNEWSFAQAHHLTMANIVTSAGGDPVAITIDSVGQTIAGATISGVGNDLVLDTDSFYRPKRPGSYPIVLATYEIVCSKYPDSQVGTAVKAFLQSTIGAGQSGLGDNGYIPIPDEFKSRLSTAVNAIA

SEQ ID NO: 15302 - DNA, 1041 bp, Edwardsiella tarda
  CDS (1)..(1041): transl_table=11
atgaaactgatgcgtaccgctgtcgctgggattgtcgccgcgaccgtctccttgagtgccaccccggccttcgccgctgagagcctgacaggtgccggcgctaccttcccggcgccggtttatgccaagtgggccgattcctaccagaaagaaaccggtaacaaagtgaattatcaaggtattggttcttctggcggcgtgaagcagatcatcgcgaacaccgtcgatttcggtgcctccgatgcaccgctaagcgatgagaagctggcggccgacggtctgtttcaattccctaccgtgatcggtggggtcgtgatggcagtgaacctaccgggggtgaagtcgggtgagttgacattagatggtgagacgctgggcgacatctacctgggtaagattaagaagtggaatgacgcggcgatcgccaaactcaatccgggcgttaaactgccggatcagaatattgccgtggtgcggcgtgcggatggttccggtacctctttcgtctttaccagctacttgagcaaagttaatccgcaatggaaggccgatgttggtgccggttcgacggtgaattggccgaccggtttagggggtaagggcaatgacggcgtcgccgcttttgtccagcgtctgccgggctctattggctacgtcgagtatgcctacgctaaacagaataagttggcgtacaccaaactggtttctgctgatggtcaagcggttagcccgacggaggtcagcttcagcaatgcggctaaaggggccgattggagccgctctttcgctcaggatctgacgaaccaggcgggcgataatgtatggccgatcacctcgacgacgtttattctggtgcataaggcatcgaccaagccaaagcagacggctgaggtactgaagttcttcgattgggcctataacgatggcgccaagcaggccaatgcattggattatgccaccttacccgcgtccgtggtggagcagatccgcgcggcctggaagacgagcgtcaaggatagcggcggtaacgccctgtattga

SEQ ID NO: 15303 - protein, 346 aa, Edwardsiella tarda
MKLMRTAVAGIVAATVSLSATPAFAAESLTGAGATFPAPVYAKWADSYQKETGNKVNYQGIGSSGGVKQIIANTVDFGASDAPLSDEKLAADGLFQFPTVIGGVVMAVNLPGVKSGELTLDGETLGDIYLGKIKKWNDAAIAKLNPGVKLPDQNIAVVRRADGSGTSFVFTSYLSKVNPQWKADVGAGSTVNWPTGLGGKGNDGVAAFVQRLPGSIGYVEYAYAKQNKLAYTKLVSADGQAVSPTEVSFSNAAKGADWSRSFAQDLTNQAGDNVWPITSTTFILVHKASTKPKQTAEVLKFFDWAYNDGAKQANALDYATLPASVVEQIRAAWKTSVKDSGGNALY

SEQ ID NO: 15304 - DNA, 636 bp, Edwardsiella tarda
  CDS (1)..(636): transl_table=11
atgaaactgatgcgtaccgctgtcgccgggattgtcaccgcgaccgtctccctgagcgccatgcctgcctttgcggcggagagcctgacaggtgccggcgccaccttccctgcgccggtttacgccaagtgggcagactcctatcagaaagagaccggtaataaagtaaactatcaaggcattggctcctccggcggtgtgaagcagatcattgctaacaccgttgacttcggcgcctccgatgcgcccctgagcgaagaaaagctggcggcggacggcctatttcagtttccgacggttatcggcggcgtggtgatggccgttaacctgccgggtattacgtcgggcgagctgacgttggacggtgaaacgctgggtgatatctacctgggtaaaattaagaagtggaacgacgcggcaatcgctaagctgaacccgggggttaaactgccggatcaggcgattgccgtggtgcgccgcgccgatggttctggcacctcgtttgtctttaccagctacctgaacaaagtcaacgcacagtggaagagtgacgtcggcgccggctccaccgttaactggccgacgggcctgggtggaaaaggtaacgatggcgttgccgcctttgtacagcgttag

SEQ ID NO: 15305 - protein, 211 aa, Edwardsiella tarda
MKLMRTAVAGIVTATVSLSAMPAFAAESLTGAGATFPAPVYAKWADSYQKETGNKVNYQGIGSSGGVKQIIANTVDFGASDAPLSEEKLAADGLFQFPTVIGGVVMAVNLPGITSGELTLDGETLGDIYLGKIKKWNDAAIAKLNPGVKLPDQAIAVVRRADGSGTSFVFTSYLNKVNAQWKSDVGAGSTVNWPTGLGGKGNDGVAAFVQR

SEQ ID NO: 15306 - DNA, 945 bp, Edwardsiella tarda
  CDS (1)..(945): transl_table=11
atgaaactgatgcgtaccgctgtcgccgggattgtcgccgcgaccgtctccctgagcgccatgcctgcctttgcggcggagagcctgacaggtgccggcgccaccttccctgcgccggtttacgccaagtgggcagactcctatcagaaagagaccggtaataaagtaaactatcaaggcattggctcctccggcggtgtgaagcagatcattgctaacaccgttgacttcggcgcctccgatgcgcccctgagcgaagaaaagctggcggcggacggcctatttcagtttccgacggttatcggcggcgtggtgatggccgttaacctgccgggtattacgtcgggcgagctgacgttggacggtgaaacgctgggtgatatctacctgggtaaaattaagaagtggaacgacgcggcaatcgctaagctgaacccgggggttaaactgccggatcaggcgattgccgtggtgcgccgcgccgatggttctggcacctcgtttgtctttaccagctacctgaacaaagtcaacgcacagtggaagagtgacgtcggcgccggctccaccgttaactggccgacgggcctgggtggaaaaggtaacgatggcgttgccgcctttgtacagcgtctgccgggcgccatcggctacgtcgagtatgcctatgccaagcagaataagctggcctacaccaagctgatctcctccgaggggcaggcggtcagtccgacggaggtcagcttcagcaatgcggcaaaaggcgccgactggagcgcatctttcgctcaggatctgacgaatcagcccggcgataacgtatggccgatcacctcgaccaccttcattctggttcataaagaatccagcaagcctaagcaaacggcagaggtgctgaagttcttcgattgggcctacagtaaaggggctaagcaggctaactag

SEQ ID NO: 15307 - protein, 314 aa, Edwardsiella tarda
MKLMRTAVAGIVAATVSLSAMPAFAAESLTGAGATFPAPVYAKWADSYQKETGNKVNYQGIGSSGGVKQIIANTVDFGASDAPLSEEKLAADGLFQFPTVIGGVVMAVNLPGITSGELTLDGETLGDIYLGKIKKWNDAAIAKLNPGVKLPDQAIAVVRRADGSGTSFVFTSYLNKVNAQWKSDVGAGSTVNWPTGLGGKGNDGVAAFVQRLPGAIGYVEYAYAKQNKLAYTKLISSEGQAVSPTEVSFSNAAKGADWSASFAQDLTNQPGDNVWPITSTTFILVHKESSKPKQTAEVLKFFDWAYSKGAKQAN

SEQ ID NO: 15308 - DNA, 1137 bp, Streptomyces griseus subsp
  CDS (1)..(1137): transl_table=11
gtgaagcttcagcgcaagaaccggcttcgtgccaccgcgctcggtgccctcgccgtctccggcgccctggtcctcacggcgtgcggttcggacgacaacaccggtggcggtacggccgggacgggcgagaagacgaccgccgcgtcgaacgtcgactgcggcaaggccaagggccagctgcgcgcctccggctccagcgctcagaagaacgccatggacctctgggtcaagaactacatggccgcctgctccggcgtggagatcaactacaactcctcctcctccggcgagggcatcgtcgccttcaaccagggcaccgtcggcttcgccggctccgactcggcgctgaagcccgaagaggtcgccgactccaagaagatgtgcaagaccggccagggcatcaacctcccgatggtcggcggcccggtcgcgatcggcttccacctggaaggcgtcgacgccctcacgctggacgccccgaccctcgccaagatcttcgacagcaagatcaagaagtggaacgacccggcgatcgccaagctgaacgacggcgtgaagctgccggacaaggcgatccaggccttccaccgctccgaggactccggcaccacgcagaacctcggcaagtacctcggcgcggccgccccgagcgactggaagtacgaggccgagaagaagtggccggcccccggtggccaggccgcgtccggctcctccggcgtcgccgcccaggtcaagcaggtcgacggcgcgatcggctacttcgagctctcctacgccaagtcccagtccatcccgaccgtggacatcaacaccggtggcgccaccccggtgaaggccacctcggagaacgcctccaaggccatcgccgccgccaagatcaagggcaccggcaaggacctggcgctcgacctcgactacaccaccaaggccgagggcgcctacccgctggtcctggtgacgtacgaggtcgtctgcgacaccggcaacaagcccgagacgctcgacaccgtcaagtccttcctctcctacaccgcctccgacgacggccagaagatcctgaccgacgccggctacgccccgatcccggccgagatcaacgccaaggtccgcgagaccatcggctccctctcgtaa

SEQ ID NO: 15309 - protein, 378 aa, Streptomyces griseus subsp
MKLQRKNRLRATALGALAVSGALVLTACGSDDNTGGGTAGTGEKTTAASNVDCGKAKGQLRASGSSAQKNAMDLWVKNYMAACSGVEINYNSSSSGEGIVAFNQGTVGFAGSDSALKPEEVADSKKMCKTGQGINLPMVGGPVAIGFHLEGVDALTLDAPTLAKIFDSKIKKWNDPAIAKLNDGVKLPDKAIQAFHRSEDSGTTQNLGKYLGAAAPSDWKYEAEKKWPAPGGQAASGSSGVAAQVKQVDGAIGYFELSYAKSQSIPTVDINTGGATPVKATSENASKAIAAAKIKGTGKDLALDLDYTTKAEGAYPLVLVTYEVVCDTGNKPETLDTVKSFLSYTASDDGQKILTDAGYAPIPAEINAKVRETIGSLS

SEQ ID NO: 15310 - DNA, 1017 bp, Burkholderia sp
  CDS (1)..(1017): transl_table=11
atgaatctgttcaaaacgctggccatcggctttgccgcttcctgctataccctgcccgtgcacacggctgagattactggcgcgggcagtactttcgccgccccggtctatgcgcaatgggcgcacgcataccggaaagccagcggcgtcaaagtgaattatcagggaatcggctcatccgctggcctcaagcaaatcatcgcaaaaaccgttgattttgcggcgagcgatacgcccttgacggcgaatgcattatccaaggccggtctgcttcagtttccgaccatcgccggcggcgttgtaccggtggtgaatgttcctggtatccagccaggcgaaatggttctgagcggtcaggtattaggcgatatttatctgggcaaaatcacaaaatggaacgaccctgaaatcatcaaactcaatccggcgctgcacacacgcgcccggctgcccgatctcacgattgccgtggtgcggcgcgcggacggctcgggcaccagcgcgctctggacccattatttatcgcagaccaacgcgcaatggaaaaagaccgttggcgaaggcgcaaccgtcagctggccggcgggcatcgggggaaaaggaaatgacggcgtcgccgccttcgttgggcgtctgaaaggcgcaatcggttatatcgagtggtcctatgccaagcaaaacaagatatcctatgtcaggctgcgcaatccggagggcgcgatcgtggcgcccaacgtgcatacctttaaagcggccttggagcgcatagactggacaaaatcctctgaacctatggccccgattccgcgacaaaacgcctggccgattgtgggccttacttttgcgctcctgcatgcgacgcagccggtctcccagaacgccgcgcaggctttgaaattttttgactggtctttcagaaacggcgcacagctcgcaagcgatctcggttatataatgctgcccgcaacagccatcgatcaggtgcgtatacgatggccaatacgccttgaaaattag

SEQ ID NO: 15311 - protein, 338 aa, Burkholderia sp
MNLFKTLAIGFAASCYTLPVHTAEITGAGSTFAAPVYAQWAHAYRKASGVKVNYQGIGSSAGLKQIIAKTVDFAASDTPLTANALSKAGLLQFPTIAGGVVPVVNVPGIQPGEMVLSGQVLGDIYLGKITKWNDPEIIKLNPALHTRARLPDLTIAVVRRADGSGTSALWTHYLSQTNAQWKKTVGEGATVSWPAGIGGKGNDGVAAFVGRLKGAIGYIEWSYAKQNKISYVRLRNPEGAIVAPNVHTFKAALERIDWTKSSEPMAPIPRQNAWPIVGLTFALLHATQPVSQNAAQALKFFDWSFRNGAQLASDLGYIMLPATAIDQVRIRWPIRLEN

SEQ ID NO: 15312 - DNA, 1107 bp, Pseudomonas aeruginosa
  CDS (1)..(1107): transl_table=11
atgttcaagcgctctctgatcgctgcctcgctgagcgtggccgccctcgtatccgcccaagccatggccgtcaccggcggtggcgcttccctgccggccgagctgtacaaaggctccgccgacagcatcctgccggccaacttcagctatgccgtgaccggcagcggcaccggcaagaacgctttcctgaccaacaactcctcgctgttcggcaccaccggtaccgttcactatgccggtagcgactcggtcctcagcggtagcgaactgaccacctacaacagcaactacaacggcacctacggtccgctgatccagatcccgtcggtagccacctcggtcaccgtgccctatcgcaaggacggcaacaccacgctcaacctgaccagcgcccaactctgcgacgccttctccggcgccaagaccacctggggtcaactgctgggcaccaccgacagcacgccgatccgcatcgtctatcgcaccggtagcagcggcaccaccgaactgttcacccgccacctgaactcgatctgcccgactcgcttcgccaccaactcgacctttaccaacgcccgtctgccggccggcggtacgttgccgagcaactgggttggcgtcgccgccacttccaccgtggtgtcgaccgtcaaggcaaccaacggctccctcggctatgtcagcccggatgcggtgaacatcaacagcaacgccgaggtttcccgtgtgaacggcaacctgccgacccaggctaacgtttccactgccctgggcagcgtggctccgccggccaacgccgccgaccgtgcggaccccagcaagtgggttccggtgttcaccaatccgagcgccggctactccatcgtcggttacaccaacttcgtcttcggccagtgctacaaggacgccagcgtttccaccgacgtccgcgccttcatcaacaagcactacggtggcactaccaccaacgccgcagttgccgcccatggcttcatcccgctgactccggcctggaagagcgccatcgtgagcgccttctacaccggcaccagcgaaaacctggccatcggcaacaccaacgtctgcaacaccaaaggccgcccgtaa

SEQ ID NO: 15313 - protein, 368 aa, Pseudomonas aeruginosa
MFKRSLIAASLSVAALVSAQAMAVTGGGASLPAELYKGSADSILPANFSYAVTGSGTGKNAFLTNNSSLFGTTGTVHYAGSDSVLSGSELTTYNSNYNGTYGPLIQIPSVATSVTVPYRKDGNTTLNLTSAQLCDAFSGAKTTWGQLLGTTDSTPIRIVYRTGSSGTTELFTRHLNSICPTRFATNSTFTNARLPAGGTLPSNWVGVAATSTVVSTVKATNGSLGYVSPDAVNINSNAEVSRVNGNLPTQANVSTALGSVAPPANAADRADPSKWVPVFTNPSAGYSIVGYTNFVFGQCYKDASVSTDVRAFINKHYGGTTTNAAVAAHGFIPLTPAWKSAIVSAFYTGTSENLAIGNTNVCNTKGRP

SEQ ID NO: 15314 - DNA, 1125 bp, Mycobacterium tuberculosis
  CDS (1)..(1125): transl_table=11
gtgaaaattcgtttgcatacgctgttggccgtgttgaccgctgcgccgctgctgctagcagcggcgggctgtggctcgaaaccaccgagcggttcgcctgaaacgggcgccggcgccggtactgtcgcgactacccccgcgtcgtcgccggtgacgttggcggagaccggtagcacgctgctctacccgctgttcaacctgtggggtccggcctttcacgagaggtatccgaacgtcacgatcaccgctcagggcaccggttctggtgccgggatcgcgcaggccgccgccgggacggtcaacattggggcctccgacgcctatctgtcggaaggtgatatggccgcgcacaaggggctgatgaacatcgcgctagccatctccgctcagcaggtcaactacaacctgcccggagtgagcgagcacctcaagctgaacggaaaagtcctggcggccatgtaccagggcaccatcaaaacctgggacgacccgcagatcgctgcgctcaaccccggcgtgaacctgcccggcaccgcggtagttccgctgcaccgctccgacgggtccggtgacaccttcttgttcacccagtacctgtccaagcaagatcccgagggctggggcaagtcgcccggcttcggcaccaccgtcgacttcccggcggtgccgggtgcgctgggtgagaacggcaacggcggcatggtgaccggttgcgccgagacaccgggctgcgtggcctatatcggcatcagcttcctcgaccaggccagtcaacggggactcggcgaggcccaactaggcaatagctctggcaatttcttgttgcccgacgcgcaaagcattcaggccgcggcggctggcttcgcatcgaaaaccccggcgaaccaggcgatttcgatgatcgacgggcccgccccggacggctacccgatcatcaactacgagtacgccatcgtcaacaaccggcaaaaggacgccgccaccgcgcagaccttgcaggcatttctgcactgggcgatcaccgacggcaacaaggcctcgttcctcgaccaggttcatttccagccgctgccgcccgcggtggtgaagttgtctgacgcgttgatcgcgacgatttccagctag

SEQ ID NO: 15315 - protein, 374 aa, Mycobacterium tuberculosis
MKIRLHTLLAVLTAAPLLLAAAGCGSKPPSGSPETGAGAGTVATTPASSPVTLAETGSTLLYPLFNLWGPAFHERYPNVTITAQGTGSGAGIAQAAAGTVNIGASDAYLSEGDMAAHKGLMNIALAISAQQVNYNLPGVSEHLKLNGKVLAAMYQGTIKTWDDPQIAALNPGVNLPGTAVVPLHRSDGSGDTFLFTQYLSKQDPEGWGKSPGFGTTVDFPAVPGALGENGNGGMVTGCAETPGCVAYIGISFLDQASQRGLGEAQLGNSSGNFLLPDAQSIQAAAAGFASKTPANQAISMIDGPAPDGYPIINYEYAIVNNRQKDAATAQTLQAFLHWAITDGNKASFLDQVHFQPLPPAVVKLSDALIATISS

SEQ ID NO: 15316 - DNA, 1113 bp, Mycobacterium tuberculosis
  CDS (1)..(1113): transl_table=11
gtgaagttcgcccgatccggcgcagcggtaagcctgttggccgccggcacactggtgttgacagcatgcggcggtggcaccaacagctcgtcgtcaggcgcaggcggcacgtctgggtcggtgcactgcggcggcaagaaggagctccactccagcggctcgaccgcacaagaaaatgccatggagcagttcgtctatgcctacgtgcgatcgtgcccgggctacacgttggactacaacgccaacgggtccggtgccggggtgacccagtttctcaacaacgaaaccgatttcgccggctcggatgtcccgttgaatccgtcgaccggtcaacctgaccggtcggcggagcggtgcggttccccggcatgggacctgccgacggtgttcggcccgatcgcgatcacctacaatatcaagggcgtgagcacgctgaatcttgacggacccactaccgccaagattttcaacggcaccatcaccgtgtggaatgatccacagatccaagccctcaactccggcaccgacctgccgccaacaccgattagcgttatcttccgcagcgacaagtccggtacgtcggacaacttccagaaatacctcgacggcgcatccaacggggcgtggggcaaaggcgccagcgaaacgttcaacgggggcgtcggcgtcggcgccagcgggaacaacggcacgtcggccctactgcagacgaccgacgggtcgatcacctacaacgagtggtcgtttgcggtgggtaagcagttgaacatggcccagatcatcacgtcggcgggtccggatccagtggcgatcaccaccgagtcggtcggcaagacaatcgccggggccaagatcatgggacaaggcaacgacctggtattggacacgtcgtcgttctacaggcccacccagcctggctcttacccgatcgtgctggcgacctatgagatcgtctgctcgaaatacccggatgcgacgaccggtactgcggtaagggcgtttatgcaagccgcgattggtccaggccaagaaggcctggaccaatacggctccattccgttgcccaaatcgttccaagcaaaattggcggccgcggtgaatgctatttcttga

SEQ ID NO: 15317 - protein, 370 aa, Mycobacterium tuberculosis
MKFARSGAAVSLLAAGTLVLTACGGGTNSSSSGAGGTSGSVHCGGKKELHSSGSTAQENAMEQFVYAYVRSCPGYTLDYNANGSGAGVTQFLNNETDFAGSDVPLNPSTGQPDRSAERCGSPAWDLPTVFGPIAITYNIKGVSTLNLDGPTTAKIFNGTITVWNDPQIQALNSGTDLPPTPISVIFRSDKSGTSDNFQKYLDGASNGAWGKGASETFNGGVGVGASGNNGTSALLQTTDGSITYNEWSFAVGKQLNMAQIITSAGPDPVAITTESVGKTIAGAKIMGQGNDLVLDTSSFYRPTQPGSYPIVLATYEIVCSKYPDATTGTAVRAFMQAAIGPGQEGLDQYGSIPLPKSFQAKLAAAVNAIS

SEQ ID NO: 15318 - DNA, 1110 bp, Mycobacterium avium
  CDS (1)..(1110): transl_table=11
ttgaaactcaaccgatttggtgccgtgctgagcgtcttgagcgccggcgcgctggtgttgtcgggatgcggaagcgataacaacggggctggcgccggcgccgccggctcgtcgtcgagcaaggtgagctgcggtggcaagaaggccctcaaggccagcggctcgaccgcccaggccaacgcgatgacccgattcgtcaacgccttcgaacaggcctgtcccggccagacactgaactacacggccaacggttccggtgccgggatcagcgaattcaacggcaagcaaaccgatttcggtggttccgactcgccgctggcgcccagtgaatacgccgcggcgcagcagcgttgcggctcgccggcctggaatctgccggtggttttcggcccgatcgccatcacctacaacgtcgccgggctgaactcgctgaacctggacggcgcgaccgccgccaaaatcttcaacggcgccatcacgacgtggaatgacccggggatccaggcgctcaaccccggcgttgccctgcccgccgagccgattcacgtcgtcttccgcaacgacgaatccggcaccaccgacaatttccagaaatatctcgatgccgccgccgacggcgcctggggcaagggcgccggcaagaccttcaagggcggcgtcggcgagggagccaagggcaacgacggcacctcggcggcgatcaaggccaccgaagggtccatcacctacaacgagtggtcgttcgctcaggcgcagaagctgaacatggccaagatcatcacgtcggccggtccggacgcggtggcgatcagcgccgactcggtgggcaagacgatcgcgggagccaagatctccggccagggcaacgatctggtgctcgacaccctgtcgttctacaagcccacccaggccgggtcgtacccgatcgtgctggccacctacgagatcgtctgctcgaagtaccccgacccccaggtcggcacggcggtcaaggcgttcctgcagagcaccgtcggcgccggccagaacggtctggccgacaacggctatatcccgatccccgacgccttcaagtcgagactgtctgctgccatcaacgcgatcacctaa

SEQ ID NO: 15319 - protein, 369 aa, Mycobacterium avium
MKLNRFGAVLSVLSAGALVLSGCGSDNNGAGAGAAGSSSSKVSCGGKKALKASGSTAQANAMTRFVNAFEQACPGQTLNYTANGSGAGISEFNGKQTDFGGSDSPLAPSEYAAAQQRCGSPAWNLPVVFGPIAITYNVAGLNSLNLDGATAAKIFNGAITTWNDPGIQALNPGVALPAEPIHVVFRNDESGTTDNFQKYLDAAADGAWGKGAGKTFKGGVGEGAKGNDGTSAAIKATEGSITYNEWSFAQAQKLNMAKIITSAGPDAVAISADSVGKTIAGAKISGQGNDLVLDTLSFYKPTQAGSYPIVLATYEIVCSKYPDPQVGTAVKAFLQSTVGAGQNGLADNGYIPIPDAFKSRLSAAINAIT

SEQ ID NO: 15320 - DNA, 1113 bp, Mycobacterium bovis
  CDS (1)..(1113): transl_table=11
ttgaaactcaaccgatttggtgccgccgtaggtgtcctggctgcgggtgcgctggtgttgtccgcgtgtggtaacgacgacaatgtgaccgggggaggtgcaaccactggccaggcgtcggcgaaggtcgattgcggggggaagaagacactcaaagccagtgggtcgacggcgcaggccaacgcgatgacccgctttgtcaacgtgttcgagcaggcctgccccggccaaaccctgaactacacggccaatggttcgggcgctggaatcagcgaatttaatggcaaccaaaccgatttcggtggctcagatgtacccctgagcaaggacgaggccgcagcggcgcagcggcgttgcggctcgccggcgtggaatctgccggtggtgttcggcccgatcgcggttacctacaacctcaacagcgtttcctcgctaaatttggacggccccacgttggcgaagatcttcaacggctccattacgcagtggaacaatcccgcgatccaggcgctgaaccgcgacttcacgctgccaggtgagcggattcacgtggtgttccgcagcgatgagtcggggaccacggacaacttccagaggtacctgcaggccgcgtccaacggtgcgtggggtaagggcgctggaaagtcgttccaaggcggcgtcggtgagggcgcgcggggtaacgatggcacgtcagcggccgcgaagaacaccccggggtcgatcacctacaacgagtggtcgttcgcccaggcgcagcacctgaccatggccaacatcgtcacttcggctggtggggacccggtggcgattactatcgactcggtcggccagacgatcgccggggccaccatctccggggtgggcaacgacctggtgctcgacacggactcgttctaccggccgaagcgtcccggctcctatccgatcgtgttagcgacatacgaaatcgtttgctcgaagtatcccgactcgcaggttggcacggctgtgaaggcgttcctgcagagcactatcggcgccggtcaaagcggcctgggggacaacggatacatcccaattccggacgagttcaaatcgaggctgtcgactgcggtcaacgcgatcgcctga

SEQ ID NO: 15321 - protein, 370 aa, Mycobacterium bovis
MKLNRFGAAVGVLAAGALVLSACGNDDNVTGGGATTGQASAKVDCGGKKTLKASGSTAQANAMTRFVNVFEQACPGQTLNYTANGSGAGISEFNGNQTDFGGSDVPLSKDEAAAAQRRCGSPAWNLPVVFGPIAVTYNLNSVSSLNLDGPTLAKIFNGSITQWNNPAIQALNRDFTLPGERIHVVFRSDESGTTDNFQRYLQAASNGAWGKGAGKSFQGGVGEGARGNDGTSAAAKNTPGSITYNEWSFAQAQHLTMANIVTSAGGDPVAITIDSVGQTIAGATISGVGNDLVLDTDSFYRPKRPGSYPIVLATYEIVCSKYPDSQVGTAVKAFLQSTIGAGQSGLGDNGYIPIPDEFKSRLSTAVNAIA

SEQ ID NO: 15322 - DNA, 1110 bp, Mycobacterium leprae
  CDS (1)..(1110): transl_table=11
ttgaagctcaaccagtttggtgccgcgattgggctcctggctactggtgcgctgttgtcgggctgcggcagcgacaacaacgcagctgtaggaagtgcacggacaggcccatcgtcaggccaggtgagctgcggtgggaagccgacactgaaagctagcgggtcgacagcccaggccaacgcgatgacccgctttgttaatgcgttcgaacggtcatgtccaggacagacgttgaactatacggctaatggttccggtgcgggggttagcgaattcaacggtaatcaaacagatttcggtggctcagactcaccgttgagtaggaaggagtatgccgcagcagagcaacgttgtggctcgcaggcgtggaatttaccggtggtcttcggccccatcgcgatcacttacaacgtgaacggcctgagttcactgaacctggacggtccgacaaccgcgaagatcttcaatggttccatcgccagttggaacgatcccgcgatccaagcgctgaacactggcgtcgcccttccggctgagccgattcatgtcgtgttccgcaacgacgagtccggtaccacggataatttccagaggtaccttgacgtcgcatcaaacggtgagtggggcaaaggtatcggcaagacctttaaaggcggtgttggtgagggtgccaagggcaatgacggtacgtcggcggccgtcaagtccactgaagggtcgatcacctacaacgaatggtcgttcgcttcggcgcggaagctgaacacggccaagatcgccacgtcggccgatccagaacccattgcgatcagcgtcgactcggtcggcaagacaatttctggggctacgatcattggagagggtaacgatttagtgcttgacacggtctcgttttacaagccggctcagcccggctcctacccaatcgtgctggcgacctacgagattgtctgctcgaagtatcccgatgcccaggtcggtagggctgtgaaggcattcctgcagagcaccatcggtggaggccagaatggcctaggggacaacggatatgtacctattccggattctttcaaatccagattgtcgactgcggctaatgccatcgcttga

SEQ ID NO: 15323 - protein, 369 aa, Mycobacterium leprae
MKLNQFGAAIGLLATGALLSGCGSDNNAAVGSARTGPSSGQVSCGGKPTLKASGSTAQANAMTRFVNAFERSCPGQTLNYTANGSGAGVSEFNGNQTDFGGSDSPLSRKEYAAAEQRCGSQAWNLPVVFGPIAITYNVNGLSSLNLDGPTTAKIFNGSIASWNDPAIQALNTGVALPAEPIHVVFRNDESGTTDNFQRYLDVASNGEWGKGIGKTFKGGVGEGAKGNDGTSAAVKSTEGSITYNEWSFASARKLNTAKIATSADPEPIAISVDSVGKTISGATIIGEGNDLVLDTVSFYKPAQPGSYPIVLATYEIVCSKYPDAQVGRAVKAFLQSTIGGGQNGLGDNGYVPIPDSFKSRLSTAANAIA

SEQ ID NO: 15324 - DNA, 1170 bp, Methanococcus jannaschii
  CDS (1)..(1170): transl_table=11
ttgaatgacaccacacaacctacaaaaggtgatgctgtgaaaaaaatattggcattaatattggggctgtgtttaatagtcccagtaatttcaatagctggatgtgttggtggaggtaattctcaaccgtcaaataatgaaaaaccaagtaccataataattaggactacaggggcaacattcccaaaataccaaatccagaaatggattgaagattatcaaaaaacccatcctaatgtcaagattgagtatgagggaggaggttcaggatacgggcaagaggcatttgcaaaaggtttaactgatattggaagaactgaccctccagttaaagaaagcatgtggaagaaattcttatcaacaggagaccaaccattacaattcccagaaattgttggtgctgtggttgtaacctacaacatcccagaaattggagataaaactttaaaattgagtagggatgttttagctgatatattcttaggtaagattgaatactgggacgatgaaagaattaaaaaaataaacccagaaattgctgataaactcccacatgagaagattatcgttgttcatagaagtgacgcaagtggaacaaccgccatatttacaacatatctaagcttaattagtaaggaatgggctgaaaaagttggagctggaaaaactgttaattggccaactgataatataggcaggggagtcgctggaaaaggaaatccaggtgttgtagcaatagtgaaatcaacgccttatacagttgcatatactgagctttcatatgcaatagaacaaaaacttccagttgcagcattagaaaacaaaaatggtaaatttgttaaaccaacagatgaaacaataaaagcagcagtttcagcagttaaggcaagtattccaaacccaacagaaggatacaaagaggatttaaagcagatgttggatgcccctggagacaatgcctatccaatagttgcattcacacacttattagtttgggaaaacaaaaatggtaagcactactctccagaaaaagctaaagctataaaagatttcttaacatgggtattaacagaagggcagaaaccagagcatttagctccaggttatgtaggattaccagaagatgttgctaagattggattaaatgctgtaaatatgataaaagaataa

SEQ ID NO: 15325 - protein, 389 aa, Methanococcus jannaschii
MNDTTQPTKGDAVKKILALILGLCLIVPVISIAGCVGGGNSQPSNNEKPSTIIIRTTGATFPKYQIQKWIEDYQKTHPNVKIEYEGGGSGYGQEAFAKGLTDIGRTDPPVKESMWKKFLSTGDQPLQFPEIVGAVVVTYNIPEIGDKTLKLSRDVLADIFLGKIEYWDDERIKKINPEIADKLPHEKIIVVHRSDASGTTAIFTTYLSLISKEWAEKVGAGKTVNWPTDNIGRGVAGKGNPGVVAIVKSTPYTVAYTELSYAIEQKLPVAALENKNGKFVKPTDETIKAAVSAVKASIPNPTEGYKEDLKQMLDAPGDNAYPIVAFTHLLVWENKNGKHYSPEKAKAIKDFLTWVLTEGQKPEHLAPGYVGLPEDVAKIGLNAVNMIKE

SEQ ID NO: 15326 - DNA, 1035 bp, Pasteurella multocida
  CDS (1)..(1035)
atgacaaaacgtgcaatgcttttggctattctattcagtacatttgctttgacgacgcaggcacaaaccattactggcgcgggcgcttcttttccttatccaatctatgccaaatgggcatccatgtatgaaaaacaaacaggtaacaaagtcaactatcaatcaattggctcggggggcggtcagcaacaaattatcgccaaaaccattgattttggtgcctcagatgatccgatgaaagcagaacttttagcacaacatcaattattacaatttccagccattatcggtggcacagtgcctgtcgtgaatttaccagaaatcaccgccggacagcttaaactttctggtgaagttctcgccgatattttcttaggcaaaattaaaaagtggaatgatcccgctatcgccaaattaaaccaaggggctaatttacccgataaagccattatcgtcgtacatcgttctgacggttcaggcaccacattcggttggactaattatctttctaaagtatcgactgaatggaaagaaacagtcggtcaaggtaaatcagtcaaatggcctacgggacaaggcggcaaaggtaacgaaggcgtggctgcttatgtcagcaaaatcaaatattcgattggttatgtggaatatgcgtacgcgaaacaaaaccagctcgcttgggcgtcattacaaaataaagccgggcaatttgtacagccctcagcagaaagttttatggcagctgccgccaatgcacaatgggaaagtgcggtcggtatgggcgtcattttaaccaatgaagaaggcgatacatcttggccagtcaccgcagcaagtttcatcttattgcataagcatgcagaaaagccagaaatcaccaaagctgtctttgatttctttgactgggcattcaagcaaggcaaagtcgcagcaaccgagcttgattatgtgcctctgcctgaggaagttattcagaaaattcaagcgcaatggaaaaccgaggtgaagtccagtgatggcaaaacactttggcaataa

SEQ ID NO: 15327 - protein, 344 aa, Pasteurella multocida
MTKRAMLLAILFSTFALTTQAQTITGAGASFPYPIYAKWASMYEKQTGNKVNYQSIGSGGGQQQIIAKTIDFGASDDPMKAELLAQHQLLQFPAIIGGTVPVVNLPEITAGQLKLSGEVLADIFLGKIKKWNDPAIAKLNQGANLPDKAIIVVHRSDGSGTTFGWTNYLSKVSTEWKETVGQGKSVKWPTGQGGKGNEGVAAYVSKIKYSIGYVEYAYAKQNQLAWASLQNKAGQFVQPSAESFMAAAANAQWESAVGMGVILTNEEGDTSWPVTAASFILLHKHAEKPEITKAVFDFFDWAFKQGKVAATELDYVPLPEEVIQKIQAQWKTEVKSSDGKTLWQ

SEQ ID NO: 15328 - DNA, 1056 bp, Rhizobium loti
  CDS (1)..(1056): transl_table=11
atgagacatttcatccgctcggcggccgttgcgatcgcaatggctacagcgtctaccttcaccctttccgcagccatcgcagctgacctttccggcgctggctcgaccttcatctatccggtgttcgccaagtgggccgacacctacaagaaggacaccggcgtcggcctcaactatcagtcgatcggttcgggcggcggcatcaagcaggtcatcgccaagaccgtgaccttcggcgccaccgacaagccgatgtccgatgccgatctggaaaagaacggcctcgtgcagttcccgatggtgatgggcggcatcgtgccgatcgtcaacctcaccggcgtcaagccgggcgaactcgtcctcgacggcaagacgctcgcccagatctatctcggcgccatcaccacctgggacgatgccgcgatcaaggcgctgaaccccagcctcaccctgccgtcgaccgcgatcgccgtcgtgcatcgttcggacggctcgggcaccaccttcaacttcaccaactatctggtaaagctctcgcccgactggaaggacaaggtcggttcggacaccgccgtcgaatggccgacgggcgtcggcgccaagggcagcgaaggcgttgccaacaccgtcaagcagacggatggcggcatcggctacgtcgaatacgcctatgccaagcagaacaacctgtcctactccaagatgctgaacgcagccggcaaggtcgtcgagccgtcgctcgaatccttcggcgctgccgcttcgaatgccgacttcaagggcgccaagaacttcaacgtcatcatcaccaacgagcccggcgacaccacctggccgatcgcggcctcgacctgggtcctgatccacaaggctccggatgatgccgctgccaccggcgaagccctgaagttctttgcctgggcctacaaggacggcaaggaaaccgccaaggcgctcgactatgtctcgatccccgacagcgtcgtcgacctgatcaaggcttcgtggaaggccgacatccaggccggcggcaagcccgtctacgccggcgagtaa

SEQ ID NO: 15329 - protein, 351 aa, Rhizobium loti
MRHFIRSAAVAIAMATASTFTLSAAIAADLSGAGSTFIYPVFAKWADTYKKDTGVGLNYQSIGSGGGIKQVIAKTVTFGATDKPMSDADLEKNGLVQFPMVMGGIVPIVNLTGVKPGELVLDGKTLAQIYLGAITTWDDAAIKALNPSLTLPSTAIAVVHRSDGSGTTFNFTNYLVKLSPDWKDKVGSDTAVEWPTGVGAKGSEGVANTVKQTDGGIGYVEYAYAKQNNLSYSKMLNAAGKVVEPSLESFGAAASNADFKGAKNFNVIITNEPGDTTWPIAASTWVLIHKAPDDAAATGEALKFFAWAYKDGKETAKALDYVSIPDSVVDLIKASWKADIQAGGKPVYAGE

SEQ ID NO: 15330 - DNA, 1095 bp, Xylella fastidiosa
  CDS (1)..(1095): transl_table=11
atgaaagtatattttgctggtttcactctcctttgtttatgcactgccgtaacaatcaccggctgtaaaccttccaacgataaccagtcaacaggtgtcagtcaggatgggaacagtacgacgccaccctctgccgagcaaaccaagagtgtgaaaatttcaggcgcaggcgcctcatttatctatccactgatctcgcaatggtcagccgactacaacgccgccactggcaataaaattaactatcagtcaatcggctcaggcggtggtattgcccaaatcaaagccgccacaatcgattttggttcttctgataagccacttgacagcagcgaactgacccaagcgggtctagggcagtttccatcggccataggtggcgtcgtgccggtggtcaatctagacaacatcgaaccaggcaaactacgcctgacaggcccactgcttgcagatattttcctagggaagatcagtaagtggaatgacgcagcaatcatcagcgccaatccggggttacatcttcccgacactaaaatcaacatcgtgcatcgttccgatggctctggcacgacattcaatttcagcaactatctatccaaagtcagcgcggaatggaaacagaaagtgggtgaaggcacttcagtgcagtggcctgggggcgtcggcggtaagggcaacgaaggtgtagcctcatatgttcaacagattaaaggctcaatcggctacgttgaactggcgtatgcgcttcagaacaaaatgtcatatacagcgctccagaacgctgctggtcaatgggtacaaccaagcgcagaaagctttgcagccgccgcatccaacgcagactggagcaatgcaaaggatttcaatttggtcattaccaacgctactggggaagcagcttggccgatcacagcgacaaactttatattgatgcgcaagcaaactaaggatgcagcgcaaagaaaagccactctagacttcttcaagtggtcctttgaaaatgggcagaaacaagccaatgaattgcactatgtgccattgccaccaaatctggtgaagcaaatcgaagcttactgggcaagcgaattcaagtaa

SEQ ID NO: 15331 - protein, 364 aa, Xylella fastidiosa
MKVYFAGFTLLCLCTAVTITGCKPSNDNQSTGVSQDGNSTTPPSAEQTKSVKISGAGASFIYPLISQWSADYNAATGNKINYQSIGSGGGIAQIKAATIDFGSSDKPLDSSELTQAGLGQFPSAIGGVVPVVNLDNIEPGKLRLTGPLLADIFLGKISKWNDAAIISANPGLHLPDTKINIVHRSDGSGTTFNFSNYLSKVSAEWKQKVGEGTSVQWPGGVGGKGNEGVASYVQQIKGSIGYVELAYALQNKMSYTALQNAAGQWVQPSAESFAAAASNADWSNAKDFNLVITNATGEAAWPITATNFILMRKQTKDAAQRKATLDFFKWSFENGQKQANELHYVPLPPNLVKQIEAYWASEFK

SEQ ID NO: 15332 - DNA, 1095 bp, Xylella fastidiosa
  CDS (1)..(1095): transl_table=11
atgaaagtacattttgctggtttcactctcctttgtttatgcactgccgtaacaatcaccggctgtaaaccttccaacgataaccagtcaacaggcgtcagtcaggatgcgaacagtacgacgcccccctctgccgagcaaaccaagagtgtgaagatttcaggcgcaggtgcctcatttatatatccactgatctcgcaatggtcagccgactacaacgccgccactggcaataaaattaactatcagtcaatcggctcaggcggtggtattgcccaaatcaaagccgccacaatcgattttggttcttctgacaagccacttgacagcagcgaactgaccaaagcgggtctagggcagtttccatcggccataggcggcgtcgtgccggtggtcaatctagacaacatcgaaccaggcaaactacgccttacaggccccctgcttgcagatattttcctggggaagatcagtaagtggaatgacgcagcaatcatcagcgccaatccggggttacatcttcccgacactaaaatcaacatcgtgcatcgttccgatggctctggcacgacattcaatttcagcaactatctatcaaaagtcagcgcggaatggaaacagaaagtgggtgaaggcacttcagtgcagtggcccggaggcgtcggcggtaaaggcaacgaaggtgtagcctcatatgttcaacagattaaaggctcgatcggctacgttgaactggcgtatgcgcttcagaacaaaatgtcatatacagcactccagaacgctgctggtcaatgggtacaaccaagcgcagaaagctttgcagccgccgcatccaacgcagactggagcaatgcaaaggatttcaatttggtcatcaccaacgctactggggaaggcgcttggccaatcacagccacaaactttatattgatgcccaagcaaactaaggatgcagcgcaaagaaaagccactctagacttcttcaagtggtgctttgaaaatgggcagaaacaagccaatgaattacactacgtgccattgccaccaaatctggtgaagcaaatcgaagcttattgggcaagcgaattcaagtaa

SEQ ID NO: 15333 - protein, 364 aa, Xylella fastidiosa
MKVHFAGFTLLCLCTAVTITGCKPSNDNQSTGVSQDANSTTPPSAEQTKSVKISGAGASFIYPLISQWSADYNAATGNKINYQSIGSGGGIAQIKAATIDFGSSDKPLDSSELTKAGLGQFPSAIGGVVPVVNLDNIEPGKLRLTGPLLADIFLGKISKWNDAAIISANPGLHLPDTKINIVHRSDGSGTTFNFSNYLSKVSAEWKQKVGEGTSVQWPGGVGGKGNEGVASYVQQIKGSIGYVELAYALQNKMSYTALQNAAGQWVQPSAESFAAAASNADWSNAKDFNLVITNATGEGAWPITATNFILMPKQTKDAAQRKATLDFFKWCFENGQKQANELHYVPLPPNLVKQIEAYWASEFK

SEQ ID NO: 15334 - DNA, 903 bp, Bacillus subtilis
  CDS (1)..(903): transl_table=11
atgaaaaaaaacaaattggtgcttatgcttctgatggctgcttttatgatgattgcagctgcatgcggaaatgcaggagaaagtaaaaaatcgaatagcgattctgcaaaaggagaagaaaaggcatcaggttctttaaccatttctggttcatcggcaatgcagccactagtacttgcagccgcggaaaaatttatggaagaaaaccctgatgctgatatacaggtacaagctggcggttctggaacagggctttctcaagtctctgaaggagctgttcagatcgggaattcagacgtttttgctgaagaaaaagaaggcatcgatgcaaaagcgcttgtcgatcatcaagtcgctgtagttggtatggcagcagctgtaaaccctgatgctggtgtaaaggatatttcaaaagatgaattgaaaaaaatcttcactggcaaaatcaaaaactggaaagagctcggcggcaaagaccaaaagattacacttgtaaaccgccctgattcttccggcacacgtgctacatttgtgaaatatgcgcttgacggagcggagcctgcagaaggcattactgaagattcctccaacacggtgaaaaagatcattgctgatactccgggagcgattggatatcttgcattctcatatttaacagatgacaaagtaactgctctatctattgacggtgttaaacctgaagcgaaaaatgtagcaactggcgagtatccgatctgggcttatcaacattcttatacaaaaggtgaagcgacaggtttagctaaagaatttcttgattatctaaagagtgaagacattcaaaaaagcattgttactgaccaaggctacattccggttactgatatgaaagtgacacgtgatgccaacgggaagcaaagctga

SEQ ID NO: 15335 - protein, 300 aa, Bacillus subtilis
MKKNKLVLMLLMAAFMMIAAACGNAGESKKSNSDSAKGEEKASGSLTISGSSAMQPLVLAAAEKFMEENPDADIQVQAGGSGTGLSQVSEGAVQIGNSDVFAEEKEGIDAKALVDHQVAVVGMAAAVNPDAGVKDISKDELKKIFTGKIKNWKELGGKDQKITLVNRPDSSGTRATFVKYALDGAEPAEGITEDSSNTVKKIIADTPGAIGYLAFSYLTDDKVTALSIDGVKPEAKNVATGEYPIWAYQHSYTKGEATGLAKEFLDYLKSEDIQKSIVTDQGYIPVTDMKVTRDANGKQS

SEQ ID NO: 15336 - DNA, 24 bp, Primer
atgaaagttatgcgtaccaccgtc

SEQ ID NO: 15337 - DNA, 23 bp, Primer
ttagtacagcggcttaccgctac

SEQ ID NO: 15338 - protein, 548 aa, consensus
  MISC_FEATURE (1)..(548): consensus for the disclosure of Xaa see table VIII
KXXXEPFRIKMVEPIRMXTREEREXAIXEAGYNXFLLXSEDVYIDLLTDSGTGAMSDXQWAAMMLGDEAYAGSRSYYXLXEAVKDIFGYXYXXXXXXXXXXXXXXXXXXXXXXXXXXXXXXXXXXXXXXXXXXXXXXIIPTHQGRGAENILFXVLIKXXXXXXGXXXXXXXXXSNXHFDTTRAHVELNGAXXVDVVXDEAXXXXXXXDTXXXXPFKGNMDLXKLEXXIXEXGAENIAXIVLTITXNSAGGQPVSMANMRXVXEIAKKYGIPVVIDAARFAENAYFIKXREXGYXDKSIXEIVREMFSYADGLTMSAKKDALVNIGGLLAIKDEXXXXXXXXXXXXXXXXXXELFXXXRXXXVVXEGFXTYGGLAGRDMEALAIGLXEGMXXDYLXYRIXQVXYLGDXLXEAGVPXIQXPXGGHAVFVDAXKLLPXXXXXXXXXHIPXDQFPAQALAXELYLEAGIRAVEIGSLLLGRDPXTGEQXXXXXELVRLTIPRRVYTQXHMDXVAEAVIXLXXXREXIKXGLXFXYEPXXXVLRHFTARLEXI

SEQ ID NO: 15339 - protein, 51 aa, consensus
  MISC_FEATURE (1)..(51): consensus for the disclosure of Xaa see table VIII
GXXXXXXXXXXXXXXXXXXXXXXXXXXXXXXGSXXGXXXXXXXXXXXXXXX

SEQ ID NO: 15340 - protein, 28 aa, consensus
  MISC_FEATURE (1)..(28): consensus for the disclosure of Xaa see table VIII
NXXXXXXXXXXXIXXXXRXXXSGXXXXX

SEQ ID NO: 15341 - DNA, 2077 bp, Saccharomyces cerevisiae; identical to SEQ ID NO: 3739
  CDS (482)..(1987)

SEQ ID NO: 15342 - protein, 501 aa, Saccharomyces cerevisiae; identical to SEQ ID NO: 3740

SEQ ID NO: 15343 - DNA, 1668 bp, Caenorhabditis elegans; identical to SEQ ID NO: 3749
  CDS (121)..(1668)

SEQ ID NO: 15344 - protein, 515 aa, Caenorhabditis elegans
MVNQSGGDSEDSTSPRAAGCRTRRRTMSGGRAEHHLLTTKTGKKIYTKGRPPWYDKKGKSLKHPFVIGVCGGSASGKTTVAEKIVERLGIPWVTILSMDSFYKVLTPEEIKAAHESRYNFDGPNAFDFDLLYEVLKRLREGKSVDVPVYDFNTHSRDPNSKMMYGADVLIFEGILAFHDERIKNLMDMKVFVDTDGDLRLARRIVRDVTDRGRDIDGIMEQYFTFVKPAFDKYIAPCMDSADLIVPRGGENDVAIDMIVQNVMAQLVERGYDRNQNNRDRHDLVRDDLPDCLPENLFILKETPQVKGLVTFVRDRETSRDNHIFYSDRLMRILIEECMNHMPYKDVEIEMAGGRKTIGKRKDAQICGLPIMRAGECMETALRSIVKDCVIGKILIQTNETTFDPELHYIRLPPHITRYKVIIMDATVTTGSAAMMAIRVLLDHDVKEEDIFVASLLMGQQGAHALAYAFPKVKLITTAMDHQMTENCYLIPGMGNFGDRYYGTGLEQDMDEPFDM

SEQ ID NO: 15345 - DNA, 1365 bp, Schizosaccharomyces pombe; identical to SEQ ID NO: 3751
  CDS (1)..(1365)

SEQ ID NO: 15346 - protein, 454 aa, Schizosaccharomyces pombe; identical to SEQ ID NO: 3752

SEQ ID NO: 15347 - DNA, 1521 bp, Debaryomyces hansenii CBS767; identical to SEQ ID NO: 3757
  CDS (1)..(1521)

SEQ ID NO: 15348 - protein, 506 aa, Debaryomyces hansenii CBS767; identical to SEQ ID NO: 3758

SEQ ID NO: 15349 - DNA, 1353 bp, Yarrowia lipolytica CLIB99; identical to SEQ ID NO: 3759
  CDS (1)..(1353)

SEQ ID NO: 15350 - protein, 450 aa, Yarrowia lipolytica CLIB99; identical to SEQ ID NO: 3760

SEQ ID NO: 15351 - DNA, 1380 bp, Kluyveromyces lactis NRRL Y; identical to SEQ ID NO: 3761
  CDS (1)..(1380)

SEQ ID NO: 15352 - protein, 459 aa, Kluyveromyces lactis NRRL Y; identical to SEQ ID NO: 3762

SEQ ID NO: 15353 - DNA, 1431 bp, Candida glabrata CBS138; identical to SEQ ID NO: 3767
  CDS (1)..(1431)

SEQ ID NO: 15354 - protein, 476 aa, Candida glabrata CBS138; identical to SEQ ID NO: 3768

SEQ ID NO: 15355 - DNA, 1965 bp, Oryza sativa; identical to SEQ ID NO: 3773
  CDS (257)..(1726)

SEQ ID NO: 15356 - protein, 489 aa, Oryza sativa; identical to SEQ ID NO: 3774

SEQ ID NO: 15357 - DNA, 1374 bp, Cryptosporidium parvum
  CDS (1)..(1374)
atgtctaatatcagtcttgaaaaattaatttctaaagacatatattatggcgatcaagctttaacgcctagcagcaattcaaatgtttttgttattgcagttgcaggaggaagtgcaagcggaaaaacaagcgtatgtaccagaattttttcagagttaggagataaacgagttacggtaattgagactgatagtttttataaaactcctgtcttagaagaggggcaaactatggcagactacaactttgatcatcctaattctgtggactttgaacttctatacaatgttttactaagtttgaaaaacggggaaggggttcacatccctaactactgttttaaacaacataagagattggaaacaggaaggaaggtttctccagcatctattattattgttgaaggcatatttattcttttccatccaaaaattagacatcttataaatatgtcaatttttgtcgatacggacgatgatattcgtcttgtacgtagaataagaagagatactattgagagaggcagacaaattgacgatattcttaatcaatatgagaaaacggttaagccatcctatgatgaattcatttatccgactagaagatatgcagatatcgtaattccgcattatccaaatgaagttgctgttgaccttgttgtacaacatcttagatacaagttaaaaatggatgatttaagaaaaatttactctaatttgcatattattccttctaattgtcaaatacgccatatgcactctattataaggaataaggatacatcagtggtggactttgtcttttggtcagatagattaattcgactggtcgtcgaaaatgctcttagccatttgtcttttactggtcaaacaattgaaacacctattggagaactttacgacggagtgcaatttaattacaaggataaactctgcgcggtctcaatagttagaggaggagaaagtatggaaataggtttatctgctgtttgtaaagatatcccaataggaaaaattctactggagttccaaaatcctaaaacggaacttgatgcccagtttgataaacctaagattatctattgcaaattacccgatgatattgcctcaaggaatgtatttattttggatcctattcttgggaatggatttggggtattttctgcaattaaatatttgttatcaaagggggttttgcagcgtaaaattattgttcttagtcttattgttgctcacaatgcaatacacagaatatgtaaagagttcccggaggtaactctaattacgactgaaattgaccgtgatgttaactctgatggttttgtaattccaggattaggttgttttgctgatcgatactttggaactgaataa

SEQ ID NO: 15358 - protein, 457 aa, Cryptosporidium parvum
MSNISLEKLISKDIYYGDQALTPSSNSNVFVIAVAGGSASGKTSVCTRIFSELGDKRVTVIETDSFYKTPVLEEGQTMADYNFDHPNSVDFELLYNVLLSLKNGEGVHIPNYCFKQHKRLETGRKVSPASIIIVEGIFILFHPKIRHLINMSIFVDTDDDIRLVRRIRRDTIERGRQIDDILNQYEKTVKPSYDEFIYPTRRYADIVIPHYPNEVAVDLVVQHLRYKLKMDDLRKIYSNLHIIPSNCQIRHMHSIIRNKDTSVVDFVFWSDRLIRLVVENALSHLSFTGQTIETPIGELYDGVQFNYKDKLCAVSIVRGGESMEIGLSAVCKDIPIGKILLEFQNPKTELDAQFDKPKIIYCKLPDDIASRNVFILDPILGNGFGVFSAIKYLLSKGVLQRKIIVLSLIVAHNAIHRICKEFPEVTLITTEIDRDVNSDGFVIPGLGCFADRYFGTE

SEQ ID NO: 15359 - DNA, 1862 bp, Oryza sativa
  CDS (98)..(1573)
cacccaatccgcgtgtcaaaacctccggcctccgcaccgtgcgcgccagctcagcacgtcggcggcggcggcggcggcggcgacggcgaggggagagatggacgccgcgatggagtcggcggtggggccgcacttcagcgggctccgcctcgactcgcgccgcctctcctcctcctccctccccacctccccctccgccgcctccagcaacggctgcggcggcaacgacgcccccgccgcggttaacgggttcgcgccgccgccgcccccctccgccgccgcagccgcggaggaggggagcaagcagcccttcgtgatcggtgtgtcgggagggacggcgtcggggaagacgacggtctgcgacatgatcatccagcagctgcacgaccaccgcgtcgtgctcgtcaaccaggattcattctaccgtggtttaactgaggaagaatctgaccgtgtgcaagattacaactttgatcacccagatgcatttgatacagagcaacttttagagtgcatgggacagcttaaaagtgggctatctgtaaatattcctatatatgattttaagaaccaccgtcgatgctctgaaagttttagaaaggttaatgcatcagatgtcatcattttggagggcattttagtttttcatgatcaaagggttcgtgatttgatggatatgaaaatttttgttgacacagatgccgatattagacttgcccggcgtataaggcgtgatacagttgaaagaggtagagatgtcatctcagtgctggagcagtatgggaggtttgtgaagcctgcgttcgatgattttgttcttccttccaaaaaatatgctgatgtgatcataccgcgagggggagataaccatgttgccatagatttaattgtgcaacatattcgtacaaaacttggtcagcatgacttatgcaaaatctacccaaatgtttatgtggttaatacaactttccagatacgtggaatgcatactcttattcgcgaccgggacattgcaactccagatttcgtcttttattcagatcgtctgattcgtctggtagttgagcatggactggggcatttgcctttcacagagaagcagattgttacaccaacagggtctacttacatgggagttgacttttgtaagaagctctgtggtgtgtcaattattcgaagtggagaaagcatggagaatgcattacgtgcttgttgtaaggggattaaaataggcaaaattctaatacatcgggatggggacaatggacaacagctcatataccacaagtttcccttggatattgctgaacgacatgttctactcatggatcctgtgcttggtacaggtaactcggcaaatcaagctatagaacttcttataagtagtggagttcctgaggagcggatcatgtttctcaatctcatctcggctcctgaaggggtccattgtgtctgcaagcgattccctcgtctgaagattgtaacctcagagatcgaaactgggttgaacgaggagtaccgggtgatcccagggttaggagagtatggtgatcgctacttcggtacagactaatcagggattgatactggcttctttggcgatgtgaaaagatcacattagagctaacattaccgtgagagagatatatactggtgtttggttgtttgtggtataccattggaggtaccgaaatcgtgcgatttcgtgtgttagtgtttgctgctgtgataaaaacttcgggtgttgaattttgaaggcccctgtcgctagttacagcggcgtgtgaaaaaagggaaaaatttgtgacatgtagagcccacttctcgggcctgaatgcggcagatgccgtgtggtttcactt

SEQ ID NO: 15360 - protein, 491 aa, Oryza sativa
MDAAMESAVGPHFSGLRLDSRRLSSSSLPTSPSAASSNGCGGNDAPAAVNGFAPPPPPSAAAAAEEGSKQPFVIGVSGGTASGKTTVCDMIIQQLHDHRVVLVNQDSFYRGLTEEESDRVQDYNFDHPDAFDTEQLLECMGQLKSGLSVNIPIYDFKNHRRCSESFRKVNASDVIILEGILVFHDQRVRDLMDMKIFVDTDADIRLARRIRRDTVERGRDVISVLEQYGRFVKPAFDDFVLPSKKYADVIIPRGGDNHVAIDLIVQHIRTKLGQHDLCKIYPNVYVVNTTFQIRGMHTLIRDRDIATPDFVFYSDRLIRLVVEHGLGHLPFTEKQIVTPTGSTYMGVDFCKKLCGVSIIRSGESMENALRACCKGIKIGKILIHRDGDNGQQLIYHKFPLDIAERHVLLMDPVLGTGNSANQAIELLISSGVPEERIMFLNLISAPEGVHCVCKRFPRLKIVTSEIETGLNEEYRVIPGLGEYGDRYFGTD

SEQ ID NO: 15361 - DNA, 1497 bp, Ashbya gossypii; identical to SEQ ID NO: 3797
  CDS (1)..(1497)

SEQ ID NO: 15362 - protein, 498 aa, Ashbya gossypii; identical to SEQ ID NO: 3798

SEQ ID NO: 15363 - DNA, 1425 bp, Neurospora crassa; identical to SEQ ID NO: 3817
  CDS (1)..(1425)

SEQ ID NO: 15364 - protein, 474 aa, Neurospora crassa; identical to SEQ ID NO: 3818

SEQ ID NO: 15365 - DNA, 1831 bp, Arabidopsis thaliana; identical to SEQ ID NO: 3841
  CDS (116)..(1525)

SEQ ID NO: 15366 - protein, 469 aa, Arabidopsis thaliana; identical to SEQ ID NO: 3842

SEQ ID NO: 15367 - DNA, 1870 bp, Arabidopsis thaliana
  CDS (207)..(1607)
cgcatatacatacacttatatacgttatcaatatattttatttttaataagtccagtttttgtctgtgcatcgagtttaacaggcaatgctcgtgtctctctctctttatatgtttagattctttatctggaacttggaagctcttttgttagctatatctaatcggtgatctcgaagcttattcaatccctctttcttttttcgaatggcttcaaagtcggatgtgaatataatagagacatcctcaaaggttcatttctcaggatttcatcaaatggatggtttagcttcaaatagaccagagcaaatggctgaggaagaagaacatggtcaaccttttgtgatcggagttgctggaggtgcagcatccgggaaaacaactgtctgtgatatgattatgcagcaactgcatgatcagagagctgttgttgtaaatcaggattctttctaccataatgtaaatgaagtggagcttgtaagagttcatgattacaattttgaccatcctgacgctttcgatactgagcaattattgtcttccatggagaagttaagaaaaggacaagcagtagatattcctaattatgacttcaaaagttacaagaacaatgtttttccacctagaagggtgaatccttctgacgttataattctggaaggtatactcattttccatgaccctcgggtgcgagatttgatgaacatgaagatatttgtagacgcagatgccgatgtgcgtctagcgagaaggataaaacgcgatactgttgagaagggcagagatattgccactgttcttgaccagtactcaaagtttgtgaagccagcatttgaggatttcatactcccaacaaagaaatacgcagatataataattccccgaggtggtgataaccatgttgctattgatttgattgtgcaacacatccatacgaagctcggtcaacatgatctctgtaaaatttatccaaatctttatgttattcaatcaacttttcagatacgtggtatgcacactctaatccgcgactctaaaacaacaaagcatgactttatcttctactccgatcgattgatacgtttggtcgttgaacatggcctcggacaccttccctttacagaaaagcaagtggttactccaacaggatctgtgtattcgggtgtggacttctgtaagaaactgtgtggtgtctcagttatcagaagcggtgagagtatggagaacgctcttagagcatgctgcaaaggcatcaaaattgggaagattctgattcatagagaaggcgacaatggtcaacagcttatctacgagaagctaccctcagacatttcagaaaggcatgtgcttttactggatccaatcctcgggacaggaaactcggcggtgcaagcgataagactgctcataagtaaaggcgtgcctgaatccaacatcatatttctcaatttgatatctgcacctgaaggagtaaatgtggtgtgcaaaaagttcccaaggataaagattgtgacttcagagatagaactcggtttaaacgacgagttccgagttgttcctggtatgggcgagtttggagaccgctattttggaaccgatgatgagtgagagagtgcgagcttgccttgcctccctcgaaaattttgatttcttttgtttcaactgttatacgtagtacttttatgatcggattcacacatatgtatacggtaatatcaaaacaaactgagtgtgaacgtattcacagtttttgggtcatcgtccacgtgtctctctataattgggtgactgttgaagtcatacaaaatgtaaaactttaaagagtcttttggtgtgcaatgaagtgacgtgagcgtataaaagttaccgac

SEQ ID NO: 15368 - protein, 466 aa, Arabidopsis thaliana
MASKSDVNIIETSSKVHFSGFHQMDGLASNRPEQMAEEEEHGQPFVIGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDADADVRLARRIKRDTVEKGRDIATVLDQYSKFVKPAFEDFILPTKKYADIIIPRGGDNHVAIDLIVQHIHTKLGQHDLCKIYPNLYVIQSTFQIRGMHTLIRDSKTTKHDFIFYSDRLIRLVVEHGLGHLPFTEKQVVTPTGSVYSGVDFCKKLCGVSVIRSGESMENALRACCKGIKIGKILIHREGDNGQQLIYEKLPSDISERHVLLLDPILGTGNSAVQAIRLLISKGVPESNIIFLNLISAPEGVNVVCKKFPRIKIVTSEIELGLNDEFRVVPGMGEFGDRYFGTDDE

SEQ ID NO: 15369 - DNA, 1711 bp, Cryptosporidium parvum; identical to SEQ ID NO: 3855
  CDS (290)..(1549)

SEQ ID NO: 15370 - protein, 419 aa, Cryptosporidium parvum; identical to SEQ ID NO: 3856

SEQ ID NO: 15371 - DNA, 1844 bp, Arabidopsis thaliana
  CDS (61)..(1521)
ttcgattcgccggaaaaatcataaaatccaaatctacaaccacctttttatcgcaatccaatgccggaagattcttcttctttagactacgcgatggagaaggcatcagggcctcacttctccggtcttcgcttcgacggccttctctcttcttctccacccaattcctccgtcgtctcttcactccgatcagctgtttcttcttcttctccgtcttcttccgatcccgaagcgcctaagcagcccttcattatcggggtttctggtggtacggcttctggtaagaccacggtctgtgacatgataatccagcaacttcatgaccatcgtgtcgttttagttaatcaggattccttttatcgtggtttgacatctgaggagttgcagcgtgtgcaagagtataactttgatcatcctgatgcgtttgacactgagcagcttttgcattgtgctgagactctcaagagcgggcaaccctatcaagttccaatctatgactttaagactcatcaacgtagatctgatactttccgccaggtcaatgcttctgatgtaataatattggaagggattctagttttccatgactcacgagttcggaatctgatgaatatgaagatctttgttgatacagatgctgatgtaaggcttgctcgcagaattaggcgtgacacagttgagaggggtagggatgtcaattctgtgcttgaacagtatgcaaagtttgtgaagccggcatttgatgacttcgtgctcccttcaaagaaatatgctgacgtgatcattcctcgaggaggtgataatcacgttgcagtcgatttgattacgcaacatatccacacaaaacttgggcagcatgatctctgcaaaatctacccaaatgtttatgttatccagtcaacatttcagataagaggcatgcatacacttattcgggaaaaggacatatcaaagcatgactttgtgttttattcagatagactcattcgtctggtcgtggagcatggtcttggtcatttgccattcactgagaaacaagtagttactccaacaggagctgtatataccggtgttgatttctgcaagaaactttgtggggtctcaattattagaagtggtgaaagcatggaaaatgcattacgcgcttgctgcaaaggaattaaaatagggaagattctcatccaccgtgatggcgataatggaaaacagcttatttatgagaagcttcctcacgacatatctgaacgccatgtcctgcttctagatcctgtcttagccacaggtaactcggctaatcaagccattgaactactcatacagaaaggtgttcctgaagctcacattatattcctcaaccttatatcggcgccggagggaatccactgtgtctgcaaacgttttccagcattgaaaattgtgacgtctgaaatagaccaatgtctgaaccaagaattcagagttataccgggcttaggcgagtttggcgatcgttacttcggcaccgacgaggaagaccagtagccaccactcaacactgtgactggtttcaaaggaaaagcctaaatttatgactagagcgacagtagaggcacttgcatgtctttgtagtttgtgctaaagaatctttatcttattgtttatgaagctcctcttgcttacttgaattatttttgaaaaactacgttaattttctcattaaaaaaatgatcgggacaatgctagttttctaaaccggtggaaaaagacataaccaatccttttatacatgattttgacaatcgtacgaaaaaaaaaaaaaaaaaaaaaaaaaaaaaaaaaaaaaaaaaaaaaaaaaaaaaaaaaaa

SEQ ID NO: 15372 - protein, 486 aa, Arabidopsis thaliana; identical to SEQ ID NO: 3858

SEQ ID NO: 15373 - DNA, 3183 bp, Arabidopsis thaliana
  CDS (1)..(3183)
atggcttcaaagtcggatgtgaatataatagagacatcctcaaaggttcatttctcaggatttcatcaaatggatggtttagcttcaaatagaccagagcaaatggctgaggaagaagaacatggtcaaccttttgtgatcggtgagagtcgtggagttgctggaggtgcagcatccgggaaaacaactgtctgtgatatgattatgcagcaactgcatgatcagagagctgttgttgtaaatcaggattctttctaccataatgtaaatgaagtggagcttgtaagagttcatgattacaattttgaccatcctgacgctttcgatactgagcaattattgtcttccatggagaagttaagaaaaggacaagcagtagatattcctaattatgacttcaaaagttacaagaacaatgtttttccacctagaagggtgaatccttctgacgttataattctggaaggtatactcattttccatgaccctcgggtgcgagatttgatgaacatgaagatatttgtagacgcaggtctttcccataccaaacctgttaacacttatgtagtcaaatccgtagcatatatgagacgctgcacttgtatatgtactcatgaagatgccgatgtgcgtctagcgagaaggataaaacgcgatactgttgagaagggcagagatattgccactgttcttgaccagtactcaaagtttgtgaagccagcatttgaggatttcatactcccaacaaagaaatacgcagatataataattccccgaggtggtgataaccatgttgctattgatttgattgtgcaacacatccatacgaagctcggtcaacatgatctctgtaaaatttatccaaatctttatgttattcaatcaacttttcaggtcgttgaacatggcctcggacaccttccctttacagaaaagcaagtggttactccaacaggatctgtgtattcgggtgtggacttctgtaagaaactgtgtggtgtctcagttatcagaagcggtgagagtatggagaacgctcttagagcatgctgcaaaggcatcaaaattgggaagattctgattcatagagaaggcgacaatggtcaacaggtttgtgttctttctctgctcatcacttctcctaactatttactaacaacaaatggcactcaccagcttatctacgagaagctaccctcagacatttcagaaaggcatgtgcttttactggatccaatcctcgggacaggaaactcggcggtgcaagcgataagactgctcataagtaaaggcgtgcctgaatccaacatcatatttctcaatttgatatctgcacctgaaggagtaaatgtggtgtgcaaaaagttcccaaggataaagattgtgacttcagagatagaactcggtttaaacgacgagttccgagttgttcctggtatgggcgaggtttcgattccttaccatctccgcaaaacccttcagaaaatcagagagtataccggaaagcagcactcggatgaggatatctttgccgtctataaggattccttcaatgatcctcatgagaccgctcagaagctcctcttcttagatacatttcatgaggtgagaagtaaaagggagaaaaagaaggaggcaagtcctatagtgccagttacacaaccaagtggcagaggtggtcggaggaactttgcttcaagtaactcttatcaaggtagtggaagaaatgcttcttttaaaagggaaaatggagctaatcatgtaacaagaggttctagaactgctcagcctgccactaacaaagcaagcaacatcacagtacctaatgaaacaaaggtttctggtcctgctagtattccgagtgaggtcagcaatcataaagctcaagatgatccttctttgatttctgcttcacgttgcagtagcaagtcagatcaagccattgaaattgagactgcgtccaaacaaggcaaaaatcaatcgcttcctaagccagatgttagcgaacagtcacacgtaacattccctttccaccttcaggttgccaaaggactgcaaaatggtctgacgtttggcagttttgattccaattttgtgaaagaggtatcttctagcaatggtgctagtgggggatatgactcaaattttgagtcttctcacgggacaggggatgatgagagggaatcttctcccactaccaatggtattactggggttgcttcggctaggttcgtgactgagatactttcactctacatattagaagaaacatcaacagtttctgaagataaggattatgggatatcaaattctgcaactggagctgagcctgtggtgcactcggatcacattgtcccacctgtagaagaagtaccgaaggaggaagctttatcaaacacagaaactcatcaaattgcttatggtcaagaagctccactcagtgtgtttggtcttgtcccctcgttgtcagcaataggccaacccgttaacacagaagcagcggagactcagcccggaaattccaactctccacctatttcattagtatcatatcctccagatcagagctccatagcagcagccactcaacagacaaattttcttaggcagcaataccctcccaatttcttcccttacggctattactcaccgtattatatgccaccgccgtacattcaccagttcttgagcccaaacgggatccctcagcagtcttattttccacaaggagctgctctaacagcaccttctcatgcaaaaccagttgacaacactgaaaaccctcccaccacaaacccttacctacacacttctcccatggttgctagcagcatcccatctacaaccaccttaaattctatccatagtgaagaaaaggcatctcacctgactgaaagtgcagctgcatggattgggcagggatttggcaacctgcaggtgaatccaatgtataacctagcataccaaggtcagccacttggttttccagtcgtgcaggctggtcatggtggcctcatgggaatgcaccaaccaacacagcccatggcagctgcttcaactacatatcagaccttaccaccaccgccacacacaacaacggctatgggtgaacccataggacacccgcacattgcttatcagcaacctcaagctgctctaacgaattgggttaacaactattag

SEQ ID NO: 15374 - protein, 1060 aa, Arabidopsis thaliana
MASKSDVNIIETSSKVHFSGFHQMDGLASNRPEQMAEEEEHGQPFVIGESRGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDAGLSHTKPVNTYVVKSVAYMRRCTCICTHEDADVRLARRIKRDTVEKGRDIATVLDQYSKFVKPAFEDFILPTKKYADIIIPRGGDNHVAIDLIVQHIHTKLGQHDLCKIYPNLYVIQSTFQVVEHGLGHLPFTEKQVVTPTGSVYSGVDFCKKLCGVSVIRSGESMENALRACCKGIKIGKILIHREGDNGQQVCVLSLLITSPNYLLTTNGTHQLIYEKLPSDISERHVLLLDPILGTGNSAVQAIRLLISKGVPESNIIFLNLISAPEGVNVVCKKFPRIKIVTSEIELGLNDEFRVVPGMGEVSIPYHLRKTLQKIREYTGKQHSDEDIFAVYKDSFNDPHETAQKLLFLDTFHEVRSKREKKKEASPIVPVTQPSGRGGRRNFASSNSYQGSGRNASFKRENGANHVTRGSRTAQPATNKASNITVPNETKVSGPASIPSEVSNHKAQDDPSLISASRCSSKSDQAIEIETASKQGKNQSLPKPDVSEQSHVTFPFHLQVAKGLQNGLTFGSFDSNFVKEVSSSNGASGGYDSNFESSHGTGDDERESSPTTNGITGVASARFVTEILSLYILEETSTVSEDKDYGISNSATGAEPVVHSDHIVPPVEEVPKEEALSNTETHQIAYGQEAPLSVFGLVPSLSAIGQPVNTEAAETQPGNSNSPPISLVSYPPDQSSIAAATQQTNFLRQQYPPNFFPYGYYSPYYMPPPYIHQFLSPNGIPQQSYFPQGAALTAPSHAKPVDNTENPPTTNPYLHTSPMVASSIPSTTTLNSIHSEEKASHLTESAAAWIGQGFGNLQVNPMYNLAYQGQPLGFPVVQAGHGGLMGMHQPTQPMAAASTTYQTLPPPPHTTTAMGEPIGHPHIAYQQPQAALTNWVNNY

SEQ ID NO: 15375 - DNA, 1629 bp, Arabidopsis thaliana
  CDS (1)..(1629)
atggcttcaaagtcggatgtgaatataatagagacatcctcaaaggttcatttctcaggatttcatcaaatggatggtttagcttcaaatagaccagagcaaatggctgaggaagaagaacatggtcaaccttttgtgatcggtgagagtcgtggagttgctggaggtgcagcatccgggaaaacaactgtctgtgatatgattatgcagcaactgcatgatcagagagctgttgttgtaaatcaggattctttctaccataatgtaaatgaagtggagcttgtaagagttcatgattacaattttgaccatcctgacgctttcgatactgagcaattattgtcttccatggagaagttaagaaaaggacaagcagtagatattcctaattatgacttcaaaagttacaagaacaatgtttttccacctagaagggtgaatccttctgacgttataattctggaaggtatactcattttccatgaccctcgggtgcgagatttgatgaacatgaagatatttgtagacgcaggtctttcccataccaaacctgttaacacttatgtagtcaaatccgtagcatatatgagacgctgcacttgtatatgtactcatgaagatgccgatgtgcgtctagcgagaaggataaaacgcgatactgttgagaagggcagagatattgccactgttcttgaccagtactcaaagtttgtgaagccagcatttgaggatttcatactcccaacaaagaaatacgcagatataataattccccgaggtggtgataaccatgttgctattgatttgattgtgcaacacatccatacgaagctcggtcaacatgatctctgtaaaatttatccaaatctttatgttattcaatcaacttttcagatacgtggtatgcacactctaatccgcgactctaaaacaacaaagcatgactttatcttctactccgatcgattgatacgtttggtcgttgaacatggcctcggacaccttccctttacagaaaagcaagtggttactccaacaggtaagctaatgaaaaagattataccttactacaatcttggagaagaactctccaatcatagatctgtgtattcgggtgtggacttctgtaagaaactgtgtggtgtctcagttatcagaagcggtgagagtatggagaacgctcttagagcatgctgcaaaggcatcaaaattgggaagattctgattcatagagaaggcgacaatggtcaacaggtttgtgttctttctctgctcatcacttctcctaactatttactaacaacaaatggcactcaccagcttatctacgagaagctaccctcagacatttcagaaaggcatgtgcttttactggatccaatcctcgggacagcaggaaactcggcggtgcaagcgataagactgctcataagtaaaggcgtgcctgaatccaacatcatatttctcaatttgatatctgcacctgaaggagtaaatgtggtgtgcaaaaagttcccaaggataaagattgtgacttcagagatagaactcggtttaaacgacgagttccgagttgttcctggtatgggcgagtttggagaccgctattttggaaccgatgatgagtga

SEQ ID NO: 15376 - protein, 542 aa, Arabidopsis thaliana
MASKSDVNIIETSSKVHFSGFHQMDGLASNRPEQMAEEEEHGQPFVIGESRGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDAGLSHTKPVNTYVVKSVAYMRRCTCICTHEDADVRLARRIKRDTVEKGRDIATVLDQYSKFVKPAFEDFILPTKKYADIIIPRGGDNHVAIDLIVQHIHTKLGQHDLCKIYPNLYVIQSTFQIRGMHTLIRDSKTTKHDFIFYSDRLIRLVVEHGLGHLPFTEKQVVTPTGKLMKKIIPYYNLGEELSNHRSVYSGVDFCKKLCGVSVIRSGESMENALRACCKGIKIGKILIHREGDNGQQVCVLSLLITSPNYLLTTNGTHQLIYEKLPSDISERHVLLLDPILGTAGNSAVQAIRLLISKGVPESNIIFLNLISAPEGVNVVCKKFPRIKIVTSEIELGLNDEFRVVPGMGEFGDRYFGTDDE

SEQ ID NO: 15377 - DNA, 1758 bp, Arabidopsis thaliana
  CDS (101)..(1552)
ctgaattgtgcagaaatcgtcgtcactgatcacttccgattccttttttttctccttaaatcgcaattttcactctcctttaccttcgccgagaaactcaatgccagaagattcaacggcgattgactatgtcatggagaaggcatcggggcctcacttctccggtcttcgccttgacggtcttctttcttctccgtcgaaatcctccgtctcttctccttctcacttccgtttgagtaattcttctttttcggctaccgacgatcccgccgctcctcatcagcccttcgttatcggagttactggtggtacagcttctggtaagacgacggtatgtgacatgataatccagcaacttcatgatcatcgcattgttttagttaaccaggattcgttttaccgtggtttgacatctgaagaacttgagcatgtacaagaatacaattttgatcatcctgatgcctttgacactgagcagcttttgcattgcgttgacatactcaagagtgggcaaccctatcaaattccaatttatgacttcaagacccatcaacgtaaagtagatgcttttcgccaggtcaatgcttgtgatgtcatcattttggaagggattctagtttttcatgactcacgagttcgggacctaatgaatatgaagatcttcgttgacacagatgctgatgtgaggcttgctcgcagaatcaggcgtgacacggttgagaggggtagggatgttgactctgtgcttgaacagtatgcaaagtttgtgaagcctgcgtttgatgattttgtgctcccctcaaagaaatatgctgatgtgatcattccacgaggaggtgacaatcacgttgcagttgatttgattgtgcaacatatccacacaaaacttgggcaacatgatctctgcaaaatctacccaaatgtttttgttattgaaacaacatttcagataagaggcatgcacactctcattcgagagaaggacatatcaaaacatgacttcgtgttttactcagatcgcctcattcgtttggttgtggagcatggtcttggccatttgcctttcactgagaaacaagtagttactccgacaggatctgtgtatagcggtgttgatttctgcaagaaactctgtggggtctcagtcattcgaagtggtgaaagcatggaaaacgcattgcgcgcatgttgcaaagggattaagatagggaagattctcatccatcgtgacggagacaatggaatgcagcttatatacgagaagcttccaagtgatatctccgagcgtcatgtcctgctattagatcctgttttaggcacaggtaactctgcaaatcaggcgatagaactactcatacagaaaggagtacctgaagcccacattatattcctcaatcttatctcagcgccagaaggaatccattgcgtctgcaaacggttcccaaagttgaagattgtgacgtcagaaatcgatcagtgtctgaacgaagagttcagggttataccaggcttgggtgagtttggtgatcgctactttggtaccgacgagtagaagaagtaccaaagtgtttgtcaatggttattgtgcttgtgtgtgaatggaagtgttttactttgtctaaagaatcttcacgggctttgtttttttttagttccctctgcttggaagcttctcgcttactaattactagaattgaaaactcatttcaagattcttggcttaagcagttcatatccgacgactttttcgtcaacaac

SEQ ID NO: 15378 - protein, 483 aa, Arabidopsis thaliana; identical to SEQ ID NO: 3864

SEQ ID NO: 15379 - DNA, 1398 bp, Arabidopsis thaliana; identical to SEQ ID NO: 3865
  CDS (1)..(1398)

SEQ ID NO: 15380 - protein, 465 aa, Arabidopsis thaliana; identical to SEQ ID NO: 3866

SEQ ID NO: 15381 - DNA, 1863 bp, Drosophila melanogaster
  CDS (77)..(1762)
cacgacgaagtaaatcaccgcgtgtttttttctaatcgctgcaactggctgctgcaatcactattctcttgtcgaaatgtctgtgacccagacgaaacaaatcaagttctacaacccatcgagttccgctagctccgacagcgatgaccgttcactctcggatgtcacagagcaactctatgtggatccgtatgccgacctaagcaatggcttgcccggggatctcaactgctgtccggcctcgcccaccacagtgcctgctaaagcatcgttggattcgcctcttaaacgttccggtaggagacagcgaaccacatccattggcaaccagaccaccacagcgaatccgtccgaatgcatcatacgcgcaaataaccgcacgatctacacggccggacgaccgccgtggtacaattgtgctgggcaacaggtggagcccttcgtcataggaatctgcggcggtagtgcctctggcaagaccacagtggctgagaaaatcatcgaaagcctagacgttccatgggtaacactgttgtccatggactgtttctacaagatccttaatgagaaacagcatgagcaggccctgatcaacgaatataacttcgatcacccggatgccttcgacatcgagctgctgctggacgtgctcaccaagctgaaggagggccgaaaggtggaagttcctgtctataattttgtgacacatggtcgtgagagccaaacgaaaaccatgtacggggccaatgtgatcatcttcgagggtattcttacctttcatagtcctgaagtacttaaattgctagacatgaagatatttgtggacacagatcccgatattcgtctggccaggcggttaagaagggacatctctcagcgcggacgagacctcaagggcgtgctgaagcaataccttaatatggttaagccctcctattgcaattacatagctccaacaatggcccatgcagatatcattgttcctcgtggaggcgacaacaaggtggccatccatctcattgttcagcacgtgcacacacagctgcaactgcgcggatttaagctgcgcgaaactctggccaactcctacaaggaccagccaatgccacattctctgcacttgctgcatcccacgccccaaataaagggcctgcacacgttcatccgttgccgaaatacgtcccgcgatgagtttattttttactcaaagcgcctgatacggctagtcattgaatatgcgctaagcttatttccctttaagaaaacaacagtggagactccacaaggtgtcctttacgagggcaagcgtatggaatcgcgaaaaatatgcggcgtctcaattctccgagctggtgaaacaatggaacaagccgtttgtgatgtgtgcaaggacattcgcatcggaaagatcctcatccagaccaatcttaagaccggcgagccggagctttactacctgaggctgcctaaagacataaaagactacaaggtgatactaatggatgccaccgtggccacaggagcagcggccatgatggccattcgggtgctgctggatcacgatgtacccgaggacaacattatcttggcctcgcttttgatggctgagatcggtgtgcactccattgcctatgccttcccaaaggtgaaaattgttacttccgctctggatccggagattaatagtaagttttatgttatacccggcattggtaactttggcgatcgctactttggcacggaaccctctgatgagtactaaggagatctgggccaatccatacctatatggaaccatcaagtttctaatgtatcttaggttaagttcaaaacgttacttaaattatgaatttggaacgagat

SEQ ID NO: 15382 - protein, 561 aa, Drosophila melanogaster; identical to SEQ ID NO: 3868

SEQ ID NO: 15383 - DNA, 1847 bp, Homo sapiens
  CDS (45)..(1691)
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcaacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgttgaatacaaagatgttaatttttaaaatgttactagtataatttattctatgcattttataaaataaataaagctttagaaaaaaaaaaaaaaaaaa

SEQ ID NO: 15384 - protein, 548 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAINLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 15385 - DNA, 23 bp, Primer
atgtcccatcgtatagcaccttc

SEQ ID NO: 15386 - DNA, 27 bp, Primer
tcaatcacaaccaaaatactttgaatc

SEQ ID NO: 15387 - protein, 466 aa, consensus
  MISC_FEATURE (1)..(466): consensus for the disclosure of Xaa see table VIII
IXXXXXXXGXXXSGKXXXXXXXXXXXXXXXXXXXXXXXFYXXXXXXXXXXXXXXXXXFDXPXXXXXXXXXXXXXXXXXGXXXXXPXYXFXXXXXXXXXXXXXXXXXXXXXEGIXXXXXXXXXXXLXXXXXXXXXXXXXXXXXXXXXXXXXXXXXXXXXXXXXXDXDXXLXRRXXRDXXXXGRXXXXXXXQXXXXVKPXXXXXXXXXXXXXXXXXPXXXXNXXAXXXXXXXXXXXLXXXXXXXXXXXXXXXXXXXXXXXXXXXXXXXXXXXXXXXXXXXXXXXXXXXXXXXXXXFXXXRXXXXXXXXXXXXXXXXXXXXXXXXXXXXXXXXXXXXXXXXXXXXXXXXXXXXXXXXXXXXXXXRXGXXXXXXXXXXXXXXXXGXXLXXXXXXXXXXXXXXXXXXXXXXXXXXXXXXXXXXXXXXXPXXXXXXXXXXXXXXXXXXXXXXXXXXXAXXXLXXXXXXXXXI

SEQ ID NO: 15388 - protein, 528 aa, consensus
  MISC_FEATURE (1)..(528): consensus for the disclosure of Xaa see table VIII
IGXXXXXXGXXXSGKTXVXXXIXXXXXXXXXVXXXXDXFYXXLXXXXXXXXXXXXYXFDXPXAXDXXXXXXXXXXLXXGXXXXXPXYXFXXHXXXXXXXXXXXXXXVXXXEGIXXXXDXXXXXXLXXXKXXVDXXXXXXXXXXXXXXXXXXXXXXXXXXXXXXDXDXXLXRRXXRDXXXRGRXXXXXXXQXXXXVKPXXXXXXXPXXXXADXXXPXXXXNXXAXXXXXXHXXXXLXXXXXXXXXXLXXXXXXXXXXXXXXXXXXXXXXXXXTXQXXXXXTXXXXXXXXXXDFXFYXXRXXXXXXXXXLXXXXXXXXXXXXXXXXXXXXXXXXXXXXXXXXXXXXXXXXXXXXXXXXXXXXXRXGXXXXXXLXXXXXXXXIGKXLIXXXXXXGXXXXXXXXXXXXXXXXXXXXXXXXXLXXXXLPXXIXXXXXXXVXLXDXXXXXXGXXXXXAXXXLXXXXVXXXXIXXXXXXXXXXGXXXXXXXFXXXXXXXXXXXXXXXXXXXXXXXXXXXXXXXXXXXXXXXXYFG

SEQ ID NO: 15389 - protein, 45 aa, consensus
  MISC_FEATURE (1)..(45): consensus for the disclosure of Xaa see table VIII
XXIXXXXXXXGXXXSGKXXXXXXXXXXXXXXXXXXXXXXXFYXXX

SEQ ID NO: 15390 - protein, 78 aa, consensus
  MISC_FEATURE (1)..(78): consensus for the disclosure of Xaa see table VIII
XXFDXPXXXXXXXXXXXXXXXXXGXXXXXPXYXFXXXXXXXXXXXXXXXXXXXXXEGIXXXXXXXXXXXLXXXXXXXX

SEQ ID NO: 15391 - protein, 72 aa, consensus
  MISC_FEATURE (1)..(72): consensus for the disclosure of Xaa see table VIII
DXDXXLXRRXXRDXXXXGRXXXXXXXQXXXXVKPXXXXXXXXXXXXXXXXXPXXXXNXXAXXXXXXXXXXXL

SEQ ID NO: 15392 - protein, 42 aa, consensus
  MISC_FEATURE (1)..(42): consensus for the disclosure of Xaa see table VIII
XXXXXXXXXXXXXXXXXXXXXXXXXXXXFXXXRXXXXXXXXX

SEQ ID NO: 15393 - protein, 29 aa, consensus
  MISC_FEATURE (1)..(29): consensus for the disclosure of Xaa see table VIII
XXXXXRXGXXXXXXXXXXXXXXXXGXXLX

SEQ ID NO: 15394 - protein, 49 aa, consensus
  MISC_FEATURE (1)..(49): consensus for the disclosure of Xaa see table VIII
XXXXXXPXXXXXXXXXXXXXXXXXXXXXXXXXXXAXXXLXXXXXXXXXI

SEQ ID NO: 15395 - DNA, 612 bp, Escherichia coli
  CDS (1)..(612)
atgaacatgccaatgaccgaaagaataagagcaggcaagctatttaccgatatgtgcgaaggcttaccggaaaaaagacttcgtgggaaaacgttaatgtatgagtttaatcactcgcatccatcagaagttgaaaaaagagaaagcctgattaaagaaatgtttgccacggtaggggaaaacgcctgggtagaaccgcctgtctatttctcttacggttccaacatccatataggccgcaatttttatgcaaatttcaatttaaccattgtcgatgactacacggtaacaatcggtgataacgtactgattgcacccaacgttactctttccgttacgggacaccctgtacaccatgaattgagaaaaaacggcgagatgtactcttttccgataacgattggcaataacgtctggatcggaagtcatgtggttattaatccaggcgtcaccatcggggataattctgttattggcgcgggtagtatcgtcacaaaagacattccaccaaacgtcgtggcggctggcgttccttgtcgggttattcgcgaaataaacgaccgggataagcactattatttcaaagattataaagttgaatcgtcagtttaa

SEQ ID NO: 15396 - protein, 203 aa, Escherichia coli
MNMPMTERIRAGKLFTDMCEGLPEKRLRGKTLMYEFNHSHPSEVEKRESLIKEMFATVGENAWVEPPVYFSYGSNIHIGRNFYANFNLTIVDDYTVTIGDNVLIAPNVTLSVTGHPVHHELRKNGEMYSFPITIGNNVWIGSHVVINPGVTIGDNSVIGAGSIVTKDIPPNVVAAGVPCRVIREINDRDKHYYFKDYKVESSV

SEQ ID NO: 15397 - DNA, 558 bp, Mesorhizobium loti MAFF303099
  CDS (1)..(558): transl_table=11
atggcgcatgagggccgcacaaggacaattgctgcgagaacgtcggaatcggcggccatgctggcggacgtcaagcgggcgatggcgatcactgcccgtctcaaccgcttgacgtttaacgacgcggacgaagtccgcttcctgttcggcgagctgatcggcagacaagtggacggcagcttcctgctgatcccgcccttctacgcgactggcggcgccgggacccgagtagggcgcaatgtcttcatcaatcagaactgcactttttatgatcttggcgggctcgacattgccgacgatgtgctgatcgggccgaatgtcagcctgatcacgtcaggccatccgctcgaaccgtcgcggcgccgcgccttcaccaccgcgaggccgatcgtcatcgaacgcaacgtctggatcgccgccggcgctacggtgatcggcggcgtgacggtcggcgaaaacgccgtcgtcgcggcaggctcggtggtcacgaaagacgttcccgcgaacacgcttgtcggcggaaacccggcgcgggttatccggtccattgccgagtga

SEQ ID NO: 15398 - protein, 185 aa, Mesorhizobium loti MAFF303099
MAHEGRTRTIAARTSESAAMLADVKRAMAITARLNRLTFNDADEVRFLFGELIGRQVDGSFLLIPPFYATGGAGTRVGRNVFINQNCTFYDLGGLDIADDVLIGPNVSLITSGHPLEPSRRRAFTTARPIVIERNVWIAAGATVIGGVTVGENAVVAAGSVVTKDVPANTLVGGNPARVIRSIAE

SEQ ID NO: 15399 - DNA, 591 bp, Mesorhizobium loti MAFF303099
  CDS (1)..(591): transl_table=11
atgggatttgcaagaaaacttcgaaccatgctcggtcttagacgagcgccaaagccggaaaagataccgctgcacgcatcgatcgggcgaagaacgctcttttacacgaagcccagcaatatctatggctgtgacgagacctcgccgcttgagataggagcgttctgctccatagcggaggagacgctgttcctttgccgcgccaatcatccgacgcacttcgtctcgacttttccatttgaagttcacatgacaaattcgatcgcggcctttgatgacctggtggtcaacgggccgacaaaaatcggcaacgatgtctggattggacgacgcgcaatcatcctgccgggaataaccattggagatggtgccgttgtcggagccggctcggtcgtcacgaaggacgtcgcaccctacgcggtcgtcgcgggaaatcccgccaggttcatccggaacaggtttacggatgaccagatcgcgagtttgctggcgattcgctggtgggagtggagcgacgagaggatcaaggccgaactgccgaccttccttggatcgattgatgccttcatcgccgccaaccgtgcatcatag

SEQ ID NO: 15400 - protein, 196 aa, Mesorhizobium loti MAFF303099
MGFARKLRTMLGLRRAPKPEKIPLHASIGRRTLFYTKPSNIYGCDETSPLEIGAFCSIAEETLFLCRANHPTHFVSTFPFEVHMTNSIAAFDDLVVNGPTKIGNDVWIGRRAIILPGITIGDGAVVGAGSVVTKDVAPYAVVAGNPARFIRNRFTDDQIASLLAIRWWEWSDERIKAELPTFLGSIDAFIAANRAS

SEQ ID NO: 15401 - DNA, 558 bp, Mesorhizobium loti MAFF303099
  CDS (1)..(558): transl_table=11
atgacgggaagcgaacgcgcgaagatggcggccggcgaatggtacacttgcctcgatgacgaactggaggcgctgcgtgccctcgcgcgcgacgcggtgttcgagcacaattgcctgccgccgcggcagcgcggcaatctcgggccgggcctgaaggcattgctcggcggcgtgggcgatggcgcccgcgtcgaggcgccgttccactgcgcctacggcttaaacatttttctcggcgacggcgtcttcctcaatgccggctgcaccattctcgacacggcagccgtacgcatcggcaagggaacgctgcttggccccaatgtgcagatctattgcgccgaacaccacaggcaagctgctgggcgacaggcggggctggagatcgccaggccggtcgagatcggcgcccatgcctggatcggcggcagcgccatcatccttggcggcgtcaccatcggcgagggcgccatcgtcggcgccggcgcggtggtgacgcgtgatgtgcctgcaaacgagacggcggtcggcaatccggcgcgaccggtcaagcgcggctga

SEQ ID NO: 15402 - protein, 185 aa, Mesorhizobium loti MAFF303099
MTGSERAKMAAGEWYTCLDDELEALRALARDAVFEHNCLPPRQRGNLGPGLKALLGGVGDGARVEAPFHCAYGLNIFLGDGVFLNAGCTILDTAAVRIGKGTLLGPNVQIYCAEHHRQAAGRQAGLEIARPVEIGAHAWIGGSAIILGGVTIGEGAIVGAGAVVTRDVPANETAVGNPARPVKRG

SEQ ID NO: 15403 - DNA, 579 bp, Vibrio cholerae O1 biovar eltor str. N16961
  CDS (1)..(579): transl_table=11
atgaagatgagcgaattagaaaaaatgctcaaaggtgaacactttgacggcgcatccgcggaaattgaggcactgcgcagccaagcgggaaggctcaagctcgagatcaaccaaagtcttgatgaagcggagcgctatgcactgcaacgtgagctgtttggtcatctcggtcataaaagttgcgtacagcctccttttcactgtgagtttggcaaaaccattcgtattggcgatcacaccttcatcaacatgaacgtggtgatgttggatggtgcacccatcacgattggggatcacgtattaatcggcccgagtactcaattttacaccgcatcgcactctttagattatcgtcgtcgccaagcgtgggaaaccatctgcaaaccgattgtgattgaagatgatgtctggattggtggaaatgtcgtcattaatcaaggggtcacgattggtgctcgttctgtcgtagcggcgaattccgtggtcaatcaggatgttccaccggatacgttagtcggtggcactcctgcgcgtattttgcgctcactaaaagatcctgccgaatcaatggcagaatga

SEQ ID NO: 15404 - protein, 192 aa, Vibrio cholerae O1 biovar eltor str. N16961
MKMSELEKMLKGEHFDGASAEIEALRSQAGRLKLEINQSLDEAERYALQRELFGHLGHKSCVQPPFHCEFGKTIRIGDHTFINMNVVMLDGAPITIGDHVLIGPSTQFYTASHSLDYRRRQAWETICKPIVIEDDVWIGGNVVINQGVTIGARSVVAANSVVNQDVPPDTLVGGTPARILRSLKDPAESMAE

SEQ ID NO: 15405 - DNA, 561 bp, Bacillus halodurans C-125
  CDS (1)..(561): transl_table=11
atgagaacagaaaaagaaaaaatgctagcaggagaacgatataaggcatgggatccagagctagtcaaggatcgagagagggcaagacggttaacacgtctgtttaatcaaacgacagaaactgaggagaagcagcgaacggaattgatcaaagagctgttcggctctatgggagaaagcgtcaatattgaaccaacatttcgatgtgattatggctataacatccatgtagggaacaacttttttgccaattttgattgtgttattttagatgtttgtgaagtgcgaattggcgcaaactgtatgcttgctccgggagtccatatttatacagctacccaccccattcacccacttgagcgagtggagggtcctgaatatggaaaaccggttacgatccggaataatgtttggattggtggccgagcgatcgttaatcctggagtgacgataggaaataatgctgttattgcctcgggatcagtagtaacgaaagatgttccagaaaatgtagttgttgctggaaatcctgccaaagttattcaaacgattgacgtgtaa

SEQ ID NO: 15406 - protein, 186 aa, Bacillus halodurans C-125
MRTEKEKMLAGERYKAWDPELVKDRERARRLTRLFNQTTETEEKQRTELIKELFGSMGESVNIEPTFRCDYGYNIHVGNNFFANFDCVILDVCEVRIGANCMLAPGVHIYTATHPIHPLERVEGPEYGKPVTIRNNVWIGGRAIVNPGVTIGNNAVIASGSVVTKDVPENVVVAGNPAKVIQTIDV

SEQ ID NO: 15407 - DNA, 612 bp, Pasteurella multocida subsp. multocida str. Pm70
  CDS (1)..(612): transl_table=11
atgttgacagacaaagaaaaacgacatttaggtttagcgcatcagccttatgatccggaattggcagagatgcgtttacgtaataaagaattattgcatgaatataatgtgttaactcgcccttcagataaacaaacaaaagcccgtttgatcttatctattcttggtaaagctgcgaatacacctcacattaatacgcctttttattgtgattacgggcaatttattgaagtcggaaaaaacttttttgcgaattatcactgtactatcctagatacaggaggcgtgaagattggcgatgatgtgttatttgctccgaatgtgagtttatacaccgtagggcatccaattgatcctgaattgcgtaaggcagaatgggaacaagcactacccattgtgattgggaataatgtgtggattgggggcaatgtggtgattttaggcggcgttactattggtgacaatactgtgattggggcgggttctgtggtcacaaaagatattccggcaaattgtgtagccgtgggcaatccatgtaaagtacaacgaatgattagcccgcaggaccgagaggattatttacaacgttttaaaccagactggaatgattga

SEQ ID NO: 15408 - protein, 203 aa, Pasteurella multocida subsp. multocida str. Pm70
MLTDKEKRHLGLAHQPYDPELAEMRLRNKELLHEYNVLTRPSDKQTKARLILSILGKAANTPHINTPFYCDYGQFIEVGKNFFANYHCTILDTGGVKIGDDVLFAPNVSLYTVGHPIDPELRKAEWEQALPIVIGNNVWIGGNVVILGGVTIGDNTVIGAGSVVTKDIPANCVAVGNPCKVQRMISPQDREDYLQRFKPDWND

SEQ ID NO: 15409 - DNA, 771 bp, Lactococcus lactis subsp. lactis Il1403
  CDS (1)..(771): transl_table=11
atggaagcacaaaaactatcagcacaagaaataattcaatttatcgggaacgctgagaaaaaaacacgtgtcaaggtaaccttatcaggaatgcctagttttaaagcagctggttttcttgctgaaaatgggcgtccaaattttaaggcactagccaataaaggaatccaagttctgggagattttcacacacattacagcttaaaaattatcattggagattggcaagcagtacgtccattgctttctggcttgactgagaataaagattacaccctagaacttgaaggccgaaattcagctgttcctctccttgataccagagaaatcaatgctcgaattgagccaggagcaattattcgtgaccaagtaactattggcgatagtgcggtcattatgatgggggctatcatcaatatcggagctgaaattggtgaaggcacaatgattgatatgggggcaattttgggtggccgtgcgacggttggtaagaactctcatattggtgctggagctgttttggctggtgttattgagcctgcaagtgctgaacctgttcgtgttggggataatgtccttgtgggagccaatgctgttgtaatcgaaggagtacaagtcggttcaggttctgttgttgcagcaggggcaattgttacccaagatgttccagaaaacgttgttgttgcgggtgttccagctcgaattatcaaagaaatagatgaaaaaacacaacaaaaaacggctttagaagatgcccttagaaatttgtaa

SEQ ID NO: 15410 - protein, 256 aa, Lactococcus lactis subsp. lactis Il1403
MEAQKLSAQEIIQFIGNAEKKTRVKVTLSGMPSFKAAGFLAENGRPNFKALANKGIQVLGDFHTHYSLKIIIGDWQAVRPLLSGLTENKDYTLELEGRNSAVPLLDTREINARIEPGAIIRDQVTIGDSAVIMMGAIINIGAEIGEGTMIDMGAILGGRATVGKNSHIGAGAVLAGVIEPASAEPVRVGDNVLVGANAVVIEGVQVGSGSVVAAGAIVTQDVPENVVVAGVPARIIKEIDEKTQQKTALEDALRNL

SEQ ID NO: 15411 - DNA, 612 bp, Lactococcus lactis subsp. lactis Il1403
  CDS (1)..(612): transl_table=11
atgaataagaaacaattaaagacactaattaattcaggaaaaacatacgatgacgccgatttagacttgtctgaatatcgtaaccatgccctttttgaaagccgccgttataatcaaaaaattaataacaatgagggttatcatccagaaatcttagagaatctttttgaacatttaggtaaaaatccttatattgaatctaattttcgctgtgaatttggcttcaatataagaattggcgataatgtcctcattaatcatgatatgattattttagactgtaatcaggtcacgattggcaataatgtttactttggtccccgctgtggtttatttgctgccaatcattcggaagatccaagtttaagaactgctggcggggtctattcaaagccaattacggttgggaaccaagtctggttgggggcaaatgtcagccttcttcctggtgtaagcattggtgacaatagtattattggtgcaggaagcgtcgttaccaaagatattccagaaaatgtgattgctgctggtaatccttgccaagtgatacgtccaattcgaacagaggatcaagaatggattaaaaaagataaattatttatttcaaaataa

SEQ ID NO: 15412 - protein, 203 aa, Lactococcus lactis subsp. lactis Il1403
MNKKQLKTLINSGKTYDDADLDLSEYRNHALFESRRYNQKINNNEGYHPEILENLFEHLGKNPYIESNFRCEFGFNIRIGDNVLINHDMIILDCNQVTIGNNVYFGPRCGLFAANHSEDPSLRTAGGVYSKPITVGNQVWLGANVSLLPGVSIGDNSIIGAGSVVTKDIPENVIAAGNPCQVIRPIRTEDQEWIKKDKLFISK

SEQ ID NO: 15413 - DNA, 603 bp, Lactococcus lactis subsp. lactis Il1403
  CDS (1)..(603): transl_table=11
atgagaacgttagatgaagcagaaaaattacgtttagcaaagctatctatttttgataaaataaataaaggtgattggtaccaatatagcaaagaagtagaactacaaaaaatagtcaaaaattctagtcaaaaaatttctgaaattaatgataaggcaaaagaaaatattgatgaagcaagaaaactcttggaggattttcttccaaatttacctcaaagttcagaaatatattttccaataattgctttggaatatcccaatcgttttaaagtcggagaaaatacttttattaatagtggacttcagattattagtgcgggtaaggttaagattgggaaaaactgttttattggaccaaattgtcaattatttacacctaatcatcatgccagggatgtgtttttaagacgtgaaggctggcaatatgatgggccaatagtaattggtaatgattgttggcttggcggttcagtgattcttttgcctggagtttctttaggagatgatgttgtcgttggtgctggctctgtggtgaccaaatcatttcctagccactgcataattgctggaaatccggcacgcttaataaaaaatgaataa

SEQ ID NO: 15414 - protein, 200 aa, Lactococcus lactis subsp. lactis Il1403
MRTLDEAEKLRLAKLSIFDKINKGDWYQYSKEVELQKIVKNSSQKISEINDKAKENIDEARKLLEDFLPNLPQSSEIYFPIIALEYPNRFKVGENTFINSGLQIISAGKVKIGKNCFIGPNCQLFTPNHHARDVFLRREGWQYDGPIVIGNDCWLGGSVILLPGVSLGDDVVVGAGSVVTKSFPSHCIIAGNPARLIKNE

SEQ ID NO: 15415 - DNA, 612 bp, Lactococcus lactis subsp. lactis Il1403
  CDS (1)..(612): transl_table=11
gtgaaaatgagcgaatttaaaagaatggttgctggcgaactctataaagcaagtaaagttgaaccagaatacaaacctgataataatcgagcattaaatcaagaaattaaccaactcaatctacttgatacagaaaaaattgtggcacttgaaaaagaactttttggtcaaactggtgatgagttatttgtaaatccaccgctttacatcgactatggtaaaaatacaagaattggtcagcgcttttatgccaatatggactgtatttttctggatgttgcaccgattacgattggcgatgatgtgatgtttggacctcgcgtcagtctgattacggcttctcatccaattgatgccggagttcgacagcgtggactagaatatggaaaagcgattacgattggtaatcgagtttggctcggtgcaggagtaattgttaatccgggcgttacgattggcgaaaatacaattgtgggttcaggaacggtagtgacaaaaaatttgccagcaaatgtgattgcagtaggtaatccagcacgaattctccgcgaaattactgattctgaccgactttactgggaagaaaaagagaacgaatattatgaaaaataa

SEQ ID NO: 15416 - protein, 203 aa, Lactococcus lactis subsp. lactis Il1403
MKMSEFKRMVAGELYKASKVEPEYKPDNNRALNQEINQLNLLDTEKIVALEKELFGQTGDELFVNPPLYIDYGKNTRIGQRFYANMDCIFLDVAPITIGDDVMFGPRVSLITASHPIDAGVRQRGLEYGKAITIGNRVWLGAGVIVNPGVTIGENTIVGSGTVVTKNLPANVIAVGNPARILREITDSDRLYWEEKENEYYEK

SEQ ID NO: 15417 - DNA, 462 bp, Lactococcus lactis subsp. lactis Il1403
  CDS (1)..(462): transl_table=11
atgttttcagaaattggggaaaattgttttattcaaccccctttttatgctaattttggcggaaaaaatgttcattttgggacagagatttatgctaattttaatctaacattggttgacgatacagatatttttgtaggaaatcatgtcatgtttggaccaaatgttacgattgacacggcgacacatcctgtctcgcctgacttacgtaaacgaggggctcaatataataaaaaagtttacattgaagaaaacgtttggctaggtgctggtgtaattgttttacctggtgttagaattggaaaaaatagtgtgattggcgcagggagtcttgtaactaaagacattccagataatgtggttgcttttggaactccttgtatggttaaaagaaaaattaatgattctgactttaaaacttatgatcatggaaaaaagattgatttagatgagttcatctga

SEQ ID NO: 15418 - protein, 153 aa, Lactococcus lactis subsp. lactis Il1403
MFSEIGENCFIQPPFYANFGGKNVHFGTEIYANFNLTLVDDTDIFVGNHVMFGPNVTIDTATHPVSPDLRKRGAQYNKKVYIEENVWLGAGVIVLPGVRIGKNSVIGAGSLVTKDIPDNVVAFGTPCMVKRKINDSDFKTYDHGKKIDLDEFI

SEQ ID NO: 15419 - DNA, 567 bp, Streptococcus pyogenes M1 GAS
  CDS (1)..(567): transl_table=11
atgaccacagaatttgacaaaatgactagaggcgaatggtatgatgctaattttgattcggaactgattcaaaaacgcatgatggcacaagacctctgtttcgatttaaaccaattaaagcctagtcgagaagaagaacgctctgccgttttaaaccaactttttggacaatcttttgagggcttggtcctgctcagccctttcatctgtgactatggtaagaacattacttttgggaagaattgctttattaacagcaattgttatttcatggatggggcgaagattgccttgggcgataatgtctttgtaggtccttcgacaggtttttacacggcaaatcaccctctagattataaacgccgcaatgaggggcttgaaaaagctttaccaattaccataggagataatgtctggtttggtgccaatgtcaatgttatgcccggcgttactattggcagtggttgtgtgattgcgtcaggatcagttgttacccatgatattccagtcaattcccttgcggcaggtgttccttgccaagttgtacggaaaattgagcaggagtag

SEQ ID NO: 15420 - protein, 188 aa, Streptococcus pyogenes M1 GAS
MTTEFDKMTRGEWYDANFDSELIQKRMMAQDLCFDLNQLKPSREEERSAVLNQLFGQSFEGLVLLSPFICDYGKNITFGKNCFINSNCYFMDGAKIALGDNVFVGPSTGFYTANHPLDYKRRNEGLEKALPITIGDNVWFGANVNVMPGVTIGSGCVIASGSVVTHDIPVNSLAAGVPCQVVRKIEQE

SEQ ID NO: 15421 - DNA, 513 bp, Neisseria meningitidis Z2491
  CDS (1)..(513): transl_table=11
ttgatgggatcaaaattctttttcctgctgctgcgttttgccggttcggtgttgccgccgtcgcatatgcgcggcatcgtcggcagacgggtacgcggttttttggcgcggcgggtttctccgcatatcggacgcggggtcaatatcgaacgcggggcgtatgtgtttccggatacggttttgggcgacggctcgggcatcggggcaaactgtgaaatctgccgtgggccggtggtcggcaaaaatgtgatgatggagccggaatgcctgctctattcgaccaaccacaagtttgaccgtgaaaacaaacgctttgagggctacacggaaatccgtccgattacgttggaggacgatgtctggccggggcgcagggtgattgtaatggcaggcgtaaccgtcggacgcggctcggtcgtgggcgcaggcgcggtggttacaaaagacattccgccctactctttggcggcaggcaatccggcagtggtgaaaaagaatctgccggaaggttga

SEQ ID NO: 15422 - protein, 170 aa, Neisseria meningitidis Z2491
MMGSKFFFLLLRFAGSVLPPSHMRGIVGRRVRGFLARRVSPHIGRGVNIERGAYVFPDTVLGDGSGIGANCEICRGPVVGKNVMMEPECLLYSTNHKFDRENKRFEGYTEIRPITLEDDVWPGRRVIVMAGVTVGRGSVVGAGAVVTKDIPPYSLAAGNPAVVKKNLPEG

SEQ ID NO: 15423 - DNA, 549 bp, Escherichia coli O157:H7
  CDS (1)..(549): transl_table=11
atgcaggatttaagcggtttctcggtgccgaaagggttccggggcggcaacgctattaaagtgcaattgtggtgggcagtacaggcaacaatatttgcctggtcgccacaagtattgtatcgctggcgggcatttttattacgtttattcggcgcaaaaataggaaaaaacgtagttattcgtccgtcagtaaaaattacctatccgtggaaattaaccttaggtgattacgtgtgggtcggcgatgacgtcaatttatataccctcggtgaaataaccattggcgcacattcggtgatatcgcaaaaaagttatttatgcaccgggagccacgaccatgcaagtcaacatttcaccattaacgccacgcctattgtgattggcgagaaatgctggctggcaaccgatgtttttgttgccccaggcgtcacgattggcgacggcaccgtcgtgggtgcgcgaagcagtgtttttaaatcgcttccggcaaatgtggtttgccgggggaatcccgcagtggtgatacgcaaacgcgttgaaactgaataa

SEQ ID NO: 15424 - protein, 182 aa, Escherichia coli O157:H7
MQDLSGFSVPKGFRGGNAIKVQLWWAVQATIFAWSPQVLYRWRAFLLRLFGAKIGKNVVIRPSVKITYPWKLTLGDYVWVGDDVNLYTLGEITIGAHSVISQKSYLCTGSHDHASQHFTINATPIVIGEKCWLATDVFVAPGVTIGDGTVVGARSSVFKSLPANVVCRGNPAVVIRKRVETE

SEQ ID NO: 15425 - DNA, 558 bp, Streptococcus pneumoniae TIGR4
  CDS (1)..(558): transl_table=11
atgactagcgaataccagaaaatgatagcaggagagttttaccgtccatcagacccagaactgagagccttagctcaggcttctcgccaaaaacaggccgcctttaacaaggaagagaaccccttgaagggagccgaaatcatcaagacttggtttgcctcaaccgggaaaaatctttacatcaacactcgcttgatggtggactacggtgtcaacatccatctaggggaaaatttttattctaattggaacttgaccatgctggatatctgtcccattcgtatcggggacaatgctatgattggtcctaattgtcagtttttgacacccctccatccactagatccacaggaacgcaattcaggtatcgagtacggaaagcctatcacaatcggagataatttctggactggtggtggcgtcattgtccttcctggagtgacactgggaaataatgtcgttgcaggagcaggggcagtaattaccaaatcttttggcgacaacgttgtcctagctggcaatcctgcgcgcgtgattaaggaaatacctgttaaatag

SEQ ID NO: 15426 - protein, 185 aa, Streptococcus pneumoniae TIGR4
MTSEYQKMIAGEFYRPSDPELRALAQASRQKQAAFNKEENPLKGAEIIKTWFASTGKNLYINTRLMVDYGVNIHLGENFYSNWNLTMLDICPIRIGDNAMIGPNCQFLTPLHPLDPQERNSGIEYGKPITIGDNFWTGGGVIVLPGVTLGNNVVAGAGAVITKSFGDNVVLAGNPARVIKEIPVK

SEQ ID NO: 15427 - DNA, 561 bp, Clostridium acetobutylicum ATCC 824
  CDS (1)..(561): transl_table=11
atgtttaagtcaataaggtatgatataaatagagttttgcagaatgatcctgctgcgaggaacggacttgaagtttttttgttgtatccatgtatacatgcacttatttggtatagaatagcccacgttttttataaacataagatgttttttattgcaagactattatcacaaattgtaagagcttttacaggaatagagattcatccaggagcgactataggaaaaggactttttattgatcatggtatgggagttgtaataggagaaacagctgaaataggtgataatgttgttatgtatcatggttctaccttagggggaactggaaaggaaactggcaagagacatccaactgttggaaataatgtgtttataggttcaggtgcaaaggtgttaggaccaataaaacttggtgatggatgtaagataggtgctaatgctgttgttcttaaagatgtaccttccaatagtacagctgtaggtattccagcaaaagtaattttgcccagtagtaaaaaagaaaaagtaattgattttaatgattattgcaataaataa

SEQ ID NO: 15428 - protein, 186 aa, Clostridium acetobutylicum ATCC 824
MFKSIRYDINRVLQNDPAARNGLEVFLLYPCIHALIWYRIAHVFYKHKMFFIARLLSQIVRAFTGIEIHPGATIGKGLFIDHGMGVVIGETAEIGDNVVMYHGSTLGGTGKETGKRHPTVGNNVFIGSGAKVLGPIKLGDGCKIGANAVVLKDVPSNSTAVGIPAKVILPSSKKEKVIDFNDYCNK

SEQ ID NO: 15429 - DNA, 615 bp, Clostridium acetobutylicum ATCC 824
  CDS (1)..(615): transl_table=11
atgaatcaaaaagaaagaatgctggcaggtcttccgtataaggcttggctagatggattattagaggaacgaatggataataaaaagaagatatatgagtataatcattgcaaaccagatgaaagtgaaaaaatagatgagttaataaaggatattttcggtaaagtaggtgtaggtgcacatattgaagcaccgtttcattgtgattatggaaaaaatattgaaatcggagataatttttttgcaaactacaactgtattattttagatgttggaaaagtgactataggcgacaatgtacaatttgctccaaatgtatctctatatacagcaggacatccaatacatcctgcttcacgtaattctggatatgagtatggtattagtataactataggaaataatgtttggcttggtggaaatgttgttgtaaatcctggggtccatataggggataatgttgttgttggttcaggaagtgttgttacaaaggatattcctgataatgtaatagcagttggaaatccgtgtaaagttattcgtgaaattacagaagaagaccgaaaatattattataaaaactatgagtttgatgttgatgattatactgtttaa

SEQ ID NO: 15430 - protein, 204 aa, Clostridium acetobutylicum ATCC 824
MNQKERMLAGLPYKAWLDGLLEERMDNKKKIYEYNHCKPDESEKIDELIKDIFGKVGVGAHIEAPFHCDYGKNIEIGDNFFANYNCIILDVGKVTIGDNVQFAPNVSLYTAGHPIHPASRNSGYEYGISITIGNNVWLGGNVVVNPGVHIGDNVVVGSGSVVTKDIPDNVIAVGNPCKVIREITEEDRKYYYKNYEFDVDDYTV

SEQ ID NO: 15431 - DNA, 600 bp, Staphylococcus aureus subsp. aureus Mu50
  CDS (1)..(600): transl_table=11
atgactgaaaaagaaaaaatgttagcagaaaaatggtacgatgcaaactttgatcaagacttaatcaatgaacgtgcacgagcgaaagatatttgctttgaattaaatcatacaaagccgagtgatacaaataaaagaaaggaattaatcgatcaattatttcaaacaacaacagacaatgtaagtatttcgattccttttgatacagattatggttggaacgttaaactaggaaaaaatgtctatgtaaacaccaattgttattttatggatggtggacagattacaattggcgataatgtttttataggacctaattgtggattctacacagcaacacatccacttaatttttatcatagaaatgaaggttatgaaaaagccggacccattcatattggcagtaatacttggtttggcggtcatgtagccgtgttaccaggggtgacgattggagaaggcagtgtgattggtgctggtagtgttgtcactaaagatattccgccacacagcttagcggttggaaacccttgtaaagtcgttcgtaaaattgataatgacctaccatccgaaacattaaatgacgaaacgataaagtag

SEQ ID NO: 15432 - protein, 199 aa, Staphylococcus aureus subsp. aureus Mu50
MTEKEKMLAEKWYDANFDQDLINERARAKDICFELNHTKPSDTNKRKELIDQLFQTTTDNVSISIPFDTDYGWNVKLGKNVYVNTNCYFMDGGQITIGDNVFIGPNCGFYTATHPLNFYHRNEGYEKAGPIHIGSNTWFGGHVAVLPGVTIGEGSVIGAGSVVTKDIPPHSLAVGNPCKVVRKIDNDLPSETLNDETIK

SEQ ID NO: 15433 - DNA, 552 bp, Escherichia coli K12
  CDS (1)..(552): transl_table=11
atgagcacagaaaaagaaaagatgattgctggtgagttgtatcgctcggcagatgagacgttatctcgcgatcgcctgcgcgctcgtcagcttattcaccgatacaatcattccctggcggaagagcacacattacgccagcaaattctcgctgatctattcggtcaggtgacagaggcttatattgagccaacgtttcgctgtgactatggctataacatttttctcggtaataattttttcgccaacttcgattgcgtgatgcttgatgtctgccctattcgcatcggtgataactgtatgttggcaccaggcgttcatatctacacggcaacacatcccatcgaccctgtagcacgtaatagcggtgctgaactggggaaacccgtcaccatcggtaataacgtctggattggcggacgcgcggtcattaaccctggtgtgaccattggtgataacgtcgtggtagcctcaggtgcagttgtcacaaaagatgtcccggacaacgttgtcgtgggcggtaatccagccagaataattaaaaaattgtaa

SEQ ID NO: 15434 - protein, 183 aa, Escherichia coli K12
MSTEKEKMIAGELYRSADETLSRDRLRARQLIHRYNHSLAEEHTLRQQILADLFGQVTEAYIEPTFRCDYGYNIFLGNNFFANFDCVMLDVCPIRIGDNCMLAPGVHIYTATHPIDPVARNSGAELGKPVTIGNNVWIGGRAVINPGVTIGDNVVVASGAVVTKDVPDNVVVGGNPARIIKKL

SEQ ID NO: 15435 - DNA, 615 bp, Sinorhizobium meliloti 1021
  CDS (1)..(615): transl_table=11
atgagccagaaactcggccccgaacccaccatccatccgactgcgagcgtcgtgaactcgaccctcggccgctacaccgaagtccaggaacgctcgcgcctcgacgaggtcgagttcggcgactattcctacatcatgcaggacggttcgatctggtgcgcgacggtcggcaaattcgtcaacatcgccgcggccgtgcgcatcaatgccaccaaccacccgacttggcgggcgacgctgcatcatttcacctatcgcgcacctatgtactgggacgatgcggagcccgaccacgatctcttcgcctggcggcggcagaaccgggtgacgatcggccacgacgtctggatcggccacggcgctacggtcctgcccggcgtgagcgtcggcaacggagccgtgatcggcgccggcgccgtcgtctccaaggacgtcgcgccctacacgatcgtcggcggggtccctgcgaaactcatccgcgaccgcttcacggccaggatcggcgaagccatggaccggctcgcctggtgggattgggatcacgccaagctgcgccacgcgctggacgatttccgggaactgacggcggaggagtttcttgtgcggtatagttag

SEQ ID NO: 15436 - protein, 204 aa, Sinorhizobium meliloti 1021
MSQKLGPEPTIHPTASVVNSTLGRYTEVQERSRLDEVEFGDYSYIMQDGSIWCATVGKFVNIAAAVRINATNHPTWRATLHHFTYRAPMYWDDAEPDHDLFAWRRQNRVTIGHDVWIGHGATVLPGVSVGNGAVIGAGAVVSKDVAPYTIVGGVPAKLIRDRFTARIGEAMDRLAWWDWDHAKLRHALDDFRELTAEEFLVRYS

SEQ ID NO: 15437 - DNA, 552 bp, Salmonella typhimurium LT2
  CDS (1)..(552): transl_table=11
atgagtgacgaaaaacaaaaaatgatcgctggggcactgtattgcccgaccgatgaaactttatgccaggatcgactgcgggcgcgtcaactcatccatcaatacaattatactacgcctgatgaaataaataagcgtcaggcgattttacgcgacctgttgggtcgatgcgaagacgcctatattgaaccttccttccgttgcgactacggctataatatttttcttggtcactccttttacgctaacttcgactgcgtcatgcttgatgtttgcccaattcatattggcgataattgtatgctcgcgccaggggtacatatctataccgccacgcatccgctggacgccgtcgaacgcaacagcggcagagaattaggtaaacccgtcactatcggaaataatgtctggataggcggacgagccgtcgttaatccgggcgtaaccatcggcgataacgtcgtcgtcgcttcaggcgctgtggtgataaaaaacgtaccgccagacgttgtggtaggcggaaatccggcgcgaatcattaaaaaattgtag

SEQ ID NO: 15438 - protein, 183 aa, Salmonella typhimurium LT2
MSDEKQKMIAGALYCPTDETLCQDRLRARQLIHQYNYTTPDEINKRQAILRDLLGRCEDAYIEPSFRCDYGYNIFLGHSFYANFDCVMLDVCPIHIGDNCMLAPGVHIYTATHPLDAVERNSGRELGKPVTIGNNVWIGGRAVVNPGVTIGDNVVVASGAVVIKNVPPDVVVGGNPARIIKKL

SEQ ID NO: 15439 - DNA, 564 bp, Listeria monocytogenes EGD-e
  CDS (1)..(564): transl_table=11
atgaaaacagaactagaaaagatgattgcaggagaaatgtatgatcctagcgacagagagcttgcacacggaagaaatcgtgcgcgtaagttctgcagagagattaacgatgcgatggattcagagtcccgtgcaagcgtgctgaagcgtctattcggcggaacgaaagaaaatgtttatgtggaacctgatttccgtgtcgattacggttctaatatttatgtaggcgaaaatttttacgctaattttgattgtgttattttagatgtttgcgaagtacatattggcgacaactgcatgatggcgccgggtgttcatatctatactgcgacacatccgcttgatccagtagaacgtaatagtggattagagcttggtaaaccagttgaaattggcgacaatgtttggattggtggacgagcaattattaatccaggcgtaaaacttggaaataatgttgtcgttgcttcaggtgcggttgtcacgaaaagtttcccggataatgtcgttgttgcgggtaacccagcgcgcgttattaaaacaattgaggttgaggaaaaatga

SEQ ID NO: 15440 - protein, 187 aa, Listeria monocytogenes EGD-e
MKTELEKMIAGEMYDPSDRELAHGRNRARKFCREINDAMDSESRASVLKRLFGGTKENVYVEPDFRVDYGSNIYVGENFYANFDCVILDVCEVHIGDNCMMAPGVHIYTATHPLDPVERNSGLELGKPVEIGDNVWIGGRAIINPGVKLGNNVVVASGAVVTKSFPDNVVVAGNPARVIKTIEVEEK

SEQ ID NO: 15441 - DNA, 570 bp, Listeria innocua Clip11262
  CDS (1)..(570): transl_table=11
atgatagaacaagatttacagaaaagactagtcgaacaagaaattctccaagggtcggatttgttagatgaaattcacgaagtaaaacaaaacaatgaacaacttatcatcgaactaaacaccaagtaccacacaaaaaaagaagtgactaaatatctcagtgacatcaccggaaaaccagtcgatccgtcagtcgatgtctcacttcctttttacagcgacttcgggaaacacattacttttgggaaaaatatctttatcaatttaaatgtaactttcgtggatttgggtgggattacgattgaagataatgtcttaattggtccgggagcaagacttgtgaccgtcaaccatttagtcagccctaaaaagagacgtggactgcgggtagcaccgatttgtgtgaagaaaaacgcctggattggtgcaaacgcaacgatattgtcaggtgtaacaatcggcgaaaatgccatcgttgctgcggatgctaccgtcacaaaagacgtcccagcaaacgtcatcgtcgccggaagcccagccaaacaaatccgtaaaattatcgaggaataa

SEQ ID NO: 15442 - protein, 189 aa, Listeria innocua Clip11262
MIEQDLQKRLVEQEILQGSDLLDEIHEVKQNNEQLIIELNTKYHTKKEVTKYLSDITGKPVDPSVDVSLPFYSDFGKHITFGKNIFINLNVTFVDLGGITIEDNVLIGPGARLVTVNHLVSPKKRRGLRVAPICVKKNAWIGANATILSGVTIGENAIVAADATVTKDVPANVIVAGSPAKQIRKIIEE

SEQ ID NO: 15443 - DNA, 564 bp, Listeria innocua Clip11262
  CDS (1)..(564): transl_table=11
atgaagacagaactagaaaagatgattgcaggagaaatgtataatcctagcgacagagaacttgtacacggaagaagtcgtgcgcgtaagttctgcagagagattaacgatacaatggattctgagtctcgtaaaagcgtgcttaagcgtctgttcggcggaacaaaagaaaatgtttatgtcgaaccagattttcgcgtagattatggttctaatatttatgttggcgaaaatttctacgctaattttgattgtgtgattttagacgtttgtgaagtacatattggtgataattgtatgatggcgccaggtgttcatatttatacggcaacgcatccccttgatccagtagaacgtaatagtgggctagagcttggtaaaccagttgaaattggcgataatgtttggattggtggtcgggcaattattaatccgggcgtgaaacttggaaataatgtcgtggttgcttcaggcgcagttgtaacgaaaagcttccccgataatgtcgtcgttgccggtaacccagcgcgcgttattaaaacaattgaggttgaggaaaaatga

SEQ ID NO: 15444 - protein, 187 aa, Listeria innocua Clip11262
MKTELEKMIAGEMYNPSDRELVHGRSRARKFCREINDTMDSESRKSVLKRLFGGTKENVYVEPDFRVDYGSNIYVGENFYANFDCVILDVCEVHIGDNCMMAPGVHIYTATHPLDPVERNSGLELGKPVEIGDNVWIGGRAIINPGVKLGNNVVVASGAVVTKSFPDNVVVAGNPARVIKTIEVEEK

SEQ ID NO: 15445 - DNA, 579 bp, Nostoc sp. PCC 7120
  CDS (1)..(579): transl_table=11
gtgaaacaaattatatatatggaaaaaactgaaaaacaaaaaatgttggcaggtgaattatacctagcagatgatccagaattagcagccgagagtaaacgagccagtcggttgttgcgaatgtataacgccacaaccgaagaacaaccagaacaacgcaggcaaattttacaagaattatttgcccaggtaggtgaaaaaatcactatcgtaccaccgcttcattgtgactacggtagcaacatctatgcaggcaacggagtatatatgaactacggttgcgtaattttagactgcaacaaagtagaaatcggcgaaaatgttttgttagctccccacgtacagatttatactgcttaccatcccaccgaaccggaaattcgtctatctggaagagaattggctgccccaattaaaattggtaataacgtctggattggtggtggtgcaattatttgtccaggggtaacaattggggacaataccacgattggtgctgggagcgtagttgtcaaagacatccctactaacgttgtagccgttgggaatccttgccgaataattcgcaatttagcctaa

SEQ ID NO: 15446 - protein, 192 aa, Nostoc sp. PCC 7120
MKQIIYMEKTEKQKMLAGELYLADDPELAAESKRASRLLRMYNATTEEQPEQRRQILQELFAQVGEKITIVPPLHCDYGSNIYAGNGVYMNYGCVILDCNKVEIGENVLLAPHVQIYTAYHPTEPEIRLSGRELAAPIKIGNNVWIGGGAIICPGVTIGDNTTIGAGSVVVKDIPTNVVAVGNPCRIIRNLA

SEQ ID NO: 15447 - DNA, 828 bp, Nostoc sp. PCC 7120
  CDS (1)..(828): transl_table=11
gtgggtattcatgtatcaatactcactaaattaatactggataaatatcaggataattggcactacagaaccaaagatacatatccaacacatcagccacatcgttcacaatatttatcggataacttaatcatgaatcatcagagatattctgccaaattacagcgatttcaagaacttctggcaatcactgttttcgggaatatccccacactactgttaggcccaaaattaaggaatctcgtatatcgaatgatttttgctcacataggcagccccgtatatattcaacatggagtagaatttaccaacgcttctaatattgaaatcggcaatagtgtacatctcttcaacggtgtccgtcttgatgccaaagggcatccaaataataaaattgctttggcagatggagtggcaattgagcgcaacgttgatatagggtgtctggaaaatacgtgtattcacattgacgtggaaactttcattgcttctgatgtttgtatttctgggccaggagacatcacaattggtaagcgttgcatgattgctgctcattcaggtatatatgccaacaatcacaactttacagatccgatattgccgattaaataccaaggtgttactcgtaaaggaattgtgattgaggatgattgttggctaggacatggagtaacggtattagatggtgtgactattggtaaaggaagtgttattggcgcaggggcagttgtcaccaaagatattcccccattctccgtagctgtaggcgcacctgcacgagtaattaaaagccgcattgcccaggatttagttgcatctggagattag

SEQ ID NO: 15448 - protein, 275 aa, Nostoc sp. PCC 7120
MGIHVSILTKLILDKYQDNWHYRTKDTYPTHQPHRSQYLSDNLIMNHQRYSAKLQRFQELLAITVFGNIPTLLLGPKLRNLVYRMIFAHIGSPVYIQHGVEFTNASNIEIGNSVHLFNGVRLDAKGHPNNKIALADGVAIERNVDIGCLENTCIHIDVETFIASDVCISGPGDITIGKRCMIAAHSGIYANNHNFTDPILPIKYQGVTRKGIVIEDDCWLGHGVTVLDGVTIGKGSVIGAGAVVTKDIPPFSVAVGAPARVIKSRIAQDLVASGD

SEQ ID NO: 15449 - DNA, 513 bp, Ralstonia solanacearum GMI1000
  CDS (1)..(513): transl_table=11
atgaagtatttcgccgtggtggtgttcgagtcggtcatgcggctgctgtttgcgctgccgcgcttccgcctggccaatgcgctcaagagcggcttcctgcggctgtgcggcgcgagcatcggccggcgggtggtgttttatccgggcgtctggatctgcaccggccgcaatctgcgcgtcggcgatcacgtggatttcgcgctggacgtgctggtgacctccgacggcggcgtgcgcatcggcgaccgcacgctgatcgggtaccgctcccagatcctgtcgagcaaccacgcgatcccggcggggcgcggccgcatcttcggggccggccatgtccgcaagccggtggagatcggcacggacgtatggatcggcgcgaactgcgtgattctccccggcgtgaccatcggggacggcgcggtggtggccgccggcagcatcgtcaccaaggatgtgcctgcttatagcgtggtcggcgggtgtccggccacacccatcaagatgagggactag

SEQ ID NO: 15450 - protein, 170 aa, Ralstonia solanacearum GMI1000
MKYFAVVVFESVMRLLFALPRFRLANALKSGFLRLCGASIGRRVVFYPGVWICTGRNLRVGDHVDFALDVLVTSDGGVRIGDRTLIGYRSQILSSNHAIPAGRGRIFGAGHVRKPVEIGTDVWIGANCVILPGVTIGDGAVVAAGSIVTKDVPAYSVVGGCPATPIKMRD

SEQ ID NO: 15451 - DNA, 618 bp, Agrobacterium tumefaciens str. C58
  CDS (1)..(618): transl_table=11
atgagtgtcaaggtcggtctcgaacccgtcatccatgaaagtgcccgcgtcaccaattcttcgatcggccgctataccgaaatttcggagcgctgccgcctcgaggaggtcgagatgggcgactactcctacgtcatgcaggatggcgcaatctggtgtgccaccatcggcaaattcgtcaacatcgccgcttccgtccgcatcaatgccaccaatcatccgatgcagcgggccacattgcaccatttcacctatcgcgcccgcagctactgggacgacgccgaagatgaaactgacttcttcgccgcccgccgcgccaaacgggtggtgatcggccacgatgtctggatcggccatggtgcgaccatcctgcccggcatcacggtggggaacggtgcagtcatcggggccggggcggtcgtttccaaagatgttgcgccctacaccatcgtcggcggcgtgcccgcccggctgatccgcgagcgttttcccgcggagcttggcaagcgcatggatgatctgaattggtgggattgggaccatgcgaggctgcgcagcgcgctggaggatttccgcgcactcgacgccgaggatttcgtggcgaaatatggcggatga

SEQ ID NO: 15452 - protein, 205 aa, Agrobacterium tumefaciens str. C58
MSVKVGLEPVIHESARVTNSSIGRYTEISERCRLEEVEMGDYSYVMQDGAIWCATIGKFVNIAASVRINATNHPMQRATLHHFTYRARSYWDDAEDETDFFAARRAKRVVIGHDVWIGHGATILPGITVGNGAVIGAGAVVSKDVAPYTIVGGVPARLIRERFPAELGKRMDDLNWWDWDHARLRSALEDFRALDAEDFVAKYGG

SEQ ID NO: 15453 - DNA, 561 bp, Agrobacterium tumefaciens str. C58
  CDS (1)..(561): transl_table=11
atgtccactgagcgggaaaagatggccgcgggcgaatggtacagctgcatgggtgccgaactggatatgctgcgctggcattcacgccgggcggttcaccagcacaataccatgccgccggatgagcgcggcaccatcgggccgctgctgcgcgcactttttgcctccgtgggcgaaggtgcattcatcgaggcgccttttcattgcgcctacggtttcaacattacgctcggcaggaatgcctatctcaatgccggctgcaccattctcgattctgcgaaggtcgcgataggcgacggcgcgatgctcggccccgccgtgcagatctattgtgcggaacaccatcttgatccggttccgcgcgcgcaggggattgagattgcaaagcctgtcacgatcggccgtgatgtctggatcggcggcggagcgatcattctggccggtatcaccatcggtgacggtgcaattgtcggtgccggctcggtggtgacgcgcaatgtgccggcgcgtgcaacggtcgtgggaaatcccgcccgacccataaatcgtatagccggctga

SEQ ID NO: 15454 - protein, 186 aa, Agrobacterium tumefaciens str. C58
MSTEREKMAAGEWYSCMGAELDMLRWHSRRAVHQHNTMPPDERGTIGPLLRALFASVGEGAFIEAPFHCAYGFNITLGRNAYLNAGCTILDSAKVAIGDGAMLGPAVQIYCAEHHLDPVPRAQGIEIAKPVTIGRDVWIGGGAIILAGITIGDGAIVGAGSVVTRNVPARATVVGNPARPINRIAG

SEQ ID NO: 15455 - DNA, 633 bp, Agrobacterium tumefaciens str. C58
  CDS (1)..(633): transl_table=11
atggactcgaccgcacagatcaagcgcccgaaactcgcagagaccgtcattcatgcgacggcgagcataagagattcgaacattggcagatgctgcgaggtcctggctgacacctcgctgcacaatgttgaacttgggaattactcctatctcgggccgcgctgcatggtgggtgatgcgataatcggaaagttctgcgccattgctgcggaggtcaggataggcgctccgaaccacccgatggaccggccatccacgcatcgtttcagctactgcccggaatattacgctgccgatgcggtgcgcgacgacgccttcttcgcccagcgaaagcaggatcgcgccatcatcggtcacgatgtctggatcggccacggggtcatcgtcttgccgggtgtaacggttggagacggcgcggttcttgccgccggtgccgttgtcaccaaagatgtgccgccctacaccatcgtcggcggcgttcccgcaaaaatcattcgcgagcgcttttcacgatccatcgcggagaagcttgccgccatcgcctggtgggactggccattcgagacgatcatggcgcggctcgccgacttccagtcaggagatatcgaagccttttgcgagcgctggtcgtag

SEQ ID NO: 15456 - protein, 210 aa, Agrobacterium tumefaciens str. C58
MDSTAQIKRPKLAETVIHATASIRDSNIGRCCEVLADTSLHNVELGNYSYLGPRCMVGDAIIGKFCAIAAEVRIGAPNHPMDRPSTHRFSYCPEYYAADAVRDDAFFAQRKQDRAIIGHDVWIGHGVIVLPGVTVGDGAVLAAGAVVTKDVPPYTIVGGVPAKIIRERFSRSIAEKLAAIAWWDWPFETIMARLADFQSGDIEAFCERWS

SEQ ID NO: 15457 - DNA, 687 bp, Brucella melitensis 16M
  CDS (1)..(687): transl_table=11
atgaaccgatacaggactgccgggcaatatgcaaaaatttcagaaagctatgaaatgacgcagggcgacgacctccgtttccagaacggcgagccgcatattcattcgaccgcgcagctcaaatccgtcaagctggggcgctatgccgatatcggggaacgggtgatcctgcgtgaagtaacggtgggtgatttcacctatttcgagcgcaatggcgaggggatttatgccgaaatcggcaagttctgctccattgccgccaatgtgcggatcaatgcgcttgaacatccgatggagcggctcaccacgcataaggtgagctaccggcccaacgaatatttccgctatcttggcgttgatggcgattttcgcgccagacggcaggcaaggcgggtcgtgatcggcaatgatgtgtggatcggccatggcgcggttatcacgccgggcgtggtgattggccatggtgcggtgatcggggccaatgcggtggtgacaagggatgtcgcaccctatttagtggtgggcggcgttccggcgcggcttatccgcaaacggttcagcgatgcggtgatcgcgcgcctgcttgcgctttcctggtgggactggcctgtggaaaagctctatgaggctgttcccgatatgcaggcgcttgagatcgaggcgtttttggaaaagtggggcggatga

SEQ ID NO: 15458 - protein, 228 aa, Brucella melitensis 16M
MNRYRTAGQYAKISESYEMTQGDDLRFQNGEPHIHSTAQLKSVKLGRYADIGERVILREVTVGDFTYFERNGEGIYAEIGKFCSIAANVRINALEHPMERLTTHKVSYRPNEYFRYLGVDGDFRARRQARRVVIGNDVWIGHGAVITPGVVIGHGAVIGANAVVTRDVAPYLVVGGVPARLIRKRFSDAVIARLLALSWWDWPVEKLYEAVPDMQALEIEAFLEKWGG

SEQ ID NO: 15459 - DNA, 681 bp, Pyrobaculum aerophilum str. IM2
  CDS (1)..(681): transl_table=11
atgggctatgtctcaaacaaagctaaaatcttggcgaagtacgtctccccagatgcgtacatatacgggccgtcagtcatcggcgccgggagttttattgacgccgccgtgatcggctatcccgcccgccagaaaattcttagcgggtttaaatcccctgacgaggtcagcaacggggcgaggataggggaggaggtcattattagaagcggcgttgtgatatatgaagacgtggaaataggcgacagggccgagtttggacacggcgttttagtaagagagttaacaagaatagggcgcggggtgagaatcggcaccagcgccataatagagcgcgatgttaaaataggcgacagggcgtggattcagtctatggtgtacatccccaacggcactgttatagaggaggacgtctttatagggccaaatgccgtcattacaaacgacaagtaccctcccagcaagaggctcgccccagtggtaattaggcggggcgctgtgattggggccaacgcgactttaatagcaggtattgaagtcggagagggcgctgtcgtggccgcaggggccgtcgtgacgagagacgtcccgccgggggttgtggtcgccggcgtccccgcccgggttattggaaaggcggaggagtatatgaggaagcgggcggcttacgagcagtcgtga

SEQ ID NO: 15460 - protein, 226 aa, Pyrobaculum aerophilum str. IM2
MGYVSNKAKILAKYVSPDAYIYGPSVIGAGSFIDAAVIGYPARQKILSGFKSPDEVSNGARIGEEVIIRSGVVIYEDVEIGDRAEFGHGVLVRELTRIGRGVRIGTSAIIERDVKIGDRAWIQSMVYIPNGTVIEEDVFIGPNAVITNDKYPPSKRLAPVVIRRGAVIGANATLIAGIEVGEGAVVAAGAVVTRDVPPGVVVAGVPARVIGKAEEYMRKRAAYEQS

SEQ ID NO: 15461 - DNA, 585 bp, Clostridium perfringens str. 13
  CDS (1)..(585): transl_table=11
atggctatgacagaaaaagaaaaaatgatagcaggtctgccttataaccctgctgacccagaattaactaaaggtagaattagagctagaattttatttcagaaatttaataaattagacttacctgataacgaagaggaagctaataaaacttttaaagaaagaagtagtatattaaaaaaacttttaggctcaacaggtgaaagcatctatatggaacctaatttcaaatgtgattatggttataacatatcagttggtaataacttttacgcaaattttgattgtataatgcttgatgtttgtaaaattaccataggagaaaattgtttctttgcccctggagttcacatttatacagctactcatccaattgatcctattgaaaggctaaactatgaatttggtaagcctgtaaccataggtaataatgtttggattggaggacatgctacaataaacccaggtgtaactataggaaataatgtagtggtagcctctggagccgttgtaactaaggatgtccctgataatgtagtggtaggtggaaatccagcaaaaattattaaaaaaagtttgtgctaa

SEQ ID NO: 15462 - protein, 194 aa, Clostridium perfringens str. 13
MAMTEKEKMIAGLPYNPADPELTKGRIRARILFQKFNKLDLPDNEEEANKTFKERSSILKKLLGSTGESIYMEPNFKCDYGYNISVGNNFYANFDCIMLDVCKITIGENCFFAPGVHIYTATHPIDPIERLNYEFGKPVTIGNNVWIGGHATINPGVTIGNNVVVASGAVVTKDVPDNVVVGGNPAKIIKKSLC

SEQ ID NO: 15463 - DNA, 501 bp, Pyrococcus furiosus DSM 3638
  CDS (1)..(501): transl_table=11
atgatggtgaataccatgaatattttaaggaaaatatttcgtagaatatgtagaacagcagtaaaatttgttttccctaacggttttaggatactgctattaagatggagcggggttaaagtgggaaaagatgtggcaataaatgaagggtttacgatggcttgtgatatcggatatgaagaaaatttagttattgaagatagagttgcaatcgggcctaatgttactattgtgataacttctcatcctaacaattcacatctcagaaatttaaaagacagatatccttcaatagaagtgtttggaaaagtccacataaaacatgacgcatggataggggcgggagccattatactcccaaatgttacaataggagagttctcaattataggggcaggatcggttgtaactaaagacgttccgccatatagtatagcggttggagtcccggctagggtagtaaagaaacttaaaatagaaaagaagactgaaaatacttaa

SEQ ID NO: 15464 - protein, 166 aa, Pyrococcus furiosus DSM 3638
MMVNTMNILRKIFRRICRTAVKFVFPNGFRILLLRWSGVKVGKDVAINEGFTMACDIGYEENLVIEDRVAIGPNVTIVITSHPNNSHLRNLKDRYPSIEVFGKVHIKHDAWIGAGAIILPNVTIGEFSIIGAGSVVTKDVPPYSIAVGVPARVVKKLKIEKKTENT

SEQ ID NO: 15465 - DNA, 687 bp, Corynebacterium glutamicum ATCC 13032
  CDS (1)..(687): transl_table=11
atggaggatatggacaatgactttgaatctatcgagaaaatgagcagcggcgattggtacgtggctaccggcgcggaacgtgaagaagtggcacaaaaaacagcgttacttttccacgaatacaaccaaattggacctacagaccccgcacgaactgccgaaatactaagaactgtactaaatcctgccagcggaacctgcacgatcaaagcgccagccatcattgaatacggcttcaacaccacgatcggcgagcatgtgttcatcaactttggcctcaccattttagatatcgcaccggttcgcatcggggcacgcagcatgctcgggccaaactgtcagctcttcaccgcaggtcacccggtcgatgactgggaaatgcgctccggtgggtgggaaaatggcgcacccatttccattggcgaggatacgtggctgggtggaaatgtcaccgtcgttggtggcgtgagcattggcgataggtgtgtgattggcgcgggggccgtggtgaccaaggatattccggatgattctattgctgtgggcaaccctgcgcgagtagtgcggaaacgtgatgatagccggctcgaacgttcgcagctgccagaaggtgcttccgtggatgcgttggggattcttcctacaaaatcacctaggctgtcagaaaatattgccgaaaaatattaa

SEQ ID NO: 15466 - protein, 228 aa, Corynebacterium glutamicum ATCC 13032
MEDMDNDFESIEKMSSGDWYVATGAEREEVAQKTALLFHEYNQIGPTDPARTAEILRTVLNPASGTCTIKAPAIIEYGFNTTIGEHVFINFGLTILDIAPVRIGARSMLGPNCQLFTAGHPVDDWEMRSGGWENGAPISIGEDTWLGGNVTVVGGVSIGDRCVIGAGAVVTKDIPDDSIAVGNPARVVRKRDDSRLERSQLPEGASVDALGILPTKSPRLSENIAEKY

SEQ ID NO: 15467 - DNA, 576 bp, Methanosarcina acetivorans C2A
  CDS (1)..(576): transl_table=11
atgagcgaaaaagtgttgaataaagacatttttgaacgtgataggtctggagaaccagtttccatagatgacccggaatatccaaagttaaaggaagtgatgcttcgtgctgcggaactaaccaccagattgaatacttcagttcatgatgaggatgaaatcaggagcctgttcagtgagttgataggttcggaggtggatgaatcctcccgggtaactcctccattctatacagatttcggacgaaatatcaaggtcggtaaaaatgtgtttatcaatcatgcatgcacctttatggatagaggaggcataacaatcgaggatgacaccaagataggaccaaaagccaatcttatcacatccaatcatccattggatccagcccatagaaaggaattaatttcaactccgatatggattaaaaggaatgtatggatcggtgctgctgcaactattttacccggtgtaactgtcggagagaactctgtaatagcagccgcagctgtagttacacaagatgttcctcctaacacagtcgtggctggcgtaccagcaaaagttatcagaacattgtaa

SEQ ID NO: 15468 - protein, 191 aa, Methanosarcina acetivorans C2A
MSEKVLNKDIFERDRSGEPVSIDDPEYPKLKEVMLRAAELTTRLNTSVHDEDEIRSLFSELIGSEVDESSRVTPPFYTDFGRNIKVGKNVFINHACTFMDRGGITIEDDTKIGPKANLITSNHPLDPAHRKELISTPIWIKRNVWIGAAATILPGVTVGENSVIAAAAVVTQDVPPNTVVAGVPAKVIRTL

SEQ ID NO: 15469 - DNA, 600 bp, Methanosarcina acetivorans C2A
  CDS (1)..(600): transl_table=11
atgaggaaaacaacaatggatgaaatgactgagaaagaaaaagcagcccggggtttattatacaatgcaagctatgataaagagctgatagatgaacgagcttattgtaaagcactttgctatgaatataatcagcttcatccagcgaaaatcgtggaaaggacagctttaattcagaaactctttggcaaaactgggggttcttttcttattgagccgccatttatatgcgactacggttacaacatagaaataggcagcaatttctatgcaaatcacaactgtatcatcctcgacgaagcaaaggttgtttttggcgataacgtgatgatcgctccaaactgtggcttctatacagctggacatcctcttgatgcagaacgtcgtaacgcgggactggagtatgcttatccgataaaagtcgggggcaatgtatggataggcggcaatgttgttgtactgcccgggataactattggagatagtactgtcatcggcgctggaagtgttgtgacaaaagacattccgtctggcgttgttgctgctgggaatccttgcagggttattcgtgagataagcgatgaagataagaaattttaa

SEQ ID NO: 15470 - protein, 199 aa, Methanosarcina acetivorans C2A
MRKTTMDEMTEKEKAARGLLYNASYDKELIDERAYCKALCYEYNQLHPAKIVERTALIQKLFGKTGGSFLIEPPFICDYGYNIEIGSNFYANHNCIILDEAKVVFGDNVMIAPNCGFYTAGHPLDAERRNAGLEYAYPIKVGGNVWIGGNVVVLPGITIGDSTVIGAGSVVTKDIPSGVVAAGNPCRVIREISDEDKKF

SEQ ID NO: 15471 - DNA, 525 bp, Methanosarcina acetivorans C2A
  CDS (1)..(525): transl_table=11
atgatatccaacagagataaagtgacttttggtgaagtatccaatcactatcatagtaataaaatcttatttggattcaggtatctgaagaactggtttttagaacagcttgcatcagtttttcctgttccttcctggagagcaaaattgcacaaaatgaggggagtaaatattgggaaaaacgtatacgtcggttatggtgtggtttttgatcggctccaccctgagctaatcacaattggagattatgcagagattggtgaccggtgtatactgtctgcccatacaagaggcagtttaactacaagacaagcgtatccgagaaccatggctccaatcaaaataggatccggagtttctattaacccgggatgtatcattatacagggagtcgagattggtgaaaactcgataataggaatagggtccgtagttacgagagatatctccccaaacagtcttgctcttggctaccctgccagagttgttaaaaagcttgatggcgtaggtgagctccaaacctga

SEQ ID NO: 15472 - protein, 174 aa, Methanosarcina acetivorans C2A
MISNRDKVTFGEVSNHYHSNKILFGFRYLKNWFLEQLASVFPVPSWRAKLHKMRGVNIGKNVYVGYGVVFDRLHPELITIGDYAEIGDRCILSAHTRGSLTTRQAYPRTMAPIKIGSGVSINPGCIIIQGVEIGENSIIGIGSVVTRDISPNSLALGYPARVVKKLDGVGELQT

SEQ ID NO: 15473 - DNA, 555 bp, Methanosarcina acetivorans C2A
  CDS (1)..(555): transl_table=11
ttgaaatcaaaagtaatcaattatctaaaatctcttgaaaagtatactgcccttatattctattattcaattgctcgacatctccctccttcagatgagccacaatctttaaagttatcaaaaccaattaggggatttttagcttccaaaatttttgatgaatgtggggttggtgtcaatcttgaaaaaggagcttacattgcagatggtaaatttattcgagtaggaaattattccggcattggtataaactctcttgttcagagaaatgtgagtataggaaatgatgttatgatgggaagagatgtcattataatgaccaccagtcatgaaacttcagatgcatcaattcctatgagataccaaggtggaaaagaggtttctcctgtcattataggcgatgatgtttggattggaagtagagttataatattaccaggagtaaggattggaactggttcaataattggtgctggagcagttgttactcgagatgtagagccatattctgtagtagggggaacccccgcaaagataataaaaaaaaggaagtag

SEQ ID NO: 15474 - protein, 184 aa, Methanosarcina acetivorans C2A
MKSKVINYLKSLEKYTALIFYYSIARHLPPSDEPQSLKLSKPIRGFLASKIFDECGVGVNLEKGAYIADGKFIRVGNYSGIGINSLVQRNVSIGNDVMMGRDVIIMTTSHETSDASIPMRYQGGKEVSPVIIGDDVWIGSRVIILPGVRIGTGSIIGAGAVVTRDVEPYSVVGGTPAKIIKKRK

SEQ ID NO: 15475 - DNA, 663 bp, Thermoanaerobacter tengcongensis MB4
  CDS (1)..(663): transl_table=11
atgtttaaaactttaaaagaagacattgaagtagtttttgaaagagaccctgctgcaaagagcgttttggaggttttactgtgttatcccgggctccacgccataatacttcacagaattgcccattacttctataaaaaaggttttatactgctgccgaggttgatttcacatataaaccgttttttgacaggcattgaaatacatccaggtgcaaaaattgggcgcagatttttcatagaccacggcatgggagttgtaataggagagactacggaaattggagacaatgtgacgatatatcaaggagtgactttgggaggtactggtaaagaaaagggaaaaaggcatcctacgataaaggacaatgtagttataggcagtggagctaaagttttgggacctattgtggtaggggaaaattcaaaaataggagcaggagctgtcgttttaaaagatgtgcccccaaatagcactgtagttggcgttcctgcaaggtgcgtcaaaaaagacaacatacgcatagcaagatcttatgaagtggacctggaacatggcaagctccctgaccctgtagaggaagagctaagaaggttaagagagaggatagagaggcttgaaaaaattttaatggaaagggatgaggaagatgaggctgtataa

SEQ ID NO: 15476 - protein, 220 aa, Thermoanaerobacter tengcongensis MB4
MFKTLKEDIEVVFERDPAAKSVLEVLLCYPGLHAIILHRIAHYFYKKGFILLPRLISHINRFLTGIEIHPGAKIGRRFFIDHGMGVVIGETTEIGDNVTIYQGVTLGGTGKEKGKRHPTIKDNVVIGSGAKVLGPIVVGENSKIGAGAVVLKDVPPNSTVVGVPARCVKKDNIRIARSYEVDLEHGKLPDPVEEELRRLRERIERLEKILMERDEEDEAV

SEQ ID NO: 15477 - DNA, 528 bp, Streptomyces coelicolor A3(2)
  CDS (1)..(528)
atgtatgtccatacgcccgagttcgcacgtcatgcggagcggatcgtggaggtgaccgatgcgacgtctcgactgaacgtgcttccgttcagcgacagtgcaggtcgttcggaactactttccgttgtgttcggaggcccactgccggaatcggtgacgatctacccgccgttcttcaccgagtacgggctgaacacgacgttcggggagaacgtcttcgtcaatcagggatgcaccttcatggacaagggaggcatccgcatcgggaaccgagtcatgatcgccccgaaggccagcctcgtcaccggaggccatccgctgcccctggccgagcgccgcgcacacctctccttcgccccgatcgtcgtcgaggacgacgtgtggatcggcacggccgccgtgatcacgcagggggtgaccatcggtgcgggcgcggtagtggctgccggtgcggtggtcacccgtgatgtccctgcgggcaccgtcgtcgcgggagtgcccgcccgcgtgatcaagcagatcggctga

SEQ ID NO: 15478 - protein, 175 aa, Streptomyces coelicolor A3(2)
MYVHTPEFARHAERIVEVTDATSRLNVLPFSDSAGRSELLSVVFGGPLPESVTIYPPFFTEYGLNTTFGENVFVNQGCTFMDKGGIRIGNRVMIAPKASLVTGGHPLPLAERRAHLSFAPIVVEDDVWIGTAAVITQGVTIGAGAVVAAGAVVTRDVPAGTVVAGVPARVIKQIG

SEQ ID NO: 15479 - DNA, 804 bp, Streptomyces coelicolor A3(2)
  CDS (1)..(804)
atgccccaccgcaagaacacgttctcgtcctggcggagccgcctcgcccagaaggccgtccacgcgggctgggcctgggtgcagcgcaccggttccgtcaccgccgcgcacccggggcggttccggttcggcgcgctgggcacgggcacccggctcgccttcccgctcggcacggtcttcggcgagccctggatccaggtcggcgcgcactgcatcatcggcgagcaggtcacgctgaccgccgggctcatgcccgacctcgacctcggaccggaaccgatcctgcgcatcggcgacggggtcgtcctcggccgcggcagccacgtcatcgcggacaccaccgtcaccatcggcagcgactgctacttcggcccgtacgtctacgtcacctccaccaaccactcctacgacgacccgcaccagcccatcggcaagcagtggccgcggatggacccggtggagatcggccccggctgctggatcggcacgggcgcggtgatcctgcccggcgcccggatcggacggaacgtggtcgtggccgccggtgccgtggtccggggcgcggtccccgaccacgccgtggtggcgggcgcccccgcccgcgtcgtacggcgctggacaccggccgagggctggcagccgccgctgcggaccccggccccggtgccgattcccgacgggatcacgccggggcagctgcgggagctgtcgaagctggacgacgaggcggtggcccgtctcgccgaactggacgacccggagcgggcggcgggcaggctcgccgaaccggccgcggagggctga

SEQ ID NO: 15480 - protein, 267 aa, Streptomyces coelicolor A3(2)
MPHRKNTFSSWRSRLAQKAVHAGWAWVQRTGSVTAAHPGRFRFGALGTGTRLAFPLGTVFGEPWIQVGAHCIIGEQVTLTAGLMPDLDLGPEPILRIGDGVVLGRGSHVIADTTVTIGSDCYFGPYVYVTSTNHSYDDPHQPIGKQWPRMDPVEIGPGCWIGTGAVILPGARIGRNVVVAAGAVVRGAVPDHAVVAGAPARVVRRWTPAEGWQPPLRTPAPVPIPDGITPGQLRELSKLDDEAVARLAELDDPERAAGRLAEPAAEG

SEQ ID NO: 15481 - DNA, 582 bp, Streptomyces coelicolor A3(2)
  CDS (1)..(582)
atgccgacggaccacttcgcgggcgactcccgcaccaacctcgaacgcatgcaggcgggcgacctctacatcgccgacgaccccgagatcgcccgcaggcagcagcaggcggtacggctggcggcccgctaccaggccggctacgcggaggacgcggaggcggcgcgcccgctcctcgtcgaactgctcggctccctgggtgccgaggcccacgtgcggccgccgctgtacgtcgactacggcagcaacatcaccgtcggcgcgcgcaccttcgtcaactacaacctgacggcgctggacgtcgcggcgatcaccatcggcgaggactgccagatcgggccgaacgtccagctgctcacccccacgcaccccctggagcccggaccgcggcgggacaagctggaggccgcccgcccgatcgtcatcggcgacaacgtctggctgggcggcggcgcgatcgtgctgccgggcgtcaccatcggggacaactccgtcatcggtgccggtgccgtcgtcaccagggacgtaccggcgaacgtcgtggcggtcggcaaccctgcccggccggtgcggaacgtgtaa

SEQ ID NO: 15482 - protein, 193 aa, Streptomyces coelicolor A3(2)
MPTDHFAGDSRTNLERMQAGDLYIADDPEIARRQQQAVRLAARYQAGYAEDAEAARPLLVELLGSLGAEAHVRPPLYVDYGSNITVGARTFVNYNLTALDVAAITIGEDCQIGPNVQLLTPTHPLEPGPRRDKLEAARPIVIGDNVWLGGGAIVLPGVTIGDNSVIGAGAVVTRDVPANVVAVGNPARPVRNV

SEQ ID NO: 15483 - DNA, 564 bp, Methanosarcina mazei Go1
  CDS (1)..(564): transl_table=11
atggggggcattaccataactgccgtaatatcaaacagagataaagtaacttttggtgaagtggctgatcattaccacagcaataaactcatttttgggctgaagtactttaagaactgggttctggaacgcgttgctgcgtggttcccgattccttcgtggagagctaaatttcataaaatgagaggcgtgaatctcgggaaaaacgtgtatgtaggctacgatgtggtttttgacaggcttcaccctgaaatgatcacagtgggagattactctgaaataggagaccgctgcattctctctgcccattccagaggcagtctgaccacaaggcaggcatatccgaggaccatagagcccataaaaatagggtgtggagtttctgtaaatccaggctgcataattactcagggggtcgagatcggggataactcaataatcggtataggttccgtggttactcgtgacatttctccaaacagccttgcccttggttatccggctcgagttatcaaaaaacttgacggtgtgggtgagctccagaccagttttaatgatacttaa

SEQ ID NO: 15484 - protein, 187 aa, Methanosarcina mazei Go1
MGGITITAVISNRDKVTFGEVADHYHSNKLIFGLKYFKNWVLERVAAWFPIPSWRAKFHKMRGVNLGKNVYVGYDVVFDRLHPEMITVGDYSEIGDRCILSAHSRGSLTTRQAYPRTIEPIKIGCGVSVNPGCIITQGVEIGDNSIIGIGSVVTRDISPNSLALGYPARVIKKLDGVGELQTSFNDT

SEQ ID NO: 15485 - DNA, 702 bp, Methanosarcina mazei Go1
  CDS (1)..(702): transl_table=11
atgtgtagttttaagtccacagtattccacagtataactcttactcttcttaacgaagatcttcttaaagaagaattaaataaacaggattatcattttacaaaggagggaacaactatggttgaaatgactgaaaaagaaaaagcagctcagggcttattatacaatgcatactatgatgaagagctgatctctcaacgggcttattgcaaagcaatttgctacgagtataatcagcttcatccagcaaaaattgaggaaaggacagctttaattcagaaactctttggcaagaccggaggttcttttcttattgagccgccatttatatgcgactacggttacaacatcgaaataggcagcaatttctatgcaaatcacaactgcatcatcctcgacggagcaaaggttgtttttggggataatgtgatgatcgctccaaactgcagcttctacacagccgggcatccgcttgatgtagaacgtcgcaatgcaggactggaatacgcttatccagtaaaagtcggcagcaatgtatggataggcggcaatgtttctgtacttcccggagtaactataggggataatgctgtcataggcgccgggagtattgtgacaaaagatattccttccgacgttgttgcttttgggaatccctgcagggttattcgtgagattagtgatgaagataaaaaattttaa

SEQ ID NO: 15486 - protein, 233 aa, Methanosarcina mazei Go1
MCSFKSTVFHSITLTLLNEDLLKEELNKQDYHFTKEGTTMVEMTEKEKAAQGLLYNAYYDEELISQRAYCKAICYEYNQLHPAKIEERTALIQKLFGKTGGSFLIEPPFICDYGYNIEIGSNFYANHNCIILDGAKVVFGDNVMIAPNCSFYTAGHPLDVERRNAGLEYAYPVKVGSNVWIGGNVSVLPGVTIGDNAVIGAGSIVTKDIPSDVVAFGNPCRVIREISDEDKKF

SEQ ID NO: 15487 - DNA, 579 bp, Xanthomonas campestris pv. campestris str. ATCC 33913
  CDS (1)..(579): transl_table=11
gtgcaccgaaaaaagaagatgctcgcaggcgagctgtacaacgcggccgatgacgaactgcaggccgatcaggctgccgccgccgcgtggatggcgcgttacaacgccgctgcgcaacagcccgctgcgcagcgccatgccttgctggtcgaacgtctggccgaggtgggcgcgggtgcagtgattcgcccgccgttccattgcgactatggctacaacatccgtttgggtgcgggggtttttctcaacttcaattgcgtgattctggatgtgtgcgaggtcagcatcggcgatggcacgcagatcggcccggcggtgcagttctacgcggccgaccatccgcgcgatgcgaccgatcgtgccagcgggctggagtttggccgcccgattcatgtgggacgtaatgtgtggatcggcggcggtgcgatcattctgccgggcgtgcgcattggcgacgatgcgttgatcggggccggtgcggtggtcacccgcgatgtgccggcaggcgccactgcggtggggaatcctgcgcgtgtgcgcatggcgcgcaccgatccgcaggcgacgccgaccgattga

SEQ ID NO: 15488 - protein, 192 aa, Xanthomonas campestris pv. campestris str. ATCC 33913
MHRKKKMLAGELYNAADDELQADQAAAAAWMARYNAAAQQPAAQRHALLVERLAEVGAGAVIRPPFHCDYGYNIRLGAGVFLNFNCVILDVCEVSIGDGTQIGPAVQFYAADHPRDATDRASGLEFGRPIHVGRNVWIGGGAIILPGVRIGDDALIGAGAVVTRDVPAGATAVGNPARVRMARTDPQATPTD

SEQ ID NO: 15489 - DNA, 579 bp, Xanthomonas axonopodis pv. citri str. 306
  CDS (1)..(579): transl_table=11
atgcagaccgaaaaacagaaaatgctggcaggcgaactctacaacgccgccgatgcgcagctgcaggccgatcaggcggcagctgcggtgtggatggagcgctacaacgccactggcgcgcagtcatcggcgcagcggcatgcattgctggtcgagcggctcgccgaggtgggtgcgaatgcggtgatccggccgccgtttcattgcgattacggctacaacatccatctgggcgcgggcgtgttcctcaacttcaattgcgtgatcctggatatctgccaggtgtacatcggcgatggcacgcaggtggggccagcggtgcagttctacgctgccgaccatccgcgcgatgccgccggacgtgccagcgggctggagttcgggcggccaatccgcgtcgggcgcaatgtgtggattgggggcggggcgatcatcctgccgggcgtctgcatcggcgacgatgcggtaatcggtgccggtgcggtcgtcacgcgcgatgtgccggccggtgcgatcgccgtgggcaatccggcgcgcgtgcgcgcaccccggcttgccgatgcgccgcccaccgactga

SEQ ID NO: 15490 - protein, 192 aa, Xanthomonas axonopodis pv. citri str. 306
MQTEKQKMLAGELYNAADAQLQADQAAAAVWMERYNATGAQSSAQRHALLVERLAEVGANAVIRPPFHCDYGYNIHLGAGVFLNFNCVILDICQVYIGDGTQVGPAVQFYAADHPRDAAGRASGLEFGRPIRVGRNVWIGGGAIILPGVCIGDDAVIGAGAVVTRDVPAGAIAVGNPARVRAPRLADAPPTD

SEQ ID NO: 15491 - DNA, 639 bp, Streptococcus agalactiae 2603V/R
  CDS (1)..(639): transl_table=11
atggctagtattttaaaaaaacatttagagaaacgtttagagcttaaaaatgatcctatgaggacagatatgagtactggtgccagttaccctaaatatggattctcggtaggaaagtacacatatggatatcaacaattcttttacgaaggcgttaacttaaaagaaattggagcattttgctcaatagcccagaacgttactattactggtctgaatcatccaaccgatcacattaccactaacccttttatttactataagtcaaggggatttataaatgaggatagggcggacttaatagatgaaaagaaaaatggaaaagttattattggcaacgatgtctggataggaactaatgtcactatacttccatctgttacaataggtaatggagcaattattggagcaggttcagttattaccaaagacattcctgactatgctgttgtcgctggaacacctgctaaaattatcaaatatcgcttttcagaggaagaaataacattattaaatgcatctcagtggtggaattggtcagatgaagctattaaggaacatattagcgaattttcagataagaaggaattcttcaatactctaaaaagtatttccgaaaacaaaaatcataaactctag

SEQ ID NO: 15492 - protein, 212 aa, Streptococcus agalactiae 2603V/R
MASILKKHLEKRLELKNDPMRTDMSTGASYPKYGFSVGKYTYGYQQFFYEGVNLKEIGAFCSIAQNVTITGLNHPTDHITTNPFIYYKSRGFINEDRADLIDEKKNGKVIIGNDVWIGTNVTILPSVTIGNGAIIGAGSVITKDIPDYAVVAGTPAKIIKYRFSEEEITLLNASQWWNWSDEAIKEHISEFSDKKEFFNTLKSISENKNHKL

SEQ ID NO: 15493 - DNA, 549 bp, Streptococcus agalactiae 2603V/R
  CDS (1)..(549): transl_table=11
atgaccgaaaaagaaaaaatgttagcaggacaatattatcgtccatcagcacctgaactacgcaaggatagagaagttgcactaaaaaatatgcaagcctttaacaatgaagataatagtagcaaacgtaacgtcattttacaaaaatggtttggtgctactgggaagagtatccatatggaacaacgttttgtctgcgattatggttgtaatatttatgttggtgaaaacttctacgccaattttaaccaaactttcttagatgtttgtgaaattcgtattggcgataactgtatgtttggcccaaactgtcaactcctcaccccactccatcctctagatccaatagaaagaaattcaggattagaatacggtgccccaatccaaatcgggaataatgtctggctaggtggaggagtgactattttaccaggtgttgtattaggagataatgtcgtcgttggcgctggaagtgtcgttacgaaatcatttgaaaataacgttgttatagcaggaaaccctgctaagataatcaaaaaattagcttaa

SEQ ID NO: 15494 - protein, 182 aa, Streptococcus agalactiae 2603V/R
MTEKEKMLAGQYYRPSAPELRKDREVALKNMQAFNNEDNSSKRNVILQKWFGATGKSIHMEQRFVCDYGCNIYVGENFYANFNQTFLDVCEIRIGDNCMFGPNCQLLTPLHPLDPIERNSGLEYGAPIQIGNNVWLGGGVTILPGVVLGDNVVVGAGSVVTKSFENNVVIAGNPAKIIKKLA

SEQ ID NO: 15495 - DNA, 540 bp, Oceanobacillus iheyensis HTE831
  CDS (1)..(540): transl_table=11
atgatagacggcgaattatataaaccagcggaccctgaattatataaagcgagacaatttgcgagaagagcaactcgctactataatgcgacaacggaagaggatgttgtaaaacgttcaggtatgttaaaagaattatttggtagtaccggaaaaaatatttttattgaacctcattttcgatgtgactatggttttaatattcatattggggagaatttctacgctaattttgattgtatattgttggatatttgtgaaataagaattggtgaagattgtatgttggcaccaggagtcaagatttttactgctactcatccacttcacccagttgaaagaaagagcggactggagtatggaaagcctgttaccataggagataatgtctggattggtggcggagcaattattaatcccggtgtaacaatcggagataatgcggtaatagcttcaggtgccgttgttacgaaaaacgttcctacaaatacagtgtacggaggaaacccggcaaagtttatgaaagagatattgttatag

SEQ ID NO: 15496 - protein, 179 aa, Oceanobacillus iheyensis HTE831
MIDGELYKPADPELYKARQFARRATRYYNATTEEDVVKRSGMLKELFGSTGKNIFIEPHFRCDYGFNIHIGENFYANFDCILLDICEIRIGEDCMLAPGVKIFTATHPLHPVERKSGLEYGKPVTIGDNVWIGGGAIINPGVTIGDNAVIASGAVVTKNVPTNTVYGGNPAKFMKEILL

SEQ ID NO: 15497 - DNA, 675 bp, Bifidobacterium longum NCC2705
  CDS (1)..(675): transl_table=11
atgatgaccgaagacaagccgatcgccaagccgattatcgatgatgcgacgcgcgagaaaatggcgcttatgttctctggcgaggtctacctgccggatgatgtggacggcttttttgatctgcaggccgcccagcgtgatctccagctcgaactcaacgccacgccgctgaccaacccgaagcgccgtaccgaactcatgcaggcgttcttcggcgcggcgggggagggtctgtacctcgaatgcccggtgtatgcgaactggggctgcaatacttattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgcccgtccacatcggcgagaacgtctggatcggcgcgaatgtcaccgtgctgcccggggtcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtag

SEQ ID NO: 15498 - protein, 224 aa, Bifidobacterium longum NCC2705
MMTEDKPIAKPIIDDATREKMALMFSGEVYLPDDVDGFFDLQAAQRDLQLELNATPLTNPKRRTELMQAFFGAAGEGLYLECPVYANWGCNTYWGERCYANFNLTLVDDGEIFIGSHTMIGPNVTLVATGHPVRPDLRYQGAQYSLPVHIGENVWIGANVTVLPGVTIGDNAVIGANSLVTKDIPANTVAYGSPCKVIREINERDDVYYWRDRQFSERFKLKEQ

SEQ ID NO: 15499 - DNA, 678 bp, Bifidobacterium longum NCC2705
  CDS (1)..(678): transl_table=11
atgagcgaaatcaatgctgaatccaccaccatgcctcccgtcgaactgcgtatgccgcgcgccagcgagcgcgaggagatgctcgccggcaaactgtacaattcggtagaccctgaattgaatgccctgcgcgagaaggccggcgacctgtgcgcgcgcttcaacgccgcgtcgcgtaccgatcatgccgcccgtgccgcgattctcgatgagctgctgcccggccacggtgccggccttgacgtgatggggccgattttcttcgactatggctgcaacatcaccatcggagagcgcgtgttcgccaacttcaacttcactgtgctggattgttgcccggtgacgattggcgacgacgtgctgttcggcccgaacgtttcgctgctgccaccgatgcatccgttgcgttggcaggatcgtaacgtgagacaggcacctgatggttccgcatacgactgcgagtatggcaagccgattgtcatcggctcgaactgctggtttggcggcaatgtgacggtaatcggcggcgtgacgatcggcgagggttgcgtgatcggtgccggctcggtggtgacgcgcgatattccgccgcacaccgtggccgtgggtaatccggcccgtccgattcgcgagattacggataaggatgcttccgcgctacagtattacgcgcagtga

SEQ ID NO: 15500 - protein, 225 aa, Bifidobacterium longum NCC2705
MSEINAESTTMPPVELRMPRASEREEMLAGKLYNSVDPELNALREKAGDLCARFNAASRTDHAARAAILDELLPGHGAGLDVMGPIFFDYGCNITIGERVFANFNFTVLDCCPVTIGDDVLFGPNVSLLPPMHPLRWQDRNVRQAPDGSAYDCEYGKPIVIGSNCWFGGNVTVIGGVTIGEGCVIGAGSVVTRDIPPHTVAVGNPARPIREITDKDASALQYYAQ

SEQ ID NO: 15501 - DNA, 597 bp, Leptospira interrogans serovar Lai str. 56601
  CDS (1)..(597): transl_table=11
atggtgttcataaagatatttaaaaagatattaaaagaagttttactatggtttgtatatattgctttcaatgtgcctggctattccggaattatgattcggcgatttgtgcttaaatataaaattagggagataggtagttgtataaatattggtcctaatgttgaaattactggatataataacattaaatttggtaataacgttaatattatgaagtattgttctatttattctcatgatggaatgcttgaaattggagataattttagcatgaattctaatagttgtttaggggcagcagatggcggagaaattatcataggtaataacgttctaataggtcagaatgtcgtattacgcgcttctgatcatgaatttaaggacatttctattccaataatgaatcaaggacatcgtggaggaaaaattaaaatcggggatgattgttggataggtgcaaatgtggtaattacatcaaacataagtattggtgatcattgtattattgctgctggcgctgtagttactaaaaatgttgaatcttattctattgtaggtggggttccggctaaattaatcaagaaaagaatttga

SEQ ID NO: 15502 - protein, 198 aa, Leptospira interrogans serovar Lai str. 56601
MVFIKIFKKILKEVLLWFVYIAFNVPGYSGIMIRRFVLKYKIREIGSCINIGPNVEITGYNNIKFGNNVNIMKYCSIYSHDGMLEIGDNFSMNSNSCLGAADGGEIIIGNNVLIGQNVVLRASDHEFKDISIPIMNQGHRGGKIKIGDDCWIGANVVITSNISIGDHCIIAAGAVVTKNVESYSIVGGVPAKLIKKRI

SEQ ID NO: 15503 - DNA, 579 bp, Shewanella oneidensis MR-1
  CDS (1)..(579): transl_table=11
atgactgagaaacaaaaaatgttggcgggccagccttataaggcttgggatgatgcgttattggctgagcggatgcgggcgaaatctatttgccatcagtttaatcaggccgatccgactttgcttgatgcgcgtatggcgcatcttcgtggcctgctcgatattccagcctgcgctcacattgagcctaatttcttttgcgattacggctataacatccatatcggtaagcaattttatgctaatcacaacttaaccatactggatgtttgctctgttttgattggcgataacgtgatgtttggtcctcatgtgatgatttcaaccgcgacgcatcctatcgaccctattgcgcggcaaacaattgaatacggcgcgccaattcaaatcggtaataatgtctggttgggtggaaacgtctctgtgttacccggtgtgatcattggcgataattgtgtcatcggtgctggtagtgttgtgaataagagcattccctcgaactgcgtggcggcgggtaacccttgtaaggttatcaaacctatcgatgtggattatcacaggaacgttaatgccgagtaa

SEQ ID NO: 15504 - protein, 192 aa, Shewanella oneidensis MR-1
MTEKQKMLAGQPYKAWDDALLAERMRAKSICHQFNQADPTLLDARMAHLRGLLDIPACAHIEPNFFCDYGYNIHIGKQFYANHNLTILDVCSVLIGDNVMFGPHVMISTATHPIDPIARQTIEYGAPIQIGNNVWLGGNVSVLPGVIIGDNCVIGAGSVVNKSIPSNCVAAGNPCKVIKPIDVDYHRNVNAE

SEQ ID NO: 15505 - DNA, 630 bp, Shewanella oneidensis MR-1
  CDS (1)..(630): transl_table=11
atgcacacgccaatcacaaccgctttgccagattatcaaagccaacacaaaaagcgtctgtcttggatgccttggctgtatttctcgttaaaagaaaaacatttaacctgggccaaaccttggcaaaatgaagtgcaaaccaacctttgcgccctcgaaaccgtcaccattggtgataattgttttatcgcccccgaggcacaattatttgccgagccaaaccgcgatatcaacatcggcaatcactgtatgattgctgctgactgttttttacatggccccatcacccttggtaatgaagtcgccatcaatcatggctgctccctcgatggcggtcgagtggggatccagattggcgatcaaacccgcattgcaaaccatgtgaccatctatgcctttaatcatggcatggcgcccgacaccccaatttaccaacaagcctcccattctaaagggatcgtgattggtaaagatgtgtggattggcgcccaggcagggatagtcgatggcgtcaccattggcgaccatgcggtgattggcatgggctgtatcgtcactaaagatgtccccgcatgggccatcgtcgctggtaatcctgcacgagtgattggcgataggcgagataagtaa

SEQ ID NO: 15506 - protein, 209 aa, Shewanella oneidensis MR-1
MHTPITTALPDYQSQHKKRLSWMPWLYFSLKEKHLTWAKPWQNEVQTNLCALETVTIGDNCFIAPEAQLFAEPNRDINIGNHCMIAADCFLHGPITLGNEVAINHGCSLDGGRVGIQIGDQTRIANHVTIYAFNHGMAPDTPIYQQASHSKGIVIGKDVWIGAQAGIVDGVTIGDHAVIGMGCIVTKDVPAWAIVAGNPARVIGDRRDK

SEQ ID NO: 15507 - DNA, 699 bp, Streptococcus mutans UA159
  CDS (1)..(699): transl_table=11
atgactgcacaaaaaatgtctgcgcaagaaatcattgctttcatcggcaatgccgaaaagaagactaatgtcaaagtgacttttgaaggagccttggccgcggctcttcctgaaaatgttgtcaagcttggcaatgttcttttcggtgattggaaggacattgaaccgcttttggctaatttaacagaaaataaagactatgtggtagagcaggatggccgcaattctgcagtgcctttgctagataaacgcaacatcaatgctcgtattgagccgggtgccatcattcgtgatcaagtgaccattgaagataatgctgtggtcatgatgggggctattatcaatatcggtgctgaaattggtgaaggaaccatgattgatatgggagctattcttggtggtcgcgcaactgttggtaagaacagtcacatcggtgcaggtgcagtacttgctggtgtcattgagcccgcttctgcagatcccgttcgtattggagacaatgttctggttggtgccaatgcggttattattgaaggggtgcaagtggggagtggttcggtcgttgcagcaggtgctattgtaactcaagacgtccctgacaatgtcgtggtagctggtgtgcctgcgcgtgttatcaaagaaattgatgaaaaaacgcagcaaaagactgctttagaagatgctcttcgtaacctctaa

SEQ ID NO: 15508 - protein, 232 aa, Streptococcus mutans UA159
MTAQKMSAQEIIAFIGNAEKKTNVKVTFEGALAAALPENVVKLGNVLFGDWKDIEPLLANLTENKDYVVEQDGRNSAVPLLDKRNINARIEPGAIIRDQVTIEDNAVVMMGAIINIGAEIGEGTMIDMGAILGGRATVGKNSHIGAGAVLAGVIEPASADPVRIGDNVLVGANAVIIEGVQVGSGSVVAAGAIVTQDVPDNVVVAGVPARVIKEIDEKTQQKTALEDALRNL

SEQ ID NO: 15509 - DNA, 648 bp, Streptomyces coelicolor A3(2)
  CDS (1)..(648)
atgaccaccgacccccgtgaacgcgaggtccgccgcaggatggcggcccgtgagctgtattcggacggcgccccggggctggcggccctggcggaggagcggctgcgcggcaaggagctggccgacgcctacaaccggaccggcgcacgggacgaggagggccgccgggcgctcttgaaggagatgctcgccgcactcggcacgggggtgtggatcgagccgccgctgcacgtggcctacggcaaccgggtgcacctgggcgacgacgtgtacgccaacttcggcctcaccctcgtcgacgacgtcgaggtcttcgtcggcgaccgggtgatgttcgccccgcacgtgacggtcagcaccaccgggcatccggtccacccggacctgcgcagggacggcacccagttctcggcgccggtgcgcatcgaggacgacgtgtggatcggggccggcgcccagatcatgcccggggtgaccgtcggccggggttcggtggtcggcgcgggcagtgtggtgacggcccacgtgccgccgatgacggtcgtggccgggacgccggcgcgggtgctgcgcgagatcaccgacgccgaccgcgagtggagctaccgtccgccccgcactctggggcccgggccggggccggggtga

SEQ ID NO: 15510 - protein, 215 aa, Streptomyces coelicolor A3(2)
MTTDPREREVRRRMAARELYSDGAPGLAALAEERLRGKELADAYNRTGARDEEGRRALLKEMLAALGTGVWIEPPLHVAYGNRVHLGDDVYANFGLTLVDDVEVFVGDRVMFAPHVTVSTTGHPVHPDLRRDGTQFSAPVRIEDDVWIGAGAQIMPGVTVGRGSVVGAGSVVTAHVPPMTVVAGTPARVLREITDADREWSYRPPRTLGPGPGPG

SEQ ID NO: 15511 - DNA, 567 bp, Pseudomonas putida KT2440
  CDS (1)..(567): transl_table=11
atgtccctcagcgaaaaacacaaaatgctcaccggccagctctaccacgctggctgccctgaactacaggccgagcagatcgccaacaagcactggatgcatcgctacaacaacagtgtcgaactgctcaacgacgcacgccacgggctgcttgtggagcactttggccaggttggcgaaggcgcggtgattcgcccgccgttctattgcgactacggctacaacatcagcgttggccgtaatactttcatgaacttcaactgcgtgatcctcgacgtggtgccggtgcgtatcggcgaggactgccagatcggtcccaacgtgcagatctataccgccgaccatccgctcgatcctgaagtgcggcgcagcgggctggagagcgggcggccggtaaccatcggcgacaacgtgtggattggcggtgcggcgatcatcctgccgggggtgaccatcggtgataatgccatcgtcggcgccggcagtgtggtgacccgggatgtgcccgcgggcgcgacggtggtgggtaacccggcgagggtccgtcagcccgaccaagggcagtag

SEQ ID NO: 15512 - protein, 188 aa, Pseudomonas putida KT2440
MSLSEKHKMLTGQLYHAGCPELQAEQIANKHWMHRYNNSVELLNDARHGLLVEHFGQVGEGAVIRPPFYCDYGYNISVGRNTFMNFNCVILDVVPVRIGEDCQIGPNVQIYTADHPLDPEVRRSGLESGRPVTIGDNVWIGGAAIILPGVTIGDNAIVGAGSVVTRDVPAGATVVGNPARVRQPDQGQ

SEQ ID NO: 15513 - DNA, 552 bp, Escherichia coli CFT073
  CDS (1)..(552): transl_table=11
atgagcacagaaaaagaaaagatgattgctggtgagttgtatcactcggcagatgaggcgttatctcgcgatcgcctgcgagctcgtcggcttattcaccgatacaatcattccctggcggaagagcacacattacgccagcaaattcttgctgatttattcggtcaggtgacagaggcttatattgagccaacgtttcgctgtgactatggctataacatttttctcggcaataattttttcgccaacttcgattgcgtgatgcttgatgtctgccctattcgcattggtgataactgtatgttggcaccaggcgttcatatctacacggcaacacatcccatcgaccctgtagcacgtaatagcggtgctgaactggggaaacccgtcaccatcggtaataacgtctggattggcggacgtgcagtcattaaccctggtgtgaccattggtgataacgtcgtggtagcctcaggtgcagttgtcacaaaagatgtcccggacaacgttgtcgtgggcggtaatccagccagaatcattaaaaaattgtaa

SEQ ID NO: 15514 - protein, 183 aa, Escherichia coli CFT073
MSTEKEKMIAGELYHSADEALSRDRLRARRLIHRYNHSLAEEHTLRQQILADLFGQVTEAYIEPTFRCDYGYNIFLGNNFFANFDCVMLDVCPIRIGDNCMLAPGVHIYTATHPIDPVARNSGAELGKPVTIGNNVWIGGRAVINPGVTIGDNVVVASGAVVTKDVPDNVVVGGNPARIIKKL

SEQ ID NO: 15515 - DNA, 549 bp, Escherichia coli CFT073
  CDS (1)..(549): transl_table=11
atgcaggatttaagtggattctcggtgccgaaagggttccggggtggcaacgctattaaagtgcaattgtggtgggcagtacaggcaacaatatttgcctggtcgccacaagtattgtatcgctggcgggcatttttattacgtttattcggcgcaaaaataggaaaaaacgtagttattcgtccgtcagtaaaaattacctatccgtggaaattaaccttaggtgattacgcatgggtcggcgatgaggtcaatttatataccctcggtgaaataaccattggcgcacattcggtgatatcgcaaaaaagttatttatgcaccgggagccacgaccatgcaagtcaacatttcaccattaacgccacgcctattgtgattggcgagaaatgctggctggcaaccgatgtctttgttgcccctggcgtcacgatcggcgacggcaccgtcgtgggtgcgcgaagcagtgtttttaaatcgcttccggcaaatgtggtttgccgggggaaccccgcagtggtgatacgcaaacgcgttgaaactgaataa

SEQ ID NO: 15516 - protein, 182 aa, Escherichia coli CFT073
MQDLSGFSVPKGFRGGNAIKVQLWWAVQATIFAWSPQVLYRWRAFLLRLFGAKIGKNVVIRPSVKITYPWKLTLGDYAWVGDEVNLYTLGEITIGAHSVISQKSYLCTGSHDHASQHFTINATPIVIGEKCWLATDVFVAPGVTIGDGTVVGARSSVFKSLPANVVCRGNPAVVIRKRVETE

SEQ ID NO: 15517 - DNA, 588 bp, Mycoplasma penetrans HF-2
  CDS (1)..(588): transl_table=4
atggcaattaaaactaaagaagaatatataaaaaaatactcagatactggagaatgaattaaatgaggggatgaagattataatttcttatttgaagcaaatatagaagcttataagattacttcaatcattaatagtggataccattctcaaaagcacttaaatagtttattttcaaagttatttggttttaaagttgatgaatctgtttttattcaccctccttttatgacagactttgggaaaaatattaagttggggaaaagattagcaattaatgctaattgttgcttccaagattgaggaggaatagaaattggtgatgattgtcaaataggtcataatgtagttttagcaactacaaatcaccatttagatcctaataagagacatgatttaataaataaaaaaatagtattaggaaaatctgtttgagtaggatcaaattcagtaattgttggaggagttacagttggagatggtgcagtaattgcagcaggtgctgttgttactaaagatgttccagcaaatactgtagttggtggagttcctgcaagaattattaaaaagattgaagttgaagattaa

SEQ ID NO: 15518 - protein, 195 aa, Mycoplasma penetrans HF-2
MAIKTKEEYIKKYSDTGEWIKWGDEDYNFLFEANIEAYKITSIINSGYHSQKHLNSLFSKLFGFKVDESVFIHPPFMTDFGKNIKLGKRLAINANCCFQDWGGIEIGDDCQIGHNVVLATTNHHLDPNKRHDLINKKIVLGKSVWVGSNSVIVGGVTVGDGAVIAAGAVVTKDVPANTVVGGVPARIIKKIEVED

SEQ ID NO: 15519 - DNA, 771 bp, Vibrio vulnificus CMCP6
  CDS (1)..(771): transl_table=11
atgttggtgaataaatcacaactcggagtcaaaccagatagcgagaaaaacacgaaaacctttcaaggaagcgacgtaaaatcttggctcaaacatcatcccaatcctcttatgcgagcgctttttcgcacactcaaacagatccgttgtgccaacttacccacaccacatttttacaatgccttgctctaccgtttgatggtgttgcttcgccaatcaagcgactatgtgtatcgcaccttcatcaccacgccagcattcaaaggcagggtcaaggcatgcggcaaacagctctacttgtatggcggattaccgctcatcaccaacaatgttcgtatctccatgggcgatgactgtaacctttccggtcaagcaaccatcacaggctgcagctctgtcaaagagcctcgattgaacatcggcaatcgtgtctcgattggctggcaaaccaccatcgcggtgggcgacctgatcacgattgaagacgacgtcgcgatcgccggacgctgcatgttttttggttattcaggccaccccttagatcccaaacgtcgtgccgcgggtgaaggcgatgatcccagccagattcgcccaattaccctacaacgcggcagctggattggcagcaacgtgatgatcatggcgggcgtcaccgtcggagctggcagtgtgatcgccgcaggcagtgtggtgacacattctattcctgaaggtgtgatcgcaggcggtaatcccgcccacgtgattcgttcattgaacatacctcgttga

SEQ ID NO: 15520 - protein, 256 aa, Vibrio vulnificus CMCP6
MLVNKSQLGVKPDSEKNTKTFQGSDVKSWLKHHPNPLMRALFRTLKQIRCANLPTPHFYNALLYRLMVLLRQSSDYVYRTFITTPAFKGRVKACGKQLYLYGGLPLITNNVRISMGDDCNLSGQATITGCSSVKEPRLNIGNRVSIGWQTTIAVGDLITIEDDVAIAGRCMFFGYSGHPLDPKRRAAGEGDDPSQIRPITLQRGSWIGSNVMIMAGVTVGAGSVIAAGSVVTHSIPEGVIAGGNPAHVIRSLNIPR

SEQ ID NO: 15521 - DNA, 594 bp, Vibrio vulnificus CMCP6
  CDS (1)..(594): transl_table=11
atgcatcaacaaaagatttacttttgtgatgatgagagtgtggcgttagagcagcaagcttgcctggaaattctctatgattttaaccaaaccagaccctcagaaatggaaaaacgcacagcgattttgcgtgatctcttggctgaagtcggtgagaactgctacatcgagccaccattaagagccaattggggtaagcacacacacttaggtaataatgtttatgccaatttcaatttaaccttggtggatgatacacacatctacattggtaactcggtgatgattgcacccaatgtcaccatcgccacggcgggacatccgattgatcctgaactgcgacgtaaagtggcgcaattcaacattcctgtgcacattaaagataacgtttggattggggcgaacagtgttgtgttaccaggcgtaacgattggcgaaaacagcgtgattggtgccggcagtgtggtgacgaaagacatccccgccaatgtcgtggccgttggtaatccttgccgagtgttgcggccgattggagagcatgacaaacgttacttctatcgcgataacgttattgacgatttaccacaagcctaa

SEQ ID NO: 15522 - protein, 197 aa, Vibrio vulnificus CMCP6
MHQQKIYFCDDESVALEQQACLEILYDFNQTRPSEMEKRTAILRDLLAEVGENCYIEPPLRANWGKHTHLGNNVYANFNLTLVDDTHIYIGNSVMIAPNVTIATAGHPIDPELRRKVAQFNIPVHIKDNVWIGANSVVLPGVTIGENSVIGAGSVVTKDIPANVVAVGNPCRVLRPIGEHDKRYFYRDNVIDDLPQA

SEQ ID NO: 15523 - DNA, 549 bp, Vibrio vulnificus CMCP6
  CDS (1)..(549): transl_table=11
atgactgaatttgaaaaaatgaattccgggcaaatctttgatggcgcggatgcggaaattgatgcgattcgcaatcgtgctgcggtgttattgaaagagatcaacgcagcaacggaaacagaacaacgcatcgcactgcaaaaacagctctttgccagcatgggcaacagttatatccagccaccatttatgtgtgaatttggcaaaaccatctctattggtgaggaaacgttcatcaacatgaatgttgtgatgctggatggggcgcacattacgatcggcagccacgtgttaattggcccgagttgccagttttataccgcttctcattcccttgattaccgaagccgccgccagtgggaaaccttctgcaaaccgattgttgtagaagatgatgtttggattggtggaaattgcgttatcaatcagggggtcactattggagctcgttctgtcatcgctgcaaattcggtcgtcaatcatgatgtcccaccagactgcttgtatgggggcaccccagcgaaactgattcgacggttagacaagtag

SEQ ID NO: 15524 - protein, 182 aa, Vibrio vulnificus CMCP6
MTEFEKMNSGQIFDGADAEIDAIRNRAAVLLKEINAATETEQRIALQKQLFASMGNSYIQPPFMCEFGKTISIGEETFINMNVVMLDGAHITIGSHVLIGPSCQFYTASHSLDYRSRRQWETFCKPIVVEDDVWIGGNCVINQGVTIGARSVIAANSVVNHDVPPDCLYGGTPAKLIRRLDK

SEQ ID NO: 15525 - DNA, 621 bp, Bradyrhizobium japonicum USDA 110
  CDS (1)..(621)
atgtccagcctctccacgctcgtgcgctggtgcgtacatgccattgatggcttcaatttacactatattgtgcagcgcctgatcgggcgggcaacctgccgcttggaccgaggcgcattcttggcccatagcgcgcggatcaggaacgcgctcggcgatagtgagaagattgtcattggcagccattctcatgtcaggggtgaactgatgatcctcggtcacggcggtcaaattaatatcggagagtggtgctatgtcggggttggcacgcggatttggtccggcgcgtcgatcgatatcgggaatcgtgtcttgatttcgcattccgtcaacatattcgacaatctctcgcatcctatccgtgcttccgagcgacacgaacaggcgaaggagattttctctaccggtcacccaaggcagctttctctcgacgaccgtccgatcaagatttgcgatgatgcgtggatcggtgcttgcgccatggttatgcgtggcgtgaccattggtgagggtgggattgtcgccgcgggtgctgtggtcaccaaggatgttccggcatattccatcgtcgcgggcaaccctgcgaccatcgtcagggaattgtcgccggacgagcgatga

SEQ ID NO: 15526 - protein, 206 aa, Bradyrhizobium japonicum USDA 110
MSSLSTLVRWCVHAIDGFNLHYIVQRLIGRATCRLDRGAFLAHSARIRNALGDSEKIVIGSHSHVRGELMILGHGGQINIGEWCYVGVGTRIWSGASIDIGNRVLISHSVNIFDNLSHPIRASERHEQAKEIFSTGHPRQLSLDDRPIKICDDAWIGACAMVMRGVTIGEGGIVAAGAVVTKDVPAYSIVAGNPATIVRELSPDER

SEQ ID NO: 15527 - DNA, 564 bp, Clostridium tetani E88
  CDS (1)..(564): transl_table=11
atgatgaaaagcgaaaaagaaaaaatgttatcaggtgatttttataatgctaatgataaagaattggttaaagaaagagactatgcaagaaatttaacttttgagtttaatcatataaatccgactgaaaaagaaaaaagacgagaaattataaaccaattaattaataccaaaggttcatttcatattgaagcaccctttaattgtgattatggttataatattgaagttggtgaaaacttttatgctaattatggatgtaccatattagatgtaaataaggttaaagttggagacaatgtacttttagcaccgaatgttcaaatctatactgctactcatcccaccaatcctacagaaagactcactggcaaagaatactctacaccaattgttataggaaataatgtttgggttggtggtggaacaataatatgccctggagtaaaaattggaaataatgtaactataggagcaggtagtgttgtggctaaagacatacctgataatgtaattgctgtaggaaatccttgcaaagttattaaaaaggctaccatactataa

SEQ ID NO: 15528 - protein, 187 aa, Clostridium tetani E88
MMKSEKEKMLSGDFYNANDKELVKERDYARNLTFEFNHINPTEKEKRREIINQLINTKGSFHIEAPFNCDYGYNIEVGENFYANYGCTILDVNKVKVGDNVLLAPNVQIYTATHPTNPTERLTGKEYSTPIVIGNNVWVGGGTIICPGVKIGNNVTIGAGSVVAKDIPDNVIAVGNPCKVIKKATIL

SEQ ID NO: 15529 - DNA, 618 bp, Lactobacillus plantarum WCFS1
  CDS (1)..(618): transl_table=11
atgaccaataataacgatcgtcttcatactggcgaactctacttacctaacgaccctgaacttgaaaaacgccaatttggctatctcgatcagctctatgatttcaaccaaactcggcccagcgaactaaccaagcgccaaattctacttagcaagatgttcgcagaaatcggcccgaagtgttacatcgaaccaccgtttcacagtaactttggtgggcaccatgtccactttggcaagggggtttacgccaattttaacctaacactggtagatgatacccatatttacgttggcgactatacgatgttcggccccaacgtgacaattgcaaccgcgggccatccgattttgccatcattgcgcgaacaagcttatcagtacaatatgccagttcatatcggccgtaactgttggttcggcgcaggtgccatcgtactacccggtattacgattggcgacaatgtcgtcgttggcgctggtagcatcgtgaccaaagacttacctgataacgtcgtcgccgtggggaatcccgcccatatcttgcgacacattaatgatcacgaccgtctgtactactttaaagaccgccagattgatcctagcttgttaaattag

SEQ ID NO: 15530 - protein, 205 aa, Lactobacillus plantarum WCFS1
MTNNNDRLHTGELYLPNDPELEKRQFGYLDQLYDFNQTRPSELTKRQILLSKMFAEIGPKCYIEPPFHSNFGGHHVHFGKGVYANFNLTLVDDTHIYVGDYTMFGPNVTIATAGHPILPSLREQAYQYNMPVHIGRNCWFGAGAIVLPGITIGDNVVVGAGSIVTKDLPDNVVAVGNPAHILRHINDHDRLYYFKDRQIDPSLLN

SEQ ID NO: 15531 - DNA, 609 bp, Lactobacillus plantarum WCFS1
  CDS (1)..(609): transl_table=11
atgatggatgaacgacagcggagtttgagcggtcagacctatgatgcacacgcaccagtatttttagagctaaaacggcgtacacggcaacttttaagccagtataaccagctcgcctatgaccaaaaaagtgagaaacgtacgatattgcaggctatgtttgccaagattggatcgaatgtttcggtggggagcccatttatttgtgactacgggtgtaatatttcgattggtcagaatgtttcaatcaatatgaactgtaccttgatcgactgtaatcggattaccattggtaataatgtcttgattgcctcaaatgttcaaatttatacggctacccatccggtcgaactgcatgaacgtttacgtgcggactggcagccagatagtgatcagtatttttgccagacgttagcgcggccagtcacaatcgaggatggctgttggattggcggtggcgtgattattattcccggcgtgacaattggtcggggatccgtgattggtgccggtagtgtggtcgtcaaagacattccagctaattcgttggcggtaggcaatccttgtcgtgtgattcggcagattaatcaaggtgaaccgcatgcttaa

SEQ ID NO: 15532 - protein, 202 aa, Lactobacillus plantarum WCFS1
MMDERQRSLSGQTYDAHAPVFLELKRRTRQLLSQYNQLAYDQKSEKRTILQAMFAKIGSNVSVGSPFICDYGCNISIGQNVSINMNCTLIDCNRITIGNNVLIASNVQIYTATHPVELHERLRADWQPDSDQYFCQTLARPVTIEDGCWIGGGVIIIPGVTIGRGSVIGAGSVVVKDIPANSLAVGNPCRVIRQINQGEPHA

SEQ ID NO: 15533 - DNA, 555 bp, Lactobacillus plantarum WCFS1
  CDS (1)..(555): transl_table=11
atgtcagaattagataaattagcagctggggaatggtatcaatttaaagatgctgaggtggccgctcaaaaagcgcgggctgccaagttatgtcaagagttcaatcagatcgatgcaacaaatccagatgcgcaaactgccaagattcaagagattcttggtagttacggtcgcaatctttccgttcaagcagactttaattgtgataatggtcgtaatattcatgttggtgataattttcttagtaattataacttaactattttggatatcgcgccagttcatataggggataacgtgatgattggccccaatgttgatatttatacggtcaatcacccgttgacggctagtggtcgacgtgctagcttggcccagggtcatccagtcacgattggtcatgatgtttggattggggggagagcggtgattacgcccggcgtgacgattggtaataatgttgtgattgcggctggagcagtcgttactcatgacatgcctgataatacgttggtggccggggtaccagccaaagttattcgacaattagaataa

SEQ ID NO: 15534 - protein, 184 aa, Lactobacillus plantarum WCFS1
MSELDKLAAGEWYQFKDAEVAAQKARAAKLCQEFNQIDATNPDAQTAKIQEILGSYGRNLSVQADFNCDNGRNIHVGDNFLSNYNLTILDIAPVHIGDNVMIGPNVDIYTVNHPLTASGRRASLAQGHPVTIGHDVWIGGRAVITPGVTIGNNVVIAAGAVVTHDMPDNTLVAGVPAKVIRQLE

SEQ ID NO: 15535 - DNA, 603 bp, Lactobacillus plantarum WCFS1
  CDS (1)..(603): transl_table=11
atgaatttagatgagaagtttgcgtatatggcgactggtcagccgtatcgagatacggatgcagaactaacggcgttgcgtgaccaagcgacgttgacaacgaacgcggtcaatgcgactgctgatccagagactaaagaaactttattgcgacaattggttggttcagctggtcgcaagccatttgtaaatcctaattttcgcgttgaatttggacggaacattcatctaggtgataacttttatgccaactatgattgtgtaatgttagatggggcgccaattacgatcggcagtcaggtcttgttggggccaaaagtcggcctttacacgagcaaccacttgtttgatgcaaccgaacgaattaggggcggctgcatcgcccgaccaatcacaattggtgatggttgttggctagccgctaacgtcaccgtattaccaggagtgaccattggtgctaacacgattattggtggtgggagcgtggtaacccacgatattccagctaacgtgattgcggctggcaacccttgccaagttattcgaccaatcacggcggccgaccgcactggttacaccggggcgcaattcgaattgtcatga

SEQ ID NO: 15536 - protein, 200 aa, Lactobacillus plantarum WCFS1
MNLDEKFAYMATGQPYRDTDAELTALRDQATLTTNAVNATADPETKETLLRQLVGSAGRKPFVNPNFRVEFGRNIHLGDNFYANYDCVMLDGAPITIGSQVLLGPKVGLYTSNHLFDATERIRGGCIARPITIGDGCWLAANVTVLPGVTIGANTIIGGGSVVTHDIPANVIAAGNPCQVIRPITAADRTGYTGAQFELS

SEQ ID NO: 15537 - DNA, 621 bp, Lactobacillus plantarum WCFS1
  CDS (1)..(621): transl_table=11
atgaaaacacagaaagaacgaatgctgtcgggtgagttgtacgttgctgatgatccagaattaggacgtgaaaatcatcgtgccaaacggttagtacgggaatttaatcaaacaaccgaagcccaaccaaaagaacggcaacgattgttaacggcaatgttcaacaaaattggtgacgggggctatatcgaaccgccatttcataccgactatggaagtaacacgacaattggcaagcacttttacgccaattacgatgcgatttttattgatgtgggtcggattacgattggggacaacgtctttatggggccgcgggtcggcttatatacggcgggtcaccccattgacgccgccattcgtgctgaacaactcgaatatggttggccaattacgattggacacgatgtttggtttgggggcaacgtggtcgttaatccgggtgtcacgattgggagtaacgtcgtgattgggtctggttccgtggttactcatgatatcccggataacgtggttgcggtcggcaatccttgccatgtcttacgagaaatcaccaccgccgaccatgaatattgggctcggcaacgggccgcctattttgctgatcgtgatgatgattga

SEQ ID NO: 15538 - protein, 206 aa, Lactobacillus plantarum WCFS1
MKTQKERMLSGELYVADDPELGRENHRAKRLVREFNQTTEAQPKERQRLLTAMFNKIGDGGYIEPPFHTDYGSNTTIGKHFYANYDAIFIDVGRITIGDNVFMGPRVGLYTAGHPIDAAIRAEQLEYGWPITIGHDVWFGGNVVVNPGVTIGSNVVIGSGSVVTHDIPDNVVAVGNPCHVLREITTADHEYWARQRAAYFADRDDD

SEQ ID NO: 15539 - DNA, 570 bp, Lactobacillus plantarum WCFS1
  CDS (1)..(570): transl_table=11
atggaaatcgataatgacccagcgtatcaacaaatgattaatggtgaattgtacttagaatcaccaatcctacagcaacgtcggcgagacgtgcggacgaagttaatgcaatataatcagattgctgataatgatgaacggaatactaagatgaaaagtctcttacgttcagccggtgaccggttcttcgttgaaccgacctttgaatttagttatggcgtcaatattcgtatcggcaatcatttttatgctaaccatggggtcacgttatgtgatgaaggacttattacgattggtaatgattgcaaatttggtcctaaagttggcttgtacacgcctgctcatccattagacccaactgtgcggcggactgaagcggaacggactgcaccgattacgattggtaatgatgtttggattggtggtagtgccgtgatcttacccggggtgacgttgggcaacaacgtgattgttggtgccggtgctgtcgtaacacattcatttccagataacgtcatcgtagtcggtaatccggcgcgtgtcttgaaacaaaatgcaccgcagtcataa

SEQ ID NO: 15540 - protein, 189 aa, Lactobacillus plantarum WCFS1
MEIDNDPAYQQMINGELYLESPILQQRRRDVRTKLMQYNQIADNDERNTKMKSLLRSAGDRFFVEPTFEFSYGVNIRIGNHFYANHGVTLCDEGLITIGNDCKFGPKVGLYTPAHPLDPTVRRTEAERTAPITIGNDVWIGGSAVILPGVTLGNNVIVGAGAVVTHSFPDNVIVVGNPARVLKQNAPQS

SEQ ID NO: 15541 - DNA, 561 bp, Lactobacillus plantarum WCFS1
  CDS (1)..(561): transl_table=11
gtgattaagagtgaaaaggccaaaatgattgctggtgagttgtttaatgtttatgacccagaactagtcggtgagcgagccatagcacggcaacaagtagaagctttcaatcagctcggtgagacgaatccccataaaagccaacaaataattaaacgattatttggcgcgactggtgataaaattgaagttcatgctacctttcgttgtgattacgggtataacctattcgttggtgaagatttctttgctaattatgactgcgtgattttagatgtggccccgattaagattggaaaacactgtctattaggtcccaaagtacaaatttattctgtgaatcatcctgatgaccctcagttacgacgcaatggtgccatgggtattggtaagtctgtgaatctaggagatgatttatgggttggcggtggcgcgattatttgtccaggggtcacattgggaaataatgtgattgttgctgcggggagtgtggtcaccaagtcctttggagataacgtggttgttggtggtaatccagcgcgggtgattcgggaattatga

SEQ ID NO: 15542 - protein, 186 aa, Lactobacillus plantarum WCFS1
MIKSEKAKMIAGELFNVYDPELVGERAIARQQVEAFNQLGETNPHKSQQIIKRLFGATGDKIEVHATFRCDYGYNLFVGEDFFANYDCVILDVAPIKIGKHCLLGPKVQIYSVNHPDDPQLRRNGAMGIGKSVNLGDDLWVGGGAIICPGVTLGNNVIVAAGSVVTKSFGDNVVVGGNPARVIREL

SEQ ID NO: 15543 - DNA, 555 bp, Vibrio parahaemolyticus RIMD 2210633
  CDS (1)..(555): transl_table=11
atgaccgaactagaaaaaatgatgtccggccaagtatttgatggcatggacaaagaaattgacgccattcgaactcaagccactcttgccctgcgcgccttcaataacaacactgacgaaagtaagcgcgacgaattgcaaaaacagctgtttggcaacgcgggtctttgcattgttcaagcccctttccattgcgaattcggtaaaaccatcgaaatcggtgaagagacctttatcaacatgaacgtggtcatgctcgatggtgccaaaattaccatcgggaaccacgtgctcattggcccgagcgtgcaattgtataccgcttctcattctgtggattaccgaagtcgccgacgttgggaaacgttttgtaaacccatcacgattgaagatgatgtgtggattggcggtaactccgtcattaaccaaggtgtgacgataggtgctcgctcagtcattgcggcgaattcagtcgttaaccatgatgtgccgccagattgtctatacggaggcactccagcgaagttgattcgtcgtctcaacgaagaagagtaa

SEQ ID NO: 15544 - protein, 184 aa, Vibrio parahaemolyticus RIMD 2210633
MTELEKMMSGQVFDGMDKEIDAIRTQATLALRAFNNNTDESKRDELQKQLFGNAGLCIVQAPFHCEFGKTIEIGEETFINMNVVMLDGAKITIGNHVLIGPSVQLYTASHSVDYRSRRRWETFCKPITIEDDVWIGGNSVINQGVTIGARSVIAANSVVNHDVPPDCLYGGTPAKLIRRLNEEE

SEQ ID NO: 15545 - DNA, 549 bp, Vibrio parahaemolyticus RIMD 2210633
  CDS (1)..(549): transl_table=11
atgttagaactgactcggatgcgctctggagaaacctataattgtctggatgaagaactaaagctaatgcgcgccaaaaccgcgcagcttgtcttccaatttaaccacgagccaaacccagatatacgtagacaactattggcagaaatgggcgtccaattagaaaacagcgcctgtatagagccaccgcttcaacttacctacggttgtcacttgtccatcggggaaaactcctacatcaactgggatgccattattctggacaatgggcaggttgagattggcgcgaacgtcatgattgggcctagagtgcaaatttacacagccgctcattcactcgatacacaaagacgcttagccggagatgagatcgccaaaccggtaaaaattggcaataacgtttggattggtgggggcgcaatcatactgccaggcgtgaccattggcgatgaggccgtcgtcggcgctggctctgtgataaccaaagacgttgcgccgggcgatcgagttgctggaaatcccgcgcgctccattaaaccaaaaaactga

SEQ ID NO: 15546 - protein, 182 aa, Vibrio parahaemolyticus RIMD 2210633
MLELTRMRSGETYNCLDEELKLMRAKTAQLVFQFNHEPNPDIRRQLLAEMGVQLENSACIEPPLQLTYGCHLSIGENSYINWDAIILDNGQVEIGANVMIGPRVQIYTAAHSLDTQRRLAGDEIAKPVKIGNNVWIGGGAIILPGVTIGDEAVVGAGSVITKDVAPGDRVAGNPARSIKPKN

SEQ ID NO: 15547 - DNA, 552 bp, Salmonella enterica subsp. enterica serovar Typhi Ty2
  CDS (1)..(552): transl_table=11
atgagtgacgaaaaacaaaaaatgatcgctggggcactgtattgcccgaccgatgaaactttatgccaggatcgactgcgggcgcgtcaactcatccatcaatacaattatactacgcctgatgaaataaataagcgtcaggcgattttacgcgacctgttgggtcgatgcgaagacgcctatattgaaccttccttccgttgcgactacggctataatatttttcttggtcactccttttacgctaacttcgactgcgtcatgcttgatgtttgcccaattcatattggcgataattgtatgctcgcgccaggggtacatatctataccgccacgcacccgctggacgccgtcgaacgcaacagcggcagagaattaggtaaacccgtcactatcggaaataacgtctggataggcggacgagccgtcgttaatcctggcgtaaccatcggcgataacgtcgtcgtcgcttcaggcgctgtggtgacaaaaaacgtaccgccagacgtcgtggtaggcggaaatccggcgcgaatcattaaaaaattgtag

SEQ ID NO: 15548 - protein, 183 aa, Salmonella enterica subsp. enterica serovar Typhi Ty2
MSDEKQKMIAGALYCPTDETLCQDRLRARQLIHQYNYTTPDEINKRQAILRDLLGRCEDAYIEPSFRCDYGYNIFLGHSFYANFDCVMLDVCPIHIGDNCMLAPGVHIYTATHPLDAVERNSGRELGKPVTIGNNVWIGGRAVVNPGVTIGDNVVVASGAVVTKNVPPDVVVGGNPARIIKKL

SEQ ID NO: 15549 - DNA, 759 bp, Bacteroides thetaiotaomicron VPI-5482
  CDS (1)..(759): transl_table=11
atgaatttatcggttgttctgtttatactaatagttgtatttattaagtattggttactgctatttacttctcctttactaatggcttattgttggctgcatcgtcgcaaaaacatggctaatcctgaaggtgaggtgagtgaaattagggattctggcattacttcttcttcttgttctaaaaaattgttcaaacgaatagataaaagaggattgatcaatattgtggatggttattttcgttggatgatcaaaataatttcggatattccttcacatcatatacgtgatttcttttacaagtatattttcttggtaaaaatggaaaagaattcagtattatattatggaagtgaaattcgtgcaccatggatgttgatgataggaaaaggttctgtcgttggagataatagtattctggatgcgaggcgtggaggaatctatatcggtgaaaacgttaatattgcttctaatgtttctctttggacaggtggtcatgattataatgatccatactttcgatctatgaaaacgaatcgtggtcctatttatataaagaaccgtgtatggattggccctaatgtaacaattttgcatagtgttactattggggagggagcagtgatagcagctggtgccgtagttactaaggatattccgccttttactatatgtggaggaataccagcaaaagttttggcgcaacgttctattgatttgcggtatactttgggagggacatatcttcattttctataa

SEQ ID NO: 15550 - protein, 252 aa, Bacteroides thetaiotaomicron VPI-5482
MNLSVVLFILIVVFIKYWLLLFTSPLLMAYCWLHRRKNMANPEGEVSEIRDSGITSSSCSKKLFKRIDKRGLINIVDGYFRWMIKIISDIPSHHIRDFFYKYIFLVKMEKNSVLYYGSEIRAPWMLMIGKGSVVGDNSILDARRGGIYIGENVNIASNVSLWTGGHDYNDPYFRSMKTNRGPIYIKNRVWIGPNVTILHSVTIGEGAVIAAGAVVTKDIPPFTICGGIPAKVLAQRSIDLRYTLGGTYLHFL

SEQ ID NO: 15551 - DNA, 624 bp, Bacteroides thetaiotaomicron VPI-5482
  CDS (1)..(624): transl_table=11
atggagaaaaggacactgaaacagcgaatcaaacagaatccggctttgaaacaagccgtacatcgttttattatgcatcccgtaaagacacgtcccaactggtggatacgccttttctattttgtatatctgaaacgtggaaaaggttccgtaatttatcgcagtgtccgcaaagaccttcctccttttaatcagttctcgctagggcgctattcggtagtagaagacttttcctgccttaataatgcggtaggagatttaatcattggagattatacccgcatcggattaggaaataccattatcggtccggttcgtatagggaatcatgtgaatcttgcacagaatataacagtcacaggacttaatcataactatcaagatgcggagaaatcaatcgacgaacaaggagtaagtacacagcctgtcactattgaggatgatgtatgggtaggtgcaaactccgtcatactgccgggagtaactttagggaaacattgtgtagtggctgccggaagcgttgtcagccgttccatcccggcatactctatttgtgccggttgccctgccaaagtgatcaaatcatatgatttcgcaacgaaagagtggaaaaaagtaaaatga

SEQ ID NO: 15552 - protein, 207 aa, Bacteroides thetaiotaomicron VPI-5482
MEKRTLKQRIKQNPALKQAVHRFIMHPVKTRPNWWIRLFYFVYLKRGKGSVIYRSVRKDLPPFNQFSLGRYSVVEDFSCLNNAVGDLIIGDYTRIGLGNTIIGPVRIGNHVNLAQNITVTGLNHNYQDAEKSIDEQGVSTQPVTIEDDVWVGANSVILPGVTLGKHCVVAAGSVVSRSIPAYSICAGCPAKVIKSYDFATKEWKKVK

SEQ ID NO: 15553 - DNA, 564 bp, Bacteroides thetaiotaomicron VPI-5482
  CDS (1)..(564): transl_table=11
atgctttcgggaaaaatgtataatgacttgtctgtagaactggttcaaagaagagaacaggctgttttcctgaccaatgattataattccacttatggaaagcctaaagaagttcgggaggcattgttacgtaaactattgaggtgtattggcagtagtgttcattttgaaccgaatttccggtgtgagtttggattcaatatcagtattggcaataatttcttcgccaattttgattgcatcatgttggacggaaatctcattacgataggcgacaatgtattattagggccccgtgtcggtttatatacggccaatcatgcgctcgatccgcaggaacgtcttatgggcgggtgctatgcccatccgattgtcattgaagataatgtatgggtaggtgccggcgttcatataatgggtggtgtcactgtcgggagaaattcagtaatcggtgcgggcagtgtggtgacaaagagcattccggagaatgtaattgccgcaggtgttccctgtaaagttattcgggaaataaccgatgaagacaagaccggttttctgccttag

SEQ ID NO: 15554 - protein, 187 aa, Bacteroides thetaiotaomicron VPI-5482
MLSGKMYNDLSVELVQRREQAVFLTNDYNSTYGKPKEVREALLRKLLRCIGSSVHFEPNFRCEFGFNISIGNNFFANFDCIMLDGNLITIGDNVLLGPRVGLYTANHALDPQERLMGGCYAHPIVIEDNVWVGAGVHIMGGVTVGRNSVIGAGSVVTKSIPENVIAAGVPCKVIREITDEDKTGFLP

SEQ ID NO: 15555 - DNA, 606 bp, Bacteroides thetaiotaomicron VPI-5482
  CDS (1)..(606): transl_table=11
atgatattcggttttattgcaaaaatatataggaaatatcaagaatatattcatcctggtatttatgttacgaggcatggtattctgtacagagaaaaagattgccgatataatgtatatccgttacaaagattaattgttggtaaggtatgggttggaaacattccttcacaggagaaagggcggcttattcttcatgctaactcggaattgatagtaaaagggaattttgatattatcggttcaactgtagtcgtattgccggatgctaaactgattttaggttccgggtatattaatttccattcgaagttacattgttttaatcacatagaaataggagaaaatgttatcatttcagagaatgtaattatccgggattctgataatcaccagataacgggaggaaatagcatgtttgctcctgttataataaaggataatgcatggattggtatgtctgctatcattttaaaaggggtgacggttggtgaaggtgctattgttgcagcaggttctgtcgtgactaaagacgtaccgccgcatactattgtcgcaggagtaccggcaagggtaattaaaaaagatgtttattatacaatatga

SEQ ID NO: 15556 - protein, 201 aa, Bacteroides thetaiotaomicron VPI-5482
MIFGFIAKIYRKYQEYIHPGIYVTRHGILYREKDCRYNVYPLQRLIVGKVWVGNIPSQEKGRLILHANSELIVKGNFDIIGSTVVVLPDAKLILGSGYINFHSKLHCFNHIEIGENVIISENVIIRDSDNHQITGGNSMFAPVIIKDNAWIGMSAIILKGVTVGEGAIVAAGSVVTKDVPPHTIVAGVPARVIKKDVYYTI

SEQ ID NO: 15557 - DNA, 552 bp, Bacteroides thetaiotaomicron VPI-5482
  CDS (1)..(552): transl_table=11
atgacagaagtagagaagatgcgtagcagccagttggctgatatgtccgcgccggagttgcaggtgcgttttgagcatgccaagaagttgctggcgatcatgcgcgggttgagcacgtatgatgacgggtacagagaattgctggaagaactggtgccgggtattcctgaaacttcggtgatctgtcctcctttccattgcgatcacggagacgggataaagttgggcgaacacgtctttgtcaatgccaactgtacttttctggacggagggtatatcacaatcggtgcccatacgctagtcggcccttgcgtacagatttatacaccgcatcatccgatgaattatctggagcgtcgcggttcgaaagagtatgcttatccggttacgatcggcgaggattgctggattggcggcggtgctgtcatttgtcccggtgtgacgattggcaaccgttgtgtgataggagcgggaagcgtcgtgacgaaagatattcccgacgacagtgttgcagtcgggaatccggcgcgccttatccgtaagcaggcttga

SEQ ID NO: 15558 - protein, 183 aa, Bacteroides thetaiotaomicron VPI-5482
MTEVEKMRSSQLADMSAPELQVRFEHAKKLLAIMRGLSTYDDGYRELLEELVPGIPETSVICPPFHCDHGDGIKLGEHVFVNANCTFLDGGYITIGAHTLVGPCVQIYTPHHPMNYLERRGSKEYAYPVTIGEDCWIGGGAVICPGVTIGNRCVIGAGSVVTKDIPDDSVAVGNPARLIRKQA

SEQ ID NO: 15559 - DNA, 846 bp, Enterococcus faecalis V583
  CDS (1)..(846): transl_table=11
atggaagaatttaaatcagaaaaagaaaaaatgatcgcaggtgcactatattttgcctcagatcctgaattagtggctgatcgcaaaaaagcccgtgaacaaatggcgttaattaaccaacaaccagacacttatattcgtcgtcaattaatagaagaaacgtttggaaaagtgggtgtcgggacgtacatcgaaccgatgattcaatttgattatggctacaacatttctgtgggaaaaaatttctatgccaattttaataacgtttttttagatgtttgtccaatcgaaattggcgataactgtatgtttggacccaatgtgcaactttatacagccgagcatccattacaagcggccaagcgtaatagcggaatggaatcagggaaacgaattatcattggcaacaatgtttggattggcggtggagcgattgtccttcctggcgtaacattaggcgataatgtagtggtggcagcaggtgctgttgtgaccaaatcgtttccagaaaactgtgtgatcgcaggtaatccagcacggataattaaagaattgactgaagatgacgccccaacaacttctttagaacaacaacgagcaaagattaaccaaatcgataaggaactggtccgtttattagaacagcggatggacgtcgtcgcagagattgctgcagtgaaaaagaaagcaggtcatgcggtttttgattctgaaagagaacaacaagtattagaaactattctgaatcatgttgaaaatgccgagtatgaagaaacattatctgagactttccagggaattatggacgcctctaaacgtttccaagaaaaacatttaggagagtga

SEQ ID NO: 15560 - protein, 281 aa, Enterococcus faecalis V583
MEEFKSEKEKMIAGALYFASDPELVADRKKAREQMALINQQPDTYIRRQLIEETFGKVGVGTYIEPMIQFDYGYNISVGKNFYANFNNVFLDVCPIEIGDNCMFGPNVQLYTAEHPLQAAKRNSGMESGKRIIIGNNVWIGGGAIVLPGVTLGDNVVVAAGAVVTKSFPENCVIAGNPARIIKELTEDDAPTTSLEQQRAKINQIDKELVRLLEQRMDVVAEIAAVKKKAGHAVFDSEREQQVLETILNHVENAEYEETLSETFQGIMDASKRFQEKHLGE

SEQ ID NO: 15561 - DNA, 639 bp, Enterococcus faecalis V583
  CDS (1)..(639): transl_table=11
atgaaacaaaatgactttgattatatgcaaatgttaaaaggtgaattatattacgcccccaccattttacccgaaaacaaatcaacaaaaggcaaggtgttagctcaaaaaatcaatcaacttcctatcgataatgtgaaagaaattgtggccctagaaaaagaattattaggaaaaactggcaatgagttatatatcaccccacccctccatgtagattacggtcgccatattgaggtaggagaaaatttttatgcaaatatggattgcatttttttagatgtaaacaaaatcatcttcggtgataatgtcatggttggccctcgtgctagtttttatactgccggccatccaattgatccaacgattcgaactgcagaattagaattcggtacgccaattattgttgaagataacgtgtggattggcggaagtgccaccattttacctggcgttacaattggaaaaaatgctattgttgctgctggtgctgtggttacaaaagacgttcctgccaacacgattgttgggggtaatccagcaaaagtcattcgcaaaattgatgaaaacgatcagcaattttggacagaaaagcaacggcagtatcaaatcgctaagaagcaattctttcatgaataa

SEQ ID NO: 15562 - protein, 212 aa, Enterococcus faecalis V583
MKQNDFDYMQMLKGELYYAPTILPENKSTKGKVLAQKINQLPIDNVKEIVALEKELLGKTGNELYITPPLHVDYGRHIEVGENFYANMDCIFLDVNKIIFGDNVMVGPRASFYTAGHPIDPTIRTAELEFGTPIIVEDNVWIGGSATILPGVTIGKNAIVAAGAVVTKDVPANTIVGGNPAKVIRKIDENDQQFWTEKQRQYQIAKKQFFHE

SEQ ID NO: 15563 - DNA, 582 bp, Enterococcus faecalis V583
  CDS (1)..(582): transl_table=11
atgcttacaaaaaatctccaagaactaattgcaacaggtagcattgataaagatgaaccactatttcaacttattcatcagattcaagaggaaaatagtcgctatttaatagaattaaatcaacaagcctatacacataatgaagtaaggaatcttcttgccacgattatccaagacaaaattgacgaaaccgttacgattttattacctttttatacagattttggacgcaatatacattttggtaaaaatatttttattaatcgggcagctatgtttgttgatttagggggcattataattgaagacaatgttttaattggtccgcgcgttaatctcttaagtgtcaatcatccggaactgccaatgaaacggcgaggcgtattgctagcaccaattaccattaaaaaatttgcgtggttaggcgcgggtgtcactgttttaccaggtattacgattggtgaaaatgctatcgtagcagctaatgcgactgtaactaaagatgtgccagctaacgctattgttgcaggaacaccagctaaaattattcgttggattcaggaagataaggaggaaatataa

SEQ ID NO: 15564 - protein, 193 aa, Enterococcus faecalis V583
MLTKNLQELIATGSIDKDEPLFQLIHQIQEENSRYLIELNQQAYTHNEVRNLLATIIQDKIDETVTILLPFYTDFGRNIHFGKNIFINRAAMFVDLGGIIIEDNVLIGPRVNLLSVNHPELPMKRRGVLLAPITIKKFAWLGAGVTVLPGITIGENAIVAANATVTKDVPANAIVAGTPAKIIRWIQEDKEEI

SEQ ID NO: 15565 - DNA, 723 bp, Bacillus cereus ATCC 14579
  CDS (1)..(723): transl_table=11
atgaaaatgatggacgctaacgaaattatttcgtttattcaaaaaagtgaaaagaaaactcctgtaaaggtatacataaaaggggatttaaaagaagtaacattccctgaaacagtacaagcatttgtgaataaaaaatcaggtgtattattcggagaatggtctgaaattaagacaattcttgatgagaataataagcacatcgttgactacgttgtagaaaacgatcgtcgtaattctgcaatcccaatgcttgatttaaaaggtattaaagctcgcatcgagccaggtgctattattcgtgaccatgttgaaattggtgacaacgctgtaattatgatgaatgcaacaattaacattggtgctgtaattggtgaaggttctatgatcgacatgaacgcagtacttggtggacgtgcaacagtcggtaaaaactgtcacgtaggtgcaggtgctgtacttgcaggtgttattgagccaccttctgcaaaaccagttatcgttgaagatgatgtagtaatcggtgcaaatgtagttgttttagagggtgttacagtaggtaaaggtgcagttgtagcagcgggagctgttgtaacagaagatgtgcctccatacacagttgttgcaggtactccagcacgtgtaattaaagaaattgatgagaagacaaaagcaaaaacagaaattaaacaagagcttcgtcaattaaacccagagaaataa

SEQ ID NO: 15566 - protein, 240 aa, Bacillus cereus ATCC 14579
MKMMDANEIISFIQKSEKKTPVKVYIKGDLKEVTFPETVQAFVNKKSGVLFGEWSEIKTILDENNKHIVDYVVENDRRNSAIPMLDLKGIKARIEPGAIIRDHVEIGDNAVIMMNATINIGAVIGEGSMIDMNAVLGGRATVGKNCHVGAGAVLAGVIEPPSAKPVIVEDDVVIGANVVVLEGVTVGKGAVVAAGAVVTEDVPPYTVVAGTPARVIKEIDEKTKAKTEIKQELRQLNPEK

SEQ ID NO: 15567 - DNA, 561 bp, Bacillus cereus ATCC 14579
  CDS (1)..(561): transl_table=11
atgatgaaaacagaaaaggaaaagatgatactaggagaaatgtacataccggctgatccagttttagtacaagaaagagagcaagcacgtatattaacgagaaaattaaatgatacgccagaagagcaattgaaagagcgtagcgaaatcgtaaaagaattattcggaacgacaggagataatattcatcttgaatcttcttttagatgtgattacggctataacattcatgtcggtgaaaatttttacgcgaactttgactgtacgattttagacgtatgcccggtaacaatcggagtgaactgtatgttagctccaggtgttcacatttatacagcaacgcacccacttgatccggtagagcgtataagcggatcagaatacggaaaaccagttacaattggcgataacgtatggattggcggaagagcaattattaatccaggtgtaacaattggagacaatgcggtaatcgcatctggtgctgtcgtaacgaaagatgtgcctaataatgtagtagttggcgggaatcctgcaaagattataaaaaaactaaaataa

SEQ ID NO: 15568 - protein, 186 aa, Bacillus cereus ATCC 14579
MMKTEKEKMILGEMYIPADPVLVQEREQARILTRKLNDTPEEQLKERSEIVKELFGTTGDNIHLESSFRCDYGYNIHVGENFYANFDCTILDVCPVTIGVNCMLAPGVHIYTATHPLDPVERISGSEYGKPVTIGDNVWIGGRAIINPGVTIGDNAVIASGAVVTKDVPNNVVVGGNPAKIIKKLK

SEQ ID NO: 15569 - DNA, 666 bp, Bacillus anthracis str. Ames
  CDS (1)..(666): transl_table=11
atgtttaagaggcttcgggaagatattgaagtcgtttttgaacaggatccagcggcaagaagttatttcgaagtcattttgacttactctggattacatgcagtttgggcccatcgaattgcacatgctttttataaaaagaatttcttctttattgcacgttggatctcacaagttagtcgtttctttactggcattgagattcatccaggagcaacaattggtcgtcgttttttcattgaccatggaatgggggttgtaattggagaaacgtgcgaaattggtgataatgtaacgatctaccaaggagttacattaggtggtacaggtaaagaaaagggaaagaggcaccctacaattcaagataatgtattaattgcaacgggtgctaaagtactaggttctattacagttggagagaactctaaaattggagcaggttctgtcgtattaaaagaagtccctgcacattctacagttgtaggtatacctggccgagtcgttattcaaaatggagtaaagatcggtcaagaattaaatcattccgaccttccagacccaatttttgataaattaaaggtcatggaagtagaacttgataaattgaaaaaacaacttgaagtaaaggtagaaaggaaggataaaaatgactattcacatttataa

SEQ ID NO: 15570 - protein, 221 aa, Bacillus anthracis str. Ames
MFKRLREDIEVVFEQDPAARSYFEVILTYSGLHAVWAHRIAHAFYKKNFFFIARWISQVSRFFTGIEIHPGATIGRRFFIDHGMGVVIGETCEIGDNVTIYQGVTLGGTGKEKGKRHPTIQDNVLIATGAKVLGSITVGENSKIGAGSVVLKEVPAHSTVVGIPGRVVIQNGVKIGQELNHSDLPDPIFDKLKVMEVELDKLKKQLEVKVERKDKNDYSHL

SEQ ID NO: 15571 - DNA, 564 bp, Bacillus anthracis str. Ames
  CDS (1)..(564): transl_table=11
atgaaaacagaaaaagacaagatgttagcgggagaaatgtatattgcggatgacgaagaattagtagctgatagggtggaggcaaaacgtttaacacgcctttataacgaggcggtggagacaggagatgagagacgttttacgttattaaatcagcttttaggttcttcagctgatgggaaagcccaaattaatcctgattttcgttgtgattatggatacaatatccatgttggaaagagcttttttgcaaatttcaattgtgtgattttagacgtttgtgaagttcgaatcggtgatcattgtatgtttgcacctggtgttcacatttatactgctacgcatcctttacatccggtagagcggaattctggtaaagagtatgggaagcctgtaaagattggtaacaatgtttgggttggcgggggagctattattaaccctggtgtttcaattggagataacgctgtaattgcttcaggggcagttgtgacaaaagatgtacctaataatgtagtagttggtggtaatccagctaaagttattaaaacgatagaagaataa

SEQ ID NO: 15572 - protein, 187 aa, Bacillus anthracis str. Ames
MKTEKDKMLAGEMYIADDEELVADRVEAKRLTRLYNEAVETGDERRFTLLNQLLGSSADGKAQINPDFRCDYGYNIHVGKSFFANFNCVILDVCEVRIGDHCMFAPGVHIYTATHPLHPVERNSGKEYGKPVKIGNNVWVGGGAIINPGVSIGDNAVIASGAVVTKDVPNNVVVGGNPAKVIKTIEE

SEQ ID NO: 15573 - DNA, 723 bp, Bacillus anthracis str. Ames
  CDS (1)..(723): transl_table=11
atgaaaatgatggacgctaacgaaattatttcgtttattcaaaaaagtgaaaagaaaactcctgtaaaggtatacataaaaggggatttaaaagaagtaacattccctgaaacagtacaagcatttgtaaataaaaagtctggtgtattatttggagaatggtctgaaattaagacaattctagatgaaaatagcaaatacattgttgattacgttgttgaaaatgaccgtcgtaattctgcaattccaatgcttgatttaaaaggtattaaagctcgtattgagccaggtgcgattattcgtgaccacgttgaaatcggcgacaacgctgttattatgatgaatgcaacaattaacatcggtgctgtaattggtgaaggttctatgatcgacatgaacgcggtacttggtggacgtgcaactgttggtaagaactgtcacgtaggtgcaggtgcagtacttgcaggcgttattgagccaccttcagcaaaaccagttatcgttgaagacgatgttgtaattggtgctaacgtagttgtgttagagggagttacagtaggtaaaggtgcagttgtagcagcaggagctgttgtaacagaagatgtacctccatatacagttgttgcaggtactccagcacgtgtaattaaagaaattgatgagaagacaaaagcaaaaactgaaattaaacaagagcttcgtcaattaaacccagagaaataa

SEQ ID NO: 15574 - protein, 240 aa, Bacillus anthracis str. Ames
MKMMDANEIISFIQKSEKKTPVKVYIKGDLKEVTFPETVQAFVNKKSGVLFGEWSEIKTILDENSKYIVDYVVENDRRNSAIPMLDLKGIKARIEPGAIIRDHVEIGDNAVIMMNATINIGAVIGEGSMIDMNAVLGGRATVGKNCHVGAGAVLAGVIEPPSAKPVIVEDDVVIGANVVVLEGVTVGKGAVVAAGAVVTEDVPPYTVVAGTPARVIKEIDEKTKAKTEIKQELRQLNPEK

SEQ ID NO: 15575 - DNA, 618 bp, Helicobacter hepaticus ATCC 51449
  CDS (1)..(618): transl_table=11
atgaaaccaactttttcgcttcgtagcacacccacacctagcacaaatcgcgatattttcacgcgggatttgggtggggagcttatagatatgaatgacccagagtttgagaggattaaagagattattttagagacgattaggcttacaagtgagctaaatagcggacatcatagcgccgagcgcgtgcaggagctgttttcgcaaatcattggcaaagaggtggattgtagcacttggattatcccgcctttttatgtggattttggcaaaaatattaaggtgggcaaaaatttctttatgaatcaagcttgcacctttatggataggggcggcatcacaatcggtgatgatgtgtttatcgcacccaaagtctgcctcacaacgattaatcacgattttaatccctacaatcgccaagcgactttttgcaaacccattgtgataaaagatagggtatggatagggattaatgcaactatttgtccgggtgtaaccattgggcaaaactctgtgattgctgctggaagcgtggtaactaaagatgttcctccaaatgtgattgttggaggcaaccctgcaagggtgctaaaaagcattgaggggtatgagaaatag

SEQ ID NO: 15576 - protein, 205 aa, Helicobacter hepaticus ATCC 51449
MKPTFSLRSTPTPSTNRDIFTRDLGGELIDMNDPEFERIKEIILETIRLTSELNSGHHSAERVQELFSQIIGKEVDCSTWIIPPFYVDFGKNIKVGKNFFMNQACTFMDRGGITIGDDVFIAPKVCLTTINHDFNPYNRQATFCKPIVIKDRVWIGINATICPGVTIGQNSVIAAGSVVTKDVPPNVIVGGNPARVLKSIEGYEK

SEQ ID NO: 15577 - DNA, 555 bp, Rhodopirellula baltica SH 1
  CDS (1)..(555): transl_table=11
atggttaccgaacgagaaagaatgttggccggtgagttgtacgacgcgggagacgcggagttggtcgaggcgcggatcatcgctcgagagcgttgtcagcagatcaacgcgagcttgcctcgcgacgaagcgtttcggcgcgtgctgacgaggaaactattcgccagcggtggagactcggttcagttggagtcaccgtttcgatgcgactatgggacgaacattcacctcggccaaaacgtgtatttcaatttcgactgtgtggttttggatgtctgcgaagttcggatcggtgattttgtgttttttggacctggcgttcatgtctacacagcttcgcatcctttggatgcaggcccacggcggacgcaggaattcggcaaaccagtcacgatcggcagcgatgtttggatcggtggcaaagccgtgatctgcccgggcgtttcgatcgggcaacgcagcgtgattggcgctggaagcgtggttacaaaagacgttcccgatggagtggtggtggccggcaatcccgcgaaactgattcgccgaattgactga

SEQ ID NO: 15578 - protein, 184 aa, Rhodopirellula baltica SH 1
MVTERERMLAGELYDAGDAELVEARIIARERCQQINASLPRDEAFRRVLTRKLFASGGDSVQLESPFRCDYGTNIHLGQNVYFNFDCVVLDVCEVRIGDFVFFGPGVHVYTASHPLDAGPRRTQEFGKPVTIGSDVWIGGKAVICPGVSIGQRSVIGAGSVVTKDVPDGVVVAGNPAKLIRRID

SEQ ID NO: 15579 - DNA, 522 bp, Chromobacterium violaceum ATCC 12472
  CDS (1)..(522): transl_table=11
atgaaggtttttaatgcggccgagcctggtttgatcgaaagaaggcgcattgccagggatttgtgtcattcgataagcaccgcttcgagggggcgcgatgagctgtaccgggcgctgtttggaaaagttgggcaagggttcgaactgtggggcacggtattctgcgagtttggctggaatatcaaaataggaaatcaggtatttatcaacaccaatggcgtattcctggatgcatttgatatcgacataggcaatcacgtctttatcgggcccagtgtgggaatttatacctctaatcatgaccagaattcccagcgcaggcgggagtatgtggaatccggcgcgccagtggtgatagaagatgatgtctggataggcggcggtgccatcatcttgccgggagtcagtatagggaggggctcgattatcggagccggcgcggtggtggcccgctcggtgccggcattcagcaaggttttaggtgctcgttcccaggtttatcctcttgctatggaaggttga

SEQ ID NO: 15580 - protein, 173 aa, Chromobacterium violaceum ATCC 12472
MKVFNAAEPGLIERRRIARDLCHSISTASRGRDELYRALFGKVGQGFELWGTVFCEFGWNIKIGNQVFINTNGVFLDAFDIDIGNHVFIGPSVGIYTSNHDQNSQRRREYVESGAPVVIEDDVWIGGGAIILPGVSIGRGSIIGAGAVVARSVPAFSKVLGARSQVYPLAMEG

SEQ ID NO: 15581 - DNA, 561 bp, Gloeobacter violaceus PCC 7421
  CDS (1)..(561): transl_table=11
atggcgcgaagcgaaaaagaaaagatgctcgccggtgaactctatcgtgcgagcgatcccgaactggtggccctgcgggtgagcgcgcgcggactgctcgccctctacaacgccaccgaacccggaccaggggagcggcggcaacaattgctgcgcgagctgttgggcgccgtcggaacgatggtggaaatcgagccgccctttttctgcgactacggcagtcagatctatgccggggaaggattctacctgaataccggctgcgttatcctcgactgcgccccggtcactatcggcaccaatgtgctgtgcgctcctggggtgcatatctacaccgccacgcaccccaccgagcctgccctgcgccggtcgggccttgaattggccgccccggtaaccattggcgacaacgtctggctcgggggcaaggcaatcgtctgtccgggggtgacgatcggccagaacaccaccatcggcgcgggcagcgtcgtagtcaaaagtatccccgccaacgtcatcgccgccggcaatccgtgccgggtgctgcgccatctcgattga

SEQ ID NO: 15582 - protein, 186 aa, Gloeobacter violaceus PCC 7421
MARSEKEKMLAGELYRASDPELVALRVSARGLLALYNATEPGPGERRQQLLRELLGAVGTMVEIEPPFFCDYGSQIYAGEGFYLNTGCVILDCAPVTIGTNVLCAPGVHIYTATHPTEPALRRSGLELAAPVTIGDNVWLGGKAIVCPGVTIGQNTTIGAGSVVVKSIPANVIAAGNPCRVLRHLD

SEQ ID NO: 15583 - DNA, 771 bp, Vibrio vulnificus YJ016
  CDS (1)..(771): transl_table=11
atgttggtgaataaatcacaactcggagtcaaaccagatagcgagaaaaacacgaaaacctgtcgaggaagcgacttaaaatcttggctcaaacatcatcccaatcctcttatgcgaacgctttttcgcacactcaaacagatccgttgtgccaacttacccaccccacatttttacaatgccttgctctaccgtttgatggtgttgctccgccaatcaagtgactatgtctatcgcaccttcattaccacgccagcattcaaaggcagggtcaaggcatgcggcaaacagctctatttgtatggcggattaccgctcatcactaacaatgttcgtatctccatgggtgatgactgtaacctttccggtcaagcaaccattacgggctgcagttctgtcaaagaacctcgattgaacatcggtaatcgtgtctcgattggctggcaaacgaccatcgcggtgggcgacctcatcacgattgaagacgacgtagcgatcgccggacgctgcatgttttttggttattcaggccaccccttagaccccaaacgtcgtgccgcgggtgaaggcgatgatcccagccagattcgcccaattaccctacaacgcggctgctggattggcagcaacgtgatgatcatggcgggcgtcaccgtcggggctggcagtgtgatcgccgcaggcagtgtggtgacacattccattcctgaaggtgtgatcgcaggcggcaatcccgcccacgtgattcgttcattgaacatacctcgttga

SEQ ID NO: 15584 - protein, 256 aa, Vibrio vulnificus YJ016
MLVNKSQLGVKPDSEKNTKTCRGSDLKSWLKHHPNPLMRTLFRTLKQIRCANLPTPHFYNALLYRLMVLLRQSSDYVYRTFITTPAFKGRVKACGKQLYLYGGLPLITNNVRISMGDDCNLSGQATITGCSSVKEPRLNIGNRVSIGWQTTIAVGDLITIEDDVAIAGRCMFFGYSGHPLDPKRRAAGEGDDPSQIRPITLQRGCWIGSNVMIMAGVTVGAGSVIAAGSVVTHSIPEGVIAGGNPAHVIRSLNIPR

SEQ ID NO: 15585 - DNA, 558 bp, Vibrio vulnificus YJ016
  CDS (1)..(558): transl_table=11
gtgtatccgatgactgaatttgaaaaaatgaattccgggcaaatctttgatggcgcggatgcggaaattgatgcgattcgcaatcgtgctgcggtgttattgaaagagatcaacgcagcaacggaaacagaacaacgcatcacactgcaaaaacagctctttgccagcatgggcaacagttatatccagccaccatttatgtgtgaatttggcaaaaccatctctattggtgaggaaacgttcatcaacatgaatgttgtgatgttggatggggcgcacattacgatcggcagtcacgtgttaattggcccgagttgccagttttataccgcttctcattcccttgattaccgaagccgacgccagtgggaaaccttctgcaaaccgattgttgtagaagatgatgtttggattggtggaaattgcgttatcaatcaaggggtcacgattggagctcgttccgtcatcgctgcaaattcggtcgtcaatcatgatgtcccgccagactgcttgtatgggggcaccccagcgaaactgattcgacggttagacaagtag

SEQ ID NO: 15586 - protein, 185 aa, Vibrio vulnificus YJ016
MYPMTEFEKMNSGQIFDGADAEIDAIRNRAAVLLKEINAATETEQRITLQKQLFASMGNSYIQPPFMCEFGKTISIGEETFINMNVVMLDGAHITIGSHVLIGPSCQFYTASHSLDYRSRRQWETFCKPIVVEDDVWIGGNCVINQGVTIGARSVIAANSVVNHDVPPDCLYGGTPAKLIRRLDK

SEQ ID NO: 15587 - DNA, 657 bp, Vibrio vulnificus YJ016
  CDS (1)..(657): transl_table=11
gtggcggtgtggtcatcaaggcaaaacggttttgtggagagaaaaatgagtgtgagagagcgaatgcatcaacaaaagatttacttttgtgatgatgagagtgtggcgttagagcagcaagcttgtctggaaattctctatgattttaaccaaaccagaccctcagaaatggaaaaacgcacggcgattttgcgcgatctcttggctgaagtcggtgagaactgctacatcgagccaccactaagagccaattggggtaagcatacacacttaggtaataatgtttatgccaatttcaatttaaccttggtggatgatacacacatctacatcggtaactcggtgatgattgcacccaatgtcaccatcgcaacggcgggacatccgattgatcctgaactgcgacgtaaagtggcgcaattcaacattcctgtgcacattaaagataacgtttggattggggcgaacagtgttgtgttaccaggcgtaacgataggcgaaaacagcgtgattggtgccggcagtgtggtgacgaaagacatccccgccaatgtcgtggctgttggtaatccttgccgagtgttgcggccgattggagagcatgacaaacgttacttctatcgcgataacgttattgacgatttaccacaagcctaa

SEQ ID NO: 15588 - protein, 218 aa, Vibrio vulnificus YJ016
MAVWSSRQNGFVERKMSVRERMHQQKIYFCDDESVALEQQACLEILYDFNQTRPSEMEKRTAILRDLLAEVGENCYIEPPLRANWGKHTHLGNNVYANFNLTLVDDTHIYIGNSVMIAPNVTIATAGHPIDPELRRKVAQFNIPVHIKDNVWIGANSVVLPGVTIGENSVIGAGSVVTKDIPANVVAVGNPCRVLRPIGEHDKRYFYRDNVIDDLPQA

SEQ ID NO: 15589 - DNA, 621 bp, Vibrio vulnificus YJ016
  CDS (1)..(621): transl_table=11
atgtgcgatagtgcgcagcagaaaatgcccgttgtgaacgttggaagacgcgaaatgaacagaactgaaaagcaaaaaatgttggctggagaaccttacaatgcgtgggatgaagagctgtatgggctgcgaattgagtgtcgtaaaaccttgcagcgattgaacaatgcgatccctgatagcaccgaatggcgagaagccatcgaccagttgatcccccaatcgcaaggtgcctatctcgaaccgccgtttcgttgtgactacggcgcaaacatcactttaggcaaaaacttctacgccaactttaactgtgtggtgctggatgttgctcctgtggtgattggcgataatgtgctgtttgcccccaacgtgcaaatatacacggcgggtcatccgctggacgtaaaaagccgcgtggaagagggtattgagtttggcacaccgattaccattggcaacaatgtgtggctcggtggcggcgtgattgtgtgcccaggcgtgacgattggtgataacagcgtcatcggcgcaggctcggtggtcaccaaagatgtgcctgccaatgtggttgcggcgggcaatccgtgtcgtgtaattcggacgttggacgccacgatttaa

SEQ ID NO: 15590 - protein, 206 aa, Vibrio vulnificus YJ016
MCDSAQQKMPVVNVGRREMNRTEKQKMLAGEPYNAWDEELYGLRIECRKTLQRLNNAIPDSTEWREAIDQLIPQSQGAYLEPPFRCDYGANITLGKNFYANFNCVVLDVAPVVIGDNVLFAPNVQIYTAGHPLDVKSRVEEGIEFGTPITIGNNVWLGGGVIVCPGVTIGDNSVIGAGSVVTKDVPANVVAAGNPCRVIRTLDATI

SEQ ID NO: 15591 - DNA, 570 bp, Corynebacterium diphtheriae NCTC 13129
  CDS (1)..(570): transl_table=11
atggccgaccagcgcgcccaacgatggcatatcccggtatctccggagatcacgcaggctatggctcgtaccgccgagttggttttcgattacaacgccactcacccagcgcataccgaggagcttagtcgcctccgccggttgatcctcagccccgccagtaaggactgcacgatcagacagcctctgaccattgaatatggtgttaacacgaccattggcaaagacacttttatcaattacggcgtgaccatcctcgacaccgcagaggtcaccattggcagccaggttcttatcggaccgaactgccagctcatcacggtcacccaccccgttgacaacgccgatatgcgcaccgccggctgggaaattgcccacccgattgtcgtcggcaagcaggcatggctaggggctggcgtgatcgttttacctggggtcaccatcggcgagcgtgctgttatcggcgctggcagtgtggtcacccacgatattcccgacgacaccatcgcctacggcaaccccgcccgagttatacgcaccaccaatcctcacaccacttatgagctttaa

SEQ ID NO: 15592 - protein, 189 aa, Corynebacterium diphtheriae NCTC 13129
MADQRAQRWHIPVSPEITQAMARTAELVFDYNATHPAHTEELSRLRRLILSPASKDCTIRQPLTIEYGVNTTIGKDTFINYGVTILDTAEVTIGSQVLIGPNCQLITVTHPVDNADMRTAGWEIAHPIVVGKQAWLGAGVIVLPGVTIGERAVIGAGSVVTHDIPDDTIAYGNPARVIRTTNPHTTYEL

SEQ ID NO: 15593 - DNA, 573 bp, Rhodopseudomonas palustris CGA009
  CDS (1)..(573): transl_table=11
atgaaccggaccgagaaggaaaagatgctggcgggcgagctgtatcgccccggcagcccggagctcgccgccgacgaggccgccaacaaggcctggatcgcccgctacaatgcttccggtgcgcagccggtggcggagcggcatgcgctgctgtcggagcatttcggccatgtcggcaagggcgcggtggtgcggccgccgttcttctgcgactgcggctacaacatcttcgtcggcgacaacgtcttcctcaatttcaactgcgtgatcctggacatcatgccggtccggatcggcgaccgcacccagatcggcccggcggtgcagatctatgcggccgaccacccgcgcgacgccgccacccgccgcgatggcctggaattcggccggccggtgacgatcggcaacgacgtctggatcggcggcggtgccatcatcctgcccggcatcagcatcggcgacggcgccgtgattggggccggcagcgtggtgacccgcgacgtcgccccccatgccatcgtcggcggcaacccggccaagccgctggggaagggcggccagacgcaaggatga

SEQ ID NO: 15594 - protein, 190 aa, Rhodopseudomonas palustris CGA009
MNRTEKEKMLAGELYRPGSPELAADEAANKAWIARYNASGAQPVAERHALLSEHFGHVGKGAVVRPPFFCDCGYNIFVGDNVFLNFNCVILDIMPVRIGDRTQIGPAVQIYAADHPRDAATRRDGLEFGRPVTIGNDVWIGGGAIILPGISIGDGAVIGAGSVVTRDVAPHAIVGGNPAKPLGKGGQTQG

SEQ ID NO: 15595 - DNA, 615 bp, Lactobacillus johnsonii NCC 533
  CDS (1)..(615): transl_table=11
atggaagaaaatactaaaaatatgctagcaggattaccttatcgtcccgacacagaagagttaagagctatttcgacaaaggcgcatcgcttaagccgtgactataatcaaacagcagatgaagataaggaagtaagaaaagcaattatcgataatttatttccagatcatggagaaggagtttacctgcaaggaccaattgaagtagattacggtaaatttacaaaattaggtaaaaatttttatgctaactttaatttgactattctagatacttgtccagttactattggcgacaatgtaatgtgtggtcctaatacttcattagtaacgccgctgcatcccttattgccagagcaaagaaatgcgcgcttgcaagcagatgggaagatagcagatattgaatatggcgcaccaattacaattggggataattgctggttagctagtaatgtaactgtttgtccaggagtaacgattggaaacaactgcgttattggagctggcagcgtagttacaaaagatattccagacaactctttagtttttggggttccaggccgagtagttagaaaaatcactgagaaagaccgcctagatacttatccatattaa

SEQ ID NO: 15596 - protein, 204 aa, Lactobacillus johnsonii NCC 533
MEENTKNMLAGLPYRPDTEELRAISTKAHRLSRDYNQTADEDKEVRKAIIDNLFPDHGEGVYLQGPIEVDYGKFTKLGKNFYANFNLTILDTCPVTIGDNVMCGPNTSLVTPLHPLLPEQRNARLQADGKIADIEYGAPITIGDNCWLASNVTVCPGVTIGNNCVIGAGSVVTKDIPDNSLVFGVPGRVVRKITEKDRLDTYPY

SEQ ID NO: 15597 - DNA, 564 bp, Bacillus cereus ATCC 10987
  CDS (1)..(564): transl_table=11
atgaaaacagaaaaagaaaagatgttagcgggagaaatgtatattgcagatgacgaagaattagtagctgatagggtggaggcaaaacgtttaacacgtctttataacgaggcgatggagacaggggatgaacaacgttttacattattaaatcagcttttaggttcttcagctgatgggaaagctcaaattaatcctgattttcgttgtgattacggctacaatattcatgttggaaagagctttttcgcaaatttcaattgtgtgattttggatgtttgtgaagtgcgaatcggtgatcattgtatgtttgcacctggggttcacatttacactgctacgcatcctttacacccgatagagcggaattctggcaaagaatatgggaagcctgtaaagattggtaacaatgtttgggtcggcgggggcgctattattaaccctggtgtttcaattggagacaacgctgtaattgcttcaggagcagttgtgacaaaagatgtacctaataatgtagttgttggtggtaacccagccaaggttattaaaacgatagacttatag

SEQ ID NO: 15598 - protein, 187 aa, Bacillus cereus ATCC 10987
MKTEKEKMLAGEMYIADDEELVADRVEAKRLTRLYNEAMETGDEQRFTLLNQLLGSSADGKAQINPDFRCDYGYNIHVGKSFFANFNCVILDVCEVRIGDHCMFAPGVHIYTATHPLHPIERNSGKEYGKPVKIGNNVWVGGGAIINPGVSIGDNAVIASGAVVTKDVPNNVVVGGNPAKVIKTIDL

SEQ ID NO: 15599 - DNA, 2154 bp, Neurospora crassa
  CDS (1)..(2154)
atgacgactttcacagctctaaatgggtcatcgcccaggccaactgagatctccaatggtgctcgggagcttgaacgcggaaacggacagtctgctggtccagacccaagatccgctagtgatgttgcagtcagccagagagaacgggaccgggaaaactggggcacttcaacccgtgaaaggcatccgtatcctgtgactaattaccacgatgctgaacctgccccaaaacggatgcggacagattccgattctcactctcccaggcgggagcacaggccttcacccatttccactgagcggcccgacaagttcgaaagaacagagagaactcccattgaacggaccgaaaggttggaaagaacggaaagaatggagagagtggagaggcctgaagtaacagagaaggcggagcaatatgaacccccacggcctccgtccaacccccatgaccgctatccgtctccccaaaaggaaggatatcgtggttacgaaaatcgtgagagcgatgaccgatggcgctctcagcaggccagaagtgagaggaacgcaagctacgatgcagcttactcggccgggccagtatccggccagtccgaggagccgatgggcgaacatatgcgcagagcgaccagtcaagcagacagcggcgactacgaaaatcagagccccgatggtgacgaaaaccgctactcggatcagtacacgcctgagcagcgcagagatggcaccgttcagtccgaccccaagaagcggaaacgcaatttcagtaatcggacgaaaaccggttgcctgacgtgcaggaggcgcaaaaagaagtgtgatgagacaaagcctcagtgtaccaactgcatcaagggttcattccaatgtgctggttacccaccacagaggggtaactggcagaagcctgagagcaagccaacccaagtcaacatcgagtccaaggatcccaactatgtccctcttggagcatatgggatgccgcagcaaccgatccctccttacaccagcaacactgctccgatattgagccaaccaaagcagcgcgagcctttcccgatggcgcgtgggcagcaacccactctccgcatcacaccgcctcaaggacggcctcttcaaagcgacgacgaccggctcacggcatcaactcttcctagtgcatcggttattagcccagacaacaaactgtccgccctctcagcttatccttcaaacgtcttccccacgcccatcagtgcccggacgccccttagagagtatgcaagagtgcccccgctccacgatttgacgaggacagaccctgaccaccaaccaccgccgccaccaccgcctcctcaaagcgccatttccgcacatcctccatacaaccttcatggtagccgaacggacacgccaacatcagcggtccagcctctaatcacatctcagccaccttcaagtgccgtacaggcgactgcgcagctagcactatcccatgcgcagtcgcatactccgtccagcgctaccgtgccccccgtacgaagggagaaagacgagatgatcagtggacgagccttttatcccttcgacaaggagcttgtgctagaacgcgagagatgcaatgcagcttgttggagattcaacaactcgaccaatcctaacattggcgtatcacctgctgaacgcgcccgacttttcaaagagatcttgcacccacgcgaaggtgttcagttgacgcccaaccagctatcccccataggccgtattggtcatgttggtgataacgtttcggtcgaggccccgttcaactgtgactatgggtacaacatctccattggcaataacgtgtctatcggccggaactgcctgattaccgactcttgcgaggtacgcattgggcacaatgtgattatcagcccgaatgtcaacatctacacaaacagctgctacacagactggaggcgccgtgatgggcacaggggtgcgcagtttggcaagccagtcatcattgacgacgatgtctggattgcggcaaacgtggtcatcttgcccggtgtaaagatcggaagggggtcaacggttggggctgggtcaattgtttcaagggacgttgctccctacagcatctacattggacggaaagcaaacatgcaccgcggcattccaacttga

SEQ ID NO: 15600 - protein, 717 aa, Neurospora crassa
MTTFTALNGSSPRPTEISNGARELERGNGQSAGPDPRSASDVAVSQRERDRENWGTSTRERHPYPVTNYHDAEPAPKRMRTDSDSHSPRREHRPSPISTERPDKFERTERTPIERTERLERTERMERVERPEVTEKAEQYEPPRPPSNPHDRYPSPQKEGYRGYENRESDDRWRSQQARSERNASYDAAYSAGPVSGQSEEPMGEHMRRATSQADSGDYENQSPDGDENRYSDQYTPEQRRDGTVQSDPKKRKRNFSNRTKTGCLTCRRRKKKCDETKPQCTNCIKGSFQCAGYPPQRGNWQKPESKPTQVNIESKDPNYVPLGAYGMPQQPIPPYTSNTAPILSQPKQREPFPMARGQQPTLRITPPQGRPLQSDDDRLTASTLPSASVISPDNKLSALSAYPSNVFPTPISARTPLREYARVPPLHDLTRTDPDHQPPPPPPPPQSAISAHPPYNLHGSRTDTPTSAVQPLITSQPPSSAVQATAQLALSHAQSHTPSSATVPPVRREKDEMISGRAFYPFDKELVLERERCNAACWRFNNSTNPNIGVSPAERARLFKEILHPREGVQLTPNQLSPIGRIGHVGDNVSVEAPFNCDYGYNISIGNNVSIGRNCLITDSCEVRIGHNVIISPNVNIYTNSCYTDWRRRDGHRGAQFGKPVIIDDDVWIAANVVILPGVKIGRGSTVGAGSIVSRDVAPYSIYIGRKANMHRGIPT

SEQ ID NO: 15601 - DNA, 660 bp, Magnaporthe grisea 70-15
  CDS (1)..(660)
atggcttcaaaaaccgaaaaagaccaggaacaaatcgccatagccaaggggttggaaaacatcccctggtgcgatgactacgaaaagatgatctctggtgtcttgtacgacgctttcgtaccagagctggtgcagggtcgctttagggcccgacaatttatgcacaaatacaaccactacttccccgaagacgccactcccgaatcgctgcaaaaaggccgtgaggagcttctacggggcatcatgggcaaggtcggcaaggacgccttcatcgagcccccggtcaacattgactatggctgcaacataatcatcggcgacaccttttactcgaacttcaacctcgtaattctagactgcggcatcgtcaacattggcaaccgagtcatgttcggacccttcgtctccatcttcaccgccacccacgagaccgaggtacagtcgcgccgggatgggattgagtatgccctccctgtcacgattggggacgactgctggatcggcgggaacgtcaccatcttgcccggtgtgacaatcggcaagggcaccaccatcggctctggaagcgtcgtgaccaagtcaatccctgagttctctgttgccgtaggatcgcctgcaaaggttatcaagaaggttcagcctgtgcctgacctcccatag

SEQ ID NO: 15602 - protein, 219 aa, Magnaporthe grisea 70-15
MASKTEKDQEQIAIAKGLENIPWCDDYEKMISGVLYDAFVPELVQGRFRARQFMHKYNHYFPEDATPESLQKGREELLRGIMGKVGKDAFIEPPVNIDYGCNIIIGDTFYSNFNLVILDCGIVNIGNRVMFGPFVSIFTATHETEVQSRRDGIEYALPVTIGDDCWIGGNVTILPGVTIGKGTTIGSGSVVTKSIPEFSVAVGSPAKVIKKVQPVPDLP

SEQ ID NO: 15603 - DNA, 699 bp, Gibberella zeae PH-1
  CDS (1)..(699)
atggccaagcaacaaaaagacaccgagatcatcgagatcgcaaagaccctcaaagacacaccctggtgcgaagagtatgagaaaatgatatctggcatgctttacaaccctcttcaccccaaactgctggaaggtcgtcacagagctcgcagtctagcctacaagttcaacaatcttgatcccaacaccggatcatacctagaagttgaaaagaagaggaccgagatgcttagcgagatgctcggaaaggttgggagcggcaccttcattgaggcaccattcatgccagactatggaagcaatgtctctatcggagagaactgcttcatgaactttggcttgacaattctagataccagcctcgtcatcattggtgatcgcgtacaaatgggccccaacgtaaacatttatacagcaggccatgagacaagtgttctctcaaggatcaagtttgttgagttcggacatcccatccgcatcgaagacgactgctggattggaggaaacgtcgtcattctgcctggtgtgacgattggaaagggttgcacagttggtgcaggtgcagtggtcacaaagagtatacctccttactcaatcgccctgggtgctcctgcaaaggttgtcaagaagatacagagtgtcgaagacgagatggcagatcccaacaaccctttccgaaatatgcccgatcgggagtga

SEQ ID NO: 15604 - protein, 232 aa, Gibberella zeae PH-1
MAKQQKDTEIIEIAKTLKDTPWCEEYEKMISGMLYNPLHPKLLEGRHRARSLAYKFNNLDPNTGSYLEVEKKRTEMLSEMLGKVGSGTFIEAPFMPDYGSNVSIGENCFMNFGLTILDTSLVIIGDRVQMGPNVNIYTAGHETSVLSRIKFVEFGHPIRIEDDCWIGGNVVILPGVTIGKGCTVGAGAVVTKSIPPYSIALGAPAKVVKKIQSVEDEMADPNNPFRNMPDRE

SEQ ID NO: 15605 - DNA, 699 bp, Gibberella zeae PH-1
  CDS (1)..(699)
atggcggcccaagagaagaacttggtcgagttagagaaggcttcgaagctggccaatgttccccactgtgaacaatacgagaggatgatctcgggcatgctttacgactcactcatcccaaaacttaccaacgctcgtcttgctgctcgaaaagctatgaatgagtacaacacatggttccccacaggcgacgacttcaacattgagaccatcacgaaaagacgagccgagatgctcaagtcgtttctcggtcatgtagcggacgacgaagtttttatcgagcctccattcagagtcgactacggacccaacatgtctgtcggcaagagattttacgccaactttaatctgacagtcttggactctgctatcctaacaatcggcgacagagtcatgattggacctaatgttatgatttcaaccgcaactcacgagaccgaggttagcagtcgaagagccaatatcgaatatgcttatccgattacgattggcgatgattgctggattggaggcggtgttaccatcttgccaggtgtcacaattggaaatggatgtactattggggcaggttctattgttactagggatgttcctgcgtggagtgttgctgtcggatcacctgcgagggttgttagaaaagttcaagaactgggcgactttgaggaagatgtcaagcaaaacgggaccactagcgcatag

SEQ ID NO: 15606 - protein, 232 aa, Gibberella zeae PH-1
MAAQEKNLVELEKASKLANVPHCEQYERMISGMLYDSLIPKLTNARLAARKAMNEYNTWFPTGDDFNIETITKRRAEMLKSFLGHVADDEVFIEPPFRVDYGPNMSVGKRFYANFNLTVLDSAILTIGDRVMIGPNVMISTATHETEVSSRRANIEYAYPITIGDDCWIGGGVTILPGVTIGNGCTIGAGSIVTRDVPAWSVAVGSPARVVRKVQELGDFEEDVKQNGTTSA

SEQ ID NO: 15607 - DNA, 690 bp, Ustilago maydis 521
  CDS (1)..(690)
atgtcaggcacgtccaagctgttccaagacattgaccgtcaatacggtgataaggtggccacgatgagcgaggaagccaagatgctcgtcggactaccctatctcgccaacacagagaatctcatccgtgcgcgtgtcagagcacgtcgtcttcagaccgagtacaacaagacgcaacccacctcggcgctggacgatcagaccaaccacttcaagcacggccagacggttatgtcggaagaccgaaagcgtctgctctcggaactgcttcaagtaccgctctcgcaggtggccaatgtggaaatcgaaccgcctctgtgggtcgactatggcaccaacatcaagccggaaggcgcattctacgcaaactacaacaccacaatcttggactgttccgaggtgaggctgggcgacggtgtgctgttcggacccaatgtcagtatttactgtggaacccactcagtatcggtcaaggaaaggaaggagggcttggaaagaagtttgcccgtcagcattggtaaggacacctgggtaggcggtggcactatcatcatggctggtgtgaccatcggcaggggctgcacaattggcgccggaagcgtagttaccaaaaacatcccggattggagcgtcgccgcgggtacgccatgcaaagttatgaggacactcacccaagacgagcgagcatga

SEQ ID NO: 15608 - protein, 229 aa, Ustilago maydis 521
MSGTSKLFQDIDRQYGDKVATMSEEAKMLVGLPYLANTENLIRARVRARRLQTEYNKTQPTSALDDQTNHFKHGQTVMSEDRKRLLSELLQVPLSQVANVEIEPPLWVDYGTNIKPEGAFYANYNTTILDCSEVRLGDGVLFGPNVSIYCGTHSVSVKERKEGLERSLPVSIGKDTWVGGGTIIMAGVTIGRGCTIGAGSVVTKNIPDWSVAAGTPCKVMRTLTQDERA

SEQ ID NO: 15609 - DNA, 702 bp, Aspergillus nidulans FGSC A4
  CDS (1)..(702)
atggccgccccagcgaaaaggccggagattatcgagattgcacgcgggctggaccacatccccatgtgtgaggattacgaaaagatgatttcgggaatgatgtacaatcccctgcttcccactcttgccgcagcacggcaccgctgccggggcgtggcaagtgattacaacaatctcgacacaaaggccgtctcctgggaggagattggggaacgccggttcgagttgttaaagaatgttgttgggcgggttggagaaggcacctttgtcgagcctccattttggccagactatgggtgcaatattgtaattgggaaggaatgctttgtgaatttcaactttacggccctggacacgagcctaatcgtcattggcgaccgcgtgcagcttggtcctaacgtatccatttacacggcaggccacgacacatccatcctatcccgacgcaagttcgtcgagtttggtcaccccgtgtttattggagatgattgctggattgggggaaatgtgattattctgcctggcgtgaggattggagaagggtgcacaattggggcggggagtgtggttacgaaggatatcccgccgttttcggttgcagtgggtagcccttgtaaggccataaagaccattcaaagtgcggaggaggagttgaacgatcccaagaatccgtatagggatttgccagagaagtcggggtag

SEQ ID NO: 15610 - protein, 233 aa, Aspergillus nidulans FGSC A4
MAAPAKRPEIIEIARGLDHIPMCEDYEKMISGMMYNPLLPTLAAARHRCRGVASDYNNLDTKAVSWEEIGERRFELLKNVVGRVGEGTFVEPPFWPDYGCNIVIGKECFVNFNFTALDTSLIVIGDRVQLGPNVSIYTAGHDTSILSRRKFVEFGHPVFIGDDCWIGGNVIILPGVRIGEGCTIGAGSVVTKDIPPFSVAVGSPCKAIKTIQSAEEELNDPKNPYRDLPEKSG

SEQ ID NO: 15611 - DNA, 618 bp, Aspergillus nidulans FGSC A4
  CDS (1)..(618)
atggccgcctctaaagaatggcagaagatgctcaagggcgagctatactgggcatgggacgccgacctgcaggctaatcgggatcgctgtagggaggcgtgcaagaggtttaatgaagccggccctgtctcccgacgacgtcgagcagcgctctggagagatataatcggcgacactcgcccacttccacctgtcaaacaggacccagcagcagacgagaagcaattcgacgagacagaccccattgttgatcctccattctccgtagaccacgggctcaatctcaaagtcggaaagggcaccttcatcaatttcgatacgacaattctcgatacatgcctcgttacaattggagagcgcgtactttttggcccgcatgttcgcatatacggggccacgcacccgatcgatccggctgtgcgtcggggcctagaggggcctgaggctggaaaagaggtgcatatcgaggatgatgtgtggattggaggcagtgtgattgtacttgccggggatgtcccacccttccatttcgttgccggaaacccggcgagggttatccgcaagattgagacgagtatggatccagtacaagctacggagggttctgagacggtttag

SEQ ID NO: 15612 - protein, 205 aa, Aspergillus nidulans FGSC A4
MAASKEWQKMLKGELYWAWDADLQANRDRCREACKRFNEAGPVSRRRRAALWRDIIGDTRPLPPVKQDPAADEKQFDETDPIVDPPFSVDHGLNLKVGKGTFINFDTTILDTCLVTIGERVLFGPHVRIYGATHPIDPAVRRGLEGPEAGKEVHIEDDVWIGGSVIVLAGDVPPFHFVAGNPARVIRKIETSMDPVQATEGSETV

SEQ ID NO: 15613 - DNA, 573 bp, Candida glabrata CBS138
  CDS (1)..(573)
atgaacactcaggactttattaaccaacttaacactggagaaccagtcttcgcaggcactgaaacttacaagttcatgcatggtgtgagccaggatgctttgaagattaccatggagatgaataacaagtaccacaccccggaagaactacttgagttgttttcgcaattgataggtaaacaagtggatcctactttttgtcttttccctccattctatactgactgtggtaaaaacattactgttggaaagagggttttcatcaactctggctgtagattccaggaccaaggtggtgtaaccattggtgatgattgcttaattggtcacaatgctgtgctggcaactttaaatcatggaatgagtcccgctgaccgtaagaacctttatccagctccaattagaataggtaataatgtgtggctcggtgccaacgtaactgtgctgcccggtgtcacaattggtgataatgcagttgttgcagcaggcgctgtggttactaaagatgtacctgaaaacatgattgttgctggtgtacctgcaaaaatactaaaatcgattcatgacaattaa

SEQ ID NO: 15614 - protein, 190 aa, Candida glabrata CBS138
MNTQDFINQLNTGEPVFAGTETYKFMHGVSQDALKITMEMNNKYHTPEELLELFSQLIGKQVDPTFCLFPPFYTDCGKNITVGKRVFINSGCRFQDQGGVTIGDDCLIGHNAVLATLNHGMSPADRKNLYPAPIRIGNNVWLGANVTVLPGVTIGDNAVVAAGAVVTKDVPENMIVAGVPAKILKSIHDN

SEQ ID NO: 15615 - DNA, 570 bp, Kluyveromyces lactis NRRL Y-1140
  CDS (1)..(570)
atgacaaggagcgaaaaagagaagatgcttataggtgagccatacttatgtatggatcctgaactcgtagaagaaagactcaaagcacgtcaattggtttacgatttcaaccagtccaaaccagaagatgaagagcttagaaaacggattctagatcagttattgggaaagcactacaacgcctttattgaaccaaactttcgttgtgattatggatctaacatcactgtcggaaagaacttctacgccaatttcgattgcattatgttagacgtttgtaaaattgaaattggtgatgatgttctgctgggacctggtgtacatatatacacagcgtcacatgctctggatcctattgaacgctcgaaaggcgtggagtttggtatcccagttaaaattggaaatagagtctggattggtggaaacgtgacaatcttgcctggtgttacaattggtgacaatgctgttattggatctggaagtgtgatcactaaagacgttgatgctaatgtcgttgtggcaggtaaccctgcaaaatttatcaaacacatcgaattgaacaagaaataa

SEQ ID NO: 15616 - protein, 189 aa, Kluyveromyces lactis NRRL Y-1140
MTRSEKEKMLIGEPYLCMDPELVEERLKARQLVYDFNQSKPEDEELRKRILDQLLGKHYNAFIEPNFRCDYGSNITVGKNFYANFDCIMLDVCKIEIGDDVLLGPGVHIYTASHALDPIERSKGVEFGIPVKIGNRVWIGGNVTILPGVTIGDNAVIGSGSVITKDVDANVVVAGNPAKFIKHIELNKK

SEQ ID NO: 15617 - DNA, 693 bp, Debaryomyces hansenii CBS767
  CDS (1)..(693)
atgactaaagataccttgtttaagaaagcagcaatatctgctgaaattatgaaaaagtcactcgaaggcaacaaagaatacgaaaaaatgctagcaggagagacgtacaattccttcgacaaagatttgatattggcccgtacgatcacaagtgaaattgcaagtgaatatgctgatattaagttgaccgatcatgattatgacattgcgaaacatcaaaaatcaagggccgattatttgtccaagtatttgttctttaaaaatgtgcctgacatttacattgaaccgccattttttgttgattttggctgcaatataaactttggtgtcaatttttatgccaacttcaacgcaacgttccttgattgtgcaccaataacatttggtgacaatgttcttttgggaactaacgtaacgttcactactgctggtcatgcgaccgatcctaaagagagaatggatggggttgaatttgcctatcccattaatatcggtagtaatgtgtggttcggtgcaaattcgattgtattgccaggtgttactattggggacggtgtggtggttggtgctggcagtgtggtaactaaagacattactagtaactgtgtcgtcgttgggtcacctgcgagagtgattaaacacttgaagctgagagaagaaagagaaattgtaattaaagaggtcgatacttag

SEQ ID NO: 15618 - protein, 230 aa, Debaryomyces hansenii CBS767
MTKDTLFKKAAISAEIMKKSLEGNKEYEKMLAGETYNSFDKDLILARTITSEIASEYADIKLTDHDYDIAKHQKSRADYLSKYLFFKNVPDIYIEPPFFVDFGCNINFGVNFYANFNATFLDCAPITFGDNVLLGTNVTFTTAGHATDPKERMDGVEFAYPINIGSNVWFGANSIVLPGVTIGDGVVVGAGSVVTKDITSNCVVVGSPARVIKHLKLREEREIVIKEVDT

SEQ ID NO: 15619 - DNA, 690 bp, Debaryomyces hansenii CBS767
  CDS (1)..(690)
atgagcgaggaatctataaagcaagaagttgtagactatgcatataaaaacttgagaggtattccaaaagggaataaagagtacgagaaaatgattctgcagctttcctacaattgctttgaccatgaattattaatgtcaagaaatttagcacacgaaagagctattgattatgctgacattagaatgaaggactatgactttgatccagaaaaacactataaagcaagagaagagtacttaagaactatatttggtaagcttggagataagagttttattgaagctccattttttgtcgattacggattcaatgtaagtgccggaaagaatttttattgtaatttcaattgtacttttcttgattgctgtttgattgtgtttggggacaattgcatgtgtggccccaatgttacgttctgcacacccacccatgcaatagatcctgaaagaagattagcaggtgaggaatcagctggtccaataactgttggtgacaatgtgtggttcggcgcaaatgccgttgttttgcaagatatcacaattggggataacagtattattggggcaggtgcagtggttaccaaagatgttcctgccaacacagttgttgtcggatctccagctagagttgtaaagcatcttactctggaacaagacaaaatagagtcagccaatcatttgacttga

SEQ ID NO: 15620 - protein, 229 aa, Debaryomyces hansenii CBS767
MSEESIKQEVVDYAYKNLRGIPKGNKEYEKMILQLSYNCFDHELLMSRNLAHERAIDYADIRMKDYDFDPEKHYKAREEYLRTIFGKLGDKSFIEAPFFVDYGFNVSAGKNFYCNFNCTFLDCCLIVFGDNCMCGPNVTFCTPTHAIDPERRLAGEESAGPITVGDNVWFGANAVVLQDITIGDNSIIGAGAVVTKDVPANTVVVGSPARVVKHLTLEQDKIESANHLT

SEQ ID NO: 15621 - DNA, 666 bp, Yarrowia lipolytica CLIB99
  CDS (1)..(666)
atgcctctgtcgcggaaattcgagctcgatgcagagcagattgcgctctccaagaaactcaacaatgtgctgcacggcgacgagtacgacaagatgatctcaaccatgggataccaggactcgggacccgaactgatccagggacgccacaggatccgaatggcccaaaagaagtacaacgactacttcccggagggcgctacgcccgatgagctggctgaggcgcgaacagccatgctggaaaagatgctgggtcgagtcggaaagggagcctacatcgagcccccggtgtttttcgactacggatacaacatgtctgtgggcgagcggttctactccaactacaactgcacgtttctggactgcgctctcatcaccattggcgaccgtgtgctgctgggacccaacgtcaatctcatcaccgccacccacgacgtggacgtgcagtcaagacgagatcatgtggagtacgcggcgcctattaccgttggagacgactgttggctcggatcgggggtccaggtcatgcccggcgtcaacattggcaagggatgcaccattggagccaactcggtggtcaccaaggacattcctccgtactccgtggcggtcggagctccggcccgagtgatcaagaccctggaggatcctgacgcggaaaagtga

SEQ ID NO: 15622 - protein, 221 aa, Yarrowia lipolytica CLIB99
MPLSRKFELDAEQIALSKKLNNVLHGDEYDKMISTMGYQDSGPELIQGRHRIRMAQKKYNDYFPEGATPDELAEARTAMLEKMLGRVGKGAYIEPPVFFDYGYNMSVGERFYSNYNCTFLDCALITIGDRVLLGPNVNLITATHDVDVQSRRDHVEYAAPITVGDDCWLGSGVQVMPGVNIGKGCTIGANSVVTKDIPPYSVAVGAPARVIKTLEDPDAEK

SEQ ID NO: 15623 - DNA, 840 bp, Yarrowia lipolytica CLIB99
  CDS (1)..(840)
atgaatcaatgtgtatattttcttttgtcgtctgcgtatgtacagtgtacacccattcggtgtatgatctgcgcaacttctccgtattatgcatcatcaattcagagttcacgcatcccggtatctcgtgatttcatacaaccacgagtacagtaccggtatttgtacttgtgcaacatgcccagtggacggaaatttgagctcaacgaggcagaaatagcaaaatcgaagaagctgaatcatgtgccccacaatgagcattacgacaagatgatttcggccatgggataccatgagtacgagccgcagctagtccaggctagacacaacatccacgtgacacaaaagaaatacaacgactactttccagaggatattactcctgagcaattgcgcaatgacagagctgtcatgttggagaatatggtcggtcatgtcggcaaaaaccctcatattgaagcacccgtctactttgactatggttgcaacttttcatgtggccaagacttcgttgctagctacaactgtgtgtttctagactgcgctctcatcactatcggcgaccgtgtcgtgatgggacccggtgtgaaactcattacagcaacccacgacgtggaagtacaaactagaagggacgggatagagtatgcttctcccatcactatcggagacgactgttggctgggatcagcggttcaggtcatgccaggagtcactataggtaagggttgcactatatcagcagggtctgtggtcacgagagacattccccccttctctgtagcggtgggagctccagcaaaggtcaccaggactctgaagaatcctgattccagctga

SEQ ID NO: 15624 - protein, 279 aa, Yarrowia lipolytica CLIB99
MNQCVYFLLSSAYVQCTPIRCMICATSPYYASSIQSSRIPVSRDFIQPRVQYRYLYLCNMPSGRKFELNEAEIAKSKKLNHVPHNEHYDKMISAMGYHEYEPQLVQARHNIHVTQKKYNDYFPEDITPEQLRNDRAVMLENMVGHVGKNPHIEAPVYFDYGCNFSCGQDFVASYNCVFLDCALITIGDRVVMGPGVKLITATHDVEVQTRRDGIEYASPITIGDDCWLGSAVQVMPGVTIGKGCTISAGSVVTRDIPPFSVAVGAPAKVTRTLKNPDSS

SEQ ID NO: 15625 - DNA, 642 bp, Cryptococcus neoformans var. neoformans JEC21
  CDS (1)..(642)
atgccccctgctcctgctcctcaccttaccaacaagcttattccacctcccgaggaaggtgaagaccctacccagttgtctttgatgatctccgccaaaccctacctcgcccttgacaaataccttgaccgtcttcgcaatcgtggtgctatcaaactagatgaaattacgagaacacctgatcatgagaagcgcatggagctttggaaggagtttgccaacataggcgaaaatgtatcaatcactcaacgatttttctgcgaatatggcttcaatttgcattttgaaggcgagaacttcatcgcagctgattgtacattcgttgatgtctgcccaatttacatcggcaagagaacgatgattggtccgaacgtcagaatatacactcccgaccaccctatttctcccgaagctcgagccggtttgactggtgaggagtggggcaagattgtaaggattgaagaggactgttggatatgcggttctgctatcatcttgcctggcgttaccgtcggtaagggaagcactgttgccgctggagcagtagtcacgaaagacatccctcccaggagtctggccatgggtaatcctgctcgtgtcgtcaagaaaattctggaggacggtaccattgtcaaggcttaa

SEQ ID NO: 15626 - protein, 213 aa, Cryptococcus neoformans var. neoformans JEC21
MPPAPAPHLTNKLIPPPEEGEDPTQLSLMISAKPYLALDKYLDRLRNRGAIKLDEITRTPDHEKRMELWKEFANIGENVSITQRFFCEYGFNLHFEGENFIAADCTFVDVCPIYIGKRTMIGPNVRIYTPDHPISPEARAGLTGEEWGKIVRIEEDCWICGSAIILPGVTVGKGSTVAAGAVVTKDIPPRSLAMGNPARVVKKILEDGTIVKA

SEQ ID NO: 15627 - DNA, 546 bp, Dictyostelium discoideum
  CDS (1)..(546)
atggaaaaagagaaatttgaatactcaagagagggtgaaaagagtagtttaacaattgatacaggtaaattagttcaggaatttaattctttgccatatgaagatattcaaggtaaaaagaaaattatagaaaagttatttggttcagttggtgacgatgtatcaatagaacacaattttcattgtgatttaggattcaatattcatgttggtaatagattctatgcaggttataattttacagtattggatgtagcagaggttagaattggtgataattgtttaattgcaccaaatgttggcatttatacagcaggccactatatatcaccaccagaggaaaggcataaaacaggttatggtatacctataacaattggtaacaatgtttggataggtggtcattctgtaatattaccaggtgtaaccattggcgataactctatcattgccgctggttctgtcgttaataaagatgttccaaaaaatacaatcgttgctgggaatccagctagaaaaataaaagatataacttcaaaactttaa

SEQ ID NO: 15628 - protein, 181 aa, Dictyostelium discoideum
MEKEKFEYSREGEKSSLTIDTGKLVQEFNSLPYEDIQGKKKIIEKLFGSVGDDVSIEHNFHCDLGFNIHVGNRFYAGYNFTVLDVAEVRIGDNCLIAPNVGIYTAGHYISPPEERHKTGYGIPITIGNNVWIGGHSVILPGVTIGDNSIIAAGSVVNKDVPKNTIVAGNPARKIKDITSKL

SEQ ID NO: 15629 - DNA, 576 bp, Dictyostelium discoideum
  CDS (1)..(576)
atggatagcattaatatgacagaaaaagaaaaaatgactaaagggttaatgtatgactcatttgatgaagaattatgtaaagatagaacagaagccagagaacttattcatagatttaataatagtatggataaattggaaagaaaagatatcaccaaacaattatttggatcaactggcgaaaagatttatattgagccaacattaagagtggattatggttacaatattcatgttggtgagaatttctttgcaaactttggtacgatatttttagatacttgtccaatcacaattggaaagaatgcaatgttagctccaaacgttcaattttattccgcaactcacccaattgatccaactgaacgtaactctggtttagaattaggtaggcctattacaattggagataatgtttggattggtgggggtgtaataattttgccaggtgttgaattaggagataatgttgttgttggtgctggtgctgtggtgactaaatcatttggaagtaatgttgttattgctggaaatcctgccaaaattattaaacaaatacctgttaaatctgaataa

SEQ ID NO: 15630 - protein, 191 aa, Dictyostelium discoideum
MDSINMTEKEKMTKGLMYDSFDEELCKDRTEARELIHRFNNSMDKLERKDITKQLFGSTGEKIYIEPTLRVDYGYNIHVGENFFANFGTIFLDTCPITIGKNAMLAPNVQFYSATHPIDPTERNSGLELGRPITIGDNVWIGGGVIILPGVELGDNVVVGAGAVVTKSFGSNVVIAGNPAKIIKQIPVKSE

SEQ ID NO: 15631 - DNA, 591 bp, Dictyostelium discoideum
  CDS (1)..(591)
atggaaccggtattaacagaaagagagaaaatggtgacaggattaagatatagatttgaagatccagaattagatcaattaagactacgtgcaagaagattaaataaacaatttaataatttaattggtagtgatgaagatgatggtaaaaaaggaccagaaattattaaacagttatttggttcaacaggtgaaattgtgattgttcgtgaaggtattaaagttagttatggagttaatattcatgttggagataagttctttattaatcataattgcatattaaatgatgatggtccaattagaattggatatggcgcaatgattggtccaaactctcaattatatacagctacacacccattcgaaccatctgaaagaattggcggatcagatgaaaattttacaaaaggaattacaattggtgataatttttggggtggtggtaatgttataattttacctggtgtcactttaggaaataacgttattgttggtgctggttctgttgtcaccaaatcattccctgataattctattattgctggtaatcctgcaaaattaattcgtatgaatattccaacaaaataa

SEQ ID NO: 15632 - protein, 196 aa, Dictyostelium discoideum
MEPVLTEREKMVTGLRYRFEDPELDQLRLRARRLNKQFNNLIGSDEDDGKKGPEIIKQLFGSTGEIVIVREGIKVSYGVNIHVGDKFFINHNCILNDDGPIRIGYGAMIGPNSQLYTATHPFEPSERIGGSDENFTKGITIGDNFWGGGNVIILPGVTLGNNVIVGAGSVVTKSFPDNSIIAGNPAKLIRMNIPTK

SEQ ID NO: 15633 - DNA, 573 bp, Dictyostelium discoideum
  CDS (1)..(573)
atggataccaaaatgacagaaagagaaaaaatgaccaaaggattaatgtatgacccaggtgatgaagaattatgtaaaggtagaaccgaagccagacaacttattcatagatttaataatagcatggataagttggaaagaaaagatatcaccaaacaattatttggatcaactggcgaaaagatttatcttgaaccaacattaagagtggattatggctacaatattcacgttggtgagaatttctatgcaaattttggtgccatatttttagatatttgcccaattacaattggaaagaatgcaatgttagctccaaatgttcaattatattctgcaactcacccaattgatccaactgaacgtaactctggtttagaatttggtaagcctattacaattggagataatgcttggattggtggtggagcaataattttacctggtgtcacattaggtgataatgttgttgttggttctggagctgtagtaactagatcatttggaagtaatgttgttattgctggaaatccagccaaagttattaaagaaatacctgttaaatccgaataa

SEQ ID NO: 15634 - protein, 190 aa, Dictyostelium discoideum
MDTKMTEREKMTKGLMYDPGDEELCKGRTEARQLIHRFNNSMDKLERKDITKQLFGSTGEKIYLEPTLRVDYGYNIHVGENFYANFGAIFLDICPITIGKNAMLAPNVQLYSATHPIDPTERNSGLEFGKPITIGDNAWIGGGAIILPGVTLGDNVVVGSGAVVTRSFGSNVVIAGNPAKVIKEIPVKSE

SEQ ID NO: 15635 - DNA, 459 bp, Entamoeba histolytica HM-1:IMSS
  CDS (1)..(459)
atgaacaccactgctgaacaagaaacaaagtatatgttagaaggtaaaattatgataccagcaacacctgatggagttgctgcatcaattgcattaggaaataagttatttgatttcaaccatgaacgagatttatccttcaaacaatacaatgtctttgctccattcaattgcacacgagggaatttcattgacattggagacaacacagtgattaacattaattgttatattcttgaaggtggaccagtgaaaataggaaataatgtgatgataggacctaatgttagtcttataggtggtacacactcaactgatccaaagatcagaaacgcatgtggtggaacagcatatggaaaaccaattaccatcaaggatggagcatggataggatgtggtgcaatcatcttaccaggtgtaacaattggagaaaatcggttgttgggtcaggaagtgtag

SEQ ID NO: 15636 - protein, 152 aa, Entamoeba histolytica HM-1:IMSS
MNTTAEQETKYMLEGKIMIPATPDGVAASIALGNKLFDFNHERDLSFKQYNVFAPFNCTRGNFIDIGDNTVININCYILEGGPVKIGNNVMIGPNVSLIGGTHSTDPKIRNACGGTAYGKPITIKDGAWIGCGAIILPGVTIGENRLLGQEV

SEQ ID NO: 15637 - DNA, 609 bp, Entamoeba histolytica HM-1:IMSS
  CDS (1)..(609)
atggcaacacctacatttgatgaaagaagtttaatgcttaatggaaagttatatgatagtacagtcccagagttagctcatgacagagagtcttgttgtgaaaaaattattgattttaattgtgaaagaaatgcacaaaagagattagaaatgttgaaggatattgttggaagtcttggagaaaatagttgtatacttccaccatttcgttgtgattatggtaaatacatttctgttggacatgatacatttgttaattataatttaacagtactagatgctaattacgttaaaattggtaatcatgtcttgattggtcctaatgtccaactcattgcagctactcatccaactgatccacttattagaaattctcttgttgaatatggattacctattgtaattaaagatggtgcttggattggtgcaggtgcaactattcttccaggaattacaattggagaaaattcagttgtaggtgctgcttctgtagttactcatgatgttccagataatacagttgttgctggcaatcctgcaagaattatcagaaaagtttcagaacatccaggatggacaagagaacaacgagatgttccactgaactaa

SEQ ID NO: 15638 - protein, 202 aa, Entamoeba histolytica HM-1:IMSS
MATPTFDERSLMLNGKLYDSTVPELAHDRESCCEKIIDFNCERNAQKRLEMLKDIVGSLGENSCILPPFRCDYGKYISVGHDTFVNYNLTVLDANYVKIGNHVLIGPNVQLIAATHPTDPLIRNSLVEYGLPIVIKDGAWIGAGATILPGITIGENSVVGAASVVTHDVPDNTVVAGNPARIIRKVSEHPGWTREQRDVPLN

SEQ ID NO: 15639 - DNA, 609 bp, Entamoeba histolytica HM-1:IMSS
  CDS (1)..(609)
atggcaacacctacatttgatgaaagaagtttaatgcttaatggaaagttatatgatagtacagtcccagagttagctcatgacagagagtcttgttgtgaaaaaattattgattttaattgtgaaagaaatgcacaaaagagattagaaatgttgaaggatattgttggaagtcttggagaaaatagttgtatacttccaccatttcgttgtgattatggtaaatacatttctgttggacatgatacatttattaattataatttaacagtactagatgctaattacgttaaaattggtaatcatgtcttgattggtcctaatgtccaactcatttcagctactcatccaactgatccacttattagaaattctcttgttgaatatggattacctattgtaattaaagatggtgcttggattggtgcaggtgcaactattcttccaggaattacaattggagaaaattcagttgtaggtgctgcttctgtagttactcatgatgttccagataatacagttgttgctggcaatcctgcaagaattatcagaaaagtttcagaacatccaggatggacaagagaacaacgagacgttccactaaactaa

SEQ ID NO: 15640 - protein, 202 aa, Entamoeba histolytica HM-1:IMSS
MATPTFDERSLMLNGKLYDSTVPELAHDRESCCEKIIDFNCERNAQKRLEMLKDIVGSLGENSCILPPFRCDYGKYISVGHDTFINYNLTVLDANYVKIGNHVLIGPNVQLISATHPTDPLIRNSLVEYGLPIVIKDGAWIGAGATILPGITIGENSVVGAASVVTHDVPDNTVVAGNPARIIRKVSEHPGWTREQRDVPLN

SEQ ID NO: 15641 - DNA, 549 bp, Entamoeba histolytica HM-1:IMSS
  CDS (1)..(549)
atgaacaccactgctgaacaagaaacaaagtatatgttagaaggtaaaattatgataccagcaacacctgatggagttgctgcatcaattgcattaggaaataagttatttgatttcaaccatgaacgagattttactaagagaagagaaatctttcaaacaatagttggtcacttaggagaaaatagcaatgtctttgtgccattcaattgcacacgaggaaatttcattgacattggagacaacacagtcattaacattaattgttatattcttgaaggtggaccagtgaaaataggaaataatgtgatgataggacttaatgttagtcttataggtggtacacactcgactgatccaaagatcagaaacgcatgtggtggaacagcatatggaaaaccaattaccatcaaggatggagcatggataggattcacgcatgatgttccagacaatatgattgctgttggaaatcctgctaaagttaggagaagagtttcagaacatctaggatggacaatagagaatagggatgttccattagactaa

SEQ ID NO: 15642 - protein, 182 aa, Entamoeba histolytica HM-1:IMSS
MNTTAEQETKYMLEGKIMIPATPDGVAASIALGNKLFDFNHERDFTKRREIFQTIVGHLGENSNVFVPFNCTRGNFIDIGDNTVININCYILEGGPVKIGNNVMIGLNVSLIGGTHSTDPKIRNACGGTAYGKPITIKDGAWIGFTHDVPDNMIAVGNPAKVRRRVSEHLGWTIENRDVPLD

SEQ ID NO: 15643 - DNA, 612 bp, Entamoeba histolytica HM-1:IMSS
  CDS (1)..(612)
atgtcaattttcagagttgaatttgaagagaaatgttctgcagaaggtaaaatttgttgttttaaattacctgaattagctgaagaagcaaaaatattaaatgataagatgtttgattttaataatgaaagagatcttactaaaagacaagaaattatcaaaacgattgttaaaagtattggtgaaaatagtgttatttttccaccatttagatgttcaaaaggaaggtttataacaattggtaataatactgttattaatgttaattgttatattattgatggaattccaataactataggcaataatgttatgattgctgcaaatgttagtattcttggtggaactcactcaactgatccaataataagaaattatggtacagtttatagaaaacctgttactattgaagacggtgcatggattgggtgtggagcaaagatcttacctggagtaagaataggtaaaaatgctgtagttggagcaggtagtgttgttactcatgatattccagataatatggttgctgtaggaaatcctgcaagagtaaaaagaagagtttcagaacatccaggatggacaatagaaaatagagatgtacctttagactaa

SEQ ID NO: 15644 - protein, 203 aa, Entamoeba histolytica HM-1:IMSS
MSIFRVEFEEKCSAEGKICCFKLPELAEEAKILNDKMFDFNNERDLTKRQEIIKTIVKSIGENSVIFPPFRCSKGRFITIGNNTVINVNCYIIDGIPITIGNNVMIAANVSILGGTHSTDPIIRNYGTVYRKPVTIEDGAWIGCGAKILPGVRIGKNAVVGAGSVVTHDIPDNMVAVGNPARVKRRVSEHPGWTIENRDVPLD

SEQ ID NO: 15645 - DNA, 615 bp, Entamoeba histolytica HM-1:IMSS
  CDS (1)..(615)
atgaacaccactgctgaacaagaaacaaagtacatgttagaaggtaaaattatgataccagcaacacctgatggagttgctgcatcaattgcattaggaaataagttatttgatttcaaccatgaacgagattttattaagagaagagaaatccttcaaaggatagttggtcatttaggagaaaatagcaatgtctttgctccattcaattgcacacgagggaatttcattgatattggagacaacacagtaattaacattaattgttatattcttgaaggtggaccagtgaaaataggaaataatgtgatgataggacctaatgttagtcttataggtggtacacactcaactgatccaaatatcagaaacgcatgtggtggaacagcatatggaaaaccaattaccatcaaggatggagcatggataggatgtggtgcaatcatcttaccaggtgtaacaattggagaaaatgcggttgttgggtcaggaagtatagtcacgcatgatgttccagataatatgattgctgttggaaatcctgctaaagttaggagaagagtttcagaacatccaggatggacaatagagaatagggatgttccattagactaa

SEQ ID NO: 15646 - protein, 204 aa, Entamoeba histolytica HM-1:IMSS
MNTTAEQETKYMLEGKIMIPATPDGVAASIALGNKLFDFNHERDFIKRREILQRIVGHLGENSNVFAPFNCTRGNFIDIGDNTVININCYILEGGPVKIGNNVMIGPNVSLIGGTHSTDPNIRNACGGTAYGKPITIKDGAWIGCGAIILPGVTIGENAVVGSGSIVTHDVPDNMIAVGNPAKVRRRVSEHPGWTIENRDVPLD

SEQ ID NO: 15647 - DNA, 924 bp, Candida albicans SC5314
  CDS (1)..(924): transl_table=12
atgtgtagcttcaccccgccaccatcaccaccaccccgacgagaagaaaaatcatcagtatataaatccggacaaaatctgagtacccccaactcgtacaagatttttcacccaccacctccgacatactccatatacaaaactttaccaaacatgcccaccttcaaagacaaagaagatttcgtcaagcaaacgaatgtcagagcagaaaagaaccaagaactaatcaaatttgcccgtgacaaccttaaccatttaccattcaccgaaaaagacggaggtgcatgggaaaactatgaacgaatgatcagtggtatgctctacaactgtttacaaaaagaattggaaacaacacgtatgtcttgcagagactacatgttggactacggcagtttcagaactagagattataaaacaacccaagaatttcttgatgcaaaatacaaacatttagaaagtttcattggacatgttggcaaaaatgcatttatggaatatccaatctattttgattatgggtttaacacttatttgggtgataatttctattccaattacaatttgacaattttggatgtttccatagtcagaattggtaataatgtcaagtgtggtcccaatgtatctatccttaccccaacacacccagtggatcccactttgcgctatgatcaattggaaaatgccttgcctgtgacggtgggtaacggggtctggttatgtggaagctgtaccattcttggtggggtgacagtaggtgatggcagcattgtggctgctggtgcagttgtcaacaaggacgttccaccaaacactgtagttgcgggagttcctgctagggtagttaagcagctagaacctagagaccctaactttgacactatggcagttttgaaacaatatggtatgggttatatagattag

SEQ ID NO: 15648 - protein, 307 aa, Candida albicans SC5314
MCSFTPPPSPPPRREEKSSVYKSGQNSSTPNSYKIFHPPPPTYSIYKTLPNMPTFKDKEDFVKQTNVRAEKNQELIKFARDNLNHLPFTEKDGGAWENYERMISGMLYNCLQKELETTRMSCRDYMLDYGSFRTRDYKTTQEFLDAKYKHLESFIGHVGKNAFMEYPIYFDYGFNTYLGDNFYSNYNLTILDVSIVRIGNNVKCGPNVSILTPTHPVDPTLRYDQLENALPVTVGNGVWLCGSCTILGGVTVGDGSIVAAGAVVNKDVPPNTVVAGVPARVVKQLEPRDPNFDTMAVLKQYGMGYID

SEQ ID NO: 15649 - DNA, 888 bp, Thermus thermophilus HB27
  CDS (1)..(888): transl_table=11
atgccctggcttcttccccgcgagatcgcgcccctccaccaaaaggccctggaccgctatctgggtagcctcacggagaggctttccgaccccaatgtggaccggaacgccttggtgcgggaggagcttgcccgcctcctttacgggaggccctacgaggagcttctggaggcgaacccgctcgcggccatgggcctggacccggaggggatcacctttgaggccgagtactacgccgccaccgacctggagaagttccggcgggtcaagcccctcctctggttctggaaggtcctggacctcacgcctttgggccagtcggtgcactcgggggtggccataaggcgggccctcgccccattcatcttcaagcgggtggggaaaaaccccaagttcttccagaacgtggagttctccgtgggctacaacctggagcttggggacgacgtggtggtgcaccgctacgtcttcctggacgacatcggcggcatcaagatcggggaccgcacctccctctccgactacgtcaacgtctacagccacacccaccacgtcctggcctcccccgacgtcaccctgaaggagaccatcatcggaagcggggtccgcatcacctaccacgccaccgtcttggcgggggtgcgcatcggggacgacgccatggtgggcacgggggccgtcgtcaccaaggacatccccccccacgccatcgccctgggcatccccgcgaggcccgtgcgctacaaggtccgccacgactgcccctactgccgcaagggggagccccatccctcggaccttgttcccaagcttcccgaccgcaaggggaaccccgactaccccgacttcctgcccccgggcttcggaacaagggaggcgggctcttga

SEQ ID NO: 15650 - protein, 295 aa, Thermus thermophilus HB27
MPWLLPREIAPLHQKALDRYLGSLTERLSDPNVDRNALVREELARLLYGRPYEELLEANPLAAMGLDPEGITFEAEYYAATDLEKFRRVKPLLWFWKVLDLTPLGQSVHSGVAIRRALAPFIFKRVGKNPKFFQNVEFSVGYNLELGDDVVVHRYVFLDDIGGIKIGDRTSLSDYVNVYSHTHHVLASPDVTLKETIIGSGVRITYHATVLAGVRIGDDAMVGTGAVVTKDIPPHAIALGIPARPVRYKVRHDCPYCRKGEPHPSDLVPKLPDRKGNPDYPDFLPPGFGTREAGS

SEQ ID NO: 15651 - DNA, 594 bp, Desulfovibrio vulgaris subsp. vulgaris str. Hildenborough
  CDS (1)..(594): transl_table=11
atggctcgttgcgccgtctttctcgaagaactgtggttcgccctcttcgcgtgggtgcccaccgtgctcggcacggcggtgcgtctcgtggcgtggcgtccgctgttcaggcttctcggcggcgtgtgcggcaaggtgcgcttcgggcagtcgctcacgcttcagggcgcggggcacatgcgccttgccgacggcgtacgcctcggcaaggggtgccacctctacgcccgcacgggtgaactcgtcatgggcgagaacgccgcgctgaacatcaacgtggtggtggacgccgacggcggcaccgtccgcatcggcgcacacgccaccgtgggccccggcaccgtcattcgcgccgccaaccaccgtttcgacaggctcgacacccccatcatgttccaggggcacgaatacggcgaagtcgtcatcgacgatgacgtatggatagccgccaactgcaccgtggtgcccggcgtgcacatcgggcgcggggccgtggtgggggcgggtgccgtcgtcacgaaggacgtggaaccctacaccgtggtcgcgggcgtacccgcacggttcatccgcaggcgcggccccgcagaatag

SEQ ID NO: 15652 - protein, 197 aa, Desulfovibrio vulgaris subsp. vulgaris str. Hildenborough
MARCAVFLEELWFALFAWVPTVLGTAVRLVAWRPLFRLLGGVCGKVRFGQSLTLQGAGHMRLADGVRLGKGCHLYARTGELVMGENAALNINVVVDADGGTVRIGAHATVGPGTVIRAANHRFDRLDTPIMFQGHEYGEVVIDDDVWIAANCTVVPGVHIGRGAVVGAGAVVTKDVEPYTVVAGVPARFIRRRGPAE

SEQ ID NO: 15653 - DNA, 570 bp, Listeria monocytogenes str. 4b F2365
  CDS (1)..(570): transl_table=11
atgatagaacaagatttacagaaaagactagtcgaccaagaaattctccaagggtcggatttgttagatgaaattcacaaagtaaagcaaaacaatgaacaacttatcatcgaactaaacaccaagtaccactcaaaaaaagaagtgattaaatatctcagtgacatcactggaaaaccagtcgatccatcagtcgatgtctcacttcctttttatagcgacttcgggaaacatattacttttgggaaaaatatctttatcaatttaaatgtaactttcgtggatttaggtgggattacgattgaagataatgttttaattggcccaggagcaagacttgtgaccgttaatcatttagttagcccgaaaaaaagacgtggactacgtgtagccccaatttgtgtgaagaaaaacgcctggattggcgcaaacgcgacgatattatcaggcgtaacaatcggcgaaaatgctatcgttgctgcggatgctaccgtcacaagagatgtcccagcaaacgttatcgtcgccggaagcccagccaaacaaattcgtaaaattatcgaggaataa

SEQ ID NO: 15654 - protein, 189 aa, Listeria monocytogenes str. 4b F2365
MIEQDLQKRLVDQEILQGSDLLDEIHKVKQNNEQLIIELNTKYHSKKEVIKYLSDITGKPVDPSVDVSLPFYSDFGKHITFGKNIFINLNVTFVDLGGITIEDNVLIGPGARLVTVNHLVSPKKRRGLRVAPICVKKNAWIGANATILSGVTIGENAIVAADATVTRDVPANVIVAGSPAKQIRKIIEE

SEQ ID NO: 15655 - DNA, 564 bp, Listeria monocytogenes str. 4b F2365
  CDS (1)..(564): transl_table=11
atgaaaacagaactagaaaagatgattgcaggagaaatgtatgatcctagcgacagagagctcgcacacggaagaaatcgtgcacgtaagttctgcagagagattaacgatgcgatggattcagagtcccgtgcaagcgtgctgaagcgcctattcggcggaacaaaagagaatgtatatgtggaacctgattttcgtgttgattacggttctaatatatatgtaggcgaaaatttttatgctaattttgattgtgttattttagatgtttgcgaagtacatattggtgataattgtatgatggcgcctggagttcatatttatacggcaacgcatccgcttgatccagtagaacgtaatagtgggctagagcttggtaaaccagttgaaattggcgataatgtttggattggtggtcgggcaattattaatccgggggttaagcttggaaataatgtcgtggttgcttcaggcgcagttgtaacgaaaagcttccccgataatgtcgttcttgccggcaacccagcacgcgttattaaaacaattgaggttgaggaaaaatga

SEQ ID NO: 15656 - protein, 187 aa, Listeria monocytogenes str. 4b F2365
MKTELEKMIAGEMYDPSDRELAHGRNRARKFCREINDAMDSESRASVLKRLFGGTKENVYVEPDFRVDYGSNIYVGENFYANFDCVILDVCEVHIGDNCMMAPGVHIYTATHPLDPVERNSGLELGKPVEIGDNVWIGGRAIINPGVKLGNNVVVASGAVVTKSFPDNVVLAGNPARVIKTIEVEEK

SEQ ID NO: 15657 - DNA, 564 bp, Bacillus thuringiensis serovar konkukian str. 97-27
  CDS (1)..(564): transl_table=11
atgaaaacggaaaaagaaaagatgttggcgggagaaatgtatattgcggatgacgaagaattagtggctgatagggtggaggcaaaacgtttaacacgcctttataacgaggcgatggagacaggagatgagagacgttacactttattaaatcagcttttaggttcttcagctgatggaaaagcccgaattaatcctgattttcgttgtgattacggctacaatatccatgttggaaagagctttttcgcaaatttcaattgtgtgattttagacgtttgtgaagttcgaatcggtgatcattgtatgtttgcacctggtgttcacatttatactgctacgcatcctttacatccggtagagcggaattctggtaaagagtatgggaagcctgtaaagattggtaacaatgtttgggttggcgggggagctattattaaccctggtgtttcaattggagataacgctgtaattgcttcaggggcagttgtgacaaaagatgtacctaataatgtagtagttggaggtaacccagctaaagttattaaaacgatagacttatag

SEQ ID NO: 15658 - protein, 187 aa, Bacillus thuringiensis serovar konkukian str. 97-27
MKTEKEKMLAGEMYIADDEELVADRVEAKRLTRLYNEAMETGDERRYTLLNQLLGSSADGKARINPDFRCDYGYNIHVGKSFFANFNCVILDVCEVRIGDHCMFAPGVHIYTATHPLHPVERNSGKEYGKPVKIGNNVWVGGGAIINPGVSIGDNAVIASGAVVTKDVPNNVVVGGNPAKVIKTIDL

SEQ ID NO: 15659 - DNA, 486 bp, Staphylococcus aureus subsp. aureus MRSA252
  CDS (1)..(486): transl_table=11
ttgagaaaatttttatcaaaagaatatcatcgtacaaaccctttatggcatgtataccgtcttgttaaattttcgaaagtttttaagaatgtaatcatcattgaattttcgaaatttattccaagtatggtactgaaaagacatatatataaacaaattttaaatattaatatcggtaatcaatcgtcgatagcttataaagtaatgttagatattttttatccagaactgattacgattggtagtaacagtgttattggttacaatgtaacaattttgacgcatgaagcattagttgatgaatttcgttatggaccagtgacgataggatctaacactttgattggtgcaaatgctaccattttacccggtataacgattggtgacaatgtaaaagttgcagctggtacggttgtttcaaaagatataccggataatggatttgcatatggcaaccctatgtatataaaaatgattaggaggtga

SEQ ID NO: 15660 - protein, 161 aa, Staphylococcus aureus subsp. aureus MRSA252
MRKFLSKEYHRTNPLWHVYRLVKFSKVFKNVIIIEFSKFIPSMVLKRHIYKQILNINIGNQSSIAYKVMLDIFYPELITIGSNSVIGYNVTILTHEALVDEFRYGPVTIGSNTLIGANATILPGITIGDNVKVAAGTVVSKDIPDNGFAYGNPMYIKMIRR

SEQ ID NO: 15661 - DNA, 600 bp, Staphylococcus aureus subsp. aureus MRSA252
  CDS (1)..(600): transl_table=11
atgactgaaaaagaaaaaatgttagcagaaaaatggtacgatgcaaactttgatcaagacttaatcaatgaacgtgcacgagcgaaagatatttgctttgaattaaatcatacaaagccgagtgacaaaaataaaagaaaggaattaatcgatgaattatttcaaacaacaacagacaatgtaagtatttcgattccttttgatacagattatggttggaacgttaaactaggaaaaaatgtctatgtaaacaccaattgttattttatggatggtggacagattacaattggcgataatgtttttataggacctaattgtggattctacacagcaacacatccacttaattttcatcatagaaatgaaggatttgaaaaagcaggaccaattaatattggcagtaatacttggtttggcggacatgtagccgtgcttccgggagtgacgattggagaaggcagtgtgattggtgctggtagtgttgtcaccaaagatattccgccacacagtttagcggttggaaacccttgtaaagtcgttcgtaaaattgataatgaggtaccatcagaagcattgaacgatgaaacactaaattag

SEQ ID NO: 15662 - protein, 199 aa, Staphylococcus aureus subsp. aureus MRSA252
MTEKEKMLAEKWYDANFDQDLINERARAKDICFELNHTKPSDKNKRKELIDELFQTTTDNVSISIPFDTDYGWNVKLGKNVYVNTNCYFMDGGQITIGDNVFIGPNCGFYTATHPLNFHHRNEGFEKAGPINIGSNTWFGGHVAVLPGVTIGEGSVIGAGSVVTKDIPPHSLAVGNPCKVVRKIDNEVPSEALNDETLN

SEQ ID NO: 15663 - DNA, 627 bp, Erwinia carotovora subsp. atroseptica SCRI1043
  CDS (1)..(627)
atgaaattaaaaaatagctacccggttaaaactgttctttattttttagccctcgtaatgtcggatacattaaaaacgctaaaatcttatcttcgaagagctcaattcagggctaacggtatttatattgataagtccgctatcattagaagcgatgacagaggaagtataacgctgaatgaaggggtaagaatttctcatggcgttgttgttatctgtactaatgagaaagcaagagagggtgtttcctctcagttggttattggaaaaggaaccacaattaatgagtactcaaatataagagcatcaggcgggataattagaattggcgaaaactgtatgatcgcccaatttgtgagtgtggtcgcgtccaatcatgtcgtcaatactgaaaaactgatgattgatgaaagctgggatgataaaaagaatgagatcacaattgggaatgacgtatggattggcgcaggggccgttattttgcctggcgttactattggtgatggtgcagtcgttgccgctggttccgtagtgacgaaagatgtagatgcatttacgataaatgctggagtgccctgcaagaaaataaaagacagggaattgttttttaaaaatatcaatagttga

SEQ ID NO: 15664 - protein, 208 aa, Erwinia carotovora subsp. atroseptica SCRI1043
MKLKNSYPVKTVLYFLALVMSDTLKTLKSYLRRAQFRANGIYIDKSAIIRSDDRGSITLNEGVRISHGVVVICTNEKAREGVSSQLVIGKGTTINEYSNIRASGGIIRIGENCMIAQFVSVVASNHVVNTEKLMIDESWDDKKNEITIGNDVWIGAGAVILPGVTIGDGAVVAAGSVVTKDVDAFTINAGVPCKKIKDRELFFKNINS

SEQ ID NO: 15665 - DNA, 573 bp, Propionibacterium acnes KPA171202
  CDS (1)..(573): transl_table=11
atgagcactgagacgacggccctgctccggaccctcaagcgatgcaaggaacgcgcgatggaggacctcgacgccgccatgcgcgaggatcccgccgctacctcgaagctcatggtcgccatcgcctaccaaggtgttcacgccatctgggcgcatcgcctagcccacgccatgtgggtcaagaagcctgcgctgcgaccactagcacggttgttgtcacaattgtctcgccacatcaccggcattgagatccatccgggggcgacgattggacgccggttcttcatcgaccacggcatgggcgtcgttattggtgagacggcggtcgtcggtgacgacgtcctcatgtatcaccaggtgaccctcggcggccgcgcccgcggacagttcaagcgtcaccccacgattggcaaccgtgtcctcatcggcgcgggagccaagatcattggcaacatcacggttggcgacgactgcaagatcggcgccaacgcgttggtcgtcaaggatgtcgcccccggcacagtcgtcgtcggaatcccgtcgaaggtgcaccagggcgacgtcatcgcctga

SEQ ID NO: 15666 - protein, 190 aa, Propionibacterium acnes KPA171202
MSTETTALLRTLKRCKERAMEDLDAAMREDPAATSKLMVAIAYQGVHAIWAHRLAHAMWVKKPALRPLARLLSQLSRHITGIEIHPGATIGRRFFIDHGMGVVIGETAVVGDDVLMYHQVTLGGRARGQFKRHPTIGNRVLIGAGAKIIGNITVGDDCKIGANALVVKDVAPGTVVVGIPSKVHQGDVIA

SEQ ID NO: 15667 - DNA, 510 bp, Desulfotalea psychrophila LSv54
  CDS (1)..(510): transl_table=11
atgaattacttgtttttgtttttttattactctttcttgatttatctgccatcagtttcatttgttagttttggtgtttttcttcgtcgtttagttgttgctcacatatttaaatatgtagggaagaatgtgaacatagctaagggggtgtactttggtagagggcataatataacgattggtgaaaactcaggaataggtgaaaattctagaatagtctgtatggaaaaggttgaaattggatgtgatgttatgattggcccagaagttatgatgctaactggaggccatggatatactgacactaagcttcttttacgtgaacaagatataattacagcgccaataaaaattggcaatgattgttggataggtgcaagagctattattttgccaggtataacaattaccgatagagtgattatcggtgctgggagtgtagttgctaaatctatatttgaatcaggtatctacgtgggtaatccagcaagtaaaattagaaatttataa

SEQ ID NO: 15668 - protein, 169 aa, Desulfotalea psychrophila LSv54
MNYLFLFFYYSFLIYLPSVSFVSFGVFLRRLVVAHIFKYVGKNVNIAKGVYFGRGHNITIGENSGIGENSRIVCMEKVEIGCDVMIGPEVMMLTGGHGYTDTKLLLREQDIITAPIKIGNDCWIGARAIILPGITITDRVIIGAGSVVAKSIFESGIYVGNPASKIRNL

SEQ ID NO: 15669 - DNA, 579 bp, Bacillus licheniformis ATCC 14580
  CDS (1)..(579): transl_table=11
atgaaaacagaaaagcaaaaaatgctggacggagagctttatcatgcttctgatccggtgctgtgccatgacagactcaaggcgcgcaaaattacgaatgaattcaaccattcgaacgaaatcgacgacaataaaaggaccaagctaatcaaagagctgtttggatcaacaggggaaacgatcctcatcgaaccgtcgtttcgctgtgattacggctttaacatacatgtcggggaaaatttcttcgccaattttgactgtgttttcctcgatgtatgcgatatccggataggcgatcattgtatgctcggaccgggtgtccatatttatacggcgtcccatccgctcgatccgtccgaaaggataagcggtgcggagtacggaatacctgtcatcatcggccggaacgtttggattggcggcggcgcggtcatcaatcccggcgtcaaggtcggcgacaatgcagtgatagcttccggagccgtcgtcacaaaagatgtcccggataatgccatcgtcggcgggaatccggcgaaaatcattaaatacgttgatagcaaaaacaccaattctatgtaa

SEQ ID NO: 15670 - protein, 192 aa, Bacillus licheniformis ATCC 14580
MKTEKQKMLDGELYHASDPVLCHDRLKARKITNEFNHSNEIDDNKRTKLIKELFGSTGETILIEPSFRCDYGFNIHVGENFFANFDCVFLDVCDIRIGDHCMLGPGVHIYTASHPLDPSERISGAEYGIPVIIGRNVWIGGGAVINPGVKVGDNAVIASGAVVTKDVPDNAIVGGNPAKIIKYVDSKNTNSM

SEQ ID NO: 15671 - DNA, 564 bp, Bacillus cereus E33L
  CDS (1)..(564): transl_table=11
atgaaaacggaaaaagaaaagatgttggcgggagaaatgtatattgcggatgacgaagaattagtggctgatagggtggaggcaaaacgtttaacacgcctttataacgaggcgatggagacaggagatgagagacgttacactttattaaatcagcttttaggttcttcagctgatggaaaagcccaaattaatcctgattttcgttgtgattacggctacaatatccatgttggaaagaactttttcgcaaatttcaattgtgtgattttagacgtttgtgaagttcgaatcggtgataattgtatgtttgcacctggtgttcacatttatactgctacgcatcctttacacccaatagagcggaattctggtaaagaatatgggaagcctgtaaagattggtaacaacgtttgggttggcgggggagctattattaaccctggtatttcaattggagacaacgctgtaattgcttcaggggcagttgtgacaaaagatgtacctaataatgtagtagttggtggtaatccagctaaagttattaaaacgatagaagaataa

SEQ ID NO: 15672 - protein, 187 aa, Bacillus cereus E33L
MKTEKEKMLAGEMYIADDEELVADRVEAKRLTRLYNEAMETGDERRYTLLNQLLGSSADGKAQINPDFRCDYGYNIHVGKNFFANFNCVILDVCEVRIGDNCMFAPGVHIYTATHPLHPIERNSGKEYGKPVKIGNNVWVGGGAIINPGISIGDNAVIASGAVVTKDVPNNVVVGGNPAKVIKTIEE

SEQ ID NO: 15673 - DNA, 603 bp, Mannheimia succiniciproducens MBEL55E
  CDS (1)..(603): transl_table=11
atggcaacggaaaaagaaaaaatgttggcgggtttagcccatctcccgatggaagaacatttatccgcattacgtttacagacaaaagagctattatttgatttcaatatgctacgcccgtcaaataagcttgaaaaaacacatttattacggaaaattttgggtaaagcggggaaaaatattcacgtcaatagcccttttcactgcgattacggttgtaatattgaggtgggcgataatttctttgccaattaccattgtgttattttggataacggcggtgtgaaaattggcaatgacgtaatgttcgcgcctaacgttagtctttatacggtcgggcatcctttagatgccgaattgcgtaaccaaggttgggagcaggcaaaacctatcatcatcggtaataatgtttggattggcggtaatgtagtgattttacccggtgtggtaatcggcgataatgtagtgatcggcgcgggatcggtagtcactaaagatattccggcaaacagccttgctttgggtaacccgtgtaaagtattacggcaaatcactgcggcggatcgcgaatattatcagcaaacctttatgcaaaataattaa

SEQ ID NO: 15674 - protein, 200 aa, Mannheimia succiniciproducens MBEL55E
MATEKEKMLAGLAHLPMEEHLSALRLQTKELLFDFNMLRPSNKLEKTHLLRKILGKAGKNIHVNSPFHCDYGCNIEVGDNFFANYHCVILDNGGVKIGNDVMFAPNVSLYTVGHPLDAELRNQGWEQAKPIIIGNNVWIGGNVVILPGVVIGDNVVIGAGSVVTKDIPANSLALGNPCKVLRQITAADREYYQQTFMQNN

SEQ ID NO: 15675 - DNA, 597 bp, Mannheimia succiniciproducens MBEL55E
  CDS (1)..(597): transl_table=11
atggtgggcaggaatgcccaccctacaagcaaaggaaatatgatggactacacactcaatctccccttaaaccaacttatcgcccaaaatagcgaattgtttagtaaaattcaccaagttgtcgataaaaatgcgccgttagtggcagaacttaattccggttttagaacgcaaaacgaaatacgggcaattttaaatgaaatgaccggcacggaaattgatgcaagttttcacgtgaatttaccgctttataccgactttagtgcgcatattcgtattggcaaacgagtgtttattaacactgcggtaatgcttaccgacttaggcggcatcacacttgaagatgatgttttgattggtccgcgcgtgaacattatcaccgtagatcaccccattgatcccgcacaacgtcgaggcgtaattgttaaaccggttgtgattaaaaagaatgcgtggattggcgccggggcaaccattttagccggtgtaaccgtgggtgaaaatgccattgtcgccgcaggtgctgtggtgaacaaagacgtacccgctaatacgatagtaggcggtattcccgccaaattgattaaggaaatctga

SEQ ID NO: 15676 - protein, 198 aa, Mannheimia succiniciproducens MBEL55E
MVGRNAHPTSKGNMMDYTLNLPLNQLIAQNSELFSKIHQVVDKNAPLVAELNSGFRTQNEIRAILNEMTGTEIDASFHVNLPLYTDFSAHIRIGKRVFINTAVMLTDLGGITLEDDVLIGPRVNIITVDHPIDPAQRRGVIVKPVVIKKNAWIGAGATILAGVTVGENAIVAAGAVVNKDVPANTIVGGIPAKLIKEI

SEQ ID NO: 15677 - DNA, 606 bp, Bacteroides fragilis YCH46
  CDS (1)..(606): transl_table=11
atgaaaacagaaatggaaaaatgtctggctggtgaatggtatgattgtcataaccaagttttcttggatttaaagacccgaacatataagttattaataaaatataattcattaccttatgaggataaagaagaaaaacacagcttgctaaaaaagatactaggtagtatcggaatgaaagtttcggttgccagtccatttatttgtgattatggctgcaatatacatataggggataatgttactgtaaatactggttgtacctttgtggattgtaatagaatcactatcggaagtaatgttcttattgcccctaatgttcagctttatacagcaactcaccctattgatttagatgaacggctagcgccttttgaaacagaagatggaataaaacgagttcgccgcacttacgctttgcctattacaattgaggatggatgctggattggtggaggtgtaataatccttcccggaataacaattgggtacggtagtgtaattggagcaggtagtgttgttacaaaagatattccggcaaatagtttagccgttggaaatccatgtaaagtgatacgtcaaatcaatcaaactaagaaactatga

SEQ ID NO: 15678 - protein, 201 aa, Bacteroides fragilis YCH46
MKTEMEKCLAGEWYDCHNQVFLDLKTRTYKLLIKYNSLPYEDKEEKHSLLKKILGSIGMKVSVASPFICDYGCNIHIGDNVTVNTGCTFVDCNRITIGSNVLIAPNVQLYTATHPIDLDERLAPFETEDGIKRVRRTYALPITIEDGCWIGGGVIILPGITIGYGSVIGAGSVVTKDIPANSLAVGNPCKVIRQINQTKKL

SEQ ID NO: 15679 - DNA, 630 bp, Bacteroides fragilis YCH46
  CDS (1)..(630): transl_table=11
atggcactgaaagagaaaatcaaacagaatcccgcactgaaacaagctgtacaccgttttattatgcatccggtaaaaacacgtcccaactggtggatacgtatattctctttcctctacctaaaacgtggaaaaagctctgtgatttaccgtagcgtacgccaggatcttcccccattcaatctcttctctctcgggaagtattcggtagtggaagatttttcgtgtctgaacaatgctgtaggcgacctgattatcggggaatatacccgaatcggactgggcaacaccattatcggccccgcaaccatcggcaaccatgtaaatctggcacagaatgtaaccgtaaccggactgaaccataattatcaggacgcagacaagcggatagacgaacaaggagtaagcacacaacccatcacgattgaagatgatgtatgggtaggtgccaattcggtgattttacccggcgtgacactgggcaaacattgcgtagtagctgccggaagtgtagtcagtcgctccatccctccctactctgtctgtgccggcagtccggctaaagtagtcaaacagttcaatccggagagccgaacctgggaaaaaacagtctcaaaaaacggaaagtaa

SEQ ID NO: 15680 - protein, 209 aa, Bacteroides fragilis YCH46
MALKEKIKQNPALKQAVHRFIMHPVKTRPNWWIRIFSFLYLKRGKSSVIYRSVRQDLPPFNLFSLGKYSVVEDFSCLNNAVGDLIIGEYTRIGLGNTIIGPATIGNHVNLAQNVTVTGLNHNYQDADKRIDEQGVSTQPITIEDDVWVGANSVILPGVTLGKHCVVAAGSVVSRSIPPYSVCAGSPAKVVKQFNPESRTWEKTVSKNGK

SEQ ID NO: 15681 - DNA, 627 bp, Bacteroides fragilis YCH46
  CDS (1)..(627): transl_table=11
atgattatgtggataaaacaattcttgattcgtaaaattctgatatttagtaatgtgaatttgagattagcaaaagacgtttgtgtcgtgaaagtgaaatttggcaaaaacgtcttgttggaaaaaggtgtccagctttcttattcaataattggagacttttcatatattaattataattcttttgtaagccatacttctattgggaaattttgctctgttggtccattttgtgttattggtatgggaaatcatccctctcactcctttgtaagtacttctccttatttgtatgttaaaggagattttttatctgcatctctttataaagagaaacaaaatgttaaaatagggaatgatgtttggattggtgctcatgttacaattattaatggagtcacaattggggatggagcgataattggtgccaattctgtagttattagggatgtacctagctatgctattgttggaggagtgcctgcgcgtgttataagacaacggtttaccgacatggaaattaatcatttgaataaaatacaatggtgggatcaatcagaggtatggttaaaagagaaagctgaaaacatgtctgatataaaaaaatttatagagagtaataaatga

SEQ ID NO: 15682 - protein, 208 aa, Bacteroides fragilis YCH46
MIMWIKQFLIRKILIFSNVNLRLAKDVCVVKVKFGKNVLLEKGVQLSYSIIGDFSYINYNSFVSHTSIGKFCSVGPFCVIGMGNHPSHSFVSTSPYLYVKGDFLSASLYKEKQNVKIGNDVWIGAHVTIINGVTIGDGAIIGANSVVIRDVPSYAIVGGVPARVIRQRFTDMEINHLNKIQWWDQSEVWLKEKAENMSDIKKFIESNK

SEQ ID NO: 15683 - DNA, 591 bp, Methylococcus capsulatus str. Bath
  CDS (1)..(591): transl_table=11
atgtccaagatcgccaaacgtctcctgctgggtttactgacaccggccgccgccatcgccgaccgcctggaatcctggcaccgcctgtgggctcatgcacggctcaaggcggccctcgattcggccctggatccttccgtcgttgtgctgggaacgcccgaactgcatggcagcagaaacatccacctggggcgggatctgttcctttatcccggcctgtacctggaaacccaggaacgaggccgtatcgagatcggcgacggtgtcgtgctgtcgcgcggagtgcacatcgtgtcctatgcctcggtcatcctggaagacggtgtgatggtgggcgaatacaccagcatccgggacgccaatcaccgcatcgccgcaggccgctccgtgcgggacaccggccatgatgccgagccggtccggatcgggcgcaacgcctggatcgggcggggcgcggtcatcctgcggggagtcacgatcggggaggccgccgtagtcggcgccaatgcggtcgtgacgcgcgatgttcccgccggcgcggtcgtggccggggtgcccgcccgttccatcgagcgcaaacgcgccggctga

SEQ ID NO: 15684 - protein, 196 aa, Methylococcus capsulatus str. Bath
MSKIAKRLLLGLLTPAAAIADRLESWHRLWAHARLKAALDSALDPSVVVLGTPELHGSRNIHLGRDLFLYPGLYLETQERGRIEIGDGVVLSRGVHIVSYASVILEDGVMVGEYTSIRDANHRIAAGRSVRDTGHDAEPVRIGRNAWIGRGAVILRGVTIGEAAVVGANAVVTRDVPAGAVVAGVPARSIERKRAG

SEQ ID NO: 15685 - DNA, 648 bp, Photobacterium profundum SS9
  CDS (1)..(648): transl_table=11
atgacttcttatgagttaggccatacaatttcgcataatatctactataaaatattgcttaatggaatggtaatgacagaaaaagaaaagatgctatctggtttaatctatcaagcgtgggatgaagagctaactgccgatcgccataacgccaaaggattatgttttaagatcaatcaaacctgtccgacgcagaaagatgtccgacagggtttgattaatgagctactcggctatgatagtgatgcatggattgaatcaccctttaactgtgattatggctacaacattaaagtcggtagcggtttttatatcaatcatggctgtaccattcttgatgctgtacctattactattggtgataactgtctgctagcccctggcgtcgttatttcaactgcaggtcatccgcttgatcctgttgaaagagcgagaggtgatgagtttgctcaagcgattacgattggcaatgatgtatggcttggtgccaatgtaaccgtgtgccccggcgtgactattggcgataatgtggttgtgggtgctggcagtgtggtggtaaaaaatctacctgcaaacagtgtgtgtgtcggatctcccgctaagcctcttcgctaccttaaagaaggcgagtgtaatcctacgttgtaa

SEQ ID NO: 15686 - protein, 215 aa, Photobacterium profundum SS9
MTSYELGHTISHNIYYKILLNGMVMTEKEKMLSGLIYQAWDEELTADRHNAKGLCFKINQTCPTQKDVRQGLINELLGYDSDAWIESPFNCDYGYNIKVGSGFYINHGCTILDAVPITIGDNCLLAPGVVISTAGHPLDPVERARGDEFAQAITIGNDVWLGANVTVCPGVTIGDNVVVGAGSVVVKNLPANSVCVGSPAKPLRYLKEGECNPTL

SEQ ID NO: 15687 - DNA, 549 bp, Photobacterium profundum SS9
  CDS (1)..(549): transl_table=11
atgtgtatgtctgaattagaaaaaatgcttaatggtattgtctataattgccagtgtaaggcgttagaaaagttacgggaagaagcttctgtcttgcttcgccatttcaataacgaaccgaattcagatcttaggcatgaaatattagttaaccttggtattaaggttcctcttgatagctgcattattccccctctcgatatgagttatggcagtcatttatctattggcaatcaaagctatataaacagcggtgcgcttatattagataatggctatgtgaacattggctctcacgtaatgatagggcctagagtgcaaatatatacggcttctcatgctcttgatgccgatagacgtattgcgggcgacgaagtagcaaaaccagtcacaattaatgataaagcttggattggcggtggcgcaataatattacctggtgtaaccattggtgaaggtgctgttattggtgctggctctgtcgtgacaaaagatgttgcaagctatgaccgtgttgcaggaaacccagctcgctccatcatcaaataa

SEQ ID NO: 15688 - protein, 182 aa, Photobacterium profundum SS9
MCMSELEKMLNGIVYNCQCKALEKLREEASVLLRHFNNEPNSDLRHEILVNLGIKVPLDSCIIPPLDMSYGSHLSIGNQSYINSGALILDNGYVNIGSHVMIGPRVQIYTASHALDADRRIAGDEVAKPVTINDKAWIGGGAIILPGVTIGEGAVIGAGSVVTKDVASYDRVAGNPARSIIK

SEQ ID NO: 15689 - DNA, 564 bp, Photobacterium profundum SS9
  CDS (1)..(564): transl_table=11
atgaatgaattagagaaaatgcgctcagggttgctatacgatggtaacgatgcctcaattgatactttgcgtcagcaatcagagttactgattattcagctacgatcgtcgccttcatctcaacaccaagtattattgaaattgttactcggttctttgggagataactcagtaatacgcatgcctttcagctgcgagtttggtaaaaccattcatattggtagcagcacttttcttaatgctggtatcgtgatgctagataatgccgatatttatattggcgataatgtgttaattggcccatcgacgcagttttttacgccaacacactcactcgatcatgaatctcgtcgacgatgggagtcgtggtgtaagccaattactgtcgaaaatgatgtttggattggtggtaatgtatcgatctgtcagggtgtcaccattggtgctcgttcagtcgtcgcggctggtagtgttgttacacatgatgttccgcctgatacactcgttggtggtacgccagcgaaggttattcgaccaatcaatagtagtgatgcagctatataa

SEQ ID NO: 15690 - protein, 187 aa, Photobacterium profundum SS9
MNELEKMRSGLLYDGNDASIDTLRQQSELLIIQLRSSPSSQHQVLLKLLLGSLGDNSVIRMPFSCEFGKTIHIGSSTFLNAGIVMLDNADIYIGDNVLIGPSTQFFTPTHSLDHESRRRWESWCKPITVENDVWIGGNVSICQGVTIGARSVVAAGSVVTHDVPPDTLVGGTPAKVIRPINSSDAAI

SEQ ID NO: 15691 - DNA, 561 bp, Haloarcula marismortui ATCC 43049
  CDS (1)..(561): transl_table=11
atggcgtctgaacgggagaagatgctggcgggcgagcgctacgacgcgagcgacccagcactcgttgctgcccgagagcgtgcgaacgaactcacccgggagtacaaccagaccgacccatctgaggccgacaccagacaggcgctcatcgaggacctctttggctcggtcggtgcggactgccacgtcgaaccgcccttccggtgtgactacggcgacaacatccacgtcggcgatgggttctacgcgaacttcgactgcgtcgtactggatgtctgccgggtcgatatcggcgacgactgcctgctcgggccgggtgtccacatctacaccgcgacgcacccacttgacccggatgaacgacgtagcggcgtcgagtacgggaagccggtgactatcggcgacaatgtctgggtcggtgggcaggcggtcatcaacccgggcgtcaccgtcggcgacgatgccgtcatcgggtccggtgcggtcgtcaccgacgacgttcctgctggcgtcgtcgttcaggggaaccccgcgtcggtcgtacgtgaaatcgaggattga

SEQ ID NO: 15692 - protein, 186 aa, Haloarcula marismortui ATCC 43049
MASEREKMLAGERYDASDPALVAARERANELTREYNQTDPSEADTRQALIEDLFGSVGADCHVEPPFRCDYGDNIHVGDGFYANFDCVVLDVCRVDIGDDCLLGPGVHIYTATHPLDPDERRSGVEYGKPVTIGDNVWVGGQAVINPGVTVGDDAVIGSGAVVTDDVPAGVVVQGNPASVVREIED

SEQ ID NO: 15693 - DNA, 675 bp, Geobacillus kaustophilus HTA426
  CDS (1)..(675): transl_table=11
atgtttaaaacgttaaaagaggatattgaggtcatttttgagcaagacccggcggcgagaagctatttggaagtcattttaacgtattccggcctgcatgccatctgggcgcatcggatcgcccatgcgctttacaagcggaaattttacttttttgcccgcttgatttcgcaaatcagccgctttttcactggcattgaaatccatccgggcgcgaaaatcggccgccgctttttcatcgaccacggcatgggcgtggtgatcggcgaaacgtgcgaaatcggcgacaatgtcactgtctatcaaggggtcacattaggcgggacagggaaagaaaaagggaagcggcacccgacgatcaaagacaactgtttgatcgctgccggcgcgaaagtgctcggttcgattacgatcggggaaaactcgaaaatcggcgctgggtcggtcgtgttaaaagacgtaccgcccaattcgaccgtcgttggcattccgggccgcgtcgttgtgcgcgacggggtgaaagtgaagaaagatttaaaccataccgaccttcctgacccgatcgccgaccggtttcgggagcttgaagaggaaatcgcccggctgaaaagcgagcttgaggcattgaaacaacaagaaaggaagaacgagtatgagcagcatccggctttataa

SEQ ID NO: 15694 - protein, 224 aa, Geobacillus kaustophilus HTA426
MFKTLKEDIEVIFEQDPAARSYLEVILTYSGLHAIWAHRIAHALYKRKFYFFARLISQISRFFTGIEIHPGAKIGRRFFIDHGMGVVIGETCEIGDNVTVYQGVTLGGTGKEKGKRHPTIKDNCLIAAGAKVLGSITIGENSKIGAGSVVLKDVPPNSTVVGIPGRVVVRDGVKVKKDLNHTDLPDPIADRFRELEEEIARLKSELEALKQQERKNEYEQHPAL

SEQ ID NO: 15695 - DNA, 558 bp, Geobacillus kaustophilus HTA426
  CDS (1)..(558): transl_table=11
atgaaaagcgaaaaagaaaagatgttggcgggacacttgtacaaccctgccgatttggagctcgtcaaggagcgggagcgggcgcggcggctcgttcgcctgtataacgaaacgttggaaacggagtatgacaaacggaccgggctgctcaaagaattgttcggttcgacaggggaacggctgttcatcgagccgaacttccgctgcgactacggctacaacattcacgtcggcgaaaacttttttatgaactttgatggcgtgattttggatgtatgtgaagtgcgaatcggcgaccattgttttatcggtcctggtgtgcacatttatacggcgactcacccgctcgatccgcacgaacgaaattccgggttggagtacggaaagccggttgtgatcggccataacgtctggatcggcgggcgggccgtcatcaacccgggcgtcacgatcggcgacaacgctgtcatcgcctcaggggcggttgtgacaaaagatgtccccgccaacgcggtcgttggcggaaacccggcgaaagtgatcaaatggctcaaatag

SEQ ID NO: 15696 - protein, 185 aa, Geobacillus kaustophilus HTA426
MKSEKEKMLAGHLYNPADLELVKERERARRLVRLYNETLETEYDKRTGLLKELFGSTGERLFIEPNFRCDYGYNIHVGENFFMNFDGVILDVCEVRIGDHCFIGPGVHIYTATHPLDPHERNSGLEYGKPVVIGHNVWIGGRAVINPGVTIGDNAVIASGAVVTKDVPANAVVGGNPAKVIKWLK

SEQ ID NO: 15697 - DNA, 552 bp, Azoarcus sp. EbN1
  CDS (1)..(552): transl_table=11
gtgaggaccgaaagggaaaaaatgctcgcgggagagctttatgatccgttcgacccggacctggttgcccggcgggaccaggcacgcgccttatgccaaacgctgaacgccacgaaagagtcggagcagggcgtcagacgccgcgtcctcgaagacctattcggcgccggtggcgataccgtctggatgcaaccgcccttctattgtgactacggttccaacattcgcctcggcgcgcgcgtatttttcaacttcaattgcaccgttctcgatgtgtgcgaagtccgcatcggcgactacacgttattcggcccgggcgtgcaaatcctcacgccgttgcatccactcgacgccgatctacgcaggaagcaggaatacggaaagccgatcgagatcggggcagacgtgtgggtgggaggtggagcactgattctggccggagtccgtatcgggtctcgaacgatcattggagcgggtagcgtcgtgacacgtgacattccggaaggcgtacttgcagccggaaatccatgccgagtgatccgcagtgtctag

SEQ ID NO: 15698 - protein, 183 aa, Azoarcus sp. EbN1
MRTEREKMLAGELYDPFDPDLVARRDQARALCQTLNATKESEQGVRRRVLEDLFGAGGDTVWMQPPFYCDYGSNIRLGARVFFNFNCTVLDVCEVRIGDYTLFGPGVQILTPLHPLDADLRRKQEYGKPIEIGADVWVGGGALILAGVRIGSRTIIGAGSVVTRDIPEGVLAAGNPCRVIRSV

SEQ ID NO: 15699 - DNA, 600 bp, Zymomonas mobilis subsp. mobilis ZM4
  CDS (1)..(600): transl_table=11
atgaatatggatatcgcgcagcaacgccaacatatcctaagcggcgcttattataatgatctcacccctgaattgataaaggcaagagaagaggcggttcggctttccaatctttataatgatagctttggtgaagctccggcaaaaagagaaagctatctgcggcaattattgaaaaaaataggcaaaaatgcctattttgagccgcgcttccgttgtgaatttggtttcaatattagcattggcgacaatttctacgccaattttgactgcattattttagacgggggcgaagtcaccatcggggataatgttctatttggtcctcgtgtcggtatttatacctcgaatcatgcgatcaaccccgatgagcggaaggctggagcttgttatgccaaagccgtgacgattggtcattctgtgtgggtcggcggcggcgttaacatcaatcagggtgtgacaatcggtgataacagtatcatcggttcgggaagcgtcgtcacaaaagatattccggccaatgtgattgcggcaggggtgccttgtcgggtgatacggcctattactgatgccgaccgtgtgggttttaacgcctcttaa

SEQ ID NO: 15700 - protein, 199 aa, Zymomonas mobilis subsp. mobilis ZM4
MNMDIAQQRQHILSGAYYNDLTPELIKAREEAVRLSNLYNDSFGEAPAKRESYLRQLLKKIGKNAYFEPRFRCEFGFNISIGDNFYANFDCIILDGGEVTIGDNVLFGPRVGIYTSNHAINPDERKAGACYAKAVTIGHSVWVGGGVNINQGVTIGDNSIIGSGSVVTKDIPANVIAAGVPCRVIRPITDADRVGFNAS

SEQ ID NO: 15701 - DNA, 693 bp, Dehalococcoides ethenogenes 195
  CDS (1)..(693): transl_table=11
atgataaaagatattagaaacgttttcagtaaagacccggctgcccgaagtgtggcagaggttcttttttgttatccgggtttgcatgccctctggtttcaccgggtggcaaactggctttggcgtcacaagctccatttctgggcacgctggctttcccacggcgggcggttctgcaccggcattgagattcatccgggggcaaaaataggccagcgtttcttcattgaccatggaatgggtgtagtcattggtgaaacctctgaaattggtgatgacgtgctcatgtatcagggggtggtcttaggcggcaccagtttgtccaagggtaagcgtcaccctactatcggcagcaatgtggttatcggcacaggtgcggtagtgctgggcggcattacagtgggcgaaggggcaaaaataggggcgggttcggtagtgactaaagacgttccggccggggcaactgtagtgggtataccggggcgggtagtagaagaatcccgccagatggttattgatttggaacacggcaaactgcctgacccggtagcggatgccttaaaggtagtgctggccgaacagcaaaagctgatggacaggcttgcccagcttgaaaaaaacagcgagctgaaagtgcctcaggatgagcttcgcgggcagatacgtgaaattatgaaagagtttaacctctga

SEQ ID NO: 15702 - protein, 230 aa, Dehalococcoides ethenogenes 195
MIKDIRNVFSKDPAARSVAEVLFCYPGLHALWFHRVANWLWRHKLHFWARWLSHGGRFCTGIEIHPGAKIGQRFFIDHGMGVVIGETSEIGDDVLMYQGVVLGGTSLSKGKRHPTIGSNVVIGTGAVVLGGITVGEGAKIGAGSVVTKDVPAGATVVGIPGRVVEESRQMVIDLEHGKLPDPVADALKVVLAEQQKLMDRLAQLEKNSELKVPQDELRGQIREIMKEFNL

SEQ ID NO: 15703 - DNA, 486 bp, Staphylococcus aureus subsp. aureus COL
  CDS (1)..(486): transl_table=11
ttgaggaaatttttatcaaaaacacatcatcatacaaaccctttatggcgtgtataccgtcttgttaaattttcgaaagtttttaagaatgtaattatcattgaattttcgaaatttattccaagtatggtactgaaaagacatatatataaacaacttttaaatattaatatcggtaatcaatcgtcgatagcttataaagtaatgttagatattttttacccagaactgattacgattggtagtaacagtgttattggttacaatgtaacaattttgacgcatgaagcattagttgatgaatttcgttatggaccagtgacgataggatctaacactttgattggtgcaaatgctaccattttacccggtataacgattggtgacaatgtaaaagttgcagctggtacggttgtttcaaaagatataccggataatggatttgcatatggcaaccctatgtatataaaaatgattaggaggtga

SEQ ID NO: 15704 - protein, 161 aa, Staphylococcus aureus subsp. aureus COL
MRKFLSKTHHHTNPLWRVYRLVKFSKVFKNVIIIEFSKFIPSMVLKRHIYKQLLNINIGNQSSIAYKVMLDIFYPELITIGSNSVIGYNVTILTHEALVDEFRYGPVTIGSNTLIGANATILPGITIGDNVKVAAGTVVSKDIPDNGFAYGNPMYIKMIRR

SEQ ID NO: 15705 - DNA, 600 bp, Staphylococcus aureus subsp. aureus COL
  CDS (1)..(600): transl_table=11
atgactgaaaaagaaaaaatgttagcagaaaaatggtacgatgcaaactttgatcaatacttaatcaatgaacgtgcacgagcgaaagatatttgctttgaattaaatcatacaagaccgagtgctacaaataaaagaaaggaattaattgatcaattatttcaaacaacaacagacaatgtaagtatttcgattccttttgatacagattatggttggaacgttaaactaggaaaaaatgtctatgtaaacaccaattgttactttatggatggtggacagattacaattggcgataatgtttttataggacctaattgtggattctacacagcgacacatccacttaatttccatcatagaaatgaaggttttgaaaaagccggacccattcatattggcagtaatacttggtttggcggtcatgtagccgtgttaccaggggtgacgattggagaaggcagtgtgattggtgctggtagtgttgtcactaaagatattccgccacacagcttagcggttggaaacccttgtaaagtcgttcgtaaaattgataatgacctaccatccgaaacattaaatgacgaaacgataaagtag

SEQ ID NO: 15706 - protein, 199 aa, Staphylococcus aureus subsp. aureus COL
MTEKEKMLAEKWYDANFDQYLINERARAKDICFELNHTRPSATNKRKELIDQLFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 15707 - DNA, 615 bp, Lactobacillus acidophilus NCFM
  CDS (1)..(615): transl_table=11
atggaagaaaatactaaaaatatgcttgctggaaagccttatcgtccaggaacaccagaattacatcaaatttctagattggctcaccgactttgtcgtgactataatttactagcagacactgataaagaagaacgaaaagcaattattaaccgcctatttcccgatcatcaagaaggtatttatttacaaggtcctattaatgtagattatggtcgttttactactctaggtaagaacttttatgctaactttaatctaactattttagacacttgccctgtaaaaatcggtgataatgttatgtgtggacctaacgttaatattcttactccacttcatccgctacttcccagtcaacgcaattctcgcgtattagaaaatggcactgtaggcgattatgaatatggtgctcctattacaattggtgataattgttggctagctggaaacgtaacaatttgtgctggtgtgactattggcaatggatgcgtaattggagctggcgctgtagttactagagatgttcctgataactcacttgttgtgggggttccaggacgtgtcattagaaaaataacaaaagaagatcgtttaaagaactggccatattaa

SEQ ID NO: 15708 - protein, 204 aa, Lactobacillus acidophilus NCFM
MEENTKNMLAGKPYRPGTPELHQISRLAHRLCRDYNLLADTDKEERKAIINRLFPDHQEGIYLQGPINVDYGRFTTLGKNFYANFNLTILDTCPVKIGDNVMCGPNVNILTPLHPLLPSQRNSRVLENGTVGDYEYGAPITIGDNCWLAGNVTICAGVTIGNGCVIGAGAVVTRDVPDNSLVVGVPGRVIRKITKEDRLKNWPY

SEQ ID NO: 15709 - DNA, 600 bp, Vibrio fischeri ES114
  CDS (1)..(600): transl_table=11
atgagtcataaattgtcggatttttcagttcaaattcccataaataaagaactgtgcgcatttcaggatgaagtaaaagagcaactgtatgactttaaccactcccgaccatcagaacatcagttaagagccgatgtattgcaatctatccttggtcaatataagggagtgactatcgtacctccattttattgtgatatgggaaagaacatacattttgagtgtggtggatttttaaattcaggagttaagatcttagatcttgctcctgtttttattggagcacatgttcaagttggcccaaatgttgtgatcagtacagcagggcatccttttgatttagcggagcgagtattaccgattgcttctgctaacccaattaagattggagataacgtttggattggtgctaacgctgttatattggatggtgtgacaatcggtgctcgaagtgtgattggtgcaggaagtgtagtgacaaaagatattccgccagactgtgtcgctgtcggtaatccttgtcgagtgattaagacgattacccattcagacatgccatctgacgatgaacttgatgaaatgtgggcagatctaacataa

SEQ ID NO: 15710 - protein, 199 aa, Vibrio fischeri ES114
MSHKLSDFSVQIPINKELCAFQDEVKEQLYDFNHSRPSEHQLRADVLQSILGQYKGVTIVPPFYCDMGKNIHFECGGFLNSGVKILDLAPVFIGAHVQVGPNVVISTAGHPFDLAERVLPIASANPIKIGDNVWIGANAVILDGVTIGARSVIGAGSVVTKDIPPDCVAVGNPCRVIKTITHSDMPSDDELDEMWADLT

SEQ ID NO: 15711 - DNA, 546 bp, Vibrio fischeri ES114
  CDS (1)..(546): transl_table=11
atgactgaaaaagagaaaatgttagcagggcttccttatgatgcttgggaagaaacgctattaaatgatcgtatgaatgccaaagcgatttgccaccaatttaatttagctgacccaactaagcttgatgaaagaatggccattttaagtgagttgctgtgtataaaggacaaagcacatatagagccaaatttcttttgtgattatggttataacattgaaattggaagtaatttttattctaaccataatttgacgattgtggatgtatgtaaggttactattggaaacaatgtgctgtttgggccacatgtgatgatttctactggtacgcatccgattgatcctatcgagcgacaaaaaacggagttcggggcgagtatttctattggtaatgacgtatggctaggaggaaatgtatccgttcttccaggtgtacgtattggaaataattgtgtgataggcgctggaagcgttgttaaccgagatattcctgataatagcgttgcggtgggtaatccttgtagagtcatcaaatccgtttag

SEQ ID NO: 15712 - protein, 181 aa, Vibrio fischeri ES114
MTEKEKMLAGLPYDAWEETLLNDRMNAKAICHQFNLADPTKLDERMAILSELLCIKDKAHIEPNFFCDYGYNIEIGSNFYSNHNLTIVDVCKVTIGNNVLFGPHVMISTGTHPIDPIERQKTEFGASISIGNDVWLGGNVSVLPGVRIGNNCVIGAGSVVNRDIPDNSVAVGNPCRVIKSV

SEQ ID NO: 15713 - DNA, 552 bp, Vibrio fischeri ES114
  CDS (1)..(552): transl_table=11
atgaccgaatttgaaaaaatgaaaagtggtttggtatttgatggtggtgatcctgaaatagacgctattcgtaaccaaacacaaaagtaccttcaacaatttaatcaaagtacagaaacgaaagaaaagttatctattttaccaaatgtctttaatgcctttggtcagagttttattcaagccccgttcttttgtgaatttggaaagacaatttcaataggaaacgaaacgtttattaatatgaacgtaaccatgctcgatggtgcagaaattacgattggtaataatgtattaattggtcctaatgctcaattttatacggcttcacattctttagattataaaagccgtcgttgttgggaaacctattgtaaaccgattgtcattgaagatgatgtgtgggttggtggtagtgtagtgattaatcaaggcgttactattggggctcgttctgttattgcagcaaattcagtggtgaaccatgatgtgccatctgattgtttgtacggtggaacgcctgccaagttaattaaacgacttgatcaaaaataa

SEQ ID NO: 15714 - protein, 183 aa, Vibrio fischeri ES114
MTEFEKMKSGLVFDGGDPEIDAIRNQTQKYLQQFNQSTETKEKLSILPNVFNAFGQSFIQAPFFCEFGKTISIGNETFINMNVTMLDGAEITIGNNVLIGPNAQFYTASHSLDYKSRRCWETYCKPIVIEDDVWVGGSVVINQGVTIGARSVIAANSVVNHDVPSDCLYGGTPAKLIKRLDQK

SEQ ID NO: 15715 - DNA, 756 bp, Vibrio fischeri ES114
  CDS (1)..(756): transl_table=11
atgaatacattatcaatttatcgttttaaacagtggctaaaagaaggtgagagtccgctagctctgacgctatttcgtatagcgaaatccatccgacattttgagttgccaactcctcgcctgcttaacaaggtactttatgggttgcacaagactctatgtactcaatggcaagcgtttactcaccttattttttatgttccagctttcaaaggtcgtttagaaagttatgggaaacgcacactgctttacggtggcttacccttctttagtggtcctttaacgatgcgcattggtaatgactgccgcatttcagggcaaacgacctttagtgggcgaacgaattcagataatccaaccttagaagtgggagacaatgtcgatatttgttggcaaaccactattgctgtaggcaacaaagttattattggtaacaatgtacgaattgcaggacaaggttttttatgtgggtatccaggacatccaattgatccaactgagcgagctttggggaagcctgatctagatagtcaagtgggcgatattatcttagagcaagacgtatggcttggttctcgagtgagtattatcggcaacgttacggttggtgaaggaaccattgttgcatctggtagtgtcgtaaccaaaagccttccaccttttgtacttgccgccggaaatcctgcaaaagtaatcaaaaaactagatgttaatgcatcaaatacaatcaaagaggaaattcactatgaagcctga

SEQ ID NO: 15716 - protein, 251 aa, Vibrio fischeri ES114
MNTLSIYRFKQWLKEGESPLALTLFRIAKSIRHFELPTPRLLNKVLYGLHKTLCTQWQAFTHLIFYVPAFKGRLESYGKRTLLYGGLPFFSGPLTMRIGNDCRISGQTTFSGRTNSDNPTLEVGDNVDICWQTTIAVGNKVIIGNNVRIAGQGFLCGYPGHPIDPTERALGKPDLDSQVGDIILEQDVWLGSRVSIIGNVTVGEGTIVASGSVVTKSLPPFVLAAGNPAKVIKKLDVNASNTIKEEIHYEA

SEQ ID NO: 15717 - DNA, 522 bp, Bacteroides fragilis NCTC 9343
  CDS (1)..(522): transl_table=11
atgaaaaagttagtttatgatgtacgaaaagatataattccatggaattctcgtattactagaattttattttttttgaataaaataccgtatttgagacttttttcgaaacctttgttgaggaaacagtttaatttatcaaatacagttcaatttaattcgggatttttttgtcatgctccgaaattgaagtgtggaaattatgtaggattatctgatacttttattttggcttatgcagacgtcgttattggtaacaacgtatctttctcttttaggaatatgttaattacgtcaacacatgatgttaatgattttaataaaataatagcttcctcaattgttataggcaataatgtttggataacatcaaatgtaataatactggctggtgttaaaataggagataatacaataataggagcagggagtgttgttacacatgatattcccgcaaatgtatttgcggcaggtaatccatgtcgtgtaataaaaagtataagatttaataagaatgaataa

SEQ ID NO: 15718 - protein, 173 aa, Bacteroides fragilis NCTC 9343
MKKLVYDVRKDIIPWNSRITRILFFLNKIPYLRLFSKPLLRKQFNLSNTVQFNSGFFCHAPKLKCGNYVGLSDTFILAYADVVIGNNVSFSFRNMLITSTHDVNDFNKIIASSIVIGNNVWITSNVIILAGVKIGDNTIIGAGSVVTHDIPANVFAAGNPCRVIKSIRFNKNE

SEQ ID NO: 15719 - DNA, 600 bp, Bacteroides fragilis NCTC 9343
  CDS (1)..(600): transl_table=11
atgaaaacagaattggaaaaatgcttgtcgggcgaatggtatgattgtcatgctcccgtatttatggggtttaaaagaaagacgcatgaattgttgctgaaatacaattcattgccgtatgattataaagaggaaaagtatgcgctattgaaagaaatgtttgaaagcgttggcaagaaagtttcagtagggcattcttttatatgcgattatggctgtaacatcagcataggtaataatgtcagcataaacactggatgcacctttgtggactgcaacaaaatcattatcggcaacaatgtattgatagcccccaatgtgcaaatctatacggctacccaccctgttgaattgaatgagcggctaacaccgacagaaacggaggacgggacagcatatatccgtcacacgtatgccttgcctgttaccattgaggacggttgttggattggcggcggtgtcattatcctgccgggtgttactatcggtcggggaagcgttattggagcgggaagtgttgtcaccaaatccgttccggcaaacagccttgccgtaggaaatccatgtaaagtaattcgggaaatcaatacttccatatag

SEQ ID NO: 15720 - protein, 199 aa, Bacteroides fragilis NCTC 9343
MKTELEKCLSGEWYDCHAPVFMGFKRKTHELLLKYNSLPYDYKEEKYALLKEMFESVGKKVSVGHSFICDYGCNISIGNNVSINTGCTFVDCNKIIIGNNVLIAPNVQIYTATHPVELNERLTPTETEDGTAYIRHTYALPVTIEDGCWIGGGVIILPGVTIGRGSVIGAGSVVTKSVPANSLAVGNPCKVIREINTSI

SEQ ID NO: 15721 - DNA, 630 bp, Bacteroides fragilis NCTC 9343
  CDS (1)..(630): transl_table=11
atggcactgaaagagaaaatcaaacagaatcccgcactgaaacaagctgtacaccgttttattatgcatccggtaaaaacacgtcccaactggtggatacgtatattctctttcctctacctaaaacgtggaaaaggctctgtgatttaccgtagcgtacgccaggatcttcccccattcaatctcttctctctcgggaagtattcggtagtggaagatttttcgtgtctgaacaatgctgtaggcgacctgattatcggggaatatacccgaatcggactgggcaacactattatcggccccgcaaccatcggcaaccatgtaaacctggcacagaatgtaaccgtaaccggcctgaaccataattatcaggacacaggcaagcggatagacgaacaaggagtaagcacacaacccatcacgattgaagatgatgtatgggtaggtgccaattcggtaattttacccggcgtgacactgggcaaacattgcgtagtagctgccggaagtgtagtcagtcgctccatccctccctactctgtctgtgccggcagtccggctaaagtagtcaaacagttcaatccggagagccgaacctgggaaaaaacagtctcaaaaaacggaaagtaa

SEQ ID NO: 15722 - protein, 209 aa, Bacteroides fragilis NCTC 9343
MALKEKIKQNPALKQAVHRFIMHPVKTRPNWWIRIFSFLYLKRGKGSVIYRSVRQDLPPFNLFSLGKYSVVEDFSCLNNAVGDLIIGEYTRIGLGNTIIGPATIGNHVNLAQNVTVTGLNHNYQDTGKRIDEQGVSTQPITIEDDVWVGANSVILPGVTLGKHCVVAAGSVVSRSIPPYSVCAGSPAKVVKQFNPESRTWEKTVSKNGK

SEQ ID NO: 15723 - DNA, 624 bp, Bacteroides fragilis NCTC 9343
  CDS (1)..(624): transl_table=11
atgaaaacagagatggagaaatgcttggccggtgaatggtatgattgccatgctccggtttttctagaactaaaaggaaaaactcaccgtttgttgatgagatacaattcactgtcttatgaacaaaaagaagaaaaatatgcgattctgaaagaaatgttcggtagtatcggaacagaggtttccgtaggacattcttttctctgcgattatggatgtaatattcatattggtgataatgttacggtaaatatgggctgtgtgtttgtcgattgcaataagattacagttggtaataatgtactgattgctcctaatgtccagatttatacggcaacgcatcccattgatttgaatgaacggttaacacctgttgaggcaccggagggagttcgatatgtccgtcatacatttgcccttccggtcactgttgaagatggttgctggatcggtggtggagttattatattgcccggggttactattggtaagggaagtgttattggtgccggaagtgttgttaccacaaatgttcctgcaaacagtctggctgttggaaacccatgtagggtgattcgtcaaatcaataaatctgaaaattatgatccggctggtagcttttga

SEQ ID NO: 15724 - protein, 207 aa, Bacteroides fragilis NCTC 9343
MKTEMEKCLAGEWYDCHAPVFLELKGKTHRLLMRYNSLSYEQKEEKYAILKEMFGSIGTEVSVGHSFLCDYGCNIHIGDNVTVNMGCVFVDCNKITVGNNVLIAPNVQIYTATHPIDLNERLTPVEAPEGVRYVRHTFALPVTVEDGCWIGGGVIILPGVTIGKGSVIGAGSVVTTNVPANSLAVGNPCRVIRQINKSENYDPAGSF

SEQ ID NO: 15725 - DNA, 552 bp, Bacteroides fragilis NCTC 9343
  CDS (1)..(552): transl_table=11
atgacagaaatagaaaaaatgcgtagcggtgaattggcggatatgtcggcacctgaattacaggtgagatttgaacatgccaagaagttattggcacgaatgcggtgcttgagtacgtatgacgaaacttatcggggactacttgaagaattgatacctgatcttccggctacttccgttatttgcccgccttttcattgtgatcatggcgatggcatccgtttgggtgagcatgtatttgtgaatgccaattgtacgttccttgacggagcattcatcaccatcggaagtcatacattgataggtccgtgtgtgcaaatctatactccacatcatccaatggactatctggaacgccgtaaccccaaagagtacgcttatccggtaactattggcgaagactgttggattggtggcggggctgtcatttgtcccggcgtgacgataggtgaccgttgtgtgatcggagccggcagtgtggtgacaaaggatataccggacgattgtgtggcggtaggtaatcctgcacgtgttattaggtgtcggatgtaa

SEQ ID NO: 15726 - protein, 183 aa, Bacteroides fragilis NCTC 9343
MTEIEKMRSGELADMSAPELQVRFEHAKKLLARMRCLSTYDETYRGLLEELIPDLPATSVICPPFHCDHGDGIRLGEHVFVNANCTFLDGAFITIGSHTLIGPCVQIYTPHHPMDYLERRNPKEYAYPVTIGEDCWIGGGAVICPGVTIGDRCVIGAGSVVTKDIPDDCVAVGNPARVIRCRM

SEQ ID NO: 15727 - DNA, 588 bp, Bacteroides fragilis NCTC 9343
  CDS (1)..(588): transl_table=11
atggaaagtgaaaaagaaaaaatgggtacaggcaggctttacgatgctaattatgatacagaattgatagccgaacgtcaggcttgcaaagagttgtgttataccttaaatcatttgcctccctcgcagatagctgaacgggaggccattatccgtcggttgttttgcaagacgaaagaacgttttctgttggaacagcctttttattgtgactatggctataacattgagattggtgaaaatttttatgccaatatgaactgtgtcattctggatgaggctaaagtaacgttcggtgataatgtctttatcgctccatcctgtggcttctataccgcggggcatcctttggatgtggaacagagaaatcgagggttggaatatgcccgtcccattcgtgtcggaaataatgtgtggattggggcacaagtgtgcgtattaccgggcgtgacgattggtgacaacacagtgataggtgcgggaagtgtagtaaatagagatattcctgccaatgtgattgctgcgggtaatccttgtcgcgtgattcgggaaattacggaagaagataaaacaaaatatttattatag

SEQ ID NO: 15728 - protein, 195 aa, Bacteroides fragilis NCTC 9343
MESEKEKMGTGRLYDANYDTELIAERQACKELCYTLNHLPPSQIAEREAIIRRLFCKTKERFLLEQPFYCDYGYNIEIGENFYANMNCVILDEAKVTFGDNVFIAPSCGFYTAGHPLDVEQRNRGLEYARPIRVGNNVWIGAQVCVLPGVTIGDNTVIGAGSVVNRDIPANVIAAGNPCRVIREITEEDKTKYLL

SEQ ID NO: 15729 - DNA, 690 bp, Brucella abortus biovar 1 str. 9-941
  CDS (1)..(690): transl_table=11
atgatgaaccgatacaggactgccgggcaatatgcaaaaatttcagaaagctatgaaatgacgcagggcgacgacctccgtttccagaacggcgagccgcatattcattcgaccgcgcagctcaaatccgtcaagctggggcgctatgccgatatcggggaacgggtgatcctgcgtgaagtaacggtgggtgatttcacctatttcgagcgcaatggcgaggggatttatgccgaaatcggcaagttctgctccattgccgccaatgtgcggatcaatgcgcttgaacatccgatggagcggctcaccacgcataaggtgagctaccggcccaacgaatatttccgctatcttggcgttgatggcgattttcgcgccagacggcaggcaaggcgggtcgtgatcggcaatgatgtgtggatcggccatggcgcggttatcacgccgggcgtggtgattggccatggtgcggtgatcggggccaatgcggtggtgacaagggatgtcgcaccctatttagtggtgggcggcgttccggcgcggcttatccgcaaacggttcagcgatgcggtgatcgcgcgcctgcttgcgctttcctggtgggactggcctgtggaaaagctctatgaggctgttcccgatatgcaggcgcttgagatcgaggcgtttttggaaaagtggggcggatga

SEQ ID NO: 15730 - protein, 229 aa, Brucella abortus biovar 1 str. 9-941
MMNRYRTAGQYAKISESYEMTQGDDLRFQNGEPHIHSTAQLKSVKLGRYADIGERVILREVTVGDFTYFERNGEGIYAEIGKFCSIAANVRINALEHPMERLTTHKVSYRPNEYFRYLGVDGDFRARRQARRVVIGNDVWIGHGAVITPGVVIGHGAVIGANAVVTRDVAPYLVVGGVPARLIRKRFSDAVIARLLALSWWDWPVEKLYEAVPDMQALEIEAFLEKWGG

SEQ ID NO: 15731 - DNA, 690 bp, Chloroflexus aurantiacus
  CDS (1)..(690)
atgcgacaacgactggtacggctctggactgactggtggatgcggcaggccggccctgggcgctgggggaaagtggcgacatggctggcagcgtggccgcacgcgccatacaaagcacgggtcgcgctcgctcatcactatccacagggctatgtttcgccatcggcccaattgagtggtcgtcgtatccgccgagggcggcatgtctttatcggcgacggcgttgtgatctatcagcgtcaggatggcggccagattgatctgggtgattacgtagaactccaccgcgatacgatcatcgaatgtggtcgtggtggtagtctgcgaatcggcgaacgaaccggtattcagccccgctgtcaactatcggcgtatattgaacagattgtcatcgggcgtggctgccagattgcaccacaatgtgcattctacccctacgaccacggtacagcacccggtcagccgatagggagccagcccctgactagcaaggggcctatcgtgctggaagatgatgtctggttgggttacggggttgtggtgctgtcgggggtcacgattggtagcgggacggtggtgggagccgggagtgttgtaacccgcagtctgccggcaggggtgattgccgccggtattccggcgcgtattgtacgtgagcgaactgagcaggatgtggaacgtacgaggtga

SEQ ID NO: 15732 - protein, 229 aa, Chloroflexus aurantiacus
MRQRLVRLWTDWWMRQAGPGRWGKVATWLAAWPHAPYKARVALAHHYPQGYVSPSAQLSGRRIRRGRHVFIGDGVVIYQRQDGGQIDLGDYVELHRDTIIECGRGGSLRIGERTGIQPRCQLSAYIEQIVIGRGCQIAPQCAFYPYDHGTAPGQPIGSQPLTSKGPIVLEDDVWLGYGVVVLSGVTIGSGTVVGAGSVVTRSLPAGVIAAGIPARIVRERTEQDVERTR

SEQ ID NO: 15733 - DNA, 564 bp, Chloroflexus aurantiacus
  CDS (1)..(564)
atgaaagagcgtatctatcagaaagtattacgtgtattaggcgaggagttaggagctgcccaaccacgactctggcttgccggatggctgatccacctactgccacgctataccgcttcacggctgcgtccggtgctgctaaggctggccggttttcggattggttacggtaccgttatcgttggaccactcaggcttcacggctttgggggaatccacaacaggcttcagatcggatcacactgtttcatcaacaccgattgtttcttcgatttgaatgatcacattactattgccgattacgtaagtcttgggcatgaagtcatgattctcaccacgtcacatcagatcagtagtgctgcacatcgagccggttcgctaactaaagcgccggttgtgatcgagaacggagcatggatcggtgcccgcgctctaatcctccccggtgtgcgaattggtgccggtagtatcgtcgctgccggtagtgtcgtgaatcggtcggtaccgcccaatacgctggttggtggtgttccggctaagccaattcgtcagcttgatgagtga

SEQ ID NO: 15734 - protein, 187 aa, Chloroflexus aurantiacus
MKERIYQKVLRVLGEELGAAQPRLWLAGWLIHLLPRYTASRLRPVLLRLAGFRIGYGTVIVGPLRLHGFGGIHNRLQIGSHCFINTDCFFDLNDHITIADYVSLGHEVMILTTSHQISSAAHRAGSLTKAPVVIENGAWIGARALILPGVRIGAGSIVAAGSVVNRSVPPNTLVGGVPAKPIRQLDE

SEQ ID NO: 15735 - DNA, 615 bp, Lactobacillus gasseri
  CDS (1)..(615)
atggaagaaaatactaaaaaaatgctcgccggtttaccatatcgtccagatactaaagagttaagtagaatttcaatgaaggcccatcgcttaagcagggattataatcaaactgccgatgaagataaagaagtcagaaaagcaattattgatgaactttttccagaccatgaaacaggagtatatttacaaggaccaattgaggttgactatggaaaatttactaaactaggtaaaaatttctatgccaatttcaacttaactattttagatacttgccctgtaacgataggtgataatgtaatgtgcggtccaaatacctcattagtaactccgcttcatcccttattacctgagcagcgtaatgcacgtcttcaaaaagatggaaaaattgctgatatcgaatatggtgctcccattacaattggcgataactgctggttagcaagtaatgtaactgtttgtcccggtgtaactattggtaagaattgtgttatcggggcagggagcgtagtaactaaagatatcccagataattcacttgtcttaggagttccaggtcgggtagtaagaaaaatcactgaaaaggatcgcttagataattatccctactaa

SEQ ID NO: 15736 - protein, 204 aa, Lactobacillus gasseri
MEENTKKMLAGLPYRPDTKELSRISMKAHRLSRDYNQTADEDKEVRKAIIDELFPDHETGVYLQGPIEVDYGKFTKLGKNFYANFNLTILDTCPVTIGDNVMCGPNTSLVTPLHPLLPEQRNARLQKDGKIADIEYGAPITIGDNCWLASNVTVCPGVTIGKNCVIGAGSVVTKDIPDNSLVLGVPGRVVRKITEKDRLDNYPY

SEQ ID NO: 15737 - DNA, 606 bp, Magnetospirillum magnetotacticum MS-1
  CDS (1)..(606)
atggccgagctggccgccacggacgaggacctccgcagcctgctctccggcgggtggctgcgctaccgcacgtcgcccgcgctgcaggagctgacccgcgacgcgcacgcgacgtgcgaccgcatcgggcgcgtgtacttcgaggacgtcgacgaggcacgccgcctcttccaccggctcgtccccggcgccgaggaggggatcgacttccgcccgccgctgacgatcgactacggcgaccggctgctgatcggcgcgcgcaccttcatcaacgccgacttcatggtcatcggcggcggcctcgtcacgatcggcccggactgcctcatcggcccgcgctgctcgatctacacgccgaaccacgccgaggacgtcgtccgtcgccgcgagggctgggagcgccccgagcccgtcacgatcgggagcaacgtgtggatcggcggctcggtcaccctcacgcccggcgtgacgatcggcgacgacagcatcatcggggcgggatccgtggtcacgcgggacatccccgcgggcgtcgtcgcggtgggcaacccgtgccgacccgcccgcgcgatcacgacggaccccgcggacaccaccgcccgctga

SEQ ID NO: 15738 - protein, 201 aa, Magnetospirillum magnetotacticum MS-1
MAELAATDEDLRSLLSGGWLRYRTSPALQELTRDAHATCDRIGRVYFEDVDEARRLFHRLVPGAEEGIDFRPPLTIDYGDRLLIGARTFINADFMVIGGGLVTIGPDCLIGPRCSIYTPNHAEDVVRRREGWERPEPVTIGSNVWIGGSVTLTPGVTIGDDSIIGAGSVVTRDIPAGVVAVGNPCRPARAITTDPADTTAR

SEQ ID NO: 15739 - DNA, 702 bp, Leuconostoc mesenteroides subsp. mesenteroides ATCC 8293
  CDS (1)..(702)
atggctgaaaacgaagcacaaaaactaattaatttcattgcaaatgcaaaaaaaattaccccagtaaaagttacatataaaggtacattggcaactgaagtgccagatactgtgcaacaatttggagatgagtcatttggacaattaattggcgactggtctgaaattgaattgttaattaagaatctaccatcagaagatgtatttattgaaaatgattcacgtaactctgccgttcctttgcttgataaaaaagaaattaatgctcgcattgaaccaggtgccattattcgcgatcaagttgaaattggtgacaatgcggtgattatgttgggcgcagtgattaatattggtgcagagattggtgctaacacaatgattgatatgggtgctgtacttggcggccgtgccattgttggtgaaaattctcatattggtgctggcgcggtattagctggtgtgattgaaccagcatctgcccaacctgttcgcatcggaaataacgttctagttggcgctaatgccgtcgttattgaaggcgtacaggtcggtgacggcgcagtagttgcggctggagcgattgtcacaaaggatgtaccagccaatacagtagttgcgggtgttcctgcaaaagtcattaaggagattgattcgaagacgcaacaaaagactgcgttaattgacgcattgcgaggcttataa

SEQ ID NO: 15740 - protein, 233 aa, Leuconostoc mesenteroides subsp. mesenteroides ATCC 8293
MAENEAQKLINFIANAKKITPVKVTYKGTLATEVPDTVQQFGDESFGQLIGDWSEIELLIKNLPSEDVFIENDSRNSAVPLLDKKEINARIEPGAIIRDQVEIGDNAVIMLGAVINIGAEIGANTMIDMGAVLGGRAIVGENSHIGAGAVLAGVIEPASAQPVRIGNNVLVGANAVVIEGVQVGDGAVVAAGAIVTKDVPANTVVAGVPAKVIKEIDSKTQQKTALIDALRGL

SEQ ID NO: 15741 - DNA, 561 bp, Nostoc punctiforme PCC 73102
  CDS (1)..(561)
atggaaaaaaccgaaaaacagaaaatgctcgcaggcgaattatatctggcggaagatccagaattggctgccgaaaataaacgagctagtcgtctgttgcgaaggtacaattctacaactgaagaacagcaagatcaacggcagcaaattttgcaagagttatttggaaacataggtgacaaagtatcaattgtgccaccatttcactgtgattatggtggtaatattttcgtcggcgacaaattttatatgaactatggctgtgtaattttagactgcaatccagttcacattggtgaaaatgtcctgtgcgctccttatgtacaaatttatactgcttatcatcctacagagccagaaattcgcctttctggtagagaattagctgccccaattaacattggtaataatgtctggattggtggcagtgcaattatttgtccaggtgtcacgattggtgataacacaaccattggtgctggcagtgtggttgtcaaagatatacctgagaatgttgtcgctgcgggtaatccctgccgcgtcattcgatatttatcctag

SEQ ID NO: 15742 - protein, 186 aa, Nostoc punctiforme PCC 73102
MEKTEKQKMLAGELYLAEDPELAAENKRASRLLRRYNSTTEEQQDQRQQILQELFGNIGDKVSIVPPFHCDYGGNIFVGDKFYMNYGCVILDCNPVHIGENVLCAPYVQIYTAYHPTEPEIRLSGRELAAPINIGNNVWIGGSAIICPGVTIGDNTTIGAGSVVVKDIPENVVAAGNPCRVIRYLS

SEQ ID NO: 15743 - DNA, 594 bp, Nostoc punctiforme PCC 73102
  CDS (1)..(594)
atgaaagagatcaaaaataaaattacaaataaattagagcgattattggaacaatggttagtacctcgtctagtacgctggggagaatatctagaaactaaaattaggcgctacaagcatcaagaactcaagagtaaattaaaattttctggctcaggtctacgatttaagcgagatattaaaattgaccatccgcaaaatgtgtctctgggaaataaagtctatatcggcccggatgtcttcttagatggacgtggtggaatcacaattggcgacaataccacactcggatttaatgttattattctctctgcaaaccacgactatcaaagtaatgatttgccttatgaacataatgtctacattcataaacctgttgtcattggccgcaatgtttggattggcggaaatgttctaattattccgggagttactattggagatggtgcaattgtggcggctggtactgttgtaactgcgaatgttgaacctttagcaattgttggaaatcaaccgatgagaacaattaaataccgcgacaaggaacattatgaaaaactcgctaacaagcaagagaatcaggatatctcataa

SEQ ID NO: 15744 - protein, 197 aa, Nostoc punctiforme PCC 73102
MKEIKNKITNKLERLLEQWLVPRLVRWGEYLETKIRRYKHQELKSKLKFSGSGLRFKRDIKIDHPQNVSLGNKVYIGPDVFLDGRGGITIGDNTTLGFNVIILSANHDYQSNDLPYEHNVYIHKPVVIGRNVWIGGNVLIIPGVTIGDGAIVAAGTVVTANVEPLAIVGNQPMRTIKYRDKEHYEKLANKQENQDIS

SEQ ID NO: 15745 - DNA, 702 bp, Nostoc punctiforme PCC 73102
  CDS (1)..(702)
atgcctaacgagcaatatttttcaaaattgcagcgtgtgcaagaacttgtagtaactactgtgttaggggatcttcctgcacttcttctggggccaaagttgcgtagtttaggatatgggagtatttttgcccaaataggcagcccaatttatattcaaaatggtgttgaatttaacggtacttcttgtattgagataggcagtggagtctatattttcaagggtgtacggatggatgctagaggacacaaaaataataaaattcatctaggcaatagagtagctattgagcgtaacgttgatatagggtgtttgaaagatacgtgtatacatattgatgaagacaccttcattgctcccaacgtgtgtattgaggggccaggagacattaaaattggcaaacactgcatgattgctgcccactccgggatatatgccaataatcataattttgccgatccgatggagctaattaaataccaaggtgttactcgcaagggaattgtgattgaagatgactgttggctaggtcatggagtaacggtattagatggcgttaccatcggcaaaggtagtgttattggtgcaggagcagttgtcaataaagatattcctcctttctccgttgctgtaggtatacctgcacgagtagtcaaaaaccgaattagtaaagacctagcaaaagttcaaactgagaaatag

SEQ ID NO: 15746 - protein, 233 aa, Nostoc punctiforme PCC 73102
MPNEQYFSKLQRVQELVVTTVLGDLPALLLGPKLRSLGYGSIFAQIGSPIYIQNGVEFNGTSCIEIGSGVYIFKGVRMDARGHKNNKIHLGNRVAIERNVDIGCLKDTCIHIDEDTFIAPNVCIEGPGDIKIGKHCMIAAHSGIYANNHNFADPMELIKYQGVTRKGIVIEDDCWLGHGVTVLDGVTIGKGSVIGAGAVVNKDIPPFSVAVGIPARVVKNRISKDLAKVQTEK

SEQ ID NO: 15747 - DNA, 675 bp, Bifidobacterium longum DJO10A
  CDS (1)..(675)
atgatgaccgaagacaagccgatcgccaagccgattatcgatgatgcgacgcgcgagaaaatggcgcttatgttctctggcgaggtctacctgccggatgatgtggacggcttttttgatctgcaggccgcccagcgtgatctccagctcgaactcaacgccacgccgctgaccaacccgaagcgccgtaccgaactcatgcaggcgttcttcggcgcggcgggggagggtctgtacctcgaatgcccggtgtatgcgaactggggctgcaatacttattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgccagtccacatcggcgagaacgtctggatcggcgcgaatgtcaccgtgctgcccgggggcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtag

SEQ ID NO: 15748 - protein, 224 aa, Bifidobacterium longum DJO10A
MMTEDKPIAKPIIDDATREKMALMFSGEVYLPDDVDGFFDLQAAQRDLQLELNATPLTNPKRRTELMQAFFGAAGEGLYLECPVYANWGCNTYWGERCYANFNLTLVDDGEIFIGSHTMIGPNVTLVATGHPVRPDLRYQGAQYSLPVHIGENVWIGANVTVLPGGTIGDNAVIGANSLVTKDIPANTVAYGSPCKVIREINERDDVYYWRDRQFSERFKLKEQ

SEQ ID NO: 15749 - DNA, 633 bp, Bifidobacterium longum DJO10A
  CDS (1)..(633)
atggcgcacgatctcgaacaactcaagcaagatcacccggatgtggcgaaactgttcgccgatgactggttgcagtaccgtaagtcggagattttgccggaacttacgcgcgaggcgcagtccacgtgcgaccgcatcaatcgcatctactttgaagacaccgccgaagctgagcgactgttccgcgaactcgtgcccgaggccggcgagggcgtggacttccgcccgccaatccggcttgattacgggctgggcctgaaaatcggagaccgtacgttcatcaacatggacctgctgattgtgggcggcggcccgatctccatcggctccgattgcctgatcggcccgcgcgtgagcatctatacgccaaaccacgccatcgcccgcaagcctcgactggaaggctggcagcacaacgccgacgtgaccatcggcaacaatgtgtggctgggcggcaatgtggtgatctgccccggcgtcaccatcggagacaactcgattatcggtgcgggcgcagtcgtcacccacgacattcccgccgattccatcgctgtgggcaatccgtgccatgtgattgccgaagtcccggatgactggactcctgaagagcgggccgctgccgagggtcggtag

SEQ ID NO: 15750 - protein, 210 aa, Bifidobacterium longum DJO10A
MAHDLEQLKQDHPDVAKLFADDWLQYRKSEILPELTREAQSTCDRINRIYFEDTAEAERLFRELVPEAGEGVDFRPPIRLDYGLGLKIGDRTFINMDLLIVGGGPISIGSDCLIGPRVSIYTPNHAIARKPRLEGWQHNADVTIGNNVWLGGNVVICPGVTIGDNSIIGAGAVVTHDIPADSIAVGNPCHVIAEVPDDWTPEERAAAEGR

SEQ ID NO: 15751 - DNA, 609 bp, Desulfovibrio desulfuricans G20
  CDS (1)..(609)
atgctgccgcgtcctgaaacgctctgcctgcgcgctgcgctgcgcgacaacgccgaagaactgtggacatggcttgcagccgtgccgcccaccgcagcgggcaccctgctgcgtatggccatgctgcggccgctgttcggcagcggcgcgccccgtatgggaacaggctgcctgctgcggggctgccgcaacatgcactttgcgcagcaggtgcgcatcatgccgcgctgcagcctgtacgcccgcggcggcagcatcagcatcggcagccgcacggcactcaacagcggggtatttgtggacgccgaagacggcggtaccataaccataggcagcgactgcggcatagggcccggcaccgtcatccgtgcggcaaaccacaggttcggcaaagccggtattcccatcagcatgcaggggcacaggccgggccgcatagtcatagaggatgacgtctggataggcgccaactgcaccattttgcccgatgtacgcataggcaccggcgcagttgtgggcgcaggagcagttgtgacgcgcgatgtgcccccccataccgtggccaccggcgtaccggcgcgtgtcaccggcagccgctccgaccgctga

SEQ ID NO: 15752 - protein, 202 aa, Desulfovibrio desulfuricans G20
MLPRPETLCLRAALRDNAEELWTWLAAVPPTAAGTLLRMAMLRPLFGSGAPRMGTGCLLRGCRNMHFAQQVRIMPRCSLYARGGSISIGSRTALNSGVFVDAEDGGTITIGSDCGIGPGTVIRAANHRFGKAGIPISMQGHRPGRIVIEDDVWIGANCTILPDVRIGTGAVVGAGAVVTRDVPPHTVATGVPARVTGSRSDR

SEQ ID NO: 15753 - DNA, 558 bp, Desulfovibrio desulfuricans G20
  CDS (1)..(558)
atggatgtgactgaaaaggaaaaaatgatcgcggggcagttgtataatgccggcgacgcggagctgacagcgctgaggctggcgtgccgcaggctgctgcactcgtttaatcatgcgcatcctgacaatgccgcggatgcggccggtgtgctggcgcagctgttgggcggtagcggggcaggtctgcagattatgccgccgtttcattgcgattacgggttcaatattaccgtaggctgcaatgtcttcatgaattataattgtatcattctggatcccgcaccggttcacatcggcgacaatgtcatgttcggcccgtctgtgtcgctgtatactgcaacgcaccccgcagatgctgccaagcggcttgaagggccggagctggggcttgccatcagcgtgggggacaatgcgtggataggcggggcagctatcatctgtcccggtgtgcaggtgggccgcaacgccgttgtcgccgcgggcgcggtagtaaccagagacgtgccggacaatgtggtggtggcaggcaatccggcgcggataatcaggcagctgtag

SEQ ID NO: 15754 - protein, 185 aa, Desulfovibrio desulfuricans G20
MDVTEKEKMIAGQLYNAGDAELTALRLACRRLLHSFNHAHPDNAADAAGVLAQLLGGSGAGLQIMPPFHCDYGFNITVGCNVFMNYNCIILDPAPVHIGDNVMFGPSVSLYTATHPADAAKRLEGPELGLAISVGDNAWIGGAAIICPGVQVGRNAVVAAGAVVTRDVPDNVVVAGNPARIIRQL

SEQ ID NO: 15755 - DNA, 576 bp, Anabaena variabilis ATCC 29413
  CDS (1)..(576)
atgatttttgctcacataggcagtcctgtatatattcaacatggagtagaatttaccaacgcttctaatattgaaattggcaatagtgtacatctatttaaaggtgtacgtcttgatgctaaagggcatccaaacaatagaatttatttggcagatggagtggcaattgagcgcaacgttgatatagggtgtctggaaaatacgtgtattcacattgacgtggaaactttcattgcttctgatgtttgtatttctgggccaggagacatcacaattggtaagcgttgcatgattgctgctcattcaggtatatatgctaacaatcacaactttacagatccgatattgccgattaaataccaaggtgttacttgtaaagggatcgtgattgaggatgattgttggctaggacatggagtaacggtattggatggtgtgaccattggtaaaggaagtgtcattggtgcaggggcagtcgtcaccaaagatattcccccattctccgtagctgtaggcgcacctgcacgagtaattaaaagccgtgttgcccaggatttagttacatctggagattag

SEQ ID NO: 15756 - protein, 191 aa, Anabaena variabilis ATCC 29413
MIFAHIGSPVYIQHGVEFTNASNIEIGNSVHLFKGVRLDAKGHPNNRIYLADGVAIERNVDIGCLENTCIHIDVETFIASDVCISGPGDITIGKRCMIAAHSGIYANNHNFTDPILPIKYQGVTCKGIVIEDDCWLGHGVTVLDGVTIGKGSVIGAGAVVTKDIPPFSVAVGAPARVIKSRVAQDLVTSGD

SEQ ID NO: 15757 - DNA, 561 bp, Anabaena variabilis ATCC 29413
  CDS (1)..(561)
atggaaaaaaccgaaaaacaaaaaatgcttgcaggtgaattatacctagcagatgatccagaattagcagccgagagtaaacgagctagtcgcctgttgcgaatgtataacgccacaaccgaggaacaaccagaacaacgcaggcaaattttacaagaattatttgcccagataggcgaaaaaatcaccatagtaccgccgcttcattgtgattacggtagcaatatctacgtaggtaatggagtatatatgaactatggctgtgtaattttagattgcaataaggtagaaatcggggataatgtcttgttcgcgccctacgtgcagatttatactgcctaccatcccacagaaccggaaattcgcctatctggaagagaattagctgccccaattaaaattggtaataacgtctggattggtggtggtgtaattatttgtcctggggtaacaattggggacaatacaacaattggggctgggagcgtagttgtaaaagatatccctgctaacgttgtagcggttgggaatccttgtcggataattcgcaatttaacctaa

SEQ ID NO: 15758 - protein, 186 aa, Anabaena variabilis ATCC 29413
MEKTEKQKMLAGELYLADDPELAAESKRASRLLRMYNATTEEQPEQRRQILQELFAQIGEKITIVPPLHCDYGSNIYVGNGVYMNYGCVILDCNKVEIGDNVLFAPYVQIYTAYHPTEPEIRLSGRELAAPIKIGNNVWIGGGVIICPGVTIGDNTTIGAGSVVVKDIPANVVAVGNPCRIIRNLT

SEQ ID NO: 15759 - DNA, 576 bp, Actinobacillus pleuropneumoniae serovar 1 str. 4074
  CDS (1)..(576)
atgcaatacgctgttgatttacctatgaatagtttgattgctaagggtagtcaaatttttgaagatattcatcgaattgtagcagaaaatgccccgaaaattgccgaattatcaggaaagtttcaaacacaagctgaaatccaacgtctattgagcgaaattacccaatcgcatattgatgaaactttacacgttaatttgccgttatattgtgatttcggtcgtcatcttcgcattggtaaaaatgtatttattaataccgcttgtgtgtttaccgacttgggagggattacacttgaagataatgttttgcttgccccgagagtaaatattattacggttaaccacccaacggatccgaaaactcgtcgtggtgtgatcgccaaacctgtaataattaagcaaaatgcttggattggtgctggagctacgattttacctggtgttacggttggtgaaaatgcgattgttgcggcaggtagtgtggttactaaagatgtaccagcaaatacgcttgttgcgggagtaccagctaaaatcatcaaaatgattgatgaggttagcgatgaaaattaa

SEQ ID NO: 15760 - protein, 191 aa, Actinobacillus pleuropneumoniae serovar 1 str. 4074
MQYAVDLPMNSLIAKGSQIFEDIHRIVAENAPKIAELSGKFQTQAEIQRLLSEITQSHIDETLHVNLPLYCDFGRHLRIGKNVFINTACVFTDLGGITLEDNVLLAPRVNIITVNHPTDPKTRRGVIAKPVIIKQNAWIGAGATILPGVTVGENAIVAAGSVVTKDVPANTLVAGVPAKIIKMIDEVSDEN

SEQ ID NO: 15761 - DNA, 501 bp, Burkholderia cepacia R18194
  CDS (1)..(501)
atggtggccgaggtcaagcgggcgatgtcgatcgccgtgcggatcaatcgcctgacattcgacgatgccgccgaggttcgcacattattcggagaactgatcggcacgcaggtggacgacggcttcgtgttgatcccgccgttccatgcgacaggcggcaccggcatgaaaatcgggcgcaacgtgttcgtcaaccagaactgcacgttctacgatctcggcgggctcgagatcggcgacgacgtgatgatcgggccgaacgtcagcctcatcacgtccggccatcccgtcgagccttcgcggcggcatgacgccgttatcgcgaagccgatcgtgatcggacggaacgtctggatcggcgccggtgcgacgatcatcggcggtgtgacggtaggcgagaattcggtggtcgcggccggtgccgtcgtcacgcgggatgttccaccgaacgtgttggtcggcggcaatccggcagcggtcattcggtcgatcgacgagtaa

SEQ ID NO: 15762 - protein, 166 aa, Burkholderia cepacia R18194
MVAEVKRAMSIAVRINRLTFDDAAEVRTLFGELIGTQVDDGFVLIPPFHATGGTGMKIGRNVFVNQNCTFYDLGGLEIGDDVMIGPNVSLITSGHPVEPSRRHDAVIAKPIVIGRNVWIGAGATIIGGVTVGENSVVAAGAVVTRDVPPNVLVGGNPAAVIRSIDE

SEQ ID NO: 15763 - DNA, 609 bp, Burkholderia cepacia R18194
  CDS (1)..(609)
atgaaaagcaggatcaaggcccgcctgctagcgtcgtcgacgtatttttttctggccgcgctcaagtactacatcggcaacaacttcattgcgcgcatgccgattgaaagcgtccgcaacttctactatcgacgcgtgctgggtatcgtcatcggccaacgaacgcacgtcagcatgcggcagttcttcaccgggtaccacacacgctgcaacgtgcgcatcggcgacaactgcgtgctcaatcgtgagatctacctggacggtcgcacgggcatcgagatcggaaacaacgtcaacatctcgttccagtgctgccttctcagcctgcatcacgatcacaaccaccctggtttcatgtcgatcggcggcgtcgtgaccatccacgaccacgcatggctgggcgcgcgcgccattatcctgccaggtgtaacgatcggcaaaggcgcagtcgtcgcagccggcgcggtcgtcacgaaggacgtcccggatttcaccgtagtcggtggtgtgcctgcaaaaatcatcggtcaacgcaatcccgacattgcctatctgaccgacttttctcctttcttcgacaccgacgtgtttgacgaatcccgtggctaa

SEQ ID NO: 15764 - protein, 202 aa, Burkholderia cepacia R18194
MKSRIKARLLASSTYFFLAALKYYIGNNFIARMPIESVRNFYYRRVLGIVIGQRTHVSMRQFFTGYHTRCNVRIGDNCVLNREIYLDGRTGIEIGNNVNISFQCCLLSLHHDHNHPGFMSIGGVVTIHDHAWLGARAIILPGVTIGKGAVVAAGAVVTKDVPDFTVVGGVPAKIIGQRNPDIAYLTDFSPFFDTDVFDESRG

SEQ ID NO: 15765 - DNA, 528 bp, Listeria monocytogenes str. 4b H7858
  CDS (1)..(528): transl_table=11
atgtatgatcctagcgacagagagctcgcacacggaagaaatcgtgcacgtaagttctgcagagagattaacgatgcgatggattcagagtcccgtgcaagcgtgctgaagcgcctattcggcggaacaaaagagaatgtatatgtggaacctgattttcgtgttgattacggttctaatatatatgtaggcgaaaatttttatgctaattttgattgtgttattttagatgtttgcgaagtacatattggtgataattgtatgatggcgcctggagttcatatttatacggcaacgcatccgcttgatccagtagaacgtaatagtgggctagagcttggtaaaccagttgaaattggcgataatgtttggattggtggtcgggcaattattaatccaggggttaagcttggaaataatgtcgtggttgcttcaggcgcagttgtaacgaaaagcttccccgataatgtcgttcttgccggcaacccagcacgcgttattaaaacaattgaggttgaggaaaaatga

SEQ ID NO: 15766 - protein, 175 aa, Listeria monocytogenes str. 4b H7858
MYDPSDRELAHGRNRARKFCREINDAMDSESRASVLKRLFGGTKENVYVEPDFRVDYGSNIYVGENFYANFDCVILDVCEVHIGDNCMMAPGVHIYTATHPLDPVERNSGLELGKPVEIGDNVWIGGRAIINPGVKLGNNVVVASGAVVTKSFPDNVVLAGNPARVIKTIEVEEK

SEQ ID NO: 15767 - DNA, 570 bp, Listeria monocytogenes str. 4b H7858
  CDS (1)..(570): transl_table=11
atgatagaacaagatttacagaaaagactagtcggccaagaaattctccaagggtcggatttgttagatgaaattcacaaagtaaagcaaaacaatgaacaacttatcatcgaactaaacaccaagtaccactcaaaaaaagaagtgattaaatatctcagtgacatcactggaaaaccagtcgatccatcagtcgatgtctcacttcctttttatagcgacttcgggaaacatattacttttgggaaaaatatctttatcaatttaaatgtaactttcgtggatttgggtgggattacaattgaagataatgttttaattggcccaggagcaagacttgtgaccgtcaaccatttagttagcccgaaaaaaagacgtggcttaagagtagccccaatttgtgtgaagaaaaacgcctggattggcgcaaacgcaacgatattatcaggcgtaacaatcggcgaaaatgctatcgttgctgcggatgctaccgtcacaagagatgtcccagcaaacgttatcgtcgccggaagcccagccaaacaaattcgtaaaattatcgaggaataa

SEQ ID NO: 15768 - protein, 189 aa, Listeria monocytogenes str. 4b H7858
MIEQDLQKRLVGQEILQGSDLLDEIHKVKQNNEQLIIELNTKYHSKKEVIKYLSDITGKPVDPSVDVSLPFYSDFGKHITFGKNIFINLNVTFVDLGGITIEDNVLIGPGARLVTVNHLVSPKKRRGLRVAPICVKKNAWIGANATILSGVTIGENAIVAADATVTRDVPANVIVAGSPAKQIRKIIEE

SEQ ID NO: 15769 - DNA, 564 bp, Bacillus cereus G9241
  CDS (1)..(564): transl_table=11
atgaaaacggagaaagaaaagatggtggcaggagaaatgtatattgcggatgacgaagaattggtggctgatagggtggaggcaaaacgtttaacacgcctttataacgaggcgatggagacaggagatgagaggcgttttacgttgttaaatcagcttttaggttcttcagctgatgggaaatcccaaattaatcctgattttcgttgtgattacggctacaatatccatgttggaaagggctttttcgcaaatttcaattgtgtgattttagatgtttgtgaagttcgaatcggtgataattgtatgtttgcacctggtgtccacatttacactgctacacatcctttacacccagtagagcggaattctggcaaagaatatgggaagcctgtaaagattggtaacaatgtttgggttggcgggggcgctattattaaccctggtgtttcaattggagataacgctgtaattgcttcaggggcagttgtgacaaaagatgtacctaataatgtagtagttggtggtaacccagctaaagttattaaaacgatagacttatag

SEQ ID NO: 15770 - protein, 187 aa, Bacillus cereus G9241
MKTEKEKMVAGEMYIADDEELVADRVEAKRLTRLYNEAMETGDERRFTLLNQLLGSSADGKSQINPDFRCDYGYNIHVGKGFFANFNCVILDVCEVRIGDNCMFAPGVHIYTATHPLHPVERNSGKEYGKPVKIGNNVWVGGGAIINPGVSIGDNAVIASGAVVTKDVPNNVVVGGNPAKVIKTIDL

SEQ ID NO: 15771 - DNA, 558 bp, Bacillus cereus G9241
  CDS (1)..(558): transl_table=11
atgaaaacagaaaaagaaaagatgatactaggcgaaatgtacataccagctgatccagttttagttcaagagagggagcaagctcgtatactaacgagaaaattaaatgaaacgccaaaagtacaattaaaagagcgtagcgaaatcgtaaaagaactattcggaacgactggagataatattcatcttgaatcttcttttagatgtgattatggatataacattcacgtgggcgaaaatttttacgcgaactttgactgtaccattttagatgtatgtccagtaacaatcggagtgaactgtatgttagctccaggtgttcacatttatacagcaacacatccgcttgatccagtagagcgcataagcggattagaatacggaaaaccagtaacaattggtgataacgtatggattggcggaagagcgattattaatccaggtgtaacaattggagacaatgcggtgatcgcatctggcgccgttgtaacgaaagatgtgccggacaatgtagtagttggcggaaatcctgcaaagattattaaaaaaataaaataa

SEQ ID NO: 15772 - protein, 185 aa, Bacillus cereus G9241
MKTEKEKMILGEMYIPADPVLVQEREQARILTRKLNETPKVQLKERSEIVKELFGTTGDNIHLESSFRCDYGYNIHVGENFYANFDCTILDVCPVTIGVNCMLAPGVHIYTATHPLDPVERISGLEYGKPVTIGDNVWIGGRAIINPGVTIGDNAVIASGAVVTKDVPDNVVVGGNPAKIIKKIK

SEQ ID NO: 15773 - DNA, 588 bp, Burkholderia fungorum LB400
  CDS (1)..(588)
atgaaccggatcttgctggcctggtatcggctcaagacccgcttctggtacgcccacgtgttcgagtcgatcggcgcgaagacgacgatcttccgtcccatgctgctcgtcaacgtgcagtacgcgtcgcttggcgagcgtgtgctgatccggcccggcgcgcgcatcgaacttgtcgtgacggacccggccgcgccaccacggctcaccataggcagccgggtcaatatcgagcagaacgttcacatcgtatgcgggtcatcgatcgagatcggcgacggtgtgacgattacgggcaacgtcgccattgtcgacgtcgaacatccctacgaggacgtcaacgaccccacgcgcattggcgaccggattcgcacgcggggcaattacgtgcggatcgggcagggcgcattcatcggctttaacacaatcgttctgccgaacgtgaagatcggccgccacacggtggtgggcgcgcattcagtagtgactcgcgatgttcctgattactgcgtggtctcgggaaatcccgcgcggatcatgaagcgctacaacttcgaaacgcaatgctgggaaagggagaagcaatga

SEQ ID NO: 15774 - protein, 195 aa, Burkholderia fungorum LB400
MNRILLAWYRLKTRFWYAHVFESIGAKTTIFRPMLLVNVQYASLGERVLIRPGARIELVVTDPAAPPRLTIGSRVNIEQNVHIVCGSSIEIGDGVTITGNVAIVDVEHPYEDVNDPTRIGDRIRTRGNYVRIGQGAFIGFNTIVLPNVKIGRHTVVGAHSVVTRDVPDYCVVSGNPARIMKRYNFETQCWEREKQ

SEQ ID NO: 15775 - DNA, 555 bp, Thermobifida fusca
  CDS (1)..(555)
atggcagggcagaaggaacgcatgctcgcaggcgaactgtacattgccgacgatcctgagctggcggctgacctgcggcgggcgatgaagctgatggagcggttcaacacggctcctgcggaggacgctgacgggcggcgggcgatcctggcggaactgttgggtgaggtcggggaggatgtggagatccgcccgccgctgtacgtggactacggctaccagatcagtatcggaccgcggacgttcgtcaatttcggggcggtcatgttggacgtggcgccgatccggatcggcgctgacacgcagatcggcccgaacgtgcagttgttgacccccacccatccgttggatcccgagttgcggcgcgccaagtgggaggcggccgagcccatcacgatcggggagaacgtgtggctgggcggcggcgtcatcgtctgcccaggggtgacgatcggcgacaacacggtggtgggcgcgggggcggtggtcacccgtgaccttccggcgaacgtggtcgcggtggggaatcctgcgcgggtgatccgcgagctttag

SEQ ID NO: 15776 - protein, 184 aa, Thermobifida fusca
MAGQKERMLAGELYIADDPELAADLRRAMKLMERFNTAPAEDADGRRAILAELLGEVGEDVEIRPPLYVDYGYQISIGPRTFVNFGAVMLDVAPIRIGADTQIGPNVQLLTPTHPLDPELRRAKWEAAEPITIGENVWLGGGVIVCPGVTIGDNTVVGAGAVVTRDLPANVVAVGNPARVIREL

SEQ ID NO: 15777 - DNA, 513 bp, Cytophaga hutchinsonii
  CDS (1)..(513)
atgtatgctcaaaatattgtcatcggaaaatttgttaaactggatgatggggtttatttaagcggattgggaaaaggtaagttgactttagcaaataatgtgagtattggtgcctatagtagaattattgtatcaactagtttaaataatattggggaatatattcatatcggaaataatgttggtattggagagtttgcttatttaggcggtggtggcggcttagagattggtgatgattgtatcataggacaatacttaagttgccatccggaaaatcataattatgattctgttgatacgttaatccgtcaccagggagtaagcaggcaaggaattgttatagggaaaaattgttggatcggttctaaggtgactattttagatggtgtccatataggaaataattgtgtgattgctgcaggtgctgttgtaaccaagtctgttccggacaattcagttgttggcggagttcctgcacgggtgttaaaaagtagaatatctgataagtaa

SEQ ID NO: 15778 - protein, 170 aa, Cytophaga hutchinsonii
MYAQNIVIGKFVKLDDGVYLSGLGKGKLTLANNVSIGAYSRIIVSTSLNNIGEYIHIGNNVGIGEFAYLGGGGGLEIGDDCIIGQYLSCHPENHNYDSVDTLIRHQGVSRQGIVIGKNCWIGSKVTILDGVHIGNNCVIAAGAVVTKSVPDNSVVGGVPARVLKSRISDK

SEQ ID NO: 15779 - DNA, 654 bp, Cytophaga hutchinsonii
  CDS (1)..(654)
atgtttttgcggatagcaaataaaatattgaaacgtttggctggagtacaggttattcctgtaaataaaaagcgtttatctgttttagataataagcatctgcatattgcctccaattcaatcttgctggaaggtacgtcattggatttcagacaggaaatttcttcttccgatacgtatgtttctattggcgggtattgcctgatcaaagctatcttcacatttgaaacaactacaggattaataaccataggtaataatgttcatattggaaatgcacattttatatgccggtccgccattacgattcatgatgatgtaacaatggcgtggggtattaccttatacgatcataattcacatagcattcattgggaagaacggaaggatgataataaaacctgttacgaagattttgttcagcatcatggaaataatatcgttaataaaaactggataaacgttctttccaggcccatagtaattgaatctaaagcctggataggttttaatgtaacaatattaaaaggcgtaactataggtgaaggcgcagtgataggagcctgcagcgttgtgacaaaagacgttcccgcgtggacagttgttgccggaaacccggctgctgttgtaaaacatttacaaaaaccggaatga

SEQ ID NO: 15780 - protein, 217 aa, Cytophaga hutchinsonii
MFLRIANKILKRLAGVQVIPVNKKRLSVLDNKHLHIASNSILLEGTSLDFRQEISSSDTYVSIGGYCLIKAIFTFETTTGLITIGNNVHIGNAHFICRSAITIHDDVTMAWGITLYDHNSHSIHWEERKDDNKTCYEDFVQHHGNNIVNKNWINVLSRPIVIESKAWIGFNVTILKGVTIGEGAVIGACSVVTKDVPAWTVVAGNPAAVVKHLQKPE

SEQ ID NO: 15781 - DNA, 744 bp, Microbulbifer degradans 2-40
  CDS (1)..(744)
atgcgtaaagaacacaaaccactttttgtattgcgctttttggcccgctgcaatcagttttatgtagagcgctttttacgcccacagtttgatcacttaggtgcgaagcctgcggttgccaaaccgcgcaccgtacaggtttttggccataatatacaggccggcaattttttgcatttaattagcagcaaacaacaaccggtgcgtttgacaacctggtctgggcgcaatcaacaggggcgcattagtattggcgattactgtttaatagccccaggggtagttattaattccgccgtagctattacgctgggcaataactgtatgctggcaaccgatgtaatgattgccgatagcgattggcatggtatttacaaccgcgtacgaccctataaatgcgatggcgaagtagtattgggtaataacgtgtgggtagggttgcgcagtattattggcaaaggcgtacatattggcgataacagcataattggtgcaggctcggtggtaactaagtctattcccgccaattgtatagctgctggcaaccccgcaaaggtagtaaaacaactggaccctagcaagcgcatggttacgcgcgaatatttatttaaccccgaggtacgcttaggtaaaaatattcgcgactatgataataaccaacaacaattagatgagtttatgttcgcccaaaactcttttagcggttggctgcgcgcaaccttaaaaccaactaaaaacgattag

SEQ ID NO: 15782 - protein, 247 aa, Microbulbifer degradans 2-40
MRKEHKPLFVLRFLARCNQFYVERFLRPQFDHLGAKPAVAKPRTVQVFGHNIQAGNFLHLISSKQQPVRLTTWSGRNQQGRISIGDYCLIAPGVVINSAVAITLGNNCMLATDVMIADSDWHGIYNRVRPYKCDGEVVLGNNVWVGLRSIIGKGVHIGDNSIIGAGSVVTKSIPANCIAAGNPAKVVKQLDPSKRMVTREYLFNPEVRLGKNIRDYDNNQQQLDEFMFAQNSFSGWLRATLKPTKND

SEQ ID NO: 15783 - DNA, 549 bp, Microbulbifer degradans 2-40
  CDS (1)..(549)
atgattggtaaattggtaagctggttgcgccgccgcaagcgtcaaaaatatatagaaggcctagtggctaagggtttaaaacttggaaacaatgttcacattgtagaccagtgcttttgggacgccgcccactgctaccttatacaaatagacgataacgttactatcgcaccaaacgttacttttctcgcccacgacgccagcacaaaagaatttttaaattacacaaaacttggcaaagttcatgtaaaagaaaattcttttatcggccattccgcaataataatgcccggcgtaactgttggtaaaaatactattattggttcgggctctgtagtaaccaaagacatacccgatggggtaatagccgcaggcaacccggcacgtattattaccaccttagaaagttacttagaaaaagtaaaagctgacgtaagcgaaaacaataagactatatttggtcaagactaccacatttacaacttagacgaccaaaagcgcgcagaactagtaaaaagtgcaaccggcacaaccggctacatcgattaa

SEQ ID NO: 15784 - protein, 182 aa, Microbulbifer degradans 2-40
MIGKLVSWLRRRKRQKYIEGLVAKGLKLGNNVHIVDQCFWDAAHCYLIQIDDNVTIAPNVTFLAHDASTKEFLNYTKLGKVHVKENSFIGHSAIIMPGVTVGKNTIIGSGSVVTKDIPDGVIAAGNPARIITTLESYLEKVKADVSENNKTIFGQDYHIYNLDDQKRAELVKSATGTTGYID

SEQ ID NO: 15785 - DNA, 417 bp, Oenococcus oeni PSU-1
  CDS (1)..(417)
atgactatcggttatggaactcaaatcagaccaagttcgtattatggagttgggcaaattggatatggcttaactattggaaatcatagttctattggtccaatggggtatctagggtgtgcaggagaaatcaaaattggagaaaaagtgatgattggccccaaggtaacacttgttgccgaaaatcatatttttaaagatgctgatatagacatcaagaatcagggagtttcccaaaaaggtattattatcgaaaataatgtttggataggcactgattgtactattctggatggtgtaactataggcgaaggaagcgtaattggggctggttgtttaataacaaaagatgttcctaataattctattgtgtatgataaaagagataaggtttatcgtgaaaggctgccagaatga

SEQ ID NO: 15786 - protein, 138 aa, Oenococcus oeni PSU-1
MTIGYGTQIRPSSYYGVGQIGYGLTIGNHSSIGPMGYLGCAGEIKIGEKVMIGPKVTLVAENHIFKDADIDIKNQGVSQKGIIIENNVWIGTDCTILDGVTIGEGSVIGAGCLITKDVPNNSIVYDKRDKVYRERLPE

SEQ ID NO: 15787 - DNA, 567 bp, Pediococcus pentosaceus ATCC 25745
  CDS (1)..(567)
atgaaagagattgaaaagttaaaacaaggtttagaatattgctttttagatgaagaagttgccaagcttaagcaagcagcattaatcaagtgcgcgcgattcaataatattgatccaacggatgaccaaaaacaacaagccgcaattaaggatttatttggttcaactggggcaaacgtatatgtgcagcctaattttaattgtgataatggtaaaaatatccatgttggagaggattttctaaccaactataacgtcacgattcttgatattgcgcccgtgaaaattggtgattatgtcatgattggacccaatacgctgattgctacggtcaatcatccgatgtctcccaagcaacgtcgacaaaagatggcgcaaggaacgccggttaccatcggaaatgacgtttggattggtggaaattgtacaattttaccgggagtaacgattggcaataatgtcgtggttgctgcaagcgcagtcgttactaaagatgtgcctgataactgtttggtagcaggagtgccagcgaaagttatcagaaagttggataacgatttggattaa

SEQ ID NO: 15788 - protein, 188 aa, Pediococcus pentosaceus ATCC 25745
MKEIEKLKQGLEYCFLDEEVAKLKQAALIKCARFNNIDPTDDQKQQAAIKDLFGSTGANVYVQPNFNCDNGKNIHVGEDFLTNYNVTILDIAPVKIGDYVMIGPNTLIATVNHPMSPKQRRQKMAQGTPVTIGNDVWIGGNCTILPGVTIGNNVVVAASAVVTKDVPDNCLVAGVPAKVIRKLDNDLD

SEQ ID NO: 15789 - DNA, 555 bp, Pediococcus pentosaceus ATCC 25745
  CDS (1)..(555)
atgcaatccaaaatggatttgggaacagcggcctatgatggtgtcgaagaaatcgtagctaaaaaccaacggttggttcagcaattaaatactggagttcattcggcaaatgaagtacttagcattgtaagccaaatcactaacgagcgaattgatggttcgactgaaattcgattaccttttcaaaccgattttggtcgcaatctccacattggtaaaaaagttttcattaatagcggatcgatgtttgtggacttaggtggtatctatattggtgatcacgtcttgattggtccaaacgtaacgattgcttccgttaatcaccgtctagaacctagcgagcgccgtaatctagatttatactcggtttgtattcataataatgcttggttaggcgccaatgtgacggtaactcctggcgtaattattggtgaaaatgcagtagttgctgcgggcgccgtggttacccgcgatgttccacccaatgcggtagttgctggtattccagcacgtgtaattaaaataatcaagagtactaaggaggatcaaaaataa

SEQ ID NO: 15790 - protein, 184 aa, Pediococcus pentosaceus ATCC 25745
MQSKMDLGTAAYDGVEEIVAKNQRLVQQLNTGVHSANEVLSIVSQITNERIDGSTEIRLPFQTDFGRNLHIGKKVFINSGSMFVDLGGIYIGDHVLIGPNVTIASVNHRLEPSERRNLDLYSVCIHNNAWLGANVTVTPGVIIGENAVVAAGAVVTRDVPPNAVVAGIPARVIKIIKSTKEDQK

SEQ ID NO: 15791 - DNA, 552 bp, Pediococcus pentosaceus ATCC 25745
  CDS (1)..(552)
atgacaagaactgaacgagaaaaaatgactgctggagaaccttaccagcagtttgatgctgaattaattggtcgtcgaaagttcatccgtcaacaattacaagtgattaacaacgaaacagacaatgagaaacgtaatggtggctttaaaaaactactaggtgatgtaggtgacgatttctttgtcgagagtgaattcaaatttgattatggatggaatattcacattggtaatcatttttatggcaactacgatatgactttccttgatacgtgtccaattacgattggtgaacactgttattttggtcctaacgtggggctgtatactcctattcatccacttgatcccgttaagagaaatgctgatgtagaattaggtgctccaattacaattggtaatagctgttggtttggaggacgagtgaccgttttacctggggtaactttgggcaataacgtcgtcgtgggtgctggatcagtggcaacaaagagttttggggacaatgtggtaattgcgggaaatcctgccagagtaatcaaacaaatctag

SEQ ID NO: 15792 - protein, 183 aa, Pediococcus pentosaceus ATCC 25745
MTRTEREKMTAGEPYQQFDAELIGRRKFIRQQLQVINNETDNEKRNGGFKKLLGDVGDDFFVESEFKFDYGWNIHIGNHFYGNYDMTFLDTCPITIGEHCYFGPNVGLYTPIHPLDPVKRNADVELGAPITIGNSCWFGGRVTVLPGVTLGNNVVVGAGSVATKSFGDNVVIAGNPARVIKQI

SEQ ID NO: 15793 - DNA, 465 bp, Streptococcus suis 89/1591
  CDS (1)..(465)
atgaagagatttaacgatgagctagatggtaaggtccgctcggagcaattgaaaaactggtttggagctacaggtgagcggatttacatggagctaaatttctactgtgactacggtagcaatattcatgttggtgaggatttttacgcaaattttaactgtacgatgttggatgtttgtcccattaccatcgggaaaaatgccatgattggtcccaatgtacagttgctaactccacttcatccactagatcctgatgaacgaaattctggtttggaatatggctctccaattaccattggtgataatttctgggctggtggtggtgcgacaatcttacctggcgtgaccttaggcaacaatgtggttgttggtgctggatctgtcgtgactaagtcttttggtgataatgttgttttagcgggcaatcctgcgtgtgttatcaaagaaatacctaaaaaataa

SEQ ID NO: 15794 - protein, 154 aa, Streptococcus suis 89/1591
MKRFNDELDGKVRSEQLKNWFGATGERIYMELNFYCDYGSNIHVGEDFYANFNCTMLDVCPITIGKNAMIGPNVQLLTPLHPLDPDERNSGLEYGSPITIGDNFWAGGGATILPGVTLGNNVVVGAGSVVTKSFGDNVVLAGNPACVIKEIPKK

SEQ ID NO: 15795 - DNA, 606 bp, Desulfovibrio desulfuricans G20
  CDS (1)..(606)
atgatcatgatgtcttcagagatgcagcccccgcagcacggcccggatgaaagacgttttcagagccgcgtgcgcacggcggcgtccggcgggctgtggcacgacatgcgccgctggtggcagctgcgccgcgtgggcagtgccggctgcggcatacacatggacagcggtgtgcatctgatgcggtacacgcggcatatgcatttcggcgacaatgtgtttttcaaacagggcgcgcggctgtgtgtggctcagccgcagggtgaactgcgcatcggcagcaatacgacaataggatatcacacgactatttttgcaagctactctgtagtgataggggcggactgcctcatagcgcccttctgttatctggtggatgccgaccacggcattgcggcgggcagcagaatcaacacgcaggatatgaccgcccgccccgtggtggtgggcgatgatgtgtggctgggggcgcgtgtgaccgtggtttcgggggtgcgtataggaaccggcgctgtggcgggggccggcagcgtcattactgccgatgtgcctgcaggggccatcgtggccggtgctccggcacggatagtgggatacagaaaatga

SEQ ID NO: 15796 - protein, 201 aa, Desulfovibrio desulfuricans G20
MIMMSSEMQPPQHGPDERRFQSRVRTAASGGLWHDMRRWWQLRRVGSAGCGIHMDSGVHLMRYTRHMHFGDNVFFKQGARLCVAQPQGELRIGSNTTIGYHTTIFASYSVVIGADCLIAPFCYLVDADHGIAAGSRINTQDMTARPVVVGDDVWLGARVTVVSGVRIGTGAVAGAGSVITADVPAGAIVAGAPARIVGYRK

SEQ ID NO: 15797 - DNA, 543 bp, Chloroflexus aurantiacus
  CDS (1)..(543)
atgccatcacgtccgctaaccgacattgtgagcgatattctggctgtgttgcgggcacgctggtatctccgtagtgcgacattggggccacgagtacggttgtgggggcgtccggcaatcagtaattatggccagctcatcatcggtgagcgagcgcgattggtttcaacgattgtgccactcgagctggcagtagctcatggggcgcggttagagattggtcaggggacgtttatcaactatggttgttcaattgcggcaactgaactggtacgtatcgggccgcgttgtaatatcggtacctacgccatgattatggacaacgacttccaccgtctggagccagagcggcgccaggaacgtccaccatcagccccaattattctggaagagaacgtctggctcggtgggcgggtaacggtattgagcggtgtgacgattggcgctggtagtgtgatcggtgccggtagtgtggtgaccaagagcatcccgccgcgttcattggcagcaggagtcccggcacgtgtgattaggcagttataa

SEQ ID NO: 15798 - protein, 180 aa, Chloroflexus aurantiacus
MPSRPLTDIVSDILAVLRARWYLRSATLGPRVRLWGRPAISNYGQLIIGERARLVSTIVPLELAVAHGARLEIGQGTFINYGCSIAATELVRIGPRCNIGTYAMIMDNDFHRLEPERRQERPPSAPIILEENVWLGGRVTVLSGVTIGAGSVIGAGSVVTKSIPPRSLAAGVPARVIRQL

SEQ ID NO: 15799 - DNA, 186 bp, Brevibacterium linens BL2
  CDS (1)..(186)
atgcatcctggccacatcatcatcggccgcaacgtgtggatcggtgcgaatgtgaccgtcctgcccggagtgaccatcggcgacaacgccgtggttgcggcggcctcggtcgtgaccaaggacgtgcgcgcaggaaccgtcgtggtcgggtcgccggcacgcgtggtgcgctcggtcaacgactga

SEQ ID NO: 15800 - protein, 61 aa, Brevibacterium linens BL2
MHPGHIIIGRNVWIGANVTVLPGVTIGDNAVVAAASVVTKDVRAGTVVVGSPARVVRSVND

SEQ ID NO: 15801 - DNA, 612 bp, Lactococcus lactis subsp. cremoris SK11
  CDS (1)..(612)
atgaataaagaacaaattaaaacactaatcaattctggaaaaacctatgatgacaatgacctagaactcagtgagtatcgtaatcatgccctttttgaaacccgacgttacaatcaaaaaatcaacaataatgagggttatcaaccagagattttaagacagctctttgaacatttgggagaaaatccctatattgaatacaattttcgctgtgaatttggctttaatataaaaattggggataatgtccttattaatcatgatctgattattttagattgcaatcaggtcacgataggtgataatgtttactttgggcctcgctgtggtttatttgctgccaatcattcagaagacccagcagtcagaactgctggtggggtctattcaaagccaattacggttggaaatcaagtctggctgggagcaaatgtcagccttcttccaggagtaacgattggtgacaactgcattattggtgcaggaagtgtcgttaccaaagatattccagcaaatgttgttgccgccggaaatccttgccaagtgattcggacaatccgaatcgaagaccaagaatggattaaaaaggataaaatattcatttcaaaataa

SEQ ID NO: 15802 - protein, 203 aa, Lactococcus lactis subsp. cremoris SK11
MNKEQIKTLINSGKTYDDNDLELSEYRNHALFETRRYNQKINNNEGYQPEILRQLFEHLGENPYIEYNFRCEFGFNIKIGDNVLINHDLIILDCNQVTIGDNVYFGPRCGLFAANHSEDPAVRTAGGVYSKPITVGNQVWLGANVSLLPGVTIGDNCIIGAGSVVTKDIPANVVAAGNPCQVIRTIRIEDQEWIKKDKIFISK

SEQ ID NO: 15803 - DNA, 588 bp, Lactococcus lactis subsp. cremoris SK11
  CDS (1)..(588)
atggttgctggcgaactctataaagcaagtaaagttgaaccagaatacaaacctgataataatcgagcattaaatcaagaaattaaccaactctatctacttgatacagaaaaaattgtggcacttgaaaaagaactttttggtcaaactggtgatgagttatttgtaaatccaccgctttacatcgactatggtaagaatacaagaattggtcagcgcttttatgccaatatgggctgtatttttctggatgttgcaccgattacgattggcgatgatgtgatgtttggacctcgtgtcagtctgattacggcttctcatccaattgatgccggagttcgacagcgtggactagaatatggaaaagcaattacgattggtgaccgagtttggctcggtgcaggagtaattgttaatccgggcgttacgattggcgaaaatacaattgtgggctcgggaacggtagtgacaaaaaatttgccagcaaatgtgattgcagtaggtaatccagcacgaattctccgcgaaattactgattctgaccgactttactgggaagaaaaagagaacgaatattatgaaaaataa

SEQ ID NO: 15804 - protein, 195 aa, Lactococcus lactis subsp. cremoris SK11
MVAGELYKASKVEPEYKPDNNRALNQEINQLYLLDTEKIVALEKELFGQTGDELFVNPPLYIDYGKNTRIGQRFYANMGCIFLDVAPITIGDDVMFGPRVSLITASHPIDAGVRQRGLEYGKAITIGDRVWLGAGVIVNPGVTIGENTIVGSGTVVTKNLPANVIAVGNPARILREITDSDRLYWEEKENEYYEK

SEQ ID NO: 15805 - DNA, 597 bp, Lactobacillus casei ATCC 334
  CDS (1)..(597)
atgaatctagaagaaaaatttgctttcatggcaactggtaagccatacgacgacatggatcctttgttactggctgtgcgggatgaagcaactgccaaaactgatgcacttaacaatgaacacgatccagccaaacgcaatgccttgtttaggaaattggtaggccaaactggcttcaaaccgtttgtgaacccaaactttcactgtgaatttggtcggaatatccgcgtaggcgatcatttttatgccaattatgactgtaccattttggacggggcgccggtgaccattggcaatcacgttttgtttggcccgaaagtcggtttgtacaccagcaaccatctttttgatccgcttgaacgacaacttggtggctgtattgctaaaccgattgtagtcggggatggctgttggctcgctgccaatgtgacggtactaccaggcgtcacgattggtgcggggacgattatcggagcaggtagtgttgtcacccacgacatcccagcgcgcgtgattgcggcgggtaatccttgcgaagtgctccgcgagatcacggctgctgataaaacagggtttgcagggcatgacatgatctaa

SEQ ID NO: 15806 - protein, 198 aa, Lactobacillus casei ATCC 334
MNLEEKFAFMATGKPYDDMDPLLLAVRDEATAKTDALNNEHDPAKRNALFRKLVGQTGFKPFVNPNFHCEFGRNIRVGDHFYANYDCTILDGAPVTIGNHVLFGPKVGLYTSNHLFDPLERQLGGCIAKPIVVGDGCWLAANVTVLPGVTIGAGTIIGAGSVVTHDIPARVIAAGNPCEVLREITAADKTGFAGHDMI

SEQ ID NO: 15807 - DNA, 705 bp, Lactobacillus casei ATCC 334
  CDS (1)..(705)
atgacagccaagattcggtacaatgagcttatcttaagtatggaggctctaaccaatatggaatcaatgaagcaaagaatgcttggtggcaaactgtataaagcaaacgatccagaaatcagcgttgagagtcagcgaggcagtgatctcgtctggcagtttaatcatttagcccctgataaaaaagcagaacgagctgcggttttaaaacaattatttcatgcatttggagacaataactacattgagcctcctttctacgttgactacggtgctcacacgtcaatcggtgatcatttttatgccaacacagattgtgttttcttggataccgcgccaattaccattggcaaccgggtttatttagcgcctaaagtgagtttatttacagccggccacccaattgatgccgctatccgcggtgaagatttagaatatggtaagcctatcaaaattggcgatgatgtctggattggcggcggcgtcattattaatccaggtgtgaccatcggcagcgatgttgttatcggttctggatcggtggtcacaaaagacgttcctgatcatgtcatcgttgctggcaatcctgctcgcatgattcggcggattactgataaagatcatgcccagtggcaacaacaaaaagatgagttcttaacctggcagcaacaggctgatgaaagccaacaatcaaagcagtcttaa

SEQ ID NO: 15808 - protein, 234 aa, Lactobacillus casei ATCC 334
MTAKIRYNELILSMEALTNMESMKQRMLGGKLYKANDPEISVESQRGSDLVWQFNHLAPDKKAERAAVLKQLFHAFGDNNYIEPPFYVDYGAHTSIGDHFYANTDCVFLDTAPITIGNRVYLAPKVSLFTAGHPIDAAIRGEDLEYGKPIKIGDDVWIGGGVIINPGVTIGSDVVIGSGSVVTKDVPDHVIVAGNPARMIRRITDKDHAQWQQQKDEFLTWQQQADESQQSKQS

SEQ ID NO: 15809 - DNA, 591 bp, Lactobacillus delbrueckii subsp. bulgaricus ATCC BAA-365
  CDS (1)..(591)
atgccgatcgaaaaagaaaaaacgctggctggccaggtctataatcctggtcaagacgaagaactggtgacagaactgacggcctgcaaggccaagtgcctccgctacaaccaattgccgtctggagcagaaaagaaggaactcttaaaggaaatcctgggccaaagcggggaaaactgccacatcgaacccaacttctggtgcgactatggctggaatattaaagtaggcgacaacttctacgccaaccataatttgaccgtcctggatgctgggggagtgacctttggtgacaatgtcttcatcggccctgactgcagcttctacacctccggccacccgttggacgcggccagaagaaataccggcctggaatatgcctacccgattactgttggcaataacgtctggatcggcgggggagtccgggtggtgcctggcgtcacaatcggtgacaattccgtgatcggcgccggcagcgtcgttgttaaagatgtcccggccaattccgtagccgctggcaatccttgccgggttatccgggaaatcactgaagctgataaaaacagtgacttaaactggaagaagtaa

SEQ ID NO: 15810 - protein, 196 aa, Lactobacillus delbrueckii subsp. bulgaricus ATCC BAA-365
MPIEKEKTLAGQVYNPGQDEELVTELTACKAKCLRYNQLPSGAEKKELLKEILGQSGENCHIEPNFWCDYGWNIKVGDNFYANHNLTVLDAGGVTFGDNVFIGPDCSFYTSGHPLDAARRNTGLEYAYPITVGNNVWIGGGVRVVPGVTIGDNSVIGAGSVVVKDVPANSVAAGNPCRVIREITEADKNSDLNWKK

SEQ ID NO: 15811 - DNA, 609 bp, Bacillus anthracis str. A2012
  CDS (1)..(609): n means a or g or c or t/u, w means t/u or a, k means g or t/u
atgtttaataagtgcagttcattcgataacaaaggagatgattctatgaaaacagaaaaagacaagatgttagcgggagaaatgtatattgcggatgacgaagaattagtagctgatagggtggaggcaaaacgtttaacacgcctttataacgaggcggtggagacaggagatgagagacgttttacgttattaaatcagcttttaggttcttcagctgatgggaaagcccaaattaatcctgattttcgttgtgattatggatacaatatccatgttggaaagagcttttttgcaaatttcaattgtgtgattttagacgtttgtgaagttcgaatcggtgatcattgtatgtttgcacctggtgttcacatttatactgctacgcatcctttacatccggtwkagcggaattctggtaaagagtatgggaagcctgtaaagattggtaacaatgtttgggttggcgggggagctattattaaccctggtgtttcaattggagataacgctgtaattgcttcaggggcagttgtgacaaaagatgtacctaataatgtagtagttggtggtaatccagctaaagttattaaaacgatagaagaataa

SEQ ID NO: 15812 - protein, 202 aa, Bacillus anthracis str. A2012
  Xaa in position 136 is unknown
MFNKCSSFDNKGDDSMKTEKDKMLAGEMYIADDEELVADRVEAKRLTRLYNEAVETGDERRFTLLNQLLGSSADGKAQINPDFRCDYGYNIHVGKSFFANFNCVILDVCEVRIGDHCMFAPGVHIYTATHPLHPVXRNSGKEYGKPVKIGNNVWVGGGAIINPGVSIGDNAVIASGAVVTKDVPNNVVVGGNPAKVIKTIEE

SEQ ID NO: 15813 - DNA, 534 bp, Anaeromyxobacter dehalogenans 2CP-C
  CDS (1)..(534): transl_table=11
atggtcataaaggtactgttcgagatcaaactgtgggtgttctggttcgtgaagtctgttcccgggaacatcggttgtgcgctccgtcgcgcggtgctgccggcagcgatcgcaaaaggagccaaggtctgggatggcgttcagattgacatgccctcgaaactccggattggactcagaacgtccatcaaccgcggcacgattttgaactgtggcggaggcattacgataggtgacgacgttctgatcgggccggacgtcatagtgtattcccagaaccacaactacaaagacgcatcccgactggtcgctgaacagggctatagcttcgctcccgtcgtgatcggtgatgatgtgtggatcgcggcccgcgccgtgatcctgccgggggtagagcttggacggggcgccgttgttgcgagtggcgcagtcgtgaccaagaacgtcccgccctacacactcgtcggaggcgtccccgcccgcgccctcggacgtcgaacgtccgacagcgatcctcaatcgtccacgacctaa

SEQ ID NO: 15814 - protein, 177 aa, Anaeromyxobacter dehalogenans 2CP-C
MVIKVLFEIKLWVFWFVKSVPGNIGCALRRAVLPAAIAKGAKVWDGVQIDMPSKLRIGLRTSINRGTILNCGGGITIGDDVLIGPDVIVYSQNHNYKDASRLVAEQGYSFAPVVIGDDVWIAARAVILPGVELGRGAVVASGAVVTKNVPPYTLVGGVPARALGRRTSDSDPQSSTT

SEQ ID NO: 15815 - DNA, 663 bp, Streptococcus pneumoniae TIGR4
  CDS (1)..(663)
atggtatgtgatgaaggtagagcatcaattgtagaaagtgctccttattctagtcagatacgtggaaaatttgatatgatagtagggaataaggagaagaataatatgactagcgaataccagaaaatgatagcaggagagttttaccgtccatcagacccagaactgagagccttagctcaggcttctcgccaaaaacaggccgcctttaacaaggaagagaaccccttgaagggagccgaaatcatcaagacttggtttgcctcaaccgggaaaaatctttacatcaacactcgcttgatggtggactacggtgtcaacatccatctaggggaaaatttttattctaattggaacttgaccatgctggatatctgtcccattcgtatcggggacaatgctatgattggtcctaattgtcagtttttgacacccctccatccactagatccacaggaacgcaattcaggtatcgagtacggaaagcctatcacaatcggagataatttctggactggtggtggcgtcattgtccttcctggagtgacactgggaaataatgtcgttgcaggagcaggggcagtaattaccaaatcttttggcgacaacgttgtcctagctggcaatcctgcgcgcgtgattaaggaaatacctgttaaatag

SEQ ID NO: 15816 - protein, 220 aa, Streptococcus pneumoniae TIGR4
MVCDEGRASIVESAPYSSQIRGKFDMIVGNKEKNNMTSEYQKMIAGEFYRPSDPELRALAQASRQKQAAFNKEENPLKGAEIIKTWFASTGKNLYINTRLMVDYGVNIHLGENFYSNWNLTMLDICPIRIGDNAMIGPNCQFLTPLHPLDPQERNSGIEYGKPITIGDNFWTGGGVIVLPGVTLGNNVVAGAGAVITKSFGDNVVLAGNPARVIKEIPVK

SEQ ID NO: 15817 - DNA, 558 bp, Burkholderia vietnamiensis G4
  CDS (1)..(558): transl_table=11
atggcccacgacgaccgcacgacggtcatttcccggcgcacgcccgaatcggcggcgatgcgcgccgagctcgcgcgcgcgatggcgatcaccgcgcggctcaaccggctgacgttcgccgatgcggacgaagtccgcagcctgttcggcgaactgacgggcaagccgatcgacgacggcttcctgctgattccgccgttctacgcaaccggcggcgcagccacgcggatcggccggaacgtgttcgtcaaccagaactgcacgttctacgacctcggcggcctcgacatcggcgacgacgtgatgatcgggccgaacgtgagcctcatcacgtccggccatccgctcgagccgtcgcgccgacgcgacgcggtcgtggcccggccgatctcgatcggcaacaacgtgtggatcggcgcgggcgcgacgatcctcggcggcgtgacggtcggcgagaacgcggtggtcggcgccggctcggtcgtgacgcgcgacgtcccgccggatacgctggtcgccggcaacccggcgcggatcgtccgttcgattgcggagtga

SEQ ID NO: 15818 - protein, 185 aa, Burkholderia vietnamiensis G4
MAHDDRTTVISRRTPESAAMRAELARAMAITARLNRLTFADADEVRSLFGELTGKPIDDGFLLIPPFYATGGAATRIGRNVFVNQNCTFYDLGGLDIGDDVMIGPNVSLITSGHPLEPSRRRDAVVARPISIGNNVWIGAGATILGGVTVGENAVVGAGSVVTRDVPPDTLVAGNPARIVRSIAE

SEQ ID NO: 15819 - DNA, 576 bp, Crocosphaera watsonii WH 8501
  CDS (1)..(576): transl_table=11
atggacaatccacaaaactcgagtagagaaaagcaaaaaatgcttaaaggagaatattataattcttttgaagaaagcttactttatgatagaaaaagagcaaaaaaattatgtcaacaattaaatgctattcctgatggaagtcaaggcgaaagaagtaaaataattcagaatttattacaaacagataaacaggtatggattgaatctccttttcgctgtgattatggttataatattgaagttggtgacaacttttatgctaattttggctgtattattctcgactgcaatctagttaaaattggtgacaatgttaaatttggtcccaatgtacaagtttatgctgcaacccatcctactaaccccgaagaaagaattgcagggaaagaaatggcctatcctattaccattggtgataatgttttgattgggggaagttctattattcttcctggtgtgactattggtaataatagtgttatcggtgccggaagtattgtgacaaaaaatattcctgaaaacgttgttgctgtgggcaacccttgtcgtgttcttcggtcaattaattgttaa

SEQ ID NO: 15820 - protein, 191 aa, Crocosphaera watsonii WH 8501
MDNPQNSSREKQKMLKGEYYNSFEESLLYDRKRAKKLCQQLNAIPDGSQGERSKIIQNLLQTDKQVWIESPFRCDYGYNIEVGDNFYANFGCIILDCNLVKIGDNVKFGPNVQVYAATHPTNPEERIAGKEMAYPITIGDNVLIGGSSIILPGVTIGNNSVIGAGSIVTKNIPENVVAVGNPCRVLRSINC

SEQ ID NO: 15821 - DNA, 555 bp, Chlorobium phaeobacteroides DSM 266
  CDS (1)..(555): transl_table=11
atgaaaaaagttgtatttgagagaccctcaaagattaaatatactatatatatattaagatcagttttctctattgagtttattaaacatcttgcttatttgtttgtatattttataatcaactttacaagaggaagatgtattgcaaaaatcggagttaatacaaagttgcatcctaccgtattaatgagagaggctgaacgtatcataatcggtgataattgcttaattaatcataataatgtattacaagcagggaaaaaagatgctaaaattgtaattggaaattatgttcatactggcccaaatgttatgatgtttgcatacaatcatgtatttgatgatcctcatataccttccaaaaatcaacaatattatgaaggggatataattatatgtgatgacgtatggataggtgctggatctatcattcttgctggcgtgacaataggaaagggtgttgttgttgctgcgggtacagttgtgaataaaaatatcacgccgtttacagtggttggtggggtacctgctaaagtcttaaaaattagagaatag

SEQ ID NO: 15822 - protein, 184 aa, Chlorobium phaeobacteroides DSM 266
MKKVVFERPSKIKYTIYILRSVFSIEFIKHLAYLFVYFIINFTRGRCIAKIGVNTKLHPTVLMREAERIIIGDNCLINHNNVLQAGKKDAKIVIGNYVHTGPNVMMFAYNHVFDDPHIPSKNQQYYEGDIIICDDVWIGAGSIILAGVTIGKGVVVAAGTVVNKNITPFTVVGGVPAKVLKIRE

SEQ ID NO: 15823 - DNA, 618 bp, Chlorobium phaeobacteroides BS1
  CDS (1)..(618): transl_table=11
atgggagtagtcgacaagataaaatcaaacccaaagcttaaaaagctggtattgtatctattgatgcctaaaaaccaggccagacctcgattatgggttaagctatttgttaatccgtttaaacatcataaaggtaaacgatcgctaatccgccgtagtgtccggatggatgttatgccattcaattatttttctttgggaaacgactctactatcgaggacttctcaaccattaataatggtgtgggcgatgtggttattggcgaaagggtaagaattggccttgggaatacgttgattggccccattaccataggaaacgatatcatgttcgctcaaaacatagtactttcaggtcttaatcatggctatgaggatatttcattacccatcagcgatcaacccgtatctactaaacctatcttcattgaagatgaagtatggattggcgccaatgccgtaattactgcaggcgttactgttggaaagcatagcattgtggcagcaggatccgttgtggttaaatccgtacctccctactccattgtcggaggtaacccagccaaactactcaaacaatataaccaaactaccaagaactgggaaagagttctttaa

SEQ ID NO: 15824 - protein, 205 aa, Chlorobium phaeobacteroides BS1
MGVVDKIKSNPKLKKLVLYLLMPKNQARPRLWVKLFVNPFKHHKGKRSLIRRSVRMDVMPFNYFSLGNDSTIEDFSTINNGVGDVVIGERVRIGLGNTLIGPITIGNDIMFAQNIVLSGLNHGYEDISLPISDQPVSTKPIFIEDEVWIGANAVITAGVTVGKHSIVAAGSVVVKSVPPYSIVGGNPAKLLKQYNQTTKNWERVL

SEQ ID NO: 15825 - DNA, 576 bp, Exiguobacterium sp. 255-15
  CDS (1)..(576): transl_table=11
atggaatcatcatcacttcttcaacagattcaaaatcgactgattgaggcggacgatcccctgctcgagcagattcatgccgtacagcgggacggagagcggctgctccaccggttgaatcagcagttgttgtcaccaatggagtttcgcgagacgctgggtgaactgattggtcagcccgttgatgagagtgtggtcgtcttacccccgttttatacagacttcgggcgacatatctcactcgggacagacatcttcatcaatcgtggagtcatgttgacggatctcggttcaattcaaatcgatgatcacgtgctgatcggtccgtttgcgaagctgttgaccgtcaatcatcccgtcagtccgtccgagcgacggggactgtccgtcaaaccgattcatctgaaaggaaatgcctggattggagcgggggcaacgatcctgccaggtgtcacgatcggcgagaatgcaatcgttgcggcggacgcgaccgtgacgaaagatgtgccggacttggcgattgtcgccggaaccccggcgcggatcatccgttatatcaatgaatcggaggactga

SEQ ID NO: 15826 - protein, 191 aa, Exiguobacterium sp. 255-15
MESSSLLQQIQNRLIEADDPLLEQIHAVQRDGERLLHRLNQQLLSPMEFRETLGELIGQPVDESVVVLPPFYTDFGRHISLGTDIFINRGVMLTDLGSIQIDDHVLIGPFAKLLTVNHPVSPSERRGLSVKPIHLKGNAWIGAGATILPGVTIGENAIVAADATVTKDVPDLAIVAGTPARIIRYINESED

SEQ ID NO: 15827 - DNA, 552 bp, Exiguobacterium sp. 255-15
  CDS (1)..(552): transl_table=11
atgacggaaaaagaaaaaatgattcaaggtcaattgtatttagccggagatgcggaactggtcgctgatcgaaagcgggctcagatgctttgtcatcaatttaatcaactcagcatcaacgagttacctgcccgaaagtcgctcctgcaggaactgttccaaatcgagcagaccgatttttacatcgaaccgtcttttaaatgtgattacggctacaacattacattcggcgcacggttttatgccaattacgattgtgtgctgctcgacatttgtccgattacgatcggcgacaactgtatgctcgctccaggtgtccacatctatacagcgacgcatccgctcgatccggtcgaacgcaacagcggttacgaattcggaaaaccggtcgtcatcggggataacgtctggatcggtggacgtgccgtcatcgcaccgggtataacgatcggtgacaatgctgtcatcgcagccggaagtgtcgtcgtcaaagatgttgctccgaatacggtggtcggaggaaatccggcccgcttcatcaaatcgatttaa

SEQ ID NO: 15828 - protein, 183 aa, Exiguobacterium sp. 255-15
MTEKEKMIQGQLYLAGDAELVADRKRAQMLCHQFNQLSINELPARKSLLQELFQIEQTDFYIEPSFKCDYGYNITFGARFYANYDCVLLDICPITIGDNCMLAPGVHIYTATHPLDPVERNSGYEFGKPVVIGDNVWIGGRAVIAPGITIGDNAVIAAGSVVVKDVAPNTVVGGNPARFIKSI

SEQ ID NO: 15829 - DNA, 702 bp, Exiguobacterium sp. 255-15
  CDS (1)..(702): transl_table=11
atggagaggagaacaaacatgacacggatgcgtgaagatatccgcaatgtatttaaacaggatccggcagcccggagtacgatagaagtcgtcttgacttatccggggttacacgctgtctggatgcaccggttagcccaccgtatgtggaaaatgaatctgcatctcgccgcccgaatgctatcgcaattcagtcggttcctgacaggaatcgaaattcatcccggtgcgacgatcggacgtcgtttcttcattgatcacggtatgggcgtcgtcatcggcgaaacagcgattatcggcgacgatgtcacgttgttccaaggtgtgacactcgggggaacagggaaagaaacgggcaaacggcatccgacactcggaaatggtgtcctcgtatccgccggagcacgcgtactcggtgatatcacgattggtgattcgtcgaagattggtgcaagctccgtcgttttaaaagacgtaccgtccaatgcgaccgttgtcggtattcccggacgtgtcgtgatacaggacggtatcaaggtcgatgcaccgcttgatcatcaattacccgatccggttcgtgaatgccaggaacgggttgaactggaacttgaacaattaaaatatgagattgaacgaataaaaggaggacaccgccatgatacaactttacaacagcatgaccggaaaaaaggaaccgtttaa

SEQ ID NO: 15830 - protein, 233 aa, Exiguobacterium sp. 255-15
MERRTNMTRMREDIRNVFKQDPAARSTIEVVLTYPGLHAVWMHRLAHRMWKMNLHLAARMLSQFSRFLTGIEIHPGATIGRRFFIDHGMGVVIGETAIIGDDVTLFQGVTLGGTGKETGKRHPTLGNGVLVSAGARVLGDITIGDSSKIGASSVVLKDVPSNATVVGIPGRVVIQDGIKVDAPLDHQLPDPVRECQERVELELEQLKYEIERIKGGHRHDTTLQQHDRKKGTV

SEQ ID NO: 15831 - DNA, 642 bp, Methanosarcina barkeri str. fusaro
  CDS (1)..(642): transl_table=11
atgagagaagaagaaaagatattttcgggcaaaatgtttgattcgcgcaaaaaagaactgagagacatcaagcataaggcgcacactgcatgtcaaagatacaatgcaatggacgaatatgatcccgaacgtttgccaattatcaaggaatttattggcggcatcggcaagaaatattattttcagggacctatccagtttaattatggctgtcacacctttattggagaaaactttgttgcgaatttcaatctcatggtgatggacgacgcacgtatttatattggcaacaatgtatgcttcggaccgaatgtttcgttaatggccacttctcatcccctgattgcccaagaacgtatgggaacagatgaaaacgggaacacgataatggccgaatatgccgaagaaatccatatcggcaacaacgtgtggattgcatgtaatgttgttgtattgggcggcgtacatataggaaacaatgtagtaatcggtgccggcagtgtcgtaacaaaagatatcccggataaccatcttgcttttggcaacccttgccgtccggttcgtccgatcaccgaagccgacagtaaaaagcatttgattttagaagaagacctcaagcattttggatataacattaaataa

SEQ ID NO: 15832 - protein, 213 aa, Methanosarcina barkeri str. fusaro
MREEEKIFSGKMFDSRKKELRDIKHKAHTACQRYNAMDEYDPERLPIIKEFIGGIGKKYYFQGPIQFNYGCHTFIGENFVANFNLMVMDDARIYIGNNVCFGPNVSLMATSHPLIAQERMGTDENGNTIMAEYAEEIHIGNNVWIACNVVVLGGVHIGNNVVIGAGSVVTKDIPDNHLAFGNPCRPVRPITEADSKKHLILEEDLKHFGYNIK

SEQ ID NO: 15833 - DNA, 600 bp, Methanosarcina barkeri str. fusaro
  CDS (1)..(600): transl_table=11
atggtagatcaagagatagtttcaatgagtgaaaaagtgttgaataaagacatttttgagcgtgatagggctggagaaccagtttctatagatgacccggaatatccaaagttaaaggaaatgatgcttcgtgctgcggaactaaccaccagattgaatacttcatttcatgatgaggatgaaataaggagcctgttcagtgagttgataggttcggaagtggataaatcttcgagggtaactcctccattctatacggatttcggacgaaatatcaaggtcggtaaaaatgtgtttatcaatcatgcatgcacctttatggatagaggaggcataacaatcgaggatgacaccaagataggaccaaaagccaatcttatcacatccaatcatccattggatccagcccatagaaaggaattaatttcaactccgatatggattaaaaggaatgtatggataggtgctggtgcaaccattttacccggcgtaactatcggagagaactctgttgtagcagctgcagctgtcgttacgcaaaatgtacctcctaacacagtcgtggctggtgtaccagcaaaagttatcaaaacattgtaa

SEQ ID NO: 15834 - protein, 199 aa, Methanosarcina barkeri str. fusaro
MVDQEIVSMSEKVLNKDIFERDRAGEPVSIDDPEYPKLKEMMLRAAELTTRLNTSFHDEDEIRSLFSELIGSEVDKSSRVTPPFYTDFGRNIKVGKNVFINHACTFMDRGGITIEDDTKIGPKANLITSNHPLDPAHRKELISTPIWIKRNVWIGAGATILPGVTIGENSVVAAAAVVTQNVPPNTVVAGVPAKVIKTL

SEQ ID NO: 15835 - DNA, 549 bp, Methanosarcina barkeri str. fusaro
  CDS (1)..(549): transl_table=11
atggggggtattcgtacgactgctgtagtgtctaatagagatcaggtaaccttttgcgaaattgcggaccattatcacagtaataaacttctttttggcattaaatattttaaaaattggattctagaacggcttgcttcaagcgctccagttccttcctggagagctaaattgcacagaatgcggggtgtaaatatcggggagaatgtatatgtcggctatgatgtggtttttgacaggatacaccctgaattaattacgataggggattactcggaaattggcgataaatgcatattatctgcacatacgagaggaagtttgactacaagacaggcatatccgagaactatggctcccataaaaataggacgtggagtctctgtaaatccaggatgtataatcacgcagggtgttgaaatcggggataactcaataataggtattggatccgtagttagccgtaatatctctccaaatagtcttgccctgggttatcctgcaagggttatcaaaaaacttgaagatgtaggagaacttaaaacctga

SEQ ID NO: 15836 - protein, 182 aa, Methanosarcina barkeri str. fusaro
MGGIRTTAVVSNRDQVTFCEIADHYHSNKLLFGIKYFKNWILERLASSAPVPSWRAKLHRMRGVNIGENVYVGYDVVFDRIHPELITIGDYSEIGDKCILSAHTRGSLTTRQAYPRTMAPIKIGRGVSVNPGCIITQGVEIGDNSIIGIGSVVSRNISPNSLALGYPARVIKKLEDVGELKT

SEQ ID NO: 15837 - DNA, 609 bp, Methanosarcina barkeri str. fusaro
  CDS (1)..(609): transl_table=11
atggaatttaaaatgagagagaaagaaaaaatgctagcaggcaaaccgtatagagcttttggggaagaactagtcgcagaacgtcaggctgcaaaagaattgatttttgaatttaattctcttcatccaagtaaaattgagcaacgaaacaaaatcattcaaagactctttggcaaaacgggcaaaaacttcattattgaaccaccctttcgctgcgattatggatacaatatctccataggagagaatttttacgccaattataattgcacaattatcgactgcgctaaagttaccatcggtgacaacgcttttatcgcacccaatgtgagtctttttactgcaggacatcccgtacattccgatatacggaattaccagttagaatatgccacccctatttttataggcgataatgtttggcttggtggtggtgctattgtgaatccgggtgttatcattgatgataacgtcgtcattggttctggaagtgtagtaacaaaggatattccggccaatgtaatcgctgttggcaatccttgtagggtgaaacgcaaaattacagaaaaagataaaactaattttttggagatgatgcataatgactaa

SEQ ID NO: 15838 - protein, 202 aa, Methanosarcina barkeri str. fusaro
MEFKMREKEKMLAGKPYRAFGEELVAERQAAKELIFEFNSLHPSKIEQRNKIIQRLFGKTGKNFIIEPPFRCDYGYNISIGENFYANYNCTIIDCAKVTIGDNAFIAPNVSLFTAGHPVHSDIRNYQLEYATPIFIGDNVWLGGGAIVNPGVIIDDNVVIGSGSVVTKDIPANVIAVGNPCRVKRKITEKDKTNFLEMMHND

SEQ ID NO: 15839 - DNA, 531 bp, Desulfuromonas acetoxidans DSM 684
  CDS (1)..(531): transl_table=11
atgtctgttcccaagctgttttcatggattcgcggcggtctggttcaagggcctggttatggctattacatgctgttctggtggttgtacaccgaacggacattacgttcgaaggccgcggtatcgccctataaccgcctgcgcaagttgttgttggtcaagtcggggattgttattggcgagggaacggagatcggctttggcagttttattctcgggataagccgcacgccaccgtccgtaacctttggcaaacgtgtagccgtggcgccttatgtcgtgtttgttgccagcagttaccccgataactctcggctggcgtatcaccctgaagccaaggggctggttcagaagaccgcaccgattttggttgaagatgatgcttggatcggggcgcatgcggtcattttccccggtgttaccgtgggggcttcggccattgttgctgctggtgctgtggtgagacaggatgtgccgccaaaatcgattgttgccggtgtgccggctaaggtcatacgcacgctggattaa

SEQ ID NO: 15840 - protein, 176 aa, Desulfuromonas acetoxidans DSM 684
MSVPKLFSWIRGGLVQGPGYGYYMLFWWLYTERTLRSKAAVSPYNRLRKLLLVKSGIVIGEGTEIGFGSFILGISRTPPSVTFGKRVAVAPYVVFVASSYPDNSRLAYHPEAKGLVQKTAPILVEDDAWIGAHAVIFPGVTVGASAIVAAGAVVRQDVPPKSIVAGVPAKVIRTLD

SEQ ID NO: 15841 - DNA, 555 bp, Jannaschia sp. CCS1
  CDS (1)..(555): transl_table=11
atgaaaacagaacgacagaagatggacgcgggcaaatggtacacatgccttgatgatgagcttgaagcgcttcgtgttaaggcgcgtgctgcggtgcatgaacacaatactctgccgccggatgcccgaggtgcgatgggaccaaaactcgcgcaacttgtcaggactggtgcggcaatcattgaggcaccgttccactgtgcatacggcatcaatatcgtgcttggtgagcaggtttttctgaatgcaggttgcacaatcctggattgcgccaaggtgacgatcagcgaccagtgtcagcttgggccgaacgtgcagatctattgtgccgaacaccataaggacccgatcaagcgaagcgtcgaggggttggagatcgcccgtccagtcttcatcgggaagcaagcctggattggtgggggagcgatcattctggccggtgttacaattggggccggtgcagtcgtcggggcgggcagcgtcgtcacgaaggatgttggtcccggcgcggttgtggtcggcaatccagcccgacccgttggtcgagccgaataa

SEQ ID NO: 15842 - protein, 184 aa, Jannaschia sp. CCS1
MKTERQKMDAGKWYTCLDDELEALRVKARAAVHEHNTLPPDARGAMGPKLAQLVRTGAAIIEAPFHCAYGINIVLGEQVFLNAGCTILDCAKVTISDQCQLGPNVQIYCAEHHKDPIKRSVEGLEIARPVFIGKQAWIGGGAIILAGVTIGAGAVVGAGSVVTKDVGPGAVVVGNPARPVGRAE

SEQ ID NO: 15843 - DNA, 630 bp, Frankia sp. EAN1pec
  CDS (1)..(630): transl_table=11
gtgaccagggttctcggctttcttcgttccctgctcgacgcccgcgccctcctgcactcactgcggatcctccacttctacaactactcgcatgtccagcaggttcgccggatgacgatcgaacggggtgtccgcctggcgccgaacgtctccgtccggaacggggagcgggtggagatacgggcgttcgcccacatcggtgagcgggtttcgctgtgggccggtgaccgcactggccggatcgagatcggcgagcactccctgatcggcccgggcacgtttctcacggccgcgaactacgagacgctgccggacatcgtcatcgacagccagccgaagcgggaggcggacatcgtcatcggtaacgacgtgtgggtcggcgccaactcggtggttcttccgggcgtgacgataggcgacagcacgattgtcggcgccggttctgtcgtcacgaagtcgttgcccgccggagcgttggccgcgggtgttccggcgaaggtcatcgggaagcgcggggagtcgacccgttccggtcgtgccgtccaggcggaccggcctgagcagaacggccgtaccggtgcggacggcaccgggcggcgtcccggctcccacccggcgggtgagcagtga

SEQ ID NO: 15844 - protein, 209 aa, Frankia sp. EAN1pec
MTRVLGFLRSLLDARALLHSLRILHFYNYSHVQQVRRMTIERGVRLAPNVSVRNGERVEIRAFAHIGERVSLWAGDRTGRIEIGEHSLIGPGTFLTAANYETLPDIVIDSQPKREADIVIGNDVWVGANSVVLPGVTIGDSTIVGAGSVVTKSLPAGALAAGVPAKVIGKRGESTRSGRAVQADRPEQNGRTGADGTGRRPGSHPAGEQ

SEQ ID NO: 15845 - DNA, 555 bp, Shewanella baltica OS155
  CDS (1)..(555): transl_table=11
atgactgaattccaaaagatgatcgctggccaagaatatgattgccttgccagcgaactattaagtttacgagctcaacagcaacggctgaatcgacaattaaatcaaataattgaccacgataccccagagtacagccaactctgtcagcagctcattccccataaatcaccagccgcaacgatatccacgccgatttttatcagttatggcgccaacctatcccttgctgacaaagtgtttatcaatgtgaatgtcaccttgcaggataatgcgcctatttctattggtgagcagactatggtcggccccaatgcacagttttatacctcgagtcacccactcgatgccgagctgcgttgctcaggtttagaaaccgctaaagcaattaaggtcggtaaacgggtatggattggtggcggcgctatcataatgccaggcgtcattattggtgatgacgccatcataggcgctggcgccgtagttacaaaaaatgtagccgccaaaaccgtggtcgcaggtaaccccgcaaagccgatccggcagctaatttaa

SEQ ID NO: 15846 - protein, 184 aa, Shewanella baltica OS155
MTEFQKMIAGQEYDCLASELLSLRAQQQRLNRQLNQIIDHDTPEYSQLCQQLIPHKSPAATISTPIFISYGANLSLADKVFINVNVTLQDNAPISIGEQTMVGPNAQFYTSSHPLDAELRCSGLETAKAIKVGKRVWIGGGAIIMPGVIIGDDAIIGAGAVVTKNVAAKTVVAGNPAKPIRQLI

SEQ ID NO: 15847 - DNA, 585 bp, Shewanella baltica OS155
  CDS (1)..(585): transl_table=11
atggttgagagtaaagggactgagataaaacagacagagaaacaaaaaatgttagcgggtcagccctataaggcatgggatgatgagctattggctgagcggatgcgggcgaaatccgtttgccatcagtttaatctggccgaaccgactcagcttgatgcccgtatggatcaccttcgtggcctgctcgatattcaacactgcgcccatattgagcccaattttttttgtgactacggttataacattcatattggtaaacaattttacgctaatcataatctaaccatattagatgtttgctctgtctcgattggcgataacgtgatgtttggtccccatgtgatgatttctaccgcaacgcatcctatcgatcccattgcgcggcaaacgacggaatacggcgcgccaattcaaattggtaataatgtctggcttggcggtaacgtctctgtgttgcccggtgtgaccattggcgataattgtgtcatcggtgctggtagtgtcgtgaataagagcattccggcgaactgtgtggcggctggcaacccttgtaaggttatcaaacccatcaatgtggcataa

SEQ ID NO: 15848 - protein, 194 aa, Shewanella baltica OS155
MVESKGTEIKQTEKQKMLAGQPYKAWDDELLAERMRAKSVCHQFNLAEPTQLDARMDHLRGLLDIQHCAHIEPNFFCDYGYNIHIGKQFYANHNLTILDVCSVSIGDNVMFGPHVMISTATHPIDPIARQTTEYGAPIQIGNNVWLGGNVSVLPGVTIGDNCVIGAGSVVNKSIPANCVAAGNPCKVIKPINVA

SEQ ID NO: 15849 - DNA, 726 bp, Ralstonia metallidurans CH34
  CDS (1)..(726): transl_table=11
atgcgcgagtggctcctatccgccatttacaaaggaagaatcatgccgacagagaacgaggctgagcgacagtccgccgatatccgcaagcgctgcgccgaactcggcggccgcatcgctcctacagcacaagtcagcagtgcggtgagcttcgacgaagcgattgatattggtgacggcgctgtggcctacgcgccggcatttattggcgggttcacctacgtcaatgtaggtgctgtggtctttccccacgtccgcatcggcaaattctgctcgatcgggcgtaacgtgcagatcggggcggcacgtcaccccgtggaattcctgagttcccacccattccaattctccccagcgctcttcaatcgcgtgccgggctatcctgccttgcagacagagaagtggcgctttcacgcgccaactaccgttggcaacgacgtttggcttggaacgaactgcgtaatcgtggctggcgtcaagattggggatggggcggttgtgggcgctggcgctgtggtgacgaaggatgtcgccccttacgaaatcgtgggaggagttccagcgcggcgcatccgacttcgcttcgatgaagacaaagtgtcgcgcctgctcaagacacgctggtgggatcttccccttgattcattgaaagatattccgttcggcaatatcgatcaggccattgcatccattgaagccatccgaagcagcaaggaaagcgcgtga

SEQ ID NO: 15850 - protein, 241 aa, Ralstonia metallidurans CH34
MREWLLSAIYKGRIMPTENEAERQSADIRKRCAELGGRIAPTAQVSSAVSFDEAIDIGDGAVAYAPAFIGGFTYVNVGAVVFPHVRIGKFCSIGRNVQIGAARHPVEFLSSHPFQFSPALFNRVPGYPALQTEKWRFHAPTTVGNDVWLGTNCVIVAGVKIGDGAVVGAGAVVTKDVAPYEIVGGVPARRIRLRFDEDKVSRLLKTRWWDLPLDSLKDIPFGNIDQAIASIEAIRSSKESA

SEQ ID NO: 15851 - DNA, 549 bp, Paracoccus denitrificans PD1222
  CDS (1)..(549): transl_table=11
ttgaccgcgcgcgaggacatgctggccggccggccctataaccccggcgacggcgagttggtggcgatgcgcaaggccgcgcagggattgatgcgcgactacaataacacgatcatcggcgacaagacccgcgcccgcacgctgacccagctgctgggcacgtggaacggcgccgtgatccgcacccccttccatgtcgattacggcaagcatatccatttcgggccggattgcttcgtgaattacggctgcttcttcatggatatctgcgagatccgcatcggcgcgcgctgccagttcggcaccgccgtgcaactgctgaccgaggaccggccgcgcgaccgcgaaagccgggccacgggcgaggaatggggcaagcccatcgccatcggcgacgatgtctgggtgggcggcggcgcaatcgtcctgccgggcgtgtccatcggcgacggcgccatcgtcggcgccggcgcggtggtgacgcgcgacgtggcgccggggaccaccgtggtcggcaacccggcccgtccgctgccgccgaaatcctga

SEQ ID NO: 15852 - protein, 182 aa, Paracoccus denitrificans PD1222
MTAREDMLAGRPYNPGDGELVAMRKAAQGLMRDYNNTIIGDKTRARTLTQLLGTWNGAVIRTPFHVDYGKHIHFGPDCFVNYGCFFMDICEIRIGARCQFGTAVQLLTEDRPRDRESRATGEEWGKPIAIGDDVWVGGGAIVLPGVSIGDGAIVGAGAVVTRDVAPGTTVVGNPARPLPPKS

SEQ ID NO: 15853 - DNA, 615 bp, Shewanella frigidimarina NCIMB 400
  CDS (1)..(615): transl_table=11
atggcagacatagattatcaagcacaacataagaaacgcttatcatggatgccatggctgtatttttcacttaaaccaaagcatttatcatgggcaaaaccttggcaagatgacattcaacaacggttatgtcagcttgaaaccattcatataggtgaacagtgttttattgccccacaagctcagctttttgccgaaccgggtcgtgatatctctataggtaaccaatgcatgattgccgcggatgtgtttatgcatggtccaatcaccctaggcaatgaagtggccattaaccatggctgtagtatagacgggggccgaaatggtatcaaaattggcaaccaaactcgtattgctaacaacgtcacgatttatgcctttaaccatggcatgtcacccagcgaacccatttataaacaacccgcgacatcaaaaggtgtagtgataggccaagatgtatggattggcgctcaggcgggcattgttgacggtgtcaccattggagattgtgcggtgattggcatgggctgcattgtcacaaaagatgtacccaattttgctattgttgctggtaatccagcccgagttattggcgaccgacgcgataaaaaatag

SEQ ID NO: 15854 - protein, 204 aa, Shewanella frigidimarina NCIMB 400
MADIDYQAQHKKRLSWMPWLYFSLKPKHLSWAKPWQDDIQQRLCQLETIHIGEQCFIAPQAQLFAEPGRDISIGNQCMIAADVFMHGPITLGNEVAINHGCSIDGGRNGIKIGNQTRIANNVTIYAFNHGMSPSEPIYKQPATSKGVVIGQDVWIGAQAGIVDGVTIGDCAVIGMGCIVTKDVPNFAIVAGNPARVIGDRRDKK

SEQ ID NO: 15855 - DNA, 777 bp, Escherichia coli
  CDS (1)..(777): transl_table=11
atgttaagactcaagactcaagactcaagactcaagactcaagactcaagactcaagactcaagactcaagactcaagactcaagactcaagactcaagactcaagactcaagactcaagactcaagactcgttttccgttgatgataatgggtcaggtaatgtttttgtatgtggagatcttgtaaatagcaaagagaataaagttcagttcaatggaaacaataacaaacttattatagaagatgatgttgagtgtcgatggcttaccgtaatatttaggggtgataataattacgtaagaatacataaaaacagtaagattaaaggtgatattgtcgcaacaaaaggttcaaaagttattatcggtagaagaacgacaataggtgcaggttttgaagtcgtcactgataagtgcaatgttacaattggccatgactgcatgatagcaagagatgttattttgcgtgcatcagatgggcatcctatatttgatattcatagcaaaaaaaggattaattgggcaaaagatatcattatatctagttacgtatgggtagggagaaatgtctctataatgaaaggagtatctgttggaagcggatctgtcattgggtatgggagtattgtaactaaagatgtgccatctatgtgtgcagcagccggtaatccagcaaaaataataaaaagaaatataatatgggcaagaacggataaagcggagctaattagtgatgacaagagatgctccagctatcatgcgaagctcacgcaataa

SEQ ID NO: 15856 - protein, 258 aa, Escherichia coli
MLRLKTQDSRLKTQDSRLKTQDSRLKTQDSRLKTQDSRLKTQDSFSVDDNGSGNVFVCGDLVNSKENKVQFNGNNNKLIIEDDVECRWLTVIFRGDNNYVRIHKNSKIKGDIVATKGSKVIIGRRTTIGAGFEVVTDKCNVTIGHDCMIARDVILRASDGHPIFDIHSKKRINWAKDIIISSYVWVGRNVSIMKGVSVGSGSVIGYGSIVTKDVPSMCAAAGNPAKIIKRNIIWARTDKAELISDDKRCSSYHAKLTQ

SEQ ID NO: 15857 - DNA, 651 bp, Pseudomonas fluorescens
  CDS (1)..(651): transl_table=11
atgaagcacattctggaaacctttaagaaacatcatgtatttttaatatataaaatatcaaaaagaatactgaccttattaagagtttttttcatcctaaagatcaatccaagatcaagaacaaaatgcacattgggagcaaattctagaattcttggaatacaaaacataacaatagcaggaaacttctctctgggtgatcacttttggttggaagccatctcagagtatcgtgaccagatttttgagccacacattgagatcggagataatttttccgcaagcgactttgttcaccttgcctgcgttaacaaaatctccataggacgaaacgtacttttaggaagcaaggtgcacataacagaccattctcatggagtttatagcggagaagctcattcaagtccccacatagcacctatcgagcgacctctatcaagccccggacatgtaatcattgaagataatgtatggatcggggataacgtgacaatacttccaaatacatctataggaagtggatctattatcggggcaaacagtgtagtttcaaaaaacatcccaaaaaatgtcattgccgtcggagtacccgcaaaacctattaagaggtgggacgacatacaaaaggaatggacagccatactgatttaa

SEQ ID NO: 15858 - protein, 216 aa, Pseudomonas fluorescens
MKHILETFKKHHVFLIYKISKRILTLLRVFFILKINPRSRTKCTLGANSRILGIQNITIAGNFSLGDHFWLEAISEYRDQIFEPHIEIGDNFSASDFVHLACVNKISIGRNVLLGSKVHITDHSHGVYSGEAHSSPHIAPIERPLSSPGHVIIEDNVWIGDNVTILPNTSIGSGSIIGANSVVSKNIPKNVIAVGVPAKPIKRWDDIQKEWTAILI

SEQ ID NO: 15859 - DNA, 579 bp, Staphylococcus haemolyticus
  CDS (1)..(579): transl_table=11
atgacagaaaaagaaaagatgttagcacaccagtggtatgatgccaattttgataaagatttggaaactgaacgagtacgtgcaaaagatttatgttttgactttaaccaaacgcgtccgagtgatgacagtagaagacaggctatattaactgaattatttggttatacattagagaatgtcgcaattaatagtccgttcgatacagattatggttggaatgttaaattaggcaaaaatgtgtttgttaatagtaattgttacttcatggatggaggtggcatcacgattggtaatgatgtatttataggtccgtcttgtggcttctatactgcccatcatccattaacgcctaaagaacgtaatgcaggtttagagttggcgcagccgattactattggaaataatatttggtttggtggcaatgtcgttgtcacacctggtgtaacgattggagatggttcagttatagcagcaggaagtgtagtaactaaagatgtaccaccgaatagcctagttgcgggtgtgcctgctaaagtaataagagagataaatgaaaatgacgcacctaaaaattaa

SEQ ID NO: 15860 - protein, 192 aa, Staphylococcus haemolyticus
MTEKEKMLAHQWYDANFDKDLETERVRAKDLCFDFNQTRPSDDSRRQAILTELFGYTLENVAINSPFDTDYGWNVKLGKNVFVNSNCYFMDGGGITIGNDVFIGPSCGFYTAHHPLTPKERNAGLELAQPITIGNNIWFGGNVVVTPGVTIGDGSVIAAGSVVTKDVPPNSLVAGVPAKVIREINENDAPKN

SEQ ID NO: 15861 - DNA, 648 bp, Aspergillus fumigatus Af293
  CDS (1)..(648)
atgatgcccagaacggagaaagacagccagatcatcgaaaaggccaaaagccttcagggtgtctgctggggcgaggaatatgagaagatgatatcagggatactatatagtccgctcgcgtcggagctcatagagggtcgcaccagggcgcgcttcctaatgtcggaattcaatggtcctcctaaacccgatgtgccgttctctgagaccgttgcgcagagggaggtgacattaaggaagttgtttgggcgggtaggaaggggcgtctatatcgagcctcctctctttgtggactatggctgcaacatcagtgttggagacggtttttatgcaaacttcaatttgactgtcctggactgtggactggtcaccatcggaaacaacgtggagattggcccgaatgtaaacatcatcacgggcgagcacgagacgaagatcgaagcccgtcgcaaacatcgaggaacggagttcaccagggaagtcattatcggtgatgattgctggattggagcgaatgtgactatcttggctggggtgaccattggatcagggtgctccatcggtgctggctctgtggtgaagagagatatcccgccgtatagtattgcagtgggaagtcctgctcgagttatcaggtcggcagtctga

SEQ ID NO: 15862 - protein, 215 aa, Aspergillus fumigatus Af293
MMPRTEKDSQIIEKAKSLQGVCWGEEYEKMISGILYSPLASELIEGRTRARFLMSEFNGPPKPDVPFSETVAQREVTLRKLFGRVGRGVYIEPPLFVDYGCNISVGDGFYANFNLTVLDCGLVTIGNNVEIGPNVNIITGEHETKIEARRKHRGTEFTREVIIGDDCWIGANVTILAGVTIGSGCSIGAGSVVKRDIPPYSIAVGSPARVIRSAV

SEQ ID NO: 15863 - DNA, 747 bp, Aspergillus fumigatus Af293
  CDS (1)..(747)
atgtccatctttcagagtggcattgatcagcggccggcacatactggcaccgtggacatgaacagcccccaggcacaggctcgaatggctcttagcattgagcatcagctgtccaatcgcaccgtaagtgaagaatcggagaaggacaagatgattcgcggcgagctttatcgccctttcgatattcaccttgtggaggagcgcgagcgatgcaaagcagccatctggcggttcaacaatgcttgtaatcctgtttcgggcttgagtgcgaaggaacagaatcgcctgctgaaggaggttctgattcctcctggttcggttgttggttctccatcgagcgtgggaccactaagacccgccggatctattgggcaaggcgctgttgttgagtcaccttttcaatgccactatgggttcaacattcacattggtgaggacgttatgatatcagagaattgtctcttcgtggatgactgtcctatcactatcggtgctcatacatggataggtcctcgagtcactattctcagttctatggcccatgcaaacatgcaagaacggaagggctctcaaagccgctaccaaggccgtcccgtcacgattgaggaggactgttacgtcggcgctggttgcactatatatcccggtgtccgtcttcggcgtggtgcctatgtggctccgggcgaggtagtcaaaagtgacattgtagcctatggttttcagggtctaaagccaagctacatgtga

SEQ ID NO: 15864 - protein, 248 aa, Aspergillus fumigatus Af293
MSIFQSGIDQRPAHTGTVDMNSPQAQARMALSIEHQLSNRTVSEESEKDKMIRGELYRPFDIHLVEERERCKAAIWRFNNACNPVSGLSAKEQNRLLKEVLIPPGSVVGSPSSVGPLRPAGSIGQGAVVESPFQCHYGFNIHIGEDVMISENCLFVDDCPITIGAHTWIGPRVTILSSMAHANMQERKGSQSRYQGRPVTIEEDCYVGAGCTIYPGVRLRRGAYVAPGEVVKSDIVAYGFQGLKPSYM

SEQ ID NO: 15865 - DNA, 687 bp, Aspergillus fumigatus Af293
  CDS (1)..(687)
atggcagccagcgaaaagcgccccgagatcatcgcactcgcgcgcgaactgaaagacgttcccatgtgcgaggaatacgagcgcatggtttccggcatgatgtacaatcctaacacacccaaactactcgaggcacggcaccggtgtcgcgggctaacagccgactacaacggcctggatacgaaaacggtgccctacgaacaaatcgccgagaaaaggctcgagctgctccggcgcgtggtcggccgagtgggcgacggcacgtttatcgagccgccgttcatggcagactacggatgtaacatcattatcggcaagaattgtttcattaattggaatctcactgtgctggacacaagcctcgtcgtcatcggtgaccgggttcagataggaacgaacgtcagcatcatcactgccggccacgacacgagtatcctgtcgcggcggaagaatgtggaattcggccacccgatcttcatcgaggatgactgctggattggtgcgaatgtcgtcattctgcctggcgtgaggatcgggcagggttcgacgattggcgcgggctccatcgtcaccaaggatattccgcccttctctgtggcactggggagtccgtgccgggtcaaacggacgattccatcggcggaggaagaagagcaggatgagacaaatccgttcaggaatctgtag

SEQ ID NO: 15866 - protein, 228 aa, Aspergillus fumigatus Af293
MAASEKRPEIIALARELKDVPMCEEYERMVSGMMYNPNTPKLLEARHRCRGLTADYNGLDTKTVPYEQIAEKRLELLRRVVGRVGDGTFIEPPFMADYGCNIIIGKNCFINWNLTVLDTSLVVIGDRVQIGTNVSIITAGHDTSILSRRKNVEFGHPIFIEDDCWIGANVVILPGVRIGQGSTIGAGSIVTKDIPPFSVALGSPCRVKRTIPSAEEEEQDETNPFRNL

SEQ ID NO: 15867 - DNA, 603 bp, Lactobacillus crispatus
  CDS (1)..(603): transl_table=11
atgtcgcttagaacaaaatttaattacatggctactggtcgtccttataatgatgcggatcctcgccttggcaccttgagagaccttgctaccttgaagaccaataatattaataatgagaatgatcacgctaaaaaagaaatattaatcaaagaactctttggttcaacaggtgagcatcccttcgtgaaccctaattttcgttgtgaatttggacaaaatattcatgttggggataacttttatgccaactatgattgcacgattttagatggcgcgcctgtttatattggaaacaatgttttgtttggtcctaaggttggcttgtataccagcaaccatttatttgatccagccgagcgaaaagccggtggttgtgttgcacattcgatcggcattggtgacaatgtctggctaggtgcaggggttagcgtaactccagatacaattattggacgtaattcaattattggtgcaggcagtgtagttgtgaatgacatcccagataatgtaattgcagcggggaatccatgcaaggtaattagaaagattaccgcggcagatcgtactggattcgatcctaatagtggtcaatttctatag

SEQ ID NO: 15868 - protein, 200 aa, Lactobacillus crispatus
MSLRTKFNYMATGRPYNDADPRLGTLRDLATLKTNNINNENDHAKKEILIKELFGSTGEHPFVNPNFRCEFGQNIHVGDNFYANYDCTILDGAPVYIGNNVLFGPKVGLYTSNHLFDPAERKAGGCVAHSIGIGDNVWLGAGVSVTPDTIIGRNSIIGAGSVVVNDIPDNVIAAGNPCKVIRKITAADRTGFDPNSGQFL

SEQ ID NO: 15869 - DNA, 642 bp, Cryptococcus neoformans var
  CDS (1)..(642)
atgccccctgctcctgctcctcaccttaccaacaagcttattccacctcccgaggaaggtgaagaccctacccagttgtctttgatgatctccaccaaaccctacctcgcccttgacaaataccttgaccgtcttcgcaatcgtggtgctatcaaactagatgaaattacgagaacacctgatcatgagaagcgcatggagctttggaaggagtttgccaacataggcgaaaatgtatcaatcactcaacgatttttctgcgaatatggcttcaatttgcattttgaaggcgagaacttcatcgcagctgattgtacattcgttgatgtctgcccaatttacatcggcaagagaacgatgattggtccgaacgtcagaatatacactcccgaccaccctatttctcccgaagctcgagccggtttgactggtgaggagtggggcaagattgtaaggattgaagaggactgttggatatgcggttctgctatcatcttgcctggcgttaccgtcggtaagggaagcactgttgccgctggagcagtagtcacgaaagacatccctcccaggagtctggccatgggtaatcctgctcgtgtcgtcaagaaaattctggaggacggtaccattgtcaaggcttaa

SEQ ID NO: 15870 - protein, 213 aa, Cryptococcus neoformans var
MPPAPAPHLTNKLIPPPEEGEDPTQLSLMISTKPYLALDKYLDRLRNRGAIKLDEITRTPDHEKRMELWKEFANIGENVSITQRFFCEYGFNLHFEGENFIAADCTFVDVCPIYIGKRTMIGPNVRIYTPDHPISPEARAGLTGEEWGKIVRIEEDCWICGSAIILPGVTVGKGSTVAAGAVVTKDIPPRSLAMGNPARVVKKILEDGTIVKA

SEQ ID NO: 15871 - DNA, 513 bp, Klebsiella pneumoniae
  CDS (1)..(513): transl_table=11
gtgtcacgcaaacaagataatcccgatgttcaaaggagttttttagtttccttaatcagatcctttataagaaattggagatttcaattaattagatttaaaaatagagggaaaatttcgcggggaaaaaatgcttatgttggcccaagtgcaaatgtttatatccctaattttgtaaaaatgggtgataacatatctattggtgctgattttatttcacaagtgaatctgactattggaaatgatagtttaatatcctcacgtgtatcatttattggtaacgaccatgatttattcaatgagtcatcttcagcatatttctctggaagaaacaagcctgccactatagtactggaaggagataattttatcggatttggttcggttattttgggaaatgtcacgatagggaaaggtgctattgttgcagcctgttcatttgttaataaagatgtcccacctaattctgtagtaggtggggtacctgcaaaagtattaagaaatcgttattga

SEQ ID NO: 15872 - protein, 170 aa, Klebsiella pneumoniae
MSRKQDNPDVQRSFLVSLIRSFIRNWRFQLIRFKNRGKISRGKNAYVGPSANVYIPNFVKMGDNISIGADFISQVNLTIGNDSLISSRVSFIGNDHDLFNESSSAYFSGRNKPATIVLEGDNFIGFGSVILGNVTIGKGAIVAACSFVNKDVPPNSVVGGVPAKVLRNRY

SEQ ID NO: 15873 - DNA, 555 bp, Vibrio cholerae non
  CDS (1)..(555): transl_table=11
atgagagaaagagaaaaaatgctctctggcgagtattacgatccgagtgacgctgagctcgtcaagttgcgtcttgaggctcgtttactcacggagaagctaaatcaaacaagtgtaagttgcccagagaaaagagtagagataatcaaatccttgttgggctctacaggaaatagcattcacattgaatctaccttcaactgcgattacgggctgaatatacacgttggtgagaatttctatgccaattttggctgtgtcattttggacgtagcggaagttcgtattggcgataactgttttatagcaccacaggttggaatttatactgcaactcatccaatcgatccgattcagagaaacagtgggttagagtttggaaagcaaatcagaataggtaacaactgttggattggaggtcatgcaacgatcaacccaggagtgatgttaggtgacaatgttgttgttgcctcgggagccgttgtgacaaagagttttggtagcaatgttgttattggtggcaatccagcacgagtgttaaaagaaatcgagtaa

SEQ ID NO: 15874 - protein, 184 aa, Vibrio cholerae non
MREREKMLSGEYYDPSDAELVKLRLEARLLTEKLNQTSVSCPEKRVEIIKSLLGSTGNSIHIESTFNCDYGLNIHVGENFYANFGCVILDVAEVRIGDNCFIAPQVGIYTATHPIDPIQRNSGLEFGKQIRIGNNCWIGGHATINPGVMLGDNVVVASGAVVTKSFGSNVVIGGNPARVLKEIE

SEQ ID NO: 15875 - DNA, 645 bp, Rhizobium etli
  CDS (1)..(645): transl_table=11
atgcaaaatatcgccagaaatatctccaatcgattagccgggtttgtctatcgccagatgcgtaaggcgcatgcgaatgcaaattcaaccgttggctactcagtaaatgccaatggcgccttgctggccgggtgtgtcattgactgcagatccggcaagtccgacggacgggtattctttggcaaggattccgttctctcttgcaggattgttctcgagcgtgatgttggcacggtgcacattgggaatgacagctatgtaggaggttctcaaatcatttgcgccgaccacatcgagattggaaataatgtccttatctcctggggctgcacaattgtcgatcacgattcacattccgtcgattggcgcaaccgtgccgaggatgttcgtaagtggcgtgaagggcttttgtcgggaggccttgaaaaggcgagcgaatccaaggactgggcggttgtcgagaaggctccgataaaaattggagataagacttggctcggtatgaatgtaaccgtgttgaaaggaataacgattggagaaggggcggtcgtcgccgctggatctgtcgtcacaaaggatgttgacccgtggactctggttgccggaaatcccgcgcgggtgatcaaggaattgccgaaatcatga

SEQ ID NO: 15876 - protein, 214 aa, Rhizobium etli
MQNIARNISNRLAGFVYRQMRKAHANANSTVGYSVNANGALLAGCVIDCRSGKSDGRVFFGKDSVLSCRIVLERDVGTVHIGNDSYVGGSQIICADHIEIGNNVLISWGCTIVDHDSHSVDWRNRAEDVRKWREGLLSGGLEKASESKDWAVVEKAPIKIGDKTWLGMNVTVLKGITIGEGAVVAAGSVVTKDVDPWTLVAGNPARVIKELPKS

SEQ ID NO: 15877 - DNA, 558 bp, Bacillus stearothermophilus
  CDS (1)..(558): transl_table=11
atgaaaaccgaaaaagaaaagatggtagcgggacacttgtacaatcccgctgatccggagctcgtcaaggagcgggagcgggcgcggcggctcgttcgtttgtataacgaaacgttggaaacggaatatgaaaagcgaaccgctctgctgaaggagctgttcggttcaacgggagaacggctgtttatcgagccgaacttccgctgcgactacggctacaacattcatgtcggcgaaaacttttttatgaactttgatggcgtgattttggatgtatgtgaagtgcgaatcggcgaccattgttttattggtcctggtgtgcacatttatacggcgactcacccgctcgatccgcacgaacgaaattccgggttggagtacggaaagccggttgtgatcggccataacgtctggatcggcgggcgggccgtcatcaacccgggcgtcacgatcggcgacaacgctgtcatcgcctcaggggcggtcgtgacaaaagatgtccccgccaacgcggtcgttggcggaaacccggcgaaagtgatcaaatggctcaaatag

SEQ ID NO: 15878 - protein, 185 aa, Bacillus stearothermophilus
MKTEKEKMVAGHLYNPADPELVKERERARRLVRLYNETLETEYEKRTALLKELFGSTGERLFIEPNFRCDYGYNIHVGENFFMNFDGVILDVCEVRIGDHCFIGPGVHIYTATHPLDPHERNSGLEYGKPVVIGHNVWIGGRAVINPGVTIGDNAVIASGAVVTKDVPANAVVGGNPAKVIKWLK

SEQ ID NO: 15879 - DNA, 594 bp, Rhizobium leguminosarum bv
  CDS (1)..(594): transl_table=11
atgaagcttagcctgaccacgatcgcaaacatggcggcgggatggttggctcgcaagcggagcaaatttgtcgttgggagtggtagcaatgtccgttggctgatattgcgatccgttcgcggaggcaatgtgaagatcggcgagaactgtatcatcaattgcaatatcagcttcgatgatccccgcggccgcatcagcattggcgatcgctgctatattggtgccagtcacctggtatgccattccggaattacgattggaaacgatgtcatcatctcatggggagtgacaatcgtggatcatgattctcattctctcgactgggaattgcgcaagaacgatgtgaccgattggggcttaggaaagaaggattggaccggggtttccatcaagccagtgtttattcaaaacaaggtgtggattggttttggcgtgagtatcctgaagggggtgacagtcggcgacggggcagttattggagcccatgctgttgtcacgcgcgatgtccccccttacaccgtcgtcgccggtaaccccgctcgcataattcggaatctcaagccgacgcaaaaagagacagaaggtcaaccatga

SEQ ID NO: 15880 - protein, 197 aa, Rhizobium leguminosarum bv
MKLSLTTIANMAAGWLARKRSKFVVGSGSNVRWLILRSVRGGNVKIGENCIINCNISFDDPRGRISIGDRCYIGASHLVCHSGITIGNDVIISWGVTIVDHDSHSLDWELRKNDVTDWGLGKKDWTGVSIKPVFIQNKVWIGFGVSILKGVTVGDGAVIGAHAVVTRDVPPYTVVAGNPARIIRNLKPTQKETEGQP

SEQ ID NO: 15881 - DNA, 573 bp, Dictyostelium discoideum
  CDS (1)..(573)
atggataccaaaatgacagaaagagaaaaaatgaccaaaggattaatgtatgacccaggtgatgaagaattatgtaaaggtagaaccgaagccagacaacttattcatagatttaataatagcatggataagttggaaagaaaagatatcaccaaacaattatttggatcaactggcgaaaagatttatcttgaaccaacattaagagtggattatggctacaatattcacgttggtgagaatttctatgcaaattttggtgccatatttttagatatttgcccaattacaattggaaagaatgcaatgttagctccaaatgttcaattatattctgcaactcacccaattgatccaactgaacgtaactctggtttagaatttggtaagcctattacaattggagataatgcttggattggtggtggagcaataattttacttggtgtcacattaggtgataatgttgttgttggttttggagctgtagtaactagatcatttggaagtaatgttgttattgctggaaatccagccaaagttattaaagaaatacctgttaaatccgaataa

SEQ ID NO: 15882 - protein, 190 aa, Dictyostelium discoideum
MDTKMTEREKMTKGLMYDPGDEELCKGRTEARQLIHRFNNSMDKLERKDITKQLFGSTGEKIYLEPTLRVDYGYNIHVGENFYANFGAIFLDICPITIGKNAMLAPNVQLYSATHPIDPTERNSGLEFGKPITIGDNAWIGGGAIILLGVTLGDNVVVGFGAVVTRSFGSNVVIAGNPAKVIKEIPVKSE

SEQ ID NO: 15883 - DNA, 657 bp, Physcomitrella patens
  CDS (1)..(657)
atgtcgacgactaaccttcccgaagatggtcctctgcctcaaggagctccggtgccagagcccttctactggcctctgggcgaggcattgttcgcccagagacgagacgcacgggaaaagctgcgaagatacaacatgacgggcctttcgtctttgcccacaaaggagctggaggctcagcgaaccgagattttgaaagagttgtttgggaaaatcaacattgagaagccccccttcatagagccgcctttccagtgcgactacggccacaacatcgaggtcggcgcagacttgtacatgaactttggatgctgcattctggattgtgccaaagttaccatcggcgacaatgtcctgtttggacccaacgtccagatttattgtcccggccatcccctcgatcccgtcttaagaaatggagtcaatggacctgaatacgcgttgcctgtcacaataggaaacgatgtctggatcggtggcggtgctatagtactgccgggggtaaccattggcgatggcgctgttgtaggagctggagctgttgtgacgaaggacgtggagcccatggttgtagtggctggtaaccctgccaaagtagtgcgcagagatgtcaagggcagttggggtagcgttgtatcgcgccacaagaatgcgtga

SEQ ID NO: 15884 - protein, 218 aa, Physcomitrella patens
MSTTNLPEDGPLPQGAPVPEPFYWPLGEALFAQRRDAREKLRRYNMTGLSSLPTKELEAQRTEILKELFGKINIEKPPFIEPPFQCDYGHNIEVGADLYMNFGCCILDCAKVTIGDNVLFGPNVQIYCPGHPLDPVLRNGVNGPEYALPVTIGNDVWIGGGAIVLPGVTIGDGAVVGAGAVVTKDVEPMVVVAGNPAKVVRRDVKGSWGSVVSRHKNA

SEQ ID NO: 15885 - DNA, 636 bp, Aeromonas hydrophila
  CDS (1)..(636): transl_table=11
atgttaagcggcttgttaacagcatttaagaaaagtattagtaaaagaaaaataataataaagtcatccttttataaggtgcgaaatagtacatcaagattctctgataagacgatacttttccgtatggcccatgttagccactccgatataggaaggtatacatatatagccggttatgcaaatataaataactgtacgataggatccttttgttctattgctgatggcgtgagggttggagttggggtacaccctctgaacttgatatccactcatcctgcattgtattccgtaaaaactatttttccatataaattaatagatgaagcaatcattaattcattaccaagtcacgaagagtccaagcgaattaatattggtaatgacgtttggatagggactgattctattattttagatggtgttaatattggtgatggtgccgtcatcgccgcaggttctgttgtaacaaaagatgtacctccttttgctgtcgttggtggggttcctgcccgtgtaattaaatacagaaccattcctgacatgatagatggtaagccatggtgggagttacaagatgctgaattgtcttgttatctaaataaaatatataaagataatcaaaaggaatga

SEQ ID NO: 15886 - protein, 211 aa, Aeromonas hydrophila
MLSGLLTAFKKSISKRKIIIKSSFYKVRNSTSRFSDKTILFRMAHVSHSDIGRYTYIAGYANINNCTIGSFCSIADGVRVGVGVHPLNLISTHPALYSVKTIFPYKLIDEAIINSLPSHEESKRINIGNDVWIGTDSIILDGVNIGDGAVIAAGSVVTKDVPPFAVVGGVPARVIKYRTIPDMIDGKPWWELQDAELSCYLNKIYKDNQKE

SEQ ID NO: 15887 - DNA, 600 bp, Aeromonas hydrophila
  CDS (1)..(600): transl_table=11
atgaagttttatatagagcactatggtttttggggatgtatcaggttaataatagaggtgattttcacaaaaatcagatttcgtaatgcgaaaataattcgtactccctttgaatgccgtggtaaaaagttattcaaaattggccgcggatttactacaggtagatactgcagactagaagcgcatggttctgaaggtaccaaagttataattggagaacgttgccagataaatgactcggttcatattgcagcagcggacagcattgttattggtgatgatgtgttgatcgccagccgggtgtttatcacggacctcaatcatggtagctacagtggagaagagcactctcatcctgattccatttgcagggagcgcatgctgcatactaagccggtcttgattgagtcaaatgtttggcttggcgaaggtgtagtcgtgttgcctggtgtaacgattggcaaggcctccatcattggcgcaaattcggtggtttccagagatatacctgcaaattccattgcggtaggtaatccggcaagagtgattaagcggtttgatttccaatgcgggcaatgggtggctgtggatgcgaagtaa

SEQ ID NO: 15888 - protein, 199 aa, Aeromonas hydrophila
MKFYIEHYGFWGCIRLIIEVIFTKIRFRNAKIIRTPFECRGKKLFKIGRGFTTGRYCRLEAHGSEGTKVIIGERCQINDSVHIAAADSIVIGDDVLIASRVFITDLNHGSYSGEEHSHPDSICRERMLHTKPVLIESNVWLGEGVVVLPGVTIGKASIIGANSVVSRDIPANSIAVGNPARVIKRFDFQCGQWVAVDAK

SEQ ID NO: 15889 - DNA, 678 bp, Corynebacterium glutamicum
  CDS (1)..(678): transl_table=11
atggacaatgactttgaatctatcgagaaaatgagcagcggcgattggtacgtggctaccggcgcggaacgtgaagaagtggcacaaaaaacagcgttacttttccacgaatacaaccaaattggacctacagaccccgcacgaactgccgaaatactaagaactgtactaaatcctgccagcggaacctgcacgatcaaagcgccagccatcattgaatacggcttcaacaccacgatcggcgagcatgtgttcatcaactttggcctcaccattttagatatcgcaccggttcgcatcggggcacgcagcatgctcgggccaaactgtcagctcttcaccgcaggtcacccggtcgatgactgggaaatgcgctccggtgggtgggaaaatggcgcacccatttccattggcgaggatacgtggctgggtggaaatgtcaccgtcgttggtggcgtgagcattggcgataggtgtgtgattggcgcgggggccgtggtgaccaaggatattccggatgattctattgctgtgggcaaccctgcgcgagtagtgcggaaacgtgatgatagccggctcgaacgttcgcagctgccagaaggtgcttccgtggatgcgttggggattcttcctacaaaatcacctaggctgtcagaaaatattgccgaaaaatattaa

SEQ ID NO: 15890 - protein, 225 aa, Corynebacterium glutamicum
MDNDFESIEKMSSGDWYVATGAEREEVAQKTALLFHEYNQIGPTDPARTAEILRTVLNPASGTCTIKAPAIIEYGFNTTIGEHVFINFGLTILDIAPVRIGARSMLGPNCQLFTAGHPVDDWEMRSGGWENGAPISIGEDTWLGGNVTVVGGVSIGDRCVIGAGAVVTKDIPDDSIAVGNPARVVRKRDDSRLERSQLPEGASVDALGILPTKSPRLSENIAEKY

SEQ ID NO: 15891 - DNA, 624 bp, Lactococcus lactis
  CDS (1)..(624): transl_table=11
atgcttaaattagaaaactacaaacgagttcacacgggagaactctactttcctaacgatcaaaaattatggaaagagcaacaagaagctttagttttactggaaaagtttaatcaaacttcagtgactcagccagagcaacaaatggtacttctcaaagaaatgttttcagaaattggagaaaattgttttattcaaccccctttctatgctaattttggtggaaaaaatgtccattttgggacagggatttacgctaattttaatctaacattagttgatgatacagatatttttgtaggaaatcatgtcatgtttggaccaaatgttacgattgacacggcgacacattctgtctcgcctgacttacgtaaacgaggggctcaatataataaaaaagtttatattgaagaaaatgtttggctaggtgctggagtaattgttttacctggtgttagaattgggaaaaatagtgtgattggcgcagggagtcttgtaactaaagacattccagataatgtggttgcttttggaactccttgtagggttaaaagaaaaatcaatgattctgactttaaaacttatgatcatggaaaaaagattgatttagatgatttcatctga

SEQ ID NO: 15892 - protein, 207 aa, Lactococcus lactis
MLKLENYKRVHTGELYFPNDQKLWKEQQEALVLLEKFNQTSVTQPEQQMVLLKEMFSEIGENCFIQPPFYANFGGKNVHFGTGIYANFNLTLVDDTDIFVGNHVMFGPNVTIDTATHSVSPDLRKRGAQYNKKVYIEENVWLGAGVIVLPGVRIGKNSVIGAGSLVTKDIPDNVVAFGTPCRVKRKINDSDFKTYDHGKKIDLDDFI

SEQ ID NO: 15893 - DNA, 621 bp, Candida albicans
  CDS (1)..(621): transl_table=12
atgatcagtggtatgctctacaactgtttacaaaaagaattggaaacaacacgtatgtcttgcagagactacatgttggactacggcagtttcagaactagagattataaaacaacccaagaatttcttgatgcaaaatacaaacatttagaaagtttcattggacatgttggcaaaaatgcatttatggaatatccaatctattttgattatgggtttaacacttatttgggtgataatttctattccaattacaatttgacaattttggatgtttccatagtcagaattggtaataatgtcaagtgtggtcccaatgtatctatccttaccccaacacacccagtggatcccactttgcgctatgatcaattggaaaatgccttgcctgtgacggtgggtaacggggtctggttgtgtggaagctgtaccattcttggtggggtgacagtaggtgatggcagcattgtggctgctggtgcagttgtcaacaaggacgttccaccaaacactgtagttgcgggagttcctgctagggtagttaagcagctagaacctagagaccctaactttgacactatggcagttttgaaacaatatggtatgggttatatagattag

SEQ ID NO: 15894 - protein, 206 aa, Candida albicans
MISGMLYNCLQKELETTRMSCRDYMLDYGSFRTRDYKTTQEFLDAKYKHLESFIGHVGKNAFMEYPIYFDYGFNTYLGDNFYSNYNLTILDVSIVRIGNNVKCGPNVSILTPTHPVDPTLRYDQLENALPVTVGNGVWLCGSCTILGGVTVGDGSIVAAGAVVNKDVPPNTVVAGVPARVVKQLEPRDPNFDTMAVLKQYGMGYID

SEQ ID NO: 15895 - DNA, 519 bp, Staphylococcus aureus
  CDS (1)..(519): transl_table=11
atgaaaaaattatttttaaagttaatgaaaaggaatctatctgaagataagataaggaaattgggtgtacaagttggaaatgattgtaggtttttaagtgttgatagatcaacatttggatctgagccttacctgattcaaataggaaatcatgtaacaataactagtggtgtaaaatttgctacccatgatggtggggtatggatttttagaaaaaaatatcctgagatagataattttcatagaatatttatcggtaataatgttttcatagggattaattcaataattttgccaggagtaacaataggaaataatgttgtagtaggtgctgggagtgtggtaacgaaagatgtacctgataatgtaattattggtggtaatcctgccaaaaaaattaaaagtatagaggcctatgaaactaaaatattagaaaatgcggattacacaaaaaaacttaattataatgaaaagaagatatatttattaaataaattcaaagagaataggtataattaa

SEQ ID NO: 15896 - protein, 172 aa, Staphylococcus aureus
MKKLFLKLMKRNLSEDKIRKLGVQVGNDCRFLSVDRSTFGSEPYLIQIGNHVTITSGVKFATHDGGVWIFRKKYPEIDNFHRIFIGNNVFIGINSIILPGVTIGNNVVVGAGSVVTKDVPDNVIIGGNPAKKIKSIEAYETKILENADYTKKLNYNEKKIYLLNKFKENRYN

SEQ ID NO: 15897 - DNA, 555 bp, Bacillus subtilis
  CDS (1)..(555): transl_table=11
atgctgaggacagaaaaagaaaaaatggcagccggagaattatacaattcggaagatcaacaactattactagaacgcaagcatgcgagacagctgattagacaatacaacgaaacaccggaagatgatgcagtgcggacgaagcttttgaaggagctgctcggttcggttggggatcaagtcacgattttgccgacattccgctgtgattatggctatcacattcatatcggagatcatacatttgttaattttgactgtgtcattttagatgtgtgtgaggtgcgtatcggctgtcattgtttgattgcgccaggtgtacatatctacacggccggtcatcctcttgatccgatcgaaaggaaatccgggaaggagttcggtaagcctgtgacaattggagatcaagtttggattggaggccgggcggtgattaacccgggagtgacaatcggtgataacgcagtgattgcttctggatctgttgtcactaaggatgtacccgctaatactgttgtaggcggaaaccccgcaaggattttgaagcaattgtaa

SEQ ID NO: 15898 - protein, 184 aa, Bacillus subtilis
MLRTEKEKMAAGELYNSEDQQLLLERKHARQLIRQYNETPEDDAVRTKLLKELLGSVGDQVTILPTFRCDYGYHIHIGDHTFVNFDCVILDVCEVRIGCHCLIAPGVHIYTAGHPLDPIERKSGKEFGKPVTIGDQVWIGGRAVINPGVTIGDNAVIASGSVVTKDVPANTVVGGNPARILKQL

SEQ ID NO: 15899 - DNA, 552 bp, Escherichia coli; identical to SEQ ID NO: 15433
  CDS (1)..(552)

SEQ ID NO: 15900 - protein, 183 aa, Escherichia coli; identical to SEQ ID NO: 15434

SEQ ID NO: 15901 - DNA, 573 bp, Rhizobium leguminosarum bv
  CDS (1)..(573): transl_table=11
atgacacgcagccaaaaagagaagatgctagcaggcgaaatgtacaacgcagcggaccccgagatccaagccgagttgctcctcaccggggcttggttgaagcggtataatgacacgctgggcgactccgccgagcggtggaatgggctccttttagaacgattgggagcagtcgggcttggagcggttattcgtcctccgttccactgcgattacgggttcaacatccggatcggagcttgggtttacatcaattacaactgcgtcattcttgacgtggcagcggtaactatcggtgacggaaccgcaataggccctgctgtgcagatttacaccgcggaccatccacatgatccagagcagcgccaggctggactgcagttgggacgacctgtcagcattggcaggcacgcctggattggcggtggagcaatcattctcccgggcgtgacaattggcgatcacgctgtcattggcgctggtagtgtggtcacgcgagatgttcctgcaggaagcacggccatgggaaatccagctcgggtcaaggctggtggacgcttgccgaaatcataa

SEQ ID NO: 15902 - protein, 190 aa, Rhizobium leguminosarum bv
MTRSQKEKMLAGEMYNAADPEIQAELLLTGAWLKRYNDTLGDSAERWNGLLLERLGAVGLGAVIRPPFHCDYGFNIRIGAWVYINYNCVILDVAAVTIGDGTAIGPAVQIYTADHPHDPEQRQAGLQLGRPVSIGRHAWIGGGAIILPGVTIGDHAVIGAGSVVTRDVPAGSTAMGNPARVKAGGRLPKS

SEQ ID NO: 15903 - DNA, 552 bp, Rhizobium meliloti
  CDS (1)..(552): transl_table=11
atgacacgcactcaaaaagagaagatgctcgcaggcgagatgtacaacgcagcggatccagaaatccaagccgacttgctggccgctggggcttggctgaagcgctacaatagtactttgggcgactccgccgagcagtggcatttgttcctccgcgaagggctaggcgaggttgggcctggagcggttatccgtccgccctttcactgcgattacggcttcaacatcagtatcggagcccacgcctatatgaacttcaactgcgtcatcctcgacgtggcaaaggtgacgatcggcgatgggaccgcaattgggcccgctgtgcagatctataccgccgatcatccggatgaccccgagcagcggcaggcggggctgcagctcgggcgacctgtccgcattggcaagcacgtgtggattggcggtggcgcgatcatcctcccgggcgtgaccattggcgatcatgcggtcgttggcgcgggcagcgtagtcacgcgcgacgtccctccgggcgcaaaagtaatgggaagcccagctcgggtaaggggctga

SEQ ID NO: 15904 - protein, 183 aa, Rhizobium meliloti
MTRTQKEKMLAGEMYNAADPEIQADLLAAGAWLKRYNSTLGDSAEQWHLFLREGLGEVGPGAVIRPPFHCDYGFNISIGAHAYMNFNCVILDVAKVTIGDGTAIGPAVQIYTADHPDDPEQRQAGLQLGRPVRIGKHVWIGGGAIILPGVTIGDHAVVGAGSVVTRDVPPGAKVMGSPARVRG

SEQ ID NO: 15905 - DNA, 624 bp, Lactococcus lactis subsp
  CDS (1)..(624): transl_table=11
atgcctaaattagaaagctacaaacgagttcatacagaagaactctactttcctaacgatcaaaaattatggaaagagcaacaagaagctttagttttactggaaaagtttaatcaaacttcagtgactcagccagagcaacaaatggaacttctaaaaaaaatgttttcagaaattggggaaaattgttttattcaaccccctttttatgctaattttggcggaaaaaatgttcattttgggacagggatttatgctaattttaatctaacattggttgacgatacagatatttttgtaggaaatcatgtcatgtttggaccaaatgttacgattgacacggcgacacatcctgtctcgcctgacttacgtaaacgaggggctcaatataataaaaaagtttacattgaagaaaacgtttggctaggtgctggtgtaattgttttacctggtgttagaattggaaaaaatagtgtgattggcgcagggagtcttgtaactaaagacattccagataatgtggttgcttttggaactccttgtatggttaaaagaaaaatcaatgattctgactttaaaacttatgatcatggaaaaaagattgatttagatgagttcatctga

SEQ ID NO: 15906 - protein, 207 aa, Lactococcus lactis subsp
MPKLESYKRVHTEELYFPNDQKLWKEQQEALVLLEKFNQTSVTQPEQQMELLKKMFSEIGENCFIQPPFYANFGGKNVHFGTGIYANFNLTLVDDTDIFVGNHVMFGPNVTIDTATHPVSPDLRKRGAQYNKKVYIEENVWLGAGVIVLPGVRIGKNSVIGAGSLVTKDIPDNVVAFGTPCMVKRKINDSDFKTYDHGKKIDLDEFI

SEQ ID NO: 15907 - DNA, 645 bp, Methanococcus jannaschii
  CDS (1)..(645): transl_table=11
ttgagcatgattaaattgttaaaaaacactttaaaagatccaaaaaaaattatgagggctttggaatttgccccttcttttgtttttgggaagatatatttgtctatttttggtataaatcctttgaaggttcataattttggaaaaatccatattagaaaatatgacagctctactataataatcaaaagtgggattcttttaagggatgtagaaatagcagcaagaggcaatggaaaaatcattattggagagaactttcactgtgaaccgtatgttagattaaacgtttttgaagaggggattttagagattggagataattgtggaattggttcattttcaataataaatgctactaaaaaaataacaattggtagtaatgttttaatttcaagtcatgttcatattattgatggagaccatggatttaaaaaaggagaattaataaggaatcagaaaatggtctcagagcctattgaaattggagatgatgtttggattggaacaggagttaaaatattaaaaggggttaaaattggggaaggggctgttattggagctggaagtgttgttacaagagatattcccccatattcagtagctgttggagttcctgcaagagttataaagaagagggaataa

SEQ ID NO: 15908 - protein, 214 aa, Methanococcus jannaschii
MSMIKLLKNTLKDPKKIMRALEFAPSFVFGKIYLSIFGINPLKVHNFGKIHIRKYDSSTIIIKSGILLRDVEIAARGNGKIIIGENFHCEPYVRLNVFEEGILEIGDNCGIGSFSIINATKKITIGSNVLISSHVHIIDGDHGFKKGELIRNQKMVSEPIEIGDDVWIGTGVKILKGVKIGEGAVIGAGSVVTRDIPPYSVAVGVPARVIKKRE

SEQ ID NO: 15909 - DNA, 624 bp, Schizosaccharomyces pombe
  CDS (1)..(624)
atgactcgtactcgtgtacaaaaaatgataccgaaaaccattgaataccaaaaaatgatatctggtcaaccgtacaaggcttacgacgaggagttgactcaagcgagatgtaatgctaaaaaattaatgcgaaggtttaatgacactatgggagatttggaaaatgtaggcccagcagaattgattaaaagacgagctgaactgttggctgaagtttttgtatttgacgaatcttcagcaccagagattgagccacctatggcttttgattacggatttaacgttcattttggaaaaaaattctttgcaaattataattgtacatttctagatgttgccataattactattggtaataatgtaatgctaggccccaatgttcaactatgtacagcaacacatcccttggattttaaagcaaggaactccggaattgaatttggtttaccaattaacattcaggacaatgtttggattggtatgggagttatagttctcccaggtgttactatcggggaaggcagtgtaattggagcgggtgctgttgttacaaaagacatcccacctaatacgttggctgtaggatcacctgccaaacctattcgtaaaattgaaaacgagtga

SEQ ID NO: 15910 - protein, 207 aa, Schizosaccharomyces pombe
MTRTRVQKMIPKTIEYQKMISGQPYKAYDEELTQARCNAKKLMRRFNDTMGDLENVGPAELIKRRAELLAEVFVFDESSAPEIEPPMAFDYGFNVHFGKKFFANYNCTFLDVAIITIGNNVMLGPNVQLCTATHPLDFKARNSGIEFGLPINIQDNVWIGMGVIVLPGVTIGEGSVIGAGAVVTKDIPPNTLAVGSPAKPIRKIENE

SEQ ID NO: 15911 - DNA, 591 bp, Saccharomyces cerevisiae
  CDS (1)..(591)
atgggcgtattagaaaatatagtacctggtgagctttatgatgcgaactatgatccagatcttttgaaaattagaaaagagactaaaataaaattgcacgaatacaacacccttagccccgctgatgagaataaaaagagccaggtaataagagaattacttggtagttgcactgataactttataattgaaccgccgttttactgtgattacggaagtaacatctatatcggagacaacttttacgccaatcacaatcttgttatattggatggggccaaggtagtcatcggtgacaacgtatttatcgcccctaatgttggtatttatacggcaggtcatccaattgacgtggaaagacggcttcaaggattagaatatgccatgcctgtgaccattggagacaatgtatggattggaggtggagtgtcaataattcctggagtaaatataggtaaaaactccgtgattgccgccggtagtgttgtgattcgtgacataccagaaaatgtagtggcagcaggtaatccttgtaaggtgataagaaagatcactgaaaaagatagtacaactacaaactatcgaaaatga

SEQ ID NO: 15912 - protein, 196 aa, Saccharomyces cerevisiae
MGVLENIVPGELYDANYDPDLLKIRKETKIKLHEYNTLSPADENKKSQVIRELLGSCTDNFIIEPPFYCDYGSNIYIGDNFYANHNLVILDGAKVVIGDNVFIAPNVGIYTAGHPIDVERRLQGLEYAMPVTIGDNVWIGGGVSIIPGVNIGKNSVIAAGSVVIRDIPENVVAAGNPCKVIRKITEKDSTTTNYRK

SEQ ID NO: 15913 - DNA, 25 bp, Artificial sequence
  (1)..(25): primer
atgaacatgccaatgaccgaaagaa

SEQ ID NO: 15914 - DNA, 28 bp, Artificial sequence
  (1)..(28): primer
ttaaactgacgattcaactttataatct

SEQ ID NO: 15915 - protein, 204 aa, Artificial sequence
  Variant (2)..(4): xaa in position 2 to 4 is any amino acid
  Variant (5)..(9): xaa in position 5 to 9 is any or no amino acid
  Variant (11)..(26): xaa in position 11 to 26 is any or no amino acid
  Variant (28)..(28): xaa in position 28 is any amino acid
  Variant (31)..(41): xaa in position 31 to 41 is any amino acid
  Variant (42)..(92): xaa in position 42 to 92 is any or no amino acid
  Variant (94)..(94): xaa in position 94 is any or no amino acid
  Variant (97)..(97): xaa in position 97 is any amino acid
  Variant (98)..(101): xaa in position 98 to 101 is any or no amino acid
  Variant (103)..(106): xaa in position 103 to 106 is any amino acid
  Variant (108)..(109): xaa in position 108 to 109 is any amino acid
  Variant (110)..(112): xaa in position 110 to 112 is any or no amino acid
  Variant (114)..(119): xaa in position 114 to 119 is any amino acid
  Variant (120)..(152): xaa in position 120 to 152 is any or no amino acid
  Variant (154)..(154): xaa in position 154 is any amino acid
  Variant (156)..(159): xaa in position 156 to 159 is any amino acid
  Variant (163)..(166): xaa in position 163 to 166 is any or no amino acid
  Variant (168)..(169): xaa in position 168 to 169 is any or no amino acid
  Variant (172)..(172): xaa in position 172 is any or no amino acid
  Variant (175)..(177): xaa in position 175 to 177 is any or no amino acid
  Variant (188)..(188): xaa in position 188 is any amino acid
  Variant (191)..(193): xaa in position 191 to 193 is any amino acid
  Variant (195)..(196): xaa in position 195 to 196 is any amino acid
  Variant (198)..(198): xaa in position 198 is any amino acid
  Variant (200)..(200): xaa in position 200 is any amino acid
IXXXXXXXXGXXXXXXXXXXXXXXXXIXIGXXXXXXXXXXXXXXXXXXXXXXXXXXXXXXXXXXXXXXXXXXXXXXXXXXXXXXXXXXXXXXIXIGXXXXXGXXXXIXXXXXHXXXXXXXXXXXXXXXXXXXXXXXXXXXXXXXXXXXXXXXIXIXXXXWIGXXXXIXXGVXIGXXXVIGAGSVVTKXVPXXXVXXGXPXRVIR

SEQ ID NO: 15916 - protein, 12 aa, Artificial sequence
  Variant (2)..(2): xaa in position 2 is any or no amino acid
  Variant (4)..(5): xaa in position 4 to 5 is any amino acid
  Variant (6)..(6): xaa in position 6 is Ala, Cys, Thr or Val
  Variant (7)..(7): xaa in position 7 is any amino acid
  Variant (8)..(8): xaa in position 8 is Phe, Ile, Leu, Met or Val
  Variant (9)..(11): xaa in position 9 to 11 is any amino acid
  Variant (12)..(12): xaa in position 12 is Ala, Cys, Asp, Gly, Asn, Ser, Thr or Val
IXGXXXXXXXXX

SEQ ID NO: 15917 - protein, 43 aa, Artificial sequence
  Variant (2)..(2): xaa in position 2 is any amino acid
  Variant (3)..(4): xaa in position 3 to 4 is any or no amino acid
  Variant (6)..(10): xaa in position 6 to 10 is any amino acid
  Variant (11)..(12): xaa in position 11 to 12 is any or no amino acid
  Variant (14)..(14): xaa in position 14 is Ala, Ile or Val
  Variant (15)..(15): xaa in position 15 is any amino acid
  Variant (16)..(16): xaa in position 16 is Ile, Leu or Val
  Variant (17)..(17): xaa in position 17 is Asp, Gly or Thr
  Variant (18)..(19): xaa in position 18 to 19 is any amino acid
  Variant (20)..(20): xaa in position 20 is Ala, Cys, Gly, Ser, Thr or Val
  Variant (21)..(21): xaa in position 21 is any amino acid
  Variant (22)..(22): xaa in position 22 is Ala, Ile, Leu or Val
  Variant (23)..(23): xaa in position 23 is Ala, Gly or Ser
  Variant (24)..(25): xaa in position 24 to 25 is any amino acid
  Variant (26)..(26): xaa in position 26 is Ala, Cys, Ser or Thr
  Variant (27)..(27): xaa in position 27 is any amino acid
  Variant (28)..(28): xaa in position 28 is Ala, Ile or Val
  Variant (29)..(31): xaa in position 29 to 31 is any amino acid
  Variant (32)..(32): xaa in position 32 is Phe, Ile, Leu, Met or Val
  Variant (33)..(39): xaa in position 33 to 39 is any amino acid
  Variant (41)..(41): xaa in position 41 is any amino acid
  Variant (43)..(43): xaa in position 43 is Ala, Cys or Gly
WXXXGXXXXXXXGXXXXXXXXXXXXXXXXXXXXXXXXXXGXPX

SEQ ID NO: 15918 - DNA, 1818 bp, Escherichia coli; identical to SEQ ID NO: 13510
  CDS (1)..(1818)

SEQ ID NO: 15919 - protein, 605 aa, Escherichia coli; identical to SEQ ID NO: 13511

SEQ ID NO: 15920 - DNA, 1665 bp, Mesorhizobium loti MAFF303099; identical to SEQ ID NO: 13512
  CDS (1)..(1665): transl_table=11

SEQ ID NO: 15921 - protein, 554 aa, Mesorhizobium loti MAFF303099; identical to SEQ ID NO: 13513

SEQ ID NO: 15922 - DNA, 1635 bp, Mesorhizobium loti MAFF303099; identical to SEQ ID NO: 13514
  CDS (1)..(1635): transl_table=11

SEQ ID NO: 15923 - protein, 544 aa, Mesorhizobium loti MAFF303099; identical to SEQ ID NO: 13515

SEQ ID NO: 15924 - DNA, 1851 bp, Thermoplasma volcanium GSS1; identical to SEQ ID NO: 13516
  CDS (1)..(1851): transl_table=11

SEQ ID NO: 15925 - protein, 616 aa, Thermoplasma volcanium GSS1; identical to SEQ ID NO: 13517

SEQ ID NO: 15926 - DNA, 1422 bp, Thermotoga maritima MSB8; identical to SEQ ID NO: 13518
  CDS (1)..(1422): transl_table=11

SEQ ID NO: 15927 - protein, 473 aa, Thermotoga maritima MSB8; identical to SEQ ID NO: 13519

SEQ ID NO: 15928 - DNA, 1671 bp, Thermotoga maritima MSB8; identical to SEQ ID NO: 13520
  CDS (1)..(1671): transl_table=11

SEQ ID NO: 15929 - protein, 556 aa, Thermotoga maritima MSB8; identical to SEQ ID NO: 13521

SEQ ID NO: 15930 - DNA, 1737 bp, Bacillus halodurans C-125; identical to SEQ ID NO: 13522
  CDS (1)..(1737): transl_table=11

SEQ ID NO: 15931 - protein, 578 aa, Bacillus halodurans C-125; identical to SEQ ID NO: 13523

SEQ ID NO: 15932 - DNA, 1704 bp, Streptococcus pyogenes M1 GAS; identical to SEQ ID NO: 13524
  CDS (1)..(1704): transl_table=11

SEQ ID NO: 15933 - protein, 567 aa, Streptococcus pyogenes M1 GAS; identical to SEQ ID NO: 13525

SEQ ID NO: 15934 - DNA, 1614 bp, Streptococcus pyogenes M1 GAS; identical to SEQ ID NO: 13526
  CDS (1)..(1614): transl_table=11

SEQ ID NO: 15935 - protein, 537 aa, Streptococcus pyogenes M1 GAS; identical to SEQ ID NO: 13527

SEQ ID NO: 15936 - DNA, 1974 bp, Deinococcus radiodurans R1; identical to SEQ ID NO: 13528
  CDS (1)..(1974): transl_table=11

SEQ ID NO: 15937 - protein, 657 aa, Deinococcus radiodurans R1; identical to SEQ ID NO: 13529

SEQ ID NO: 15938 - DNA, 1497 bp, Deinococcus radiodurans R1; identical to SEQ ID NO: 13530
  CDS (1)..(1497): transl_table=11

SEQ ID NO: 15939 - protein, 498 aa, Deinococcus radiodurans R1; identical to SEQ ID NO: 13531

SEQ ID NO: 15940 - DNA, 1695 bp, Deinococcus radiodurans R1; identical to SEQ ID NO: 13532
  CDS (1)..(1695): transl_table=11

SEQ ID NO: 15941 - protein, 564 aa, Deinococcus radiodurans R1; identical to SEQ ID NO: 13533

SEQ ID NO: 15942 - DNA, 1452 bp, Deinococcus radiodurans R1; identical to SEQ ID NO: 13534
  CDS (1)..(1452): transl_table=11

SEQ ID NO: 15943 - protein, 483 aa, Deinococcus radiodurans R1; identical to SEQ ID NO: 13535

SEQ ID NO: 15944 - DNA, 1659 bp, Deinococcus radiodurans R1; identical to SEQ ID NO: 13536
  CDS (1)..(1659): transl_table=11

SEQ ID NO: 15945 - protein, 552 aa, Deinococcus radiodurans R1; identical to SEQ ID NO: 13537

SEQ ID NO: 15946 - DNA, 1824 bp, Mycoplasma pulmonis UAB CTIP; identical to SEQ ID NO: 13538
  CDS (1)..(1824): transl_table=4

SEQ ID NO: 15947 - protein, 607 aa, Mycoplasma pulmonis UAB CTIP; identical to SEQ ID NO: 13539

SEQ ID NO: 15948 - DNA, 1806 bp, Mycobacterium tuberculosis CDC1551; identical to SEQ ID NO: 13540
  CDS (1)..(1806): transl_table=11

SEQ ID NO: 15949 - protein, 601 aa, Mycobacterium tuberculosis CDC1551; identical to SEQ ID NO: 13541

SEQ ID NO: 15950 - DNA, 1641 bp, Mycobacterium tuberculosis CDC1551; identical to SEQ ID NO: 13542
  CDS (1)..(1641): transl_table=11

SEQ ID NO: 15951 - protein, 546 aa, Mycobacterium tuberculosis CDC1551; identical to SEQ ID NO: 13543

SEQ ID NO: 15952 - DNA, 1356 bp, Clostridium acetobutylicum ATCC 824; identical to SEQ ID NO: 13544
  CDS (1)..(1356): transl_table=11

SEQ ID NO: 15953 - protein, 451 aa, Clostridium acetobutylicum ATCC 824; identical to SEQ ID NO: 13545

SEQ ID NO: 15954 - DNA, 1785 bp, Agrobacterium tumefaciens str. C58; identical to SEQ ID NO: 13546
  CDS (1)..(1785): transl_table=11

SEQ ID NO: 15955 - protein, 594 aa, Agrobacterium tumefaciens str. C58; identical to SEQ ID NO: 13547

SEQ ID NO: 15956 - DNA, 1608 bp, Streptococcus pneumoniae R6; identical to SEQ ID NO: 13548
  CDS (1)..(1608): transl_table=11

SEQ ID NO: 15957 - protein, 535 aa, Streptococcus pneumoniae R6; identical to SEQ ID NO: 13549

SEQ ID NO: 15958 - DNA, 1764 bp, Streptococcus pneumoniae R6; identical to SEQ ID NO: 13550
  CDS (1)..(1764): transl_table=11

SEQ ID NO: 15959 - protein, 587 aa, Streptococcus pneumoniae R6; identical to SEQ ID NO: 13551

SEQ ID NO: 15960 - DNA, 1851 bp, Thermoplasma acidophilum DSM 1728; identical to SEQ ID NO: 13552
  CDS (1)..(1851): transl_table=11

SEQ ID NO: 15961 - protein, 616 aa, Thermoplasma acidophilum DSM 1728; identical to SEQ ID NO: 13553

SEQ ID NO: 15962 - DNA, 1527 bp, Synechocystis sp. PCC 6803; identical to SEQ ID NO: 13554
  CDS (1)..(1527): transl_table=11

SEQ ID NO: 15963 - protein, 508 aa, Synechocystis sp. PCC 6803; identical to SEQ ID NO: 13555

SEQ ID NO: 15964 - DNA, 1818 bp, Salmonella typhimurium LT2; identical to SEQ ID NO: 13556
  CDS (1)..(1818): transl_table=11

SEQ ID NO: 15965 - protein, 605 aa, Salmonella typhimurium LT2; identical to SEQ ID NO: 13557

SEQ ID NO: 15966 - DNA, 1662 bp, Listeria monocytogenes EGD-e; identical to SEQ ID NO: 13558
  CDS (1)..(1662): transl_table=11

SEQ ID NO: 15967 - protein, 553 aa, Listeria monocytogenes EGD-e; identical to SEQ ID NO: 13559

SEQ ID NO: 15968 - DNA, 1776 bp, Listeria monocytogenes EGD-e; identical to SEQ ID NO: 13560
  CDS (1)..(1776): transl_table=11

SEQ ID NO: 15969 - protein, 591 aa, Listeria monocytogenes EGD-e; identical to SEQ ID NO: 13561

SEQ ID NO: 15970 - DNA, 1467 bp, Nostoc sp. PCC 7120; identical to SEQ ID NO: 13562
  CDS (1)..(1467): transl_table=11

SEQ ID NO: 15971 - protein, 488 aa, Nostoc sp. PCC 7120; identical to SEQ ID NO: 13563

SEQ ID NO: 15972 - DNA, 3483 bp, Ralstonia solanacearum GMI1000; identical to SEQ ID NO: 13564
  CDS (1)..(3483): transl_table=11

SEQ ID NO: 15973 - protein, 1160 aa, Ralstonia solanacearum GMI1000; identical to SEQ ID NO: 13565

SEQ ID NO: 15974 - DNA, 1821 bp, Clostridium perfringens str. 13; identical to SEQ ID NO: 13566
  CDS (1)..(1821): transl_table=11

SEQ ID NO: 15975 - protein, 606 aa, Clostridium perfringens str. 13; identical to SEQ ID NO: 13567

SEQ ID NO: 15976 - DNA, 1665 bp, Clostridium perfringens str. 13; identical to SEQ ID NO: 13568
  CDS (1)..(1665): transl_table=11

SEQ ID NO: 15977 - protein, 554 aa, Clostridium perfringens str. 13; identical to SEQ ID NO: 13569

SEQ ID NO: 15978 - DNA, 1833 bp, Clostridium perfringens str. 13; identical to SEQ ID NO: 13570
  CDS (1)..(1833): transl_table=11

SEQ ID NO: 15979 - protein, 610 aa, Clostridium perfringens str. 13; identical to SEQ ID NO: 13571

SEQ ID NO: 15980 - DNA, 1938 bp, Pyrococcus furiosus DSM 3638; identical to SEQ ID NO: 13572
  CDS (1)..(1938): transl_table=11

SEQ ID NO: 15981 - protein, 645 aa, Pyrococcus furiosus DSM 3638; identical to SEQ ID NO: 13573

SEQ ID NO: 15982 - DNA, 1614 bp, Streptococcus pyogenes MGAS8232; identical to SEQ ID NO: 13574
  CDS (1)..(1614): transl_table=11

SEQ ID NO: 15983 - protein, 537 aa, Streptococcus pyogenes MGAS8232; identical to SEQ ID NO: 13575

SEQ ID NO: 15984 - DNA, 1725 bp, Thermoanaerobacter tengcongensis MB4; identical to SEQ ID NO: 13576
  CDS (1)..(1725): transl_table=11

SEQ ID NO: 15985 - protein, 574 aa, Thermoanaerobacter tengcongensis MB4; identical to SEQ ID NO: 13577

SEQ ID NO: 15986 - DNA, 1575 bp, Thermoanaerobacter tengcongensis MB4; identical to SEQ ID NO: 13578
  CDS (1)..(1575): transl_table=11

SEQ ID NO: 15987 - protein, 524 aa, Thermoanaerobacter tengcongensis MB4; identical to SEQ ID NO: 13579

SEQ ID NO: 15988 - DNA, 1719 bp, Streptomyces coelicolor A3(2); identical to SEQ ID NO: 13580
  CDS (1)..(1719)

SEQ ID NO: 15989 - protein, 572 aa, Streptomyces coelicolor A3(2); identical to SEQ ID NO: 13581

SEQ ID NO: 15990 - DNA, 3351 bp, Xanthomonas campestris pv. campestris str. ATCC 33913; identical to SEQ ID NO: 13582
  CDS (1)..(3351): transl_table=11

SEQ ID NO: 15991 - protein, 1116 aa, Xanthomonas campestris pv. campestris str. ATCC 33913; identical to SEQ ID NO: 13583

SEQ ID NO: 15992 - DNA, 1617 bp, Xanthomonas campestris pv. campestris str. ATCC 33913; identical to SEQ ID NO: 13584
  CDS (1)..(1617): transl_table=11

SEQ ID NO: 15993 - protein, 538 aa, Xanthomonas campestris pv. campestris str. ATCC 33913; identical to SEQ ID NO: 13585

SEQ ID NO: 15994 - DNA, 1617 bp, Xanthomonas axonopodis pv. citri str. 306; identical to SEQ ID NO: 13586
  CDS (1)..(1617): transl_table=11

SEQ ID NO: 15995 - protein, 538 aa, Xanthomonas axonopodis pv. citri str. 306; identical to SEQ ID NO: 13587

SEQ ID NO: 15996 - DNA, 3327 bp, Chlorobium tepidum TLS; identical to SEQ ID NO: 13588
  CDS (1)..(3327): transl_table=11

SEQ ID NO: 15997 - protein, 1108 aa, Chlorobium tepidum TLS; identical to SEQ ID NO: 13589

SEQ ID NO: 15998 - DNA, 1668 bp, Yersinia pestis KIM; identical to SEQ ID NO: 13590
  CDS (1)..(1668): transl_table=11

SEQ ID NO: 15999 - protein, 555 aa, Yersinia pestis KIM; identical to SEQ ID NO: 13591

SEQ ID NO: 16000 - DNA, 1830 bp, Yersinia pestis KIM; identical to SEQ ID NO: 13592
  CDS (1)..(1830): transl_table=11

SEQ ID NO: 16001 - protein, 609 aa, Yersinia pestis KIM; identical to SEQ ID NO: 13593

SEQ ID NO: 16002 - DNA, 1608 bp, Streptococcus agalactiae 2603V/R; identical to SEQ ID NO: 13594
  CDS (1)..(1608): transl_table=11

SEQ ID NO: 16003 - protein, 535 aa, Streptococcus agalactiae 2603V/R; identical to SEQ ID NO: 13595

SEQ ID NO: 16004 - DNA, 1497 bp, Oceanobacillus iheyensis HTE831; identical to SEQ ID NO: 13596
  CDS (1)..(1497): transl_table=11

SEQ ID NO: 16005 - protein, 498 aa, Oceanobacillus iheyensis HTE831; identical to SEQ ID NO: 13597

SEQ ID NO: 16006 - DNA, 1752 bp, Oceanobacillus iheyensis HTE831; identical to SEQ ID NO: 13598
  CDS (1)..(1752): transl_table=11

SEQ ID NO: 16007 - protein, 583 aa, Oceanobacillus iheyensis HTE831; identical to SEQ ID NO: 13599

SEQ ID NO: 16008 - DNA, 1398 bp, Bifidobacterium longum NCC2705; identical to SEQ ID NO: 13600
  CDS (1)..(1398): transl_table=11

SEQ ID NO: 16009 - protein, 465 aa, Bifidobacterium longum NCC2705; identical to SEQ ID NO: 13601

SEQ ID NO: 16010 - DNA, 1818 bp, Shigella flexneri 2a str. 301; identical to SEQ ID NO: 13602
  CDS (1)..(1818): transl_table=11

SEQ ID NO: 16011 - protein, 605 aa, Shigella flexneri 2a str. 301; identical to SEQ ID NO: 13603

SEQ ID NO: 16012 - DNA, 1746 bp, Leptospira interrogans serovar Lai str. 56601; identical to SEQ ID NO: 13604
  CDS (1)..(1746): transl_table=11

SEQ ID NO: 16013 - protein, 581 aa, Leptospira interrogans serovar Lai str. 56601; identical to SEQ ID NO: 13605

SEQ ID NO: 16014 - DNA, 1839 bp, Corynebacterium efficiens YS-314; identical to SEQ ID NO: 13606
  CDS (1)..(1839): transl_table=11

SEQ ID NO: 16015 - protein, 612 aa, Corynebacterium efficiens YS-314; identical to SEQ ID NO: 13607

SEQ ID NO: 16016 - DNA, 1839 bp, Vibrio vulnificus CMCP6; identical to SEQ ID NO: 13608
  CDS (1)..(1839): transl_table=11

SEQ ID NO: 16017 - protein, 612 aa, Vibrio vulnificus CMCP6; identical to SEQ ID NO: 13609

SEQ ID NO: 16018 - DNA, 2064 bp, Vibrio vulnificus CMCP6; identical to SEQ ID NO: 13610
  CDS (1)..(2064): transl_table=11

SEQ ID NO: 16019 - protein, 687 aa, Vibrio vulnificus CMCP6; identical to SEQ ID NO: 13611

SEQ ID NO: 16020 - DNA, 1464 bp, Bradyrhizobium japonicum USDA 110; identical to SEQ ID NO: 13612
  CDS (1)..(1464)

SEQ ID NO: 16021 - protein, 487 aa, Bradyrhizobium japonicum USDA 110; identical to SEQ ID NO: 13613

SEQ ID NO: 16022 - DNA, 1698 bp, Bradyrhizobium japonicum USDA 110; identical to SEQ ID NO: 13614
  CDS (1)..(1698)

SEQ ID NO: 16023 - protein, 565 aa, Bradyrhizobium japonicum USDA 110; identical to SEQ ID NO: 13615

SEQ ID NO: 16024 - DNA, 1626 bp, Lactobacillus plantarum WCFS1; identical to SEQ ID NO: 13616
  CDS (1)..(1626): transl_table=11

SEQ ID NO: 16025 - protein, 541 aa, Lactobacillus plantarum WCFS1; identical to SEQ ID NO: 13617

SEQ ID NO: 16026 - DNA, 1827 bp, Vibrio parahaemolyticus RIMD 2210633; identical to SEQ ID NO: 13618
  CDS (1)..(1827): transl_table=11

SEQ ID NO: 16027 - protein, 608 aa, Vibrio parahaemolyticus RIMD 2210633; identical to SEQ ID NO: 13619

SEQ ID NO: 16028 - DNA, 1818 bp, Salmonella enterica subsp. enterica serovar Typhi Ty2; identical to SEQ ID NO: 13620
  CDS (1)..(1818): transl_table=11

SEQ ID NO: 16029 - protein, 605 aa, Salmonella enterica subsp. enterica serovar Typhi Ty2; identical to SEQ ID NO: 13621

SEQ ID NO: 16030 - DNA, 2079 bp, Bacteroides thetaiotaomicron VPI-5482; identical to SEQ ID NO: 13622
  CDS (1)..(2079): transl_table=11

SEQ ID NO: 16031 - protein, 692 aa, Bacteroides thetaiotaomicron VPI-5482; identical to SEQ ID NO: 13623

SEQ ID NO: 16032 - DNA, 1854 bp, Bacteroides thetaiotaomicron VPI-5482; identical to SEQ ID NO: 13624
  CDS (1)..(1854): transl_table=11

SEQ ID NO: 16033 - protein, 617 aa, Bacteroides thetaiotaomicron VPI-5482; identical to SEQ ID NO: 13625

SEQ ID NO: 16034 - DNA, 1767 bp, Enterococcus faecalis V583; identical to SEQ ID NO: 13626
  CDS (1)..(1767): transl_table=11

SEQ ID NO: 16035 - protein, 588 aa, Enterococcus faecalis V583; identical to SEQ ID NO: 13627

SEQ ID NO: 16036 - DNA, 1614 bp, Enterococcus faecalis V583; identical to SEQ ID NO: 13628
  CDS (1)..(1614): transl_table=11

SEQ ID NO: 16037 - protein, 537 aa, Enterococcus faecalis V583; identical to SEQ ID NO: 13629

SEQ ID NO: 16038 - DNA, 1674 bp, Enterococcus faecalis V583; identical to SEQ ID NO: 13630
  CDS (1)..(1674): transl_table=11

SEQ ID NO: 16039 - protein, 557 aa, Enterococcus faecalis V583; identical to SEQ ID NO: 13631

SEQ ID NO: 16040 - DNA, 1719 bp, Streptomyces avermitilis MA-4680; identical to SEQ ID NO: 13632
  CDS (1)..(1719)

SEQ ID NO: 16041 - protein, 572 aa, Streptomyces avermitilis MA-4680; identical to SEQ ID NO: 13633

SEQ ID NO: 16042 - DNA, 1752 bp, Streptomyces avermitilis MA-4680; identical to SEQ ID NO: 13634
  CDS (1)..(1752)

SEQ ID NO: 16043 - protein, 583 aa, Streptomyces avermitilis MA-4680; identical to SEQ ID NO: 13635

SEQ ID NO: 16044 - DNA, 1665 bp, Bacillus anthracis str. Ames; identical to SEQ ID NO: 13636
  CDS (1)..(1665): transl_table=11

SEQ ID NO: 16045 - protein, 554 aa, Bacillus anthracis str. Ames; identical to SEQ ID NO: 13637

SEQ ID NO: 16046 - DNA, 1761 bp, Bacillus anthracis str. Ames; identical to SEQ ID NO: 13638
  CDS (1)..(1761): transl_table=11

SEQ ID NO: 16047 - protein, 586 aa, Bacillus anthracis str. Ames; identical to SEQ ID NO: 13639

SEQ ID NO: 16048 - DNA, 1641 bp, Mycobacterium bovis AF2122/97; identical to SEQ ID NO: 13640
  CDS (1)..(1641): transl_table=11

SEQ ID NO: 16049 - protein, 546 aa, Mycobacterium bovis AF2122/97; identical to SEQ ID NO: 13641

SEQ ID NO: 16050 - DNA, 1761 bp, Rhodopirellula baltica SH 1; identical to SEQ ID NO: 13642
  CDS (1)..(1761): transl_table=11

SEQ ID NO: 16051 - protein, 586 aa, Rhodopirellula baltica SH 1; identical to SEQ ID NO: 13643

SEQ ID NO: 16052 - DNA, 3342 bp, Bordetella pertussis Tohama I; identical to SEQ ID NO: 13644
  CDS (1)..(3342): transl_table=11

SEQ ID NO: 16053 - protein, 1113 aa, Bordetella pertussis Tohama I; identical to SEQ ID NO: 13645

SEQ ID NO: 16054 - DNA, 3342 bp, Bordetella bronchiseptica RB50; identical to SEQ ID NO: 13646
  CDS (1)..(3342)

SEQ ID NO: 16055 - protein, 1113 aa, Bordetella bronchiseptica RB50; identical to SEQ ID NO: 13647

SEQ ID NO: 16056 - DNA, 1452 bp, Prochlorococcus marinus str. MIT 9313; identical to SEQ ID NO: 13648
  CDS (1)..(1452): transl_table=11

SEQ ID NO: 16057 - protein, 483 aa, Prochlorococcus marinus str. MIT 9313; identical to SEQ ID NO: 13649

SEQ ID NO: 16058 - DNA, 1407 bp, Synechococcus sp. WH 8102; identical to SEQ ID NO: 13650
  CDS (1)..(1407): transl_table=11

SEQ ID NO: 16059 - protein, 468 aa, Synechococcus sp. WH 8102; identical to SEQ ID NO: 13651

SEQ ID NO: 16060 - DNA, 1662 bp, Synechococcus sp. WH 8102; identical to SEQ ID NO: 13652
  CDS (1)..(1662): transl_table=11

SEQ ID NO: 16061 - protein, 553 aa, Synechococcus sp. WH 8102; identical to SEQ ID NO: 13653

SEQ ID NO: 16062 - DNA, 1863 bp, Gloeobacter violaceus PCC 7421; identical to SEQ ID NO: 13654
  CDS (1)..(1863): transl_table=11

SEQ ID NO: 16063 - protein, 620 aa, Gloeobacter violaceus PCC 7421; identical to SEQ ID NO: 13655

SEQ ID NO: 16064 - DNA, 1443 bp, Gloeobacter violaceus PCC 7421; identical to SEQ ID NO: 13656
  CDS (1)..(1443): transl_table=11

SEQ ID NO: 16065 - protein, 480 aa, Gloeobacter violaceus PCC 7421; identical to SEQ ID NO: 13657

SEQ ID NO: 16066 - DNA, 1635 bp, Vibrio vulnificus YJ016; identical to SEQ ID NO: 13658
  CDS (1)..(1635): transl_table=11

SEQ ID NO: 16067 - protein, 544 aa, Vibrio vulnificus YJ016; identical to SEQ ID NO: 13659

SEQ ID NO: 16068 - DNA, 3303 bp, Rhodopseudomonas palustris CGA009; identical to SEQ ID NO: 13660
  CDS (1)..(3303): transl_table=11

SEQ ID NO: 16069 - protein, 1100 aa, Rhodopseudomonas palustris CGA009; identical to SEQ ID NO: 13661

SEQ ID NO: 16070 - DNA, 1617 bp, Rhodopseudomonas palustris CGA009; identical to SEQ ID NO: 13662
  CDS (1)..(1617): transl_table=11

SEQ ID NO: 16071 - protein, 538 aa, Rhodopseudomonas palustris CGA009; identical to SEQ ID NO: 13663

SEQ ID NO: 16072 - DNA, 3336 bp, Geobacter sulfurreducens PCA; identical to SEQ ID NO: 13664
  CDS (1)..(3336): transl_table=11

SEQ ID NO: 16073 - protein, 1111 aa, Geobacter sulfurreducens PCA; identical to SEQ ID NO: 13665

SEQ ID NO: 16074 - DNA, 1335 bp, Mycobacterium avium subsp. paratuberculosis str. k10; identical to SEQ ID NO: 13666
  CDS (1)..(1335): transl_table=11

SEQ ID NO: 16075 - protein, 444 aa, Mycobacterium avium subsp. paratuberculosis str. k10; identical to SEQ ID NO: 13667

SEQ ID NO: 16076 - DNA, 1773 bp, Mycobacterium avium subsp. paratuberculosis str. k10; identical to SEQ ID NO: 13668
  CDS (1)..(1773): transl_table=11

SEQ ID NO: 16077 - protein, 590 aa, Mycobacterium avium subsp. paratuberculosis str. k10; identical to SEQ ID NO: 13669

SEQ ID NO: 16078 - DNA, 1725 bp, Lactobacillus johnsonii NCC 533; identical to SEQ ID NO: 13670
  CDS (1)..(1725): transl_table=11

SEQ ID NO: 16079 - protein, 574 aa, Lactobacillus johnsonii NCC 533; identical to SEQ ID NO: 13671

SEQ ID NO: 16080 - DNA, 1668 bp, Lactobacillus johnsonii NCC 533; identical to SEQ ID NO: 13672
  CDS (1)..(1668): transl_table=11

SEQ ID NO: 16081 - protein, 555 aa, Lactobacillus johnsonii NCC 533; identical to SEQ ID NO: 13673

SEQ ID NO: 16082 - DNA, 1665 bp, Bacillus cereus ATCC 10987; identical to SEQ ID NO: 13674
  CDS (1)..(1665): transl_table=11

SEQ ID NO: 16083 - protein, 554 aa, Bacillus cereus ATCC 10987; identical to SEQ ID NO: 13675

SEQ ID NO: 16084 - DNA, 1710 bp, Anopheles gambiae str. PEST; identical to SEQ ID NO: 13676
  CDS (1)..(1710)

SEQ ID NO: 16085 - protein, 569 aa, Anopheles gambiae str. PEST; identical to SEQ ID NO: 13677

SEQ ID NO: 16086 - DNA, 1800 bp, Anopheles gambiae str. PEST; identical to SEQ ID NO: 13678
  CDS (1)..(1800)

SEQ ID NO: 16087 - protein, 599 aa, Anopheles gambiae str. PEST; identical to SEQ ID NO: 13679

SEQ ID NO: 16088 - DNA, 1509 bp, Anopheles gambiae str. PEST; identical to SEQ ID NO: 13680
  CDS (1)..(1509)

SEQ ID NO: 16089 - protein, 502 aa, Anopheles gambiae str. PEST; identical to SEQ ID NO: 13681

SEQ ID NO: 16090 - DNA, 1716 bp, Gibberella zeae PH-1; identical to SEQ ID NO: 13682
  CDS (1)..(1716)

SEQ ID NO: 16091 - protein, 571 aa, Gibberella zeae PH-1; identical to SEQ ID NO: 13683

SEQ ID NO: 16092 - DNA, 1635 bp, Leptospira interrogans serovar Copenhageni str. Fiocruz L1-130; identical to SEQ ID NO: 13684
  CDS (1)..(1635): transl_table=11

SEQ ID NO: 16093 - protein, 544 aa, Leptospira interrogans serovar Copenhageni str. Fiocruz L1-130; identical to SEQ ID NO: 13685

SEQ ID NO: 16094 - DNA, 1251 bp, Thermus thermophilus HB27; identical to SEQ ID NO: 13686
  CDS (1)..(1251): transl_table=11

SEQ ID NO: 16095 - protein, 416 aa, Thermus thermophilus HB27 [sequence omitted]

SEQ ID NO: 16096 - DNA, 1662 bp, Listeria monocytogenes str. 4b F2365; identical to SEQ ID NO: 13688
  CDS (1)..(1662): transl_table=11

SEQ ID NO: 16097 - protein, 553 aa, Listeria monocytogenes str. 4b F2365; identical to SEQ ID NO: 13689

SEQ ID NO: 16098 - DNA, 1533 bp, Listeria monocytogenes str. 4b F2365; identical to SEQ ID NO: 13690
  CDS (1)..(1533): transl_table=11

SEQ ID NO: 16099 - protein, 510 aa, Listeria monocytogenes str. 4b F2365; identical to SEQ ID NO: 13691

SEQ ID NO: 16100 - DNA, 1761 bp, Bacillus thuringiensis serovar konkukian str. 97-27; identical to SEQ ID NO: 13692
  CDS (1)..(1761): transl_table=11

SEQ ID NO: 16101 - protein, 586 aa, Bacillus thuringiensis serovar konkukian str. 97-27; identical to SEQ ID NO: 13693

SEQ ID NO: 16102 - DNA, 1710 bp, Leifsonia xyli subsp. xyli str. CTCB07; identical to SEQ ID NO: 13694
  CDS (1)..(1710): transl_table=11

SEQ ID NO: 16103 - protein, 569 aa, Leifsonia xyli subsp. xyli str. CTCB07; identical to SEQ ID NO: 13695

SEQ ID NO: 16104 - DNA, 1683 bp, Bacillus licheniformis ATCC 14580; identical to SEQ ID NO: 13696
  CDS (1)..(1683): transl_table=11

SEQ ID NO: 16105 - protein, 560 aa, Bacillus licheniformis ATCC 14580; identical to SEQ ID NO: 13697

SEQ ID NO: 16106 - DNA, 1764 bp, Bacillus licheniformis ATCC 14580; identical to SEQ ID NO: 13698
  CDS (1)..(1764): transl_table=11

SEQ ID NO: 16107 - protein, 587 aa, Bacillus licheniformis ATCC 14580; identical to SEQ ID NO: 13699

SEQ ID NO: 16108 - DNA, 1620 bp, Methylococcus capsulatus str. Bath; identical to SEQ ID NO: 13700
  CDS (1)..(1620): transl_table=11

SEQ ID NO: 16109 - protein, 539 aa, Methylococcus capsulatus str. Bath; identical to SEQ ID NO: 13701

SEQ ID NO: 16110 - DNA, 1866 bp, Photobacterium profundum SS9; identical to SEQ ID NO: 13702
  CDS (1)..(1866): transl_table=11

SEQ ID NO: 16111 - protein, 621 aa, Photobacterium profundum SS9; identical to SEQ ID NO: 13703

SEQ ID NO: 16112 - DNA, 1656 bp, Thermus thermophilus HB8; identical to SEQ ID NO: 13704
  CDS (1)..(1656): transl_table=11

SEQ ID NO: 16113 - protein, 551 aa, Thermus thermophilus HB8; identical to SEQ ID NO: 13705

SEQ ID NO: 16114 - DNA, 1767 bp, Geobacillus kaustophilus HTA426; identical to SEQ ID NO: 13706
  CDS (1)..(1767): transl_table=11

SEQ ID NO: 16115 - protein, 588 aa, Geobacillus kaustophilus HTA426; identical to SEQ ID NO: 13707

SEQ ID NO: 16116 - DNA, 1542 bp, Geobacillus kaustophilus HTA426; identical to SEQ ID NO: 13708
  CDS (1)..(1542): transl_table=11

SEQ ID NO: 16117 - protein, 513 aa, Geobacillus kaustophilus HTA426; identical to SEQ ID NO: 13709

SEQ ID NO: 16118 - DNA, 4983 bp, Geobacillus kaustophilus HTA426; identical to SEQ ID NO: 13710
  CDS (1)..(4983): transl_table=11

SEQ ID NO: 16119 - protein, 1660 aa, Geobacillus kaustophilus HTA426; identical to SEQ ID NO: 13711

SEQ ID NO: 16120 - DNA, 1689 bp, Azoarcus sp. EbN1; identical to SEQ ID NO: 13712
  CDS (1)..(1689): transl_table=11

SEQ ID NO: 16121 - protein, 562 aa, Azoarcus sp. EbN1; identical to SEQ ID NO: 13713

SEQ ID NO: 16122 - DNA, 1770 bp, Bacillus clausii KSM-K16; identical to SEQ ID NO: 13714
  CDS (1)..(1770): transl_table=11

SEQ ID NO: 16123 - protein, 589 aa, Bacillus clausii KSM-K16; identical to SEQ ID NO: 13715

SEQ ID NO: 16124 - DNA, 2298 bp, Thermococcus kodakarensis KOD1; identical to SEQ ID NO: 13716
  CDS (1)..(2298): transl_table=11

SEQ ID NO: 16125 - protein, 765 aa, Thermococcus kodakarensis KOD1; identical to SEQ ID NO: 13717

SEQ ID NO: 16126 - DNA, 2724 bp, Xanthomonas oryzae pv. oryzae KACC10331; identical to SEQ ID NO: 13718
  CDS (1)..(2724): transl_table=11

SEQ ID NO: 16127 - protein, 907 aa, Xanthomonas oryzae pv. oryzae KACC10331; identical to SEQ ID NO: 13719

SEQ ID NO: 16128 - DNA, 1260 bp, Vibrio fischeri ES114; identical to SEQ ID NO: 13720
  CDS (1)..(1260): transl_table=11

SEQ ID NO: 16129 - protein, 419 aa, Vibrio fischeri ES114; identical to SEQ ID NO: 13721

SEQ ID NO: 16130 - DNA, 1815 bp, Corynebacterium glutamicum ATCC 13032; identical to SEQ ID NO: 13722
  CDS (1)..(1815): transl_table=11

SEQ ID NO: 16131 - protein, 604 aa, Corynebacterium glutamicum ATCC 13032; identical to SEQ ID NO: 13723

SEQ ID NO: 16132 - DNA, 3327 bp, Pseudomonas syringae pv. syringae B728a; identical to SEQ ID NO: 13724
  CDS (1)..(3327)

SEQ ID NO: 16133 - protein, 1108 aa, Pseudomonas syringae pv. syringae B728a; identical to SEQ ID NO: 13725

SEQ ID NO: 16134 - DNA, 1659 bp, Lactobacillus gasseri; identical to SEQ ID NO: 13726
  CDS (1)..(1659)

SEQ ID NO: 16135 - protein, 552 aa, Lactobacillus gasseri; identical to SEQ ID NO: 13727

SEQ ID NO: 16136 - DNA, 1467 bp, Nostoc punctiforme PCC 73102; identical to SEQ ID NO: 13728
  CDS (1)..(1467)

SEQ ID NO: 16137 - protein, 488 aa, Nostoc punctiforme PCC 73102; identical to SEQ ID NO: 13729

SEQ ID NO: 16138 - DNA, 1674 bp, Nostoc punctiforme PCC 73102; identical to SEQ ID NO: 13730
  CDS (1)..(1674)

SEQ ID NO: 16139 - protein, 557 aa, Nostoc punctiforme PCC 73102; identical to SEQ ID NO: 13731

SEQ ID NO: 16140 - DNA, 1266 bp, Bifidobacterium longum DJO10A; identical to SEQ ID NO: 13732
  CDS (1)..(1266)

SEQ ID NO: 16141 - protein, 421 aa, Bifidobacterium longum DJO10A; identical to SEQ ID NO: 13733

SEQ ID NO: 16142 - DNA, 3333 bp, Desulfovibrio desulfuricans G20; identical to SEQ ID NO: 13734
  CDS (1)..(3333)

SEQ ID NO: 16143 - protein, 1110 aa, Desulfovibrio desulfuricans G20; identical to SEQ ID NO: 13735

SEQ ID NO: 16144 - DNA, 1467 bp, Anabaena variabilis ATCC 29413; identical to SEQ ID NO: 13736
  CDS (1)..(1467)

SEQ ID NO: 16145 - protein, 488 aa, Anabaena variabilis ATCC 29413; identical to SEQ ID NO: 13737

SEQ ID NO: 16146 - DNA, 3366 bp, Ralstonia eutropha JMP134; identical to SEQ ID NO: 13738
  CDS (1)..(3366)

SEQ ID NO: 16147 - protein, 1121 aa, Ralstonia eutropha JMP134; identical to SEQ ID NO: 13739

SEQ ID NO: 16148 - DNA, 2586 bp, Rhodobacter sphaeroides 2.4.1; identical to SEQ ID NO: 13740
  CDS (1)..(2586)

SEQ ID NO: 16149 - protein, 861 aa, Rhodobacter sphaeroides 2.4.1; identical to SEQ ID NO: 13741

SEQ ID NO: 16150 - DNA, 3417 bp, Burkholderia cepacia R18194; identical to SEQ ID NO: 13742
  CDS (1)..(3417)

SEQ ID NO: 16151 - protein, 1138 aa, Burkholderia cepacia R18194; identical to SEQ ID NO: 13743

SEQ ID NO: 16152 - DNA, 1776 bp, Listeria monocytogenes str. 4b H7858; identical to SEQ ID NO: 13744
  CDS (1)..(1776): transl_table=11

SEQ ID NO: 16153 - protein, 591 aa, Listeria monocytogenes str. 4b H7858; identical to SEQ ID NO: 13745

SEQ ID NO: 16154 - DNA, 1533 bp, Listeria monocytogenes str. 1/2a F6854; identical to SEQ ID NO: 13746
  CDS (1)..(1533): transl_table=11

SEQ ID NO: 16155 - protein, 510 aa, Listeria monocytogenes str. 1/2a F6854; identical to SEQ ID NO: 13747

SEQ ID NO: 16156 - DNA, 1662 bp, Listeria monocytogenes str. 1/2a F6854; identical to SEQ ID NO: 13748
  CDS (1)..(1662): transl_table=11

SEQ ID NO: 16157 - protein, 553 aa, Listeria monocytogenes str. 1/2a F6854; identical to SEQ ID NO: 13749

SEQ ID NO: 16158 - DNA, 3342 bp, Pseudomonas fluorescens PfO-1; identical to SEQ ID NO: 13750
  CDS (1)..(3342)

SEQ ID NO: 16159 - protein, 1113 aa, Pseudomonas fluorescens PfO-1; identical to SEQ ID NO: 13751

SEQ ID NO: 16160 - DNA, 1629 bp, Rhodospirillum rubrum; identical to SEQ ID NO: 13752
  CDS (1)..(1629)

SEQ ID NO: 16161 - protein, 542 aa, Rhodospirillum rubrum; identical to SEQ ID NO: 13753

SEQ ID NO: 16162 - DNA, 3303 bp, Rhodospirillum rubrum; identical to SEQ ID NO: 13754
  CDS (1)..(3303)

SEQ ID NO: 16163 - protein, 1100 aa, Rhodospirillum rubrum; identical to SEQ ID NO: 13755

SEQ ID NO: 16164 - DNA, 3465 bp, Burkholderia fungorum LB400; identical to SEQ ID NO: 13756
  CDS (1)..(3465)

SEQ ID NO: 16165 - protein, 1154 aa, Burkholderia fungorum LB400; identical to SEQ ID NO: 13757

SEQ ID NO: 16166 - DNA, 1821 bp, Thermobifida fusca; identical to SEQ ID NO: 13758
  CDS (1)..(1821)

SEQ ID NO: 16167 - protein, 606 aa, Thermobifida fusca; identical to SEQ ID NO: 13759

SEQ ID NO: 16168 - DNA, 1563 bp, Microbulbifer degradans 2-40; identical to SEQ ID NO: 13760
  CDS (1)..(1563)

SEQ ID NO: 16169 - protein, 520 aa, Microbulbifer degradans 2-40; identical to SEQ ID NO: 13761

SEQ ID NO: 16170 - DNA, 1671 bp, Oenococcus oeni PSU-1; identical to SEQ ID NO: 13762
  CDS (1)..(1671)

SEQ ID NO: 16171 - protein, 556 aa, Oenococcus oeni PSU-1; identical to SEQ ID NO: 13763

SEQ ID NO: 16172 - DNA, 1482 bp, Trichodesmium erythraeum IMS101; identical to SEQ ID NO: 13764
  CDS (1)..(1482)

SEQ ID NO: 16173 - protein, 493 aa, Trichodesmium erythraeum IMS101; identical to SEQ ID NO: 13765

SEQ ID NO: 16174 - DNA, 3288 bp, Thiobacillus denitrificans ATCC 25259; identical to SEQ ID NO: 13766
  CDS (1)..(3288)

SEQ ID NO: 16175 - protein, 1095 aa, Thiobacillus denitrificans ATCC 25259; identical to SEQ ID NO: 13767

SEQ ID NO: 16176 - DNA, 1815 bp, Chloroflexus aurantiacus; identical to SEQ ID NO: 13768
  CDS (1)..(1815)

SEQ ID NO: 16177 - protein, 604 aa, Chloroflexus aurantiacus; identical to SEQ ID NO: 13769

SEQ ID NO: 16178 - DNA, 4140 bp, Chloroflexus aurantiacus; identical to SEQ ID NO: 13770
  CDS (1)..(4140)

SEQ ID NO: 16179 - protein, 1379 aa, Chloroflexus aurantiacus; identical to SEQ ID NO: 13771

SEQ ID NO: 16180 - DNA, 3363 bp, Chloroflexus aurantiacus; identical to SEQ ID NO: 13772
  CDS (1)..(3363)

SEQ ID NO: 16181 - protein, 1120 aa, Chloroflexus aurantiacus; identical to SEQ ID NO: 13773

SEQ ID NO: 16182 - DNA, 1803 bp, Lactococcus lactis subsp. cremoris SK11; identical to SEQ ID NO: 13774
  CDS (1)..(1803)

SEQ ID NO: 16183 - protein, 600 aa, Lactococcus lactis subsp. cremoris SK11; identical to SEQ ID NO: 13775

SEQ ID NO: 16184 - DNA, 1755 bp, Lactococcus lactis subsp. cremoris SK11; identical to SEQ ID NO: 13776
  CDS (1)..(1755)

SEQ ID NO: 16185 - protein, 584 aa, Lactococcus lactis subsp. cremoris SK11; identical to SEQ ID NO: 13777

SEQ ID NO: 16186 - DNA, 1695 bp, Lactobacillus casei ATCC 334; identical to SEQ ID NO: 13778
  CDS (1)..(1695)

SEQ ID NO: 16187 - protein, 564 aa, Lactobacillus casei ATCC 334; identical to SEQ ID NO: 13779

SEQ ID NO: 16188 - DNA, 1779 bp, Lactobacillus casei ATCC 334; identical to SEQ ID NO: 13780
  CDS (1)..(1779)

SEQ ID NO: 16189 - protein, 592 aa, Lactobacillus casei ATCC 334; identical to SEQ ID NO: 13781

SEQ ID NO: 16190 - DNA, 1668 bp, Lactobacillus casei ATCC 334; identical to SEQ ID NO: 13782
  CDS (1)..(1668)

SEQ ID NO: 16191 - protein, 555 aa, Lactobacillus casei ATCC 334; identical to SEQ ID NO: 13783

SEQ ID NO: 16192 - DNA, 570 bp, Lactobacillus delbrueckii subsp. bulgaricus ATCC BAA-365; identical to SEQ ID NO: 13784
  CDS (1)..(570)

SEQ ID NO: 16193 - protein, 189 aa, Lactobacillus delbrueckii subsp. bulgaricus ATCC BAA-365; identical to SEQ ID NO: 13785

SEQ ID NO: 16194 - DNA, 1827 bp, Deinococcus geothermalis DSM 11300; identical to SEQ ID NO: 13786
  CDS (1)..(1827): transl_table=11

SEQ ID NO: 16195 - protein, 608 aa, Deinococcus geothermalis DSM 11300; identical to SEQ ID NO: 13787

SEQ ID NO: 16196 - DNA, 1491 bp, Deinococcus geothermalis DSM 11300; identical to SEQ ID NO: 13788
  CDS (1)..(1491): transl_table=11

SEQ ID NO: 16197 - protein, 496 aa, Deinococcus geothermalis DSM 11300; identical to SEQ ID NO: 13789

SEQ ID NO: 16198 - DNA, 2097 bp, Deinococcus geothermalis DSM 11300; identical to SEQ ID NO: 13790
  CDS (1)..(2097): transl_table=11

SEQ ID NO: 16199 - protein, 698 aa, Deinococcus geothermalis DSM 11300; identical to SEQ ID NO: 13791

SEQ ID NO: 16200 - DNA, 1662 bp, Anaeromyxobacter dehalogenans 2CP-C; identical to SEQ ID NO: 13792
  CDS (1)..(1662): transl_table=11

SEQ ID NO: 16201 - protein, 553 aa, Anaeromyxobacter dehalogenans 2CP-C; identical to SEQ ID NO: 13793

SEQ ID NO: 16202 - DNA, 1638 bp, Anaeromyxobacter dehalogenans 2CP-C; identical to SEQ ID NO: 13794
  CDS (1)..(1638): transl_table=11

SEQ ID NO: 16203 - protein, 545 aa, Anaeromyxobacter dehalogenans 2CP-C; identical to SEQ ID NO: 13795

SEQ ID NO: 16204 - DNA, 1602 bp, Anaeromyxobacter dehalogenans 2CP-C; identical to SEQ ID NO: 13796
  CDS (1)..(1602): transl_table=11

SEQ ID NO: 16205 - protein, 533 aa, Anaeromyxobacter dehalogenans 2CP-C; identical to SEQ ID NO: 13797

SEQ ID NO: 16206 - DNA, 1188 bp, Streptococcus pneumoniae TIGR4; identical to SEQ ID NO: 13798
  CDS (1)..(1188)

SEQ ID NO: 16207 - protein, 395 aa, Streptococcus pneumoniae TIGR4; identical to SEQ ID NO: 13799

SEQ ID NO: 16208 - DNA, 1407 bp, Arthrobacter sp. FB24; identical to SEQ ID NO: 13800
  CDS (1)..(1407): transl_table=11

SEQ ID NO: 16209 - protein, 468 aa, Arthrobacter sp. FB24; identical to SEQ ID NO: 13801

SEQ ID NO: 16210 - DNA, 1968 bp, Arthrobacter sp. FB24; identical to SEQ ID NO: 13802
  CDS (1)..(1968): transl_table=11

SEQ ID NO: 16211 - protein, 655 aa, Arthrobacter sp. FB24; identical to SEQ ID NO: 13803

SEQ ID NO: 16212 - DNA, 1797 bp, Arthrobacter sp. FB24; identical to SEQ ID NO: 13804
  CDS (1)..(1797): transl_table=11

SEQ ID NO: 16213 - protein, 598 aa, Arthrobacter sp. FB24; identical to SEQ ID NO: 13805

SEQ ID NO: 16214 - DNA, 3327 bp, Azotobacter vinelandii AvOP; identical to SEQ ID NO: 13806
  CDS (1)..(3327): transl_table=11

SEQ ID NO: 16215 - protein, 1108 aa, Azotobacter vinelandii AvOP; identical to SEQ ID NO: 13807

SEQ ID NO: 16216 - DNA, 3414 bp, Burkholderia vietnamiensis G4; identical to SEQ ID NO: 13808
  CDS (1)..(3414): transl_table=11

SEQ ID NO: 16217 - protein, 1137 aa, Burkholderia vietnamiensis G4; identical to SEQ ID NO: 13809

SEQ ID NO: 16218 - DNA, 3414 bp, Burkholderia cenocepacia HI2424; identical to SEQ ID NO: 13810
  CDS (1)..(3414): transl_table=11

SEQ ID NO: 16219 - protein, 1137 aa, Burkholderia cenocepacia HI2424; identical to SEQ ID NO: 13811

SEQ ID NO: 16220 - DNA, 1614 bp, Chromohalobacter salexigens DSM 3043; identical to SEQ ID NO: 13812
  CDS (1)..(1614): transl_table=11

SEQ ID NO: 16221 - protein, 537 aa, Chromohalobacter salexigens DSM 3043; identical to SEQ ID NO: 13813

SEQ ID NO: 16222 - DNA, 3396 bp, Burkholderia pseudomallei S13; identical to SEQ ID NO: 13814
  CDS (1)..(3396)

SEQ ID NO: 16223 - protein, 1131 aa, Burkholderia pseudomallei S13; identical to SEQ ID NO: 13815

SEQ ID NO: 16224 - DNA, 1728 bp, Clostridium thermocellum ATCC 27405; identical to SEQ ID NO: 13816
  CDS (1)..(1728): transl_table=11

SEQ ID NO: 16225 - protein, 575 aa, Clostridium thermocellum ATCC 27405; identical to SEQ ID NO: 13817

SEQ ID NO: 16226 - DNA, 1461 bp, Crocosphaera watsonii WH 8501; identical to SEQ ID NO: 13818
  CDS (1)..(1461): transl_table=11

SEQ ID NO: 16227 - protein, 486 aa, Crocosphaera watsonii WH 8501; identical to SEQ ID NO: 13819

SEQ ID NO: 16228 - DNA, 3318 bp, Chlorobium phaeobacteroides BS1; identical to SEQ ID NO: 13820
  CDS (1)..(3318): transl_table=11

SEQ ID NO: 16229 - protein, 1105 aa, Chlorobium phaeobacteroides BS1; identical to SEQ ID NO: 13821

SEQ ID NO: 16230 - DNA, 3339 bp, Geobacter metallireducens GS-15; identical to SEQ ID NO: 13822
  CDS (1)..(3339): transl_table=11

SEQ ID NO: 16231 - protein, 1112 aa, Geobacter metallireducens GS-15; identical to SEQ ID NO: 13823

SEQ ID NO: 16232 - DNA, 1785 bp, Exiguobacterium sp. 255-15; identical to SEQ ID NO: 13824
  CDS (1)..(1785): transl_table=11

SEQ ID NO: 16233 - protein, 594 aa, Exiguobacterium sp. 255-15; identical to SEQ ID NO: 13825

SEQ ID NO: 16234 - DNA, 1674 bp, Exiguobacterium sp. 255-15; identical to SEQ ID NO: 13826
  CDS (1)..(1674): transl_table=11

SEQ ID NO: 16235 - protein, 557 aa, Exiguobacterium sp. 255-15; identical to SEQ ID NO: 13827

SEQ ID NO: 16236 - DNA, 1611 bp, Exiguobacterium sp. 255-15; identical to SEQ ID NO: 13828
  CDS (1)..(1611): transl_table=11

SEQ ID NO: 16237 - protein, 536 aa, Exiguobacterium sp. 255-15; identical to SEQ ID NO: 13829

SEQ ID NO: 16238 - DNA, 1788 bp, Exiguobacterium sp. 255-15; identical to SEQ ID NO: 13830
  CDS (1)..(1788): transl_table=11

SEQ ID NO: 16239 - protein, 595 aa, Exiguobacterium sp. 255-15; identical to SEQ ID NO: 13831

SEQ ID NO: 16240 - DNA, 1803 bp, Frankia sp. CcI3; identical to SEQ ID NO: 13832
  CDS (1)..(1803): transl_table=11

SEQ ID NO: 16241 - protein, 600 aa, Frankia sp. CcI3; identical to SEQ ID NO: 13833

SEQ ID NO: 16242 - DNA, 3582 bp, Desulfitobacterium hafniense DCB-2; identical to SEQ ID NO: 13834
  CDS (1)..(3582): transl_table=11

SEQ ID NO: 16243 - protein, 1193 aa, Desulfitobacterium hafniense DCB-2; identical to SEQ ID NO: 13835

SEQ ID NO: 16244 - DNA, 1719 bp, Frankia sp. EAN1pec; identical to SEQ ID NO: 13836
  CDS (1)..(1719): transl_table=11

SEQ ID NO: 16245 - protein, 572 aa, Frankia sp. EAN1pec; identical to SEQ ID NO: 13837

SEQ ID NO: 16246 - DNA, 1761 bp, Moorella thermoacetica ATCC 39073; identical to SEQ ID NO: 13838
  CDS (1)..(1761): transl_table=11

SEQ ID NO: 16247 - protein, 586 aa, Moorella thermoacetica ATCC 39073; identical to SEQ ID NO: 13839

SEQ ID NO: 16248 - DNA, 1623 bp, Shewanella baltica OS155; identical to SEQ ID NO: 13840
  CDS (1)..(1623): transl_table=11

SEQ ID NO: 16249 - protein, 540 aa, Shewanella baltica OS155; identical to SEQ ID NO: 13841

SEQ ID NO: 16250 - DNA, 1635 bp, Shewanella amazonensis SB2B; identical to SEQ ID NO: 13842
  CDS (1)..(1635): transl_table=11

SEQ ID NO: 16251 - protein, 544 aa, Shewanella amazonensis SB2B; identical to SEQ ID NO: 13843

SEQ ID NO: 16252 - DNA, 3297 bp, Pelodictyon phaeoclathratiforme BU-1; identical to SEQ ID NO: 13844
  CDS (1)..(3297): transl_table=11

SEQ ID NO: 16253 - protein, 1098 aa, Pelodictyon phaeoclathratiforme BU-1; identical to SEQ ID NO: 13845

SEQ ID NO: 16254 - DNA, 3414 bp, Prosthecochloris aestuarii DSM 271; identical to SEQ ID NO: 13846
  CDS (1)..(3414): transl_table=11

SEQ ID NO: 16255 - protein, 1137 aa, Prosthecochloris aestuarii DSM 271; identical to SEQ ID NO: 13847

SEQ ID NO: 16256 - DNA, 1593 bp, Rubrobacter xylanophilus DSM 9941; identical to SEQ ID NO: 13848
  CDS (1)..(1593): transl_table=11

SEQ ID NO: 16257 - protein, 530 aa, Rubrobacter xylanophilus DSM 9941; identical to SEQ ID NO: 13849

SEQ ID NO: 16258 - DNA, 5328 bp, Rubrobacter xylanophilus DSM 9941; identical to SEQ ID NO: 13850
  CDS (1)..(5328): transl_table=11

SEQ ID NO: 16259 - protein, 1775 aa, Rubrobacter xylanophilus DSM 9941; identical to SEQ ID NO: 13851

SEQ ID NO: 16260 - DNA, 1755 bp, Mesorhizobium sp. BNC1; identical to SEQ ID NO: 13852
  CDS (1)..(1755): transl_table=11

SEQ ID NO: 16261 - protein, 584 aa, Mesorhizobium sp. BNC1; identical to SEQ ID NO: 13853

SEQ ID NO: 16262 - DNA, 3348 bp, Mesorhizobium sp. BNC1; identical to SEQ ID NO: 13854
  CDS (1)..(3348): transl_table=11

SEQ ID NO: 16263 - protein, 1115 aa, Mesorhizobium sp. BNC1; identical to SEQ ID NO: 13855

SEQ ID NO: 16264 - DNA, 1653 bp, Silicibacter sp. TM1040; identical to SEQ ID NO: 13856
  CDS (1)..(1653): transl_table=11

SEQ ID NO: 16265 - protein, 550 aa, Silicibacter sp. TM1040; identical to SEQ ID NO: 13857

SEQ ID NO: 16266 - DNA, 3267 bp, Nitrobacter hamburgensis X14; identical to SEQ ID NO: 13858
  CDS (1)..(3267): transl_table=11

SEQ ID NO: 16267 - protein, 1088 aa, Nitrobacter hamburgensis X14; identical to SEQ ID NO: 13859

SEQ ID NO: 16268 - DNA, 1926 bp, Shewanella denitrificans OS-217; identical to SEQ ID NO: 13860
  CDS (1)..(1926): transl_table=11

SEQ ID NO: 16269 - protein, 641 aa, Shewanella denitrificans OS-217; identical to SEQ ID NO: 13861

SEQ ID NO: 16270 - DNA, 1419 bp, Thermotoga neapolitana; identical to SEQ ID NO: 13862
  CDS (1)..(1419): transl_table=11

SEQ ID NO: 16271 - protein, 472 aa, Thermotoga neapolitana; identical to SEQ ID NO: 13863

SEQ ID NO: 16272 - DNA, 1701 bp, Bacteroides thetaiotaomicron; identical to SEQ ID NO: 13864
  CDS (1)..(1701): transl_table=11

SEQ ID NO: 16273 - protein, 566 aa, Bacteroides thetaiotaomicron; identical to SEQ ID NO: 13865

SEQ ID NO: 16274 - DNA, 3906 bp, Alicyclobacillus acidocaldarius; identical to SEQ ID NO: 13866
  CDS (1)..(3906): transl_table=11

SEQ ID NO: 16275 - protein, 1301 aa, Alicyclobacillus acidocaldarius; identical to SEQ ID NO: 13867

SEQ ID NO: 16276 - DNA, 1797 bp, Klebsiella oxytoca; identical to SEQ ID NO: 13868
  CDS (1)..(1797): transl_table=11

SEQ ID NO: 16277 - protein, 598 aa, Klebsiella oxytoca; identical to SEQ ID NO: 13869

SEQ ID NO: 16278 - DNA, 1581 bp, Bacillus sp; identical to SEQ ID NO: 13870
  CDS (1)..(1581): transl_table=11

SEQ ID NO: 16279 - protein, 526 aa, Bacillus sp; identical to SEQ ID NO: 13871

SEQ ID NO: 16280 - DNA, 1761 bp, Anoxybacillus flavithermus; identical to SEQ ID NO: 13872
  CDS (1)..(1761): transl_table=11

SEQ ID NO: 16281 - protein, 586 aa, Anoxybacillus flavithermus; identical to SEQ ID NO: 13873

SEQ ID NO: 16282 - DNA, 1749 bp, Thermoactinomyces thalpophilus; identical to SEQ ID NO: 13874
  CDS (1)..(1749): transl_table=11

SEQ ID NO: 16283 - protein, 582 aa, Thermoactinomyces thalpophilus; identical to SEQ ID NO: 13875

SEQ ID NO: 16284 - DNA, 1332 bp, Anaerobranca gottschalkii; identical to SEQ ID NO: 13876
  CDS (1)..(1332): transl_table=11

SEQ ID NO: 16285 - protein, 443 aa, Anaerobranca gottschalkii; identical to SEQ ID NO: 13877

SEQ ID NO: 16286 - DNA, 1740 bp, Aedes albopictus; identical to SEQ ID NO: 13878
  CDS (1)..(1740)

SEQ ID NO: 16287 - protein, 579 aa, Aedes albopictus; identical to SEQ ID NO: 13879

SEQ ID NO: 16288 - DNA, 1170 bp, Aeromonas hydrophila; identical to SEQ ID NO: 13880
  CDS (1)..(1170): n means a or g or c or t/u, s means g or c

SEQ ID NO: 16289 - protein, 389 aa, Aeromonas hydrophila; identical to SEQ ID NO: 13881
  for the disclosure of Xaa see table VIII

SEQ ID NO: 16290 - DNA, 1449 bp, Thermoactinomyces vulgaris; identical to SEQ ID NO: 13882
  CDS (1)..(1449): transl_table=11

SEQ ID NO: 16291 - protein, 482 aa, Thermoactinomyces vulgaris; identical to SEQ ID NO: 13883

SEQ ID NO: 16292 - DNA, 1581 bp, Xanthomonas campestris; identical to SEQ ID NO: 13884
  CDS (1)..(1581): transl_table=11

SEQ ID NO: 16293 - protein, 526 aa, Xanthomonas campestris; identical to SEQ ID NO: 13885

SEQ ID NO: 16294 - DNA, 3309 bp, Rhodobacter sphaeroides f; identical to SEQ ID NO: 13886
  CDS (1)..(3309): transl_table=11

SEQ ID NO: 16295 - protein, 1102 aa, Rhodobacter sphaeroides f; identical to SEQ ID NO: 13887

SEQ ID NO: 16296 - DNA, 1548 bp, Ostreococcus tauri; identical to SEQ ID NO: 13888
  CDS (1)..(1548)

SEQ ID NO: 16297 - protein, 515 aa, Ostreococcus tauri; identical to SEQ ID NO: 13889

SEQ ID NO: 16298 - DNA, 1554 bp, uncultured bacterium; identical to SEQ ID NO: 13890
  CDS (1)..(1554)

SEQ ID NO: 16299 - protein, 517 aa, uncultured bacterium; identical to SEQ ID NO: 13891

SEQ ID NO: 16300 - DNA, 2628 bp, Chlamydomonas reinhardtii; identical to SEQ ID NO: 13892
  CDS (1)..(2628)

SEQ ID NO: 16301 - protein, 875 aa, Chlamydomonas reinhardtii; identical to SEQ ID NO: 13893

SEQ ID NO: 16302 - DNA, 1962 bp, Paenibacillus sp; identical to SEQ ID NO: 13894
  CDS (1)..(1962): transl_table=11

SEQ ID NO: 16303 - protein, 653 aa, Paenibacillus sp; identical to SEQ ID NO: 13895

SEQ ID NO: 16304 - DNA, 1548 bp, Halothermothrix orenii; identical to SEQ ID NO: 13896
  CDS (1)..(1548): transl_table=11

SEQ ID NO: 16305 - protein, 515 aa, Halothermothrix orenii; identical to SEQ ID NO: 13897

SEQ ID NO: 16306 - DNA, 1533 bp, Paenibacillus sp; identical to SEQ ID NO: 13898
  CDS (1)..(1533): transl_table=11

SEQ ID NO: 16307 - protein, 510 aa, Paenibacillus sp; identical to SEQ ID NO: 13899

SEQ ID NO: 16308 - DNA, 1767 bp, Bacillus stearothermophilus; identical to SEQ ID NO: 13900
  CDS (1)..(1767): transl_table=11

SEQ ID NO: 16309 - protein, 588 aa, Bacillus stearothermophilus; identical to SEQ ID NO: 13901

SEQ ID NO: 16310 - DNA, 6057 bp, Bacillus stearothermophilus; identical to SEQ ID NO: 13902
  CDS (1)..(6057): transl_table=11

SEQ ID NO: 16311 - protein, 2018 aa, Bacillus stearothermophilus; identical to SEQ ID NO: 13903

SEQ ID NO: 16312 - DNA, 1983 bp, Thermococcus sp; identical to SEQ ID NO: 13904
  CDS (1)..(1983): transl_table=11

SEQ ID NO: 16313 - protein, 660 aa, Thermococcus sp; identical to SEQ ID NO: 13905

SEQ ID NO: 16314 - DNA, 2181 bp, Thermococcus sp; identical to SEQ ID NO: 13906
  CDS (1)..(2181)

SEQ ID NO: 16315 - protein, 726 aa, Thermococcus sp; identical to SEQ ID NO: 13907

SEQ ID NO: 16316 - DNA, 2220 bp, Thermococcus sp; identical to SEQ ID NO: 13908
  CDS (1)..(2220): transl_table=11

SEQ ID NO: 16317 - protein, 739 aa, Thermococcus sp; identical to SEQ ID NO: 13909

SEQ ID NO: 16318 - DNA, 1737 bp, Alicyclobacillus acidocaldarius; identical to SEQ ID NO: 13910
  CDS (1)..(1737): transl_table=11

SEQ ID NO: 16319 - protein, 578 aa, Alicyclobacillus acidocaldarius; identical to SEQ ID NO: 13911

SEQ ID NO: 16320 - DNA, 1548 bp, Paenibacillus polymyxa; identical to SEQ ID NO: 13912
  CDS (1)..(1548): transl_table=11

SEQ ID NO: 16321 - protein, 515 aa, Paenibacillus polymyxa; identical to SEQ ID NO: 13913

SEQ ID NO: 16322 - DNA, 1689 bp, Dictyoglomus thermophilum; identical to SEQ ID NO: 13914
  CDS (1)..(1689): transl_table=11

SEQ ID NO: 16323 - protein, 562 aa, Dictyoglomus thermophilum; identical to SEQ ID NO: 13915

SEQ ID NO: 16324 - DNA, 1497 bp, Dictyoglomus thermophilum; identical to SEQ ID NO: 13916
  CDS (1)..(1497): transl_table=11

SEQ ID NO: 16325 - protein, 498 aa, Dictyoglomus thermophilum; identical to SEQ ID NO: 13917

SEQ ID NO: 16326 - DNA, 1242 bp, Triticum aestivum; identical to SEQ ID NO: 13918
  CDS (1)..(1242)

SEQ ID NO: 16327 - protein, 413 aa, Triticum aestivum; identical to SEQ ID NO: 13919

SEQ ID NO: 16328 - DNA, 1761 bp, Bacillus acidopullulyticus; identical to SEQ ID NO: 13920
  CDS (1)..(1761): transl_table=11

SEQ ID NO: 16329 - protein, 586 aa, Bacillus acidopullulyticus; identical to SEQ ID NO: 13921

SEQ ID NO: 16330 - DNA, 1563 bp, Bacillus megaterium; identical to SEQ ID NO: 13922
  CDS (1)..(1563): transl_table=11

SEQ ID NO: 16331 - protein, 520 aa, Bacillus megaterium; identical to SEQ ID NO: 13923

SEQ ID NO: 16332 - DNA, 4428 bp, Thermoanaerobacter thermohydrosulfuricus; identical to SEQ ID NO: 13924
  CDS (1)..(4428): transl_table=11

SEQ ID NO: 16333 - protein, 1475 aa, Thermoanaerobacter thermohydrosulfuricus; identical to SEQ ID NO: 13925

SEQ ID NO: 16334 - DNA, 1776 bp, Bacillus sphaericus; identical to SEQ ID NO: 13926
  CDS (1)..(1776): transl_table=11

SEQ ID NO: 16335 - protein, 591 aa, Bacillus sphaericus; identical to SEQ ID NO: 13927

SEQ ID NO: 16336 - DNA, 1725 bp, Thermoanaerobacter ethanolicus; identical to SEQ ID NO: 13928
  CDS (1)..(1725): transl_table=11

SEQ ID NO: 16337 - protein, 574 aa, Thermoanaerobacter ethanolicus; identical to SEQ ID NO: 13929

SEQ ID NO: 16338 - DNA, 1761 bp, Drosophila virilis; identical to SEQ ID NO: 13930
  CDS (1)..(1761)

SEQ ID NO: 16339 - protein, 586 aa, Drosophila virilis; identical to SEQ ID NO: 13931

SEQ ID NO: 16340 - DNA, 1329 bp, Thermotoga neapolitana; identical to SEQ ID NO: 13932
  CDS (1)..(1329): transl_table=11

SEQ ID NO: 16341 - protein, 442 aa, Thermotoga neapolitana; identical to SEQ ID NO: 13933

SEQ ID NO: 16342 - DNA, 2001 bp, Thermoactinomyces vulgaris; identical to SEQ ID NO: 13934
  CDS (1)..(2001): transl_table=11

SEQ ID NO: 16343 - protein, 666 aa, Thermoactinomyces vulgaris; identical to SEQ ID NO: 13935

SEQ ID NO: 16344 - DNA, 1758 bp, Thermoactinomyces vulgaris; identical to SEQ ID NO: 13936
  CDS (1)..(1758): transl_table=11

SEQ ID NO: 16345 - protein, 585 aa, Thermoactinomyces vulgaris; identical to SEQ ID NO: 13937

SEQ ID NO: 16346 - DNA, 24 bp, Artificial sequence
  (1)..(24): primer
atgatgttaaatgcatggcacctg

SEQ ID NO: 16347 - DNA, 24 bp, Artificial sequence
  (1)..(24): primer
ttagttcatccataccgtagccga

SEQ ID NO: 16348 - protein, 917 aa, Artificial sequence; identical to SEQ ID NO: 13940
  Variant (2)..(2): xaa in position 2 is any amino acid
  Variant (6)..(6): xaa in position 6 is any amino acid
  Variant (15)..(16): xaa in position 15 to 16 is any amino acid
  Variant (18)..(18): xaa in position 18 is any amino acid
  Variant (22)..(22): xaa in position 22 is any amino acid
  Variant (25)..(25): xaa in position 25 is any amino acid
  Variant (26)..(85): xaa in position 26 to 85 is any or no amino acid
  Variant (89)..(89): xaa in position 89 is any amino acid
  Variant (93)..(93): xaa in position 93 is any amino acid
  Variant (99)..(99): xaa in position 99 is any amino acid
  Variant (101)..(108): xaa in position 101 to 108 is any or no amino acid
  Variant (112)..(112): xaa in position 112 is any amino acid
  Variant (117)..(117): xaa in position 117 is any amino acid
  Variant (121)..(121): xaa in position 121 is any amino acid
  Variant (124)..(125): xaa in position 124 to 125 is any amino acid
  Variant (126)..(152): xaa in position 126 to 152 is any or no amino acid
  Variant (158)..(158): xaa in position 158 is any amino acid
  Variant (161)..(162): xaa in position 161 to 162 is any amino acid
  Variant (166)..(166): xaa in position 166 is any amino acid
  Variant (171)..(171): xaa in position 171 is any amino acid
  Variant (174)..(175): xaa in position 174 to 175 is any amino acid
  Variant (178)..(179): xaa in position 178 to 179 is any amino acid
  Variant (182)..(182): xaa in position 182 is any amino acid
  Variant (186)..(189): xaa in position 186 to 189 is any or no amino acid
  Variant (195)..(195): xaa in position 195 is any amino acid
  Variant (197)..(197): xaa in position 197 is any amino acid
  Variant (203)..(203): xaa in position 203 is any amino acid
  Variant (205)..(205): xaa in position 205 is any amino acid
  Variant (208)..(208): xaa in position 208 is any amino acid
  Variant (211)..(214): xaa in position 211 to 214 is any amino acid
  Variant (215)..(256): xaa in position 215 to 256 is any or no amino acid
  Variant (258)..(258): xaa in position 258 is any or no amino acid
  Variant (266)..(266): xaa in position 266 is any or no amino acid
  Variant (268)..(269): xaa in position 268 to 269 is any amino acid
  Variant (270)..(394): xaa in position 270 to 394 is any or no amino acid
  Variant (397)..(399): xaa in position 397 to 399 is any or no amino acid
  Variant (401)..(402): xaa in position 401 to 402 is any amino acid
  Variant (403)..(404): xaa in position 403 to 404 is any or no amino acid
  Variant (413)..(413): xaa in position 413 is any amino acid
  Variant (415)..(417): xaa in position 415 to 417 is any amino acid
  Variant (420)..(420): xaa in position 420 is any amino acid
  Variant (421)..(426): xaa in position 421 to 426 is any or no amino acid
  Variant (433)..(433): xaa in position 433 is any amino acid
  Variant (434)..(434): xaa in position 434 is any or no amino acid
  Variant (436)..(441): xaa in position 436 to 441 is any or no amino acid
  Variant (449)..(449): xaa in position 449 is any amino acid
  Variant (451)..(452): xaa in position 451 to 452 is any amino acid
  Variant (454)..(458): xaa in position 454 to 458 is any amino acid
  Variant (459)..(487): xaa in position 459 to 487 is any or no amino acid
  Variant (489)..(490): xaa in position 489 to 490 is any amino acid
  Variant (492)..(495): xaa in position 492 to 495 is any amino acid
  Variant (498)..(498): xaa in position 498 is any amino acid
  Variant (504)..(509): xaa in position 504 to 509 is any amino acid
  Variant (510)..(529): xaa in position 510 to 529 is any or no amino acid
  Variant (532)..(534): xaa in position 532 to 534 is any amino acid
  Variant (535)..(538): xaa in position 535 to 538 is any or no amino acid
  Variant (540)..(544): xaa in position 540 to 544 is any amino acid
  Variant (547)..(554): xaa in position 547 to 554 is any amino acid
  Variant (555)..(592): xaa in position 555 to 592 is any or no amino acid
  Variant (594)..(607): xaa in position 594 to 607 is any amino acid
  Variant (608)..(611): xaa in position 608 to 611 is any or no amino acid
  Variant (613)..(613): xaa in position 613 is any amino acid
  Variant (617)..(618): xaa in position 617 to 618 is any amino acid
  Variant (620)..(620): xaa in position 620 is any amino acid
  Variant (623)..(623): xaa in position 623 is any amino acid
  Variant (625)..(627): xaa in position 625 to 627 is any amino acid
  Variant (628)..(667): xaa in position 628 to 667 is any or no amino acid
  Variant (672)..(674): xaa in position 672 to 674 is any amino acid
  Variant (684)..(684): xaa in position 684 is any amino acid
  Variant (694)..(697): xaa in position 694 to 697 is any amino acid
  Variant (698)..(737): xaa in position 698 to 737 is any or no amino acid
  Variant (739)..(739): xaa in position 739 is any amino acid
  Variant (740)..(740): xaa in position 740 is any or no amino acid
  Variant (742)..(742): xaa in position 742 is any or no amino acid
  Variant (745)..(745): xaa in position 745 is any or no amino acid
  Variant (747)..(750): xaa in position 747 to 750 is any amino acid
  Variant (752)..(797): xaa in position 752 to 797 is any or no amino acid
  Variant (801)..(801): xaa in position 801 is any amino acid
  Variant (803)..(803): xaa in position 803 is any amino acid
  Variant (805)..(805): xaa in position 805 is any amino acid
  Variant (808)..(808): xaa in position 808 is any amino acid
  Variant (812)..(814): xaa in position 812 to 814 is any amino acid
  Variant (817)..(817): xaa in position 817 is any amino acid
  Variant (818)..(818): xaa in position 818 is any or no amino acid
  Variant (820)..(827): xaa in position 820 to 827 is any amino acid
  Variant (828)..(840): xaa in position 828 to 840 is any or no amino acid
  Variant (845)..(845): xaa in position 845 is any amino acid
  Variant (847)..(850): xaa in position 847 to 850 is any amino acid
  Variant (852)..(852): xaa in position 852 is any amino acid
  Variant (857)..(857): xaa in position 857 is any amino acid
  Variant (859)..(864): xaa in position 859 to 864 is any amino acid
  Variant (865)..(886): xaa in position 865 to 886 is any or no amino acid
  Variant (888)..(898): xaa in position 888 to 898 is any amino acid
  Variant (899)..(909): xaa in position 899 to 909 is any or no amino acid
  Variant (911)..(915): xaa in position 911 to 915 is any amino acid
  Variant (916)..(916): xaa in position 916 is any or no amino acid

SEQ ID NO: 16349 - protein, 8 aa, Artificial sequence
  Variant (2)..(2): xaa in position 2 is Glu or Gln
  Variant (3)..(3): xaa in position 3 is Ile, Leu or Val
  Variant (4)..(7): xaa in position 4 to 7 is any amino acid
YXXXXXXF

SEQ ID NO: 16350 - protein, 72 aa, Artificial sequence; identical to SEQ ID NO: 13942
  Variant (2)..(12): xaa in position 2 to 12 is any amino acid
  Variant (14)..(16): xaa in position 14 to 16 is any amino acid
  Variant (17)..(17): xaa in position 17 is Phe, Ile, Leu, Met or Val
  Variant (18)..(18): xaa in position 18 is Trp or Tyr
  Variant (19)..(19): xaa in position 19 is Phe, Ile, Leu, Met or Val
  Variant (20)..(20): xaa in position 20 is any amino acid
  Variant (22)..(30): xaa in position 22 to 30 is any amino acid
  Variant (31)..(31): xaa in position 31 is any or no amino acid
  Variant (33)..(35): xaa in position 33 to 35 is any amino acid
  Variant (36)..(36): xaa in position 36 is Asp, Glu, Asn or Thr
  Variant (37)..(39): xaa in position 37 to 39 is any amino acid
  Variant (40)..(40): xaa in position 40 is Phe, Ile, Leu or Val
  Variant (41)..(44): xaa in position 41 to 44 is any amino acid
  Variant (46)..(52): xaa in position 46 to 52 is any amino acid
  Variant (53)..(53): xaa in position 53 is Phe, Leu, Met or Val
  Variant (54)..(61): xaa in position 54 to 61 is any amino acid
  Variant (62)..(62): xaa in position 62 is Phe, Ile, Leu, Met or Val
  Variant (63)..(63): xaa in position 63 is any amino acid
  Variant (64)..(64): xaa in position 64 is Ile, Leu or Val
  Variant (65)..(66): xaa in position 65 to 66 is any amino acid
  Variant (67)..(67): xaa in position 67 is Asp or Glu
  Variant (68)..(71): xaa in position 68 to 71 is any amino acid

SEQ ID NO: 16351 - protein, 14 aa, Artificial sequence
  Variant (2)..(6): xaa in position 2 to 6 is any amino acid
  Variant (7)..(8): xaa in position 7 to 8 is any or no amino acid
  Variant (10)..(10): xaa in position 10 is Ala or Gly
  Variant (11)..(11): xaa in position 11 is any amino acid
  Variant (13)..(13): xaa in position 13 is Phe, Ile, Leu, Met or Val
WXXXXXXXDXXRXD

SEQ ID NO: 16352 - protein, 12 aa, Artificial sequence
  Variant (2)..(2): xaa in position 2 is any amino acid
  Variant (3)..(3): xaa in position 3 is Ala, Ile, Pro or Val
  Variant (4)..(5): xaa in position 4 to 5 is any amino acid
  Variant (7)..(7): xaa in position 7 is any amino acid
  Variant (9)..(9): xaa in position 9 is Asp, Glu, Gly, Asn, Gln, Ser or Thr
  Variant (11)..(11): xaa in position 11 is any amino acid
GXXXXYXGXEXG

SEQ ID NO: 16353 - DNA, 1203 bp, Escherichia coli; identical to SEQ ID NO: 13945
  CDS (1)..(1203)

SEQ ID NO: 16354 - protein, 400 aa, Escherichia coli; identical to SEQ ID NO: 13946

SEQ ID NO: 16355 - DNA, 1281 bp, Aquifex aeolicus VF5; identical to SEQ ID NO: 13947
  CDS (1)..(1281): transl_table=11

SEQ ID NO: 16356 - protein, 426 aa, Aquifex aeolicus VF5; identical to SEQ ID NO: 13948

SEQ ID NO: 16357 - DNA, 1260 bp, Neisseria meningitidis Z2491; identical to SEQ ID NO: 13949
  CDS (1)..(1260): transl_table=11

SEQ ID NO: 16358 - protein, 419 aa, Neisseria meningitidis Z2491; identical to SEQ ID NO: 13950

SEQ ID NO: 16359 - DNA, 1425 bp, Deinococcus radiodurans R1; identical to SEQ ID NO: 13951
  CDS (1)..(1425): transl_table=11

SEQ ID NO: 16360 - protein, 474 aa, Deinococcus radiodurans R1; identical to SEQ ID NO: 13952

SEQ ID NO: 16361 - DNA, 1392 bp, Mycobacterium tuberculosis CDC1551; identical to SEQ ID NO: 13953
  CDS (1)..(1392): transl_table=11

SEQ ID NO: 16362 - protein, 463 aa, Mycobacterium tuberculosis CDC1551; identical to SEQ ID NO: 13954

SEQ ID NO: 16363 - DNA, 1203 bp, Salmonella typhimurium LT2; identical to SEQ ID NO: 13955
  CDS (1)..(1203): transl_table=11

SEQ ID NO: 16364 - protein, 400 aa, Salmonella typhimurium LT2; identical to SEQ ID NO: 13956

SEQ ID NO: 16365 - DNA, 1320 bp, Agrobacterium tumefaciens str. C58; identical to SEQ ID NO: 13957
  CDS (1)..(1320): transl_table=11

SEQ ID NO: 16366 - protein, 439 aa, Agrobacterium tumefaciens str. C58; identical to SEQ ID NO: 13958

SEQ ID NO: 16367 - DNA, 1251 bp, Yersinia pestis KIM; identical to SEQ ID NO: 13959
  CDS (1)..(1251): transl_table=11

SEQ ID NO: 16368 - protein, 416 aa, Yersinia pestis KIM; identical to SEQ ID NO: 13960

SEQ ID NO: 16369 - DNA, 1314 bp, Thermosynechococcus elongatus BP-1; identical to SEQ ID NO: 13961
  CDS (1)..(1314): transl_table=11

SEQ ID NO: 16370 - protein, 437 aa, Thermosynechococcus elongatus BP-1; identical to SEQ ID NO: 13962

SEQ ID NO: 16371 - DNA, 1464 bp, Oceanobacillus iheyensis HTE831; identical to SEQ ID NO: 13963
  CDS (1)..(1464): transl_table=11

SEQ ID NO: 16372 - protein, 487 aa, Oceanobacillus iheyensis HTE831; identical to SEQ ID NO: 13964

SEQ ID NO: 16373 - DNA, 1209 bp, Pseudomonas putida KT2440; identical to SEQ ID NO: 13965
  CDS (1)..(1209): transl_table=11

SEQ ID NO: 16374 - protein, 402 aa, Pseudomonas putida KT2440; identical to SEQ ID NO: 13966

SEQ ID NO: 16375 - DNA, 1305 bp, Bradyrhizobium japonicum USDA 110; identical to SEQ ID NO: 13967
  CDS (1)..(1305)

SEQ ID NO: 16376 - protein, 434 aa, Bradyrhizobium japonicum USDA 110; identical to SEQ ID NO: 13968

SEQ ID NO: 16377 - DNA, 1434 bp, Lactobacillus plantarum WCFS1; identical to SEQ ID NO: 13969
  CDS (1)..(1434): transl_table=11

SEQ ID NO: 16378 - protein, 477 aa, Lactobacillus plantarum WCFS1; identical to SEQ ID NO: 13970

SEQ ID NO: 16379 - DNA, 1203 bp, Salmonella enterica subsp. enterica serovar Typhi Ty2; identical to SEQ ID NO: 13971
  CDS (1)..(1203): transl_table=11

SEQ ID NO: 16380 - protein, 400 aa, Salmonella enterica subsp. enterica serovar Typhi Ty2; identical to SEQ ID NO: 13972

SEQ ID NO: 16381 - DNA, 1170 bp, Bacteroides thetaiotaomicron VPI-5482; identical to SEQ ID NO: 13973
  CDS (1)..(1170): transl_table=11

SEQ ID NO: 16382 - protein, 389 aa, Bacteroides thetaiotaomicron VPI-5482; identical to SEQ ID NO: 13974

SEQ ID NO: 16383 - DNA, 1407 bp, Coxiella burnetii RSA 493; identical to SEQ ID NO: 13975
  CDS (1)..(1407): transl_table=11

SEQ ID NO: 16384 - protein, 468 aa, Coxiella burnetii RSA 493; identical to SEQ ID NO: 13976

SEQ ID NO: 16385 - DNA, 1185 bp, Porphyromonas gingivalis W83; identical to SEQ ID NO: 13977
  CDS (1)..(1185): transl_table=11

SEQ ID NO: 16386 - protein, 394 aa, Porphyromonas gingivalis W83; identical to SEQ ID NO: 13978

SEQ ID NO: 16387 - DNA, 1608 bp, Oryza sativa (japonica cultivar-group); identical to SEQ ID NO: 13979
  CDS (1)..(1608)

SEQ ID NO: 16388 - protein, 535 aa, Oryza sativa (japonica cultivar-group); identical to SEQ ID NO: 13980

SEQ ID NO: 16389 - DNA, 1446 bp, Geobacter sulfurreducens PCA; identical to SEQ ID NO: 13981
  CDS (1)..(1446): transl_table=11

SEQ ID NO: 16390 - protein, 481 aa, Geobacter sulfurreducens PCA; identical to SEQ ID NO: 13982

SEQ ID NO: 16391 - DNA, 1437 bp, Treponema denticola ATCC 35405; identical to SEQ ID NO: 13983
  CDS (1)..(1437): transl_table=11

SEQ ID NO: 16392 - protein, 478 aa, Treponema denticola ATCC 35405; identical to SEQ ID NO: 13984

SEQ ID NO: 16393 - DNA, 1293 bp, Eremothecium gossypii; identical to SEQ ID NO: 13985
  CDS (1)..(1293)

SEQ ID NO: 16394 - protein, 430 aa, Eremothecium gossypii; identical to SEQ ID NO: 13986

SEQ ID NO: 16395 - DNA, 1434 bp, Neurospora crassa; identical to SEQ ID NO: 13987
  CDS (1)..(1434)

SEQ ID NO: 16396 - protein, 477 aa, Neurospora crassa; identical to SEQ ID NO: 13988

SEQ ID NO: 16397 - DNA, 5916 bp, Magnaporthe grisea 70-15; identical to SEQ ID NO: 13989
  CDS (1)..(5916)

SEQ ID NO: 16398 - protein, 1971 aa, Magnaporthe grisea 70-15; identical to SEQ ID NO: 13990

SEQ ID NO: 16399 - DNA, 1380 bp, Gibberella zeae PH-1; identical to SEQ ID NO: 13991
  CDS (1)..(1380)

SEQ ID NO: 16400 - protein, 459 aa, Gibberella zeae PH-1; identical to SEQ ID NO: 13992

SEQ ID NO: 16401 - DNA, 1839 bp, Ustilago maydis 521; identical to SEQ ID NO: 13993
  CDS (1)..(1839)

SEQ ID NO: 16402 - protein, 612 aa, Ustilago maydis 521; identical to SEQ ID NO: 13994

SEQ ID NO: 16403 - DNA, 1464 bp, Aspergillus nidulans FGSC A4; identical to SEQ ID NO: 13995
  CDS (1)..(1464)

SEQ ID NO: 16404 - protein, 487 aa, Aspergillus nidulans FGSC A4; identical to SEQ ID NO: 13996

SEQ ID NO: 16405 - DNA, 1296 bp, Candida glabrata CBS138; identical to SEQ ID NO: 13997
  CDS (1)..(1296)

SEQ ID NO: 16406 - protein, 431 aa, Candida glabrata CBS138; identical to SEQ ID NO: 13998

SEQ ID NO: 16407 - DNA, 1284 bp, Kluyveromyces lactis NRRL Y-1140; identical to SEQ ID NO: 13999
  CDS (1)..(1284)

SEQ ID NO: 16408 - protein, 427 aa, Kluyveromyces lactis NRRL Y-1140; identical to SEQ ID NO: 14000

SEQ ID NO: 16409 - DNA, 1269 bp, Debaryomyces hansenii CBS767; identical to SEQ ID NO: 14001
  CDS (1)..(1269)

SEQ ID NO: 16410 - protein, 422 aa, Debaryomyces hansenii CBS767; identical to SEQ ID NO: 14002

SEQ ID NO: 16411 - DNA, 1245 bp, Yarrowia lipolytica CLIB99; identical to SEQ ID NO: 14003
  CDS (1)..(1245)

SEQ ID NO: 16412 - protein, 414 aa, Yarrowia lipolytica CLIB99; identical to SEQ ID NO: 14004

SEQ ID NO: 16413 - DNA, 1362 bp, Cryptococcus neoformans var. neoformans JEC21; identical to SEQ ID NO: 14005
  CDS (1)..(1362)

SEQ ID NO: 16414 - protein, 453 aa, Cryptococcus neoformans var. neoformans JEC21; identical to SEQ ID NO: 14006

SEQ ID NO: 16415 - DNA, 1173 bp, Entamoeba histolytica HM-1:IMSS; identical to SEQ ID NO: 14007
  CDS (1)..(1173)

SEQ ID NO: 16416 - protein, 390 aa, Entamoeba histolytica HM-1:IMSS; identical to SEQ ID NO: 14008

SEQ ID NO: 16417 - DNA, 1266 bp, Candida albicans SC5314; identical to SEQ ID NO: 14009
  CDS (1)..(1266): transl_table=12

SEQ ID NO: 16418 - protein, 421 aa, Candida albicans SC5314; identical to SEQ ID NO: 14010

SEQ ID NO: 16419 - DNA, 1305 bp, Bartonella quintana str. Toulouse; identical to SEQ ID NO: 14011
  CDS (1)..(1305): transl_table=11

SEQ ID NO: 16420 - protein, 434 aa, Bartonella quintana str. Toulouse; identical to SEQ ID NO: 14012

SEQ ID NO: 16421 - DNA, 1305 bp, Bartonella henselae str. Houston-1; identical to SEQ ID NO: 14013
  CDS (1)..(1305): transl_table=11

SEQ ID NO: 16422 - protein, 434 aa, Bartonella henselae str. Houston-1; identical to SEQ ID NO: 14014

SEQ ID NO: 16423 - DNA, 1470 bp, Bacillus licheniformis ATCC 14580; identical to SEQ ID NO: 14015
  CDS (1)..(1470): transl_table=11

SEQ ID NO: 16424 - protein, 489 aa, Bacillus licheniformis ATCC 14580; identical to SEQ ID NO: 14016

SEQ ID NO: 16425 - DNA, 1167 bp, Bacteroides fragilis YCH46; identical to SEQ ID NO: 14017
  CDS (1)..(1167): transl_table=11

SEQ ID NO: 16426 - protein, 388 aa, Bacteroides fragilis YCH46; identical to SEQ ID NO: 14018

SEQ ID NO: 16427 - DNA, 1350 bp, Methylococcus capsulatus str. Bath; identical to SEQ ID NO: 14019
  CDS (1)..(1350): transl_table=11

SEQ ID NO: 16428 - protein, 449 aa, Methylococcus capsulatus str. Bath; identical to SEQ ID NO: 14020

SEQ ID NO: 16429 - DNA, 1317 bp, Nocardia farcinica IFM 10152; identical to SEQ ID NO: 14021
  CDS (1)..(1317): transl_table=11

SEQ ID NO: 16430 - protein, 438 aa, Nocardia farcinica IFM 10152; identical to SEQ ID NO: 14022

SEQ ID NO: 16431 - DNA, 1404 bp, Legionella pneumophila str. Paris; identical to SEQ ID NO: 14023
  CDS (1)..(1404): transl_table=11

SEQ ID NO: 16432 - protein, 467 aa, Legionella pneumophila str. Paris; identical to SEQ ID NO: 14024

SEQ ID NO: 16433 - DNA, 1404 bp, Legionella pneumophila str. Lens; identical to SEQ ID NO: 14025
  CDS (1)..(1404): transl_table=11

SEQ ID NO: 16434 - protein, 467 aa, Legionella pneumophila str. Lens; identical to SEQ ID NO: 14026

SEQ ID NO: 16435 - DNA, 1473 bp, Geobacillus kaustophilus HTA426; identical to SEQ ID NO: 14027
  CDS (1)..(1473): transl_table=11

SEQ ID NO: 16436 - protein, 490 aa, Geobacillus kaustophilus HTA426; identical to SEQ ID NO: 14028

SEQ ID NO: 16437 - DNA, 1347 bp, Idiomarina loihiensis L2TR; identical to SEQ ID NO: 14029
  CDS (1)..(1347): transl_table=11

SEQ ID NO: 16438 - protein, 448 aa, Idiomarina loihiensis L2TR; identical to SEQ ID NO: 14030

SEQ ID NO: 16439 - DNA, 1344 bp, Silicibacter pomeroyi DSS-3; identical to SEQ ID NO: 14031
  CDS (1)..(1344): transl_table=11

SEQ ID NO: 16440 - protein, 447 aa, Silicibacter pomeroyi DSS-3; identical to SEQ ID NO: 14032

SEQ ID NO: 16441 - DNA, 1260 bp, Neisseria gonorrhoeae FA 1090; identical to SEQ ID NO: 14033
  CDS (1)..(1260): transl_table=11

SEQ ID NO: 16442 - protein, 419 aa, Neisseria gonorrhoeae FA 1090; identical to SEQ ID NO: 14034

SEQ ID NO: 16443 - DNA, 1167 bp, Bacteroides fragilis NCTC 9343; identical to SEQ ID NO: 14035
  CDS (1)..(1167): transl_table=11

SEQ ID NO: 16444 - protein, 388 aa, Bacteroides fragilis NCTC 9343; identical to SEQ ID NO: 14036

SEQ ID NO: 16445 - DNA, 1251 bp, Salmonella enterica subsp. enterica serovar Choleraesuis str; identical to SEQ ID NO: 14037
  CDS (1)..(1251): transl_table=11

SEQ ID NO: 16446 - protein, 416 aa, Salmonella enterica subsp. enterica serovar Choleraesuis str; identical to SEQ ID NO: 14038

SEQ ID NO: 16447 - DNA, 1224 bp, Pseudomonas syringae pv. syringae B728a; identical to SEQ ID NO: 14039
  CDS (1)..(1224)

SEQ ID NO: 16448 - protein, 407 aa, Pseudomonas syringae pv. syringae B728a; identical to SEQ ID NO: 14040

SEQ ID NO: 16449 - DNA, 1326 bp, Corynebacterium jeikeium K411; identical to SEQ ID NO: 14041
  CDS (1)..(1326): transl_table=11

SEQ ID NO: 16450 - protein, 441 aa, Corynebacterium jeikeium K411; identical to SEQ ID NO: 14042

SEQ ID NO: 16451 - DNA, 1293 bp, Rhodobacter sphaeroides 2.4.1; identical to SEQ ID NO: 14043
  CDS (1)..(1293)

SEQ ID NO: 16452 - protein, 430 aa, Rhodobacter sphaeroides 2.4.1; identical to SEQ ID NO: 14044

SEQ ID NO: 16453 - DNA, 1134 bp, Xylella fastidiosa Ann-1; identical to SEQ ID NO: 14045
  CDS (1)..(1134)

SEQ ID NO: 16454 - protein, 377 aa, Xylella fastidiosa Ann-1; identical to SEQ ID NO: 14046

SEQ ID NO: 16455 - DNA, 1464 bp, Leuconostoc mesenteroides subsp. mesenteroides ATCC 8293; identical to SEQ ID NO: 14047
  CDS (1)..(1464)

SEQ ID NO: 16456 - protein, 487 aa, Leuconostoc mesenteroides subsp. mesenteroides ATCC 8293; identical to SEQ ID NO: 14048

SEQ ID NO: 16457 - DNA, 1242 bp, Psychrobacter sp. 273-4; identical to SEQ ID NO: 14049
  CDS (1)..(1242)

SEQ ID NO: 16458 - protein, 413 aa, Psychrobacter sp. 273-4; identical to SEQ ID NO: 14050

SEQ ID NO: 16459 - DNA, 1179 bp, Ralstonia eutropha JMP134; identical to SEQ ID NO: 14051
  CDS (1)..(1179)

SEQ ID NO: 16460 - protein, 392 aa, Ralstonia eutropha JMP134; identical to SEQ ID NO: 14052

SEQ ID NO: 16461 - DNA, 1200 bp, Burkholderia cepacia R18194; identical to SEQ ID NO: 14053
  CDS (1)..(1200)

SEQ ID NO: 16462 - protein, 399 aa, Burkholderia cepacia R18194; identical to SEQ ID NO: 14054

SEQ ID NO: 16463 - DNA, 1224 bp, Pseudomonas fluorescens PfO-1; identical to SEQ ID NO: 14055
  CDS (1)..(1224)

SEQ ID NO: 16464 - protein, 407 aa, Pseudomonas fluorescens PfO-1; identical to SEQ ID NO: 14056

SEQ ID NO: 16465 - DNA, 1197 bp, Burkholderia fungorum LB400; identical to SEQ ID NO: 14057
  CDS (1)..(1197)

SEQ ID NO: 16466 - protein, 398 aa, Burkholderia fungorum LB400; identical to SEQ ID NO: 14058

SEQ ID NO: 16467 - DNA, 1428 bp, Oenococcus oeni PSU-1; identical to SEQ ID NO: 14059
  CDS (1)..(1428)

SEQ ID NO: 16468 - protein, 475 aa, Oenococcus oeni PSU-1; identical to SEQ ID NO: 14060

SEQ ID NO: 16469 - DNA, 1380 bp, Trichodesmium erythraeum IMS101; identical to SEQ ID NO: 14061
  CDS (1)..(1380)

SEQ ID NO: 16470 - protein, 459 aa, Trichodesmium erythraeum IMS101; identical to SEQ ID NO: 14062

SEQ ID NO: 16471 - DNA, 1434 bp, Campylobacter upsaliensis RM3195; identical to SEQ ID NO: 14063
  CDS (1)..(1434): transl_table=11

SEQ ID NO: 16472 - protein, 477 aa, Campylobacter upsaliensis RM3195; identical to SEQ ID NO: 14064

SEQ ID NO: 16473 - DNA, 1488 bp, Lactococcus lactis subsp. cremoris SK11; identical to SEQ ID NO: 14065
  CDS (1)..(1488)

SEQ ID NO: 16474 - protein, 495 aa, Lactococcus lactis subsp. cremoris SK11; identical to SEQ ID NO: 14066

SEQ ID NO: 16475 - DNA, 1461 bp, Deinococcus geothermalis DSM 11300; identical to SEQ ID NO: 14067
  CDS (1)..(1461): transl_table=11

SEQ ID NO: 16476 - protein, 486 aa, Deinococcus geothermalis DSM 11300; identical to SEQ ID NO: 14068

SEQ ID NO: 16477 - DNA, 1359 bp, Azotobacter vinelandii AvOP; identical to SEQ ID NO: 14069
  CDS (1)..(1359): transl_table=11

SEQ ID NO: 16478 - protein, 452 aa, Azotobacter vinelandii AvOP; identical to SEQ ID NO: 14070

SEQ ID NO: 16479 - DNA, 1356 bp, Burkholderia vietnamiensis G4; identical to SEQ ID NO: 14071
  CDS (1)..(1356): transl_table=11

SEQ ID NO: 16480 - protein, 451 aa, Burkholderia vietnamiensis G4; identical to SEQ ID NO: 14072

SEQ ID NO: 16481 - DNA, 1200 bp, Burkholderia mallei 10229; identical to SEQ ID NO: 14073
  CDS (1)..(1200)

SEQ ID NO: 16482 - protein, 399 aa, Burkholderia mallei 10229; identical to SEQ ID NO: 14074

SEQ ID NO: 16483 - DNA, 1200 bp, Burkholderia cenocepacia AU 1054; identical to SEQ ID NO: 14075
  CDS (1)..(1200): transl_table=11

SEQ ID NO: 16484 - protein, 399 aa, Burkholderia cenocepacia AU 1054; identical to SEQ ID NO: 14076

SEQ ID NO: 16485 - DNA, 1356 bp, Burkholderia pseudomallei 1655; identical to SEQ ID NO: 14077
  CDS (1)..(1356)

SEQ ID NO: 16486 - protein, 451 aa, Burkholderia pseudomallei 1655; identical to SEQ ID NO: 14078

SEQ ID NO: 16487 - DNA, 1173 bp, Chromohalobacter salexigens DSM 3043; identical to SEQ ID NO: 14079
  CDS (1)..(1173): transl_table=11

SEQ ID NO: 16488 - protein, 390 aa, Chromohalobacter salexigens DSM 3043; identical to SEQ ID NO: 14080

SEQ ID NO: 16489 - DNA, 1356 bp, Burkholderia pseudomallei 668; identical to SEQ ID NO: 14081
  CDS (1)..(1356)

SEQ ID NO: 16490 - protein, 451 aa, Burkholderia pseudomallei 668; identical to SEQ ID NO: 14082

SEQ ID NO: 16491 - DNA, 1269 bp, Polaromonas sp. JS666; identical to SEQ ID NO: 14083
  CDS (1)..(1269): transl_table=11

SEQ ID NO: 16492 - protein, 422 aa, Polaromonas sp. JS666; identical to SEQ ID NO: 14084

SEQ ID NO: 16493 - DNA, 1341 bp, Crocosphaera watsonii WH 8501; identical to SEQ ID NO: 14085
  CDS (1)..(1341): transl_table=11

SEQ ID NO: 16494 - protein, 446 aa, Crocosphaera watsonii WH 8501; identical to SEQ ID NO: 14086

SEQ ID NO: 16495 - DNA, 1431 bp, Geobacter metallireducens GS-15; identical to SEQ ID NO: 14087
  CDS (1)..(1431): transl_table=11

SEQ ID NO: 16496 - protein, 476 aa, Geobacter metallireducens GS-15; identical to SEQ ID NO: 14088

SEQ ID NO: 16497 - DNA, 1206 bp, Methanosarcina barkeri str. fusaro; identical to SEQ ID NO: 14089
  CDS (1)..(1206): transl_table=11

SEQ ID NO: 16498 - protein, 401 aa, Methanosarcina barkeri str. fusaro; identical to SEQ ID NO: 14090

SEQ ID NO: 16499 - DNA, 1206 bp, Desulfuromonas acetoxidans DSM 684; identical to SEQ ID NO: 14091
  CDS (1)..(1206): transl_table=11

SEQ ID NO: 16500 - protein, 401 aa, Desulfuromonas acetoxidans DSM 684; identical to SEQ ID NO: 14092

SEQ ID NO: 16501 - DNA, 1293 bp, Jannaschia sp. CCS1; identical to SEQ ID NO: 14093
  CDS (1)..(1293): transl_table=11

SEQ ID NO: 16502 - protein, 430 aa, Jannaschia sp. CCS1; identical to SEQ ID NO: 14094

SEQ ID NO: 16503 - DNA, 1458 bp, Desulfitobacterium hafniense DCB-2; identical to SEQ ID NO: 14095
  CDS (1)..(1458): transl_table=11

SEQ ID NO: 16504 - protein, 485 aa, Desulfitobacterium hafniense DCB-2; identical to SEQ ID NO: 14096

SEQ ID NO: 16505 - DNA, 1218 bp, Methanococcoides burtonii DSM 6242; identical to SEQ ID NO: 14097
  CDS (1)..(1218): transl_table=11

SEQ ID NO: 16506 - protein, 405 aa, Methanococcoides burtonii DSM 6242; identical to SEQ ID NO: 14098

SEQ ID NO: 16507 - DNA, 1575 bp, Frankia sp. EAN1pec; identical to SEQ ID NO: 14099
  CDS (1)..(1575): transl_table=11

SEQ ID NO: 16508 - protein, 524 aa, Frankia sp. EAN1pec; identical to SEQ ID NO: 14100

SEQ ID NO: 16509 - DNA, 1200 bp, Ralstonia metallidurans CH34; identical to SEQ ID NO: 14101
  CDS (1)..(1200): transl_table=11

SEQ ID NO: 16510 - protein, 399 aa, Ralstonia metallidurans CH34; identical to SEQ ID NO: 14102

SEQ ID NO: 16511 - DNA, 1341 bp, Magnetococcus sp. MC-1; identical to SEQ ID NO: 14103
  CDS (1)..(1341): transl_table=11

SEQ ID NO: 16512 - protein, 446 aa, Magnetococcus sp. MC-1; identical to SEQ ID NO: 14104

SEQ ID NO: 16513 - DNA, 1305 bp, Mesorhizobium sp. BNC1; identical to SEQ ID NO: 14105
  CDS (1)..(1305): transl_table=11

SEQ ID NO: 16514 - protein, 434 aa, Mesorhizobium sp. BNC1; identical to SEQ ID NO: 14106

SEQ ID NO: 16515 - DNA, 1290 bp, Silicibacter sp. TM1040; identical to SEQ ID NO: 14107
  CDS (1)..(1290): transl_table=11

SEQ ID NO: 16516 - protein, 429 aa, Silicibacter sp. TM1040; identical to SEQ ID NO: 14108

SEQ ID NO: 16517 - DNA, 1305 bp, Nitrobacter hamburgensis X14; identical to SEQ ID NO: 14109
  CDS (1)..(1305): transl_table=11

SEQ ID NO: 16518 - protein, 434 aa, Nitrobacter hamburgensis X14; identical to SEQ ID NO: 14110

SEQ ID NO: 16519 - DNA, 1308 bp, Paracoccus denitrificans PD1222; identical to SEQ ID NO: 14111
  CDS (1)..(1308): transl_table=11

SEQ ID NO: 16520 - protein, 435 aa, Paracoccus denitrificans PD1222; identical to SEQ ID NO: 14112

SEQ ID NO: 16521 - DNA, 1230 bp, Pseudomonas fluorescens; identical to SEQ ID NO: 14113
  CDS (1)..(1230): transl_table=11

SEQ ID NO: 16522 - protein, 409 aa, Pseudomonas fluorescens; identical to SEQ ID NO: 14114

SEQ ID NO: 16523 - DNA, 1215 bp, Pseudomonas fluorescens; identical to SEQ ID NO: 14115
  CDS (1)..(1215): transl_table=11

SEQ ID NO: 16524 - protein, 404 aa, Pseudomonas fluorescens; identical to SEQ ID NO: 14116

SEQ ID NO: 16525 - DNA, 1443 bp, Staphylococcus haemolyticus; identical to SEQ ID NO: 14117
  CDS (1)..(1443): transl_table=11

SEQ ID NO: 16526 - protein, 480 aa, Staphylococcus haemolyticus; identical to SEQ ID NO: 14118

SEQ ID NO: 16527 - DNA, 1245 bp, Leishmania major; identical to SEQ ID NO: 14119
  CDS (1)..(1245)

SEQ ID NO: 16528 - protein, 414 aa, Leishmania major; identical to SEQ ID NO: 14120

SEQ ID NO: 16529 - DNA, 1380 bp, Gibberella moniliformis; identical to SEQ ID NO: 14121
  CDS (1)..(1380)

SEQ ID NO: 16530 - protein, 459 aa, Gibberella moniliformis; identical to SEQ ID NO: 14122

SEQ ID NO: 16531 - DNA, 1233 bp, Schizosaccharomyces pombe; identical to SEQ ID NO: 14123
  CDS (1)..(1233)

SEQ ID NO: 16532 - protein, 410 aa, Schizosaccharomyces pombe; identical to SEQ ID NO: 14124

SEQ ID NO: 16533 - DNA, 1290 bp, Saccharomyces cerevisiae; identical to SEQ ID NO: 14125
  CDS (1)..(1290)

SEQ ID NO: 16534 - protein, 429 aa, Saccharomyces cerevisiae; identical to SEQ ID NO: 14126

SEQ ID NO: 16535 - DNA, 1200 bp, Pseudomonas aeruginosa; identical to SEQ ID NO: 14127
  CDS (1)..(1200): transl_table=11

SEQ ID NO: 16536 - protein, 399 aa, Pseudomonas aeruginosa; identical to SEQ ID NO: 14128

SEQ ID NO: 16537 - DNA, 1197 bp, Pseudomonas aeruginosa; identical to SEQ ID NO: 14129
  CDS (1)..(1197): transl_table=11

SEQ ID NO: 16538 - protein, 398 aa, Pseudomonas aeruginosa; identical to SEQ ID NO: 14130

SEQ ID NO: 16539 - DNA, 1224 bp, Acinetobacter sp; identical to SEQ ID NO: 14131
  CDS (1)..(1224): transl_table=11

SEQ ID NO: 16540 - protein, 407 aa, Acinetobacter sp; identical to SEQ ID NO: 14132

SEQ ID NO: 16541 - DNA, 1218 bp, Bordetella pertussis; identical to SEQ ID NO: 14133
  CDS (1)..(1218): transl_table=11

SEQ ID NO: 16542 - protein, 405 aa, Bordetella pertussis; identical to SEQ ID NO: 14134

SEQ ID NO: 16543 - DNA, 1305 bp, Brucella melitensis; identical to SEQ ID NO: 14135
  CDS (1)..(1305): transl_table=11

SEQ ID NO: 16544 - protein, 434 aa, Brucella melitensis; identical to SEQ ID NO: 14136

SEQ ID NO: 16545 - DNA, 1305 bp, Brucella suis; identical to SEQ ID NO: 14137
  CDS (1)..(1305)

SEQ ID NO: 16546 - protein, 434 aa, Brucella suis; identical to SEQ ID NO: 14138

SEQ ID NO: 16547 - DNA, 1200 bp, Buchnera aphidicola; identical to SEQ ID NO: 14139
  CDS (1)..(1200): transl_table=11

SEQ ID NO: 16548 - protein, 399 aa, Buchnera aphidicola; identical to SEQ ID NO: 14140

SEQ ID NO: 16549 - DNA, 1197 bp, Buchnera aphidicola; identical to SEQ ID NO: 14141
  CDS (1)..(1197): transl_table=11

SEQ ID NO: 16550 - protein, 398 aa, Buchnera aphidicola; identical to SEQ ID NO: 14142

SEQ ID NO: 16551 - DNA, 1200 bp, Burkholderia mallei; identical to SEQ ID NO: 14143
  CDS (1)..(1200): transl_table=11

SEQ ID NO: 16552 - protein, 399 aa, Burkholderia mallei; identical to SEQ ID NO: 14144

SEQ ID NO: 16553 - DNA, 1209 bp, Chromobacterium violaceum; identical to SEQ ID NO: 14145
  CDS (1)..(1209): transl_table=11

SEQ ID NO: 16554 - protein, 402 aa, Chromobacterium violaceum; identical to SEQ ID NO: 14146

SEQ ID NO: 16555 - DNA, 1206 bp, Erwinia carotovora; identical to SEQ ID NO: 14147
  CDS (1)..(1206): transl_table=11

SEQ ID NO: 16556 - protein, 401 aa, Erwinia carotovora; identical to SEQ ID NO: 14148

SEQ ID NO: 16557 - DNA, 1215 bp, Methanosarcina acetivorans; identical to SEQ ID NO: 14149
  CDS (1)..(1215): transl_table=11

SEQ ID NO: 16558 - protein, 404 aa, Methanosarcina acetivorans; identical to SEQ ID NO: 14150

SEQ ID NO: 16559 - DNA, 1209 bp, Neisseria gonorrhoeae; identical to SEQ ID NO: 14151
  CDS (1)..(1209)

SEQ ID NO: 16560 - protein, 402 aa, Neisseria gonorrhoeae; identical to SEQ ID NO: 14152

SEQ ID NO: 16561 - DNA, 1209 bp, Neisseria meningitidis; identical to SEQ ID NO: 14153
  CDS (1)..(1209)

SEQ ID NO: 16562 - protein, 402 aa, Neisseria meningitidis; identical to SEQ ID NO: 14154

SEQ ID NO: 16563 - DNA, 1209 bp, Neisseria meningitidis; identical to SEQ ID NO: 14155
  CDS (1)..(1209): transl_table=11

SEQ ID NO: 16564 - protein, 402 aa, Neisseria meningitidis; identical to SEQ ID NO: 14156

SEQ ID NO: 16565 - DNA, 1215 bp, Photorhabdus luminescens; identical to SEQ ID NO: 14157
  CDS (1)..(1215): transl_table=11

SEQ ID NO: 16566 - protein, 404 aa, Photorhabdus luminescens; identical to SEQ ID NO: 14158

SEQ ID NO: 16567 - DNA, 1218 bp, Photobacterium profundum; identical to SEQ ID NO: 14159
  CDS (1)..(1218): transl_table=11

SEQ ID NO: 16568 - protein, 405 aa, Photobacterium profundum; identical to SEQ ID NO: 14160

SEQ ID NO: 16569 - DNA, 1170 bp, Ralstonia solanacearum; identical to SEQ ID NO: 14161
  CDS (1)..(1170)

SEQ ID NO: 16570 - protein, 389 aa, Ralstonia solanacearum; identical to SEQ ID NO: 14162

SEQ ID NO: 16571 - DNA, 1305 bp, Rhizobium loti; identical to SEQ ID NO: 14163
  CDS (1)..(1305): transl_table=11

SEQ ID NO: 16572 - protein, 434 aa, Rhizobium loti; identical to SEQ ID NO: 14164

SEQ ID NO: 16573 - DNA, 1305 bp, Rhizobium meliloti; identical to SEQ ID NO: 14165
  CDS (1)..(1305): transl_table=11

SEQ ID NO: 16574 - protein, 434 aa, Rhizobium meliloti; identical to SEQ ID NO: 14166

SEQ ID NO: 16575 - DNA, 1203 bp, Salmonella choleraesuis; identical to SEQ ID NO: 14167
  CDS (1)..(1203)

SEQ ID NO: 16576 - protein, 400 aa, Salmonella choleraesuis; identical to SEQ ID NO: 14168

SEQ ID NO: 16577 - DNA, 1203 bp, Salmonella paratyphi; identical to SEQ ID NO: 14169
  CDS (1)..(1203): transl_table=11

SEQ ID NO: 16578 - protein, 400 aa, Salmonella paratyphi; identical to SEQ ID NO: 14170

SEQ ID NO: 16579 - DNA, 1308 bp, Vibrio cholerae; identical to SEQ ID NO: 14171
  CDS (1)..(1308): transl_table=11

SEQ ID NO: 16580 - protein, 435 aa, Vibrio cholerae; identical to SEQ ID NO: 14172

SEQ ID NO: 16581 - DNA, 1311 bp, Vibrio parahaemolyticus; identical to SEQ ID NO: 14173
  CDS (1)..(1311): transl_table=11

SEQ ID NO: 16582 - protein, 436 aa, Vibrio parahaemolyticus; identical to SEQ ID NO: 14174

SEQ ID NO: 16583 - DNA, 1314 bp, Vibrio vulnificus; identical to SEQ ID NO: 14175
  CDS (1)..(1314): transl_table=11

SEQ ID NO: 16584 - protein, 437 aa, Vibrio vulnificus; identical to SEQ ID NO: 14176

SEQ ID NO: 16585 - DNA, 1314 bp, Vibrio vulnificus; identical to SEQ ID NO: 14177
  CDS (1)..(1314): transl_table=11

SEQ ID NO: 16586 - protein, 437 aa, Vibrio vulnificus; identical to SEQ ID NO: 14178

SEQ ID NO: 16587 - DNA, 1179 bp, Xanthomonas axonopodis; identical to SEQ ID NO: 14179
  CDS (1)..(1179): transl_table=11

SEQ ID NO: 16588 - protein, 392 aa, Xanthomonas axonopodis; identical to SEQ ID NO: 14180

SEQ ID NO: 16589 - DNA, 1197 bp, Xanthomonas campestris; identical to SEQ ID NO: 14181
  CDS (1)..(1197): transl_table=11

SEQ ID NO: 16590 - protein, 398 aa, Xanthomonas campestris; identical to SEQ ID NO: 14182

SEQ ID NO: 16591 - DNA, 1185 bp, Xylella fastidiosa; identical to SEQ ID NO: 14183
  CDS (1)..(1185): transl_table=11

SEQ ID NO: 16592 - protein, 394 aa, Xylella fastidiosa; identical to SEQ ID NO: 14184

SEQ ID NO: 16593 - DNA, 1185 bp, Xylella fastidiosa; identical to SEQ ID NO: 14185
  CDS (1)..(1185): transl_table=11

SEQ ID NO: 16594 - protein, 394 aa, Xylella fastidiosa; identical to SEQ ID NO: 14186

SEQ ID NO: 16595 - DNA, 24 bp, Artificial sequence
  (1)..(24): primer
atgacacaattcgcttctcctgtt

SEQ ID NO: 16596 - DNA, 26 bp, Artificial sequence
  (1)..(26): primer
ttaactggcttttttaatatgcggaa

SEQ ID NO: 16597 - protein, 581 aa, Artificial sequence; identical to SEQ ID NO: 14189
  Variant (3)..(3): xaa in position 3 is any amino acid
  Variant (20)..(22): xaa in position 20 to 22 is any amino acid
  Variant (23)..(24): xaa in position 23 to 24 is any or no amino acid
  Variant (27)..(29): xaa in position 27 to 29 is any amino acid
  Variant (31)..(31): xaa in position 31 is any amino acid
  Variant (33)..(33): xaa in position 33 is any amino acid
  Variant (35)..(36): xaa in position 35 to 36 is any amino acid
  Variant (38)..(42): xaa in position 38 to 42 is any amino acid
  Variant (43)..(53): xaa in position 43 to 53 is any or no amino acid
  Variant (56)..(57): xaa in position 56 to 57 is any amino acid
  Variant (60)..(60): xaa in position 60 is any amino acid
  Variant (62)..(63): xaa in position 62 to 63 is any amino acid
  Variant (68)..(68): xaa in position 68 is any amino acid
  Variant (72)..(72): xaa in position 72 is any amino acid
  Variant (75)..(76): xaa in position 75 to 76 is any amino acid
  Variant (78)..(78): xaa in position 78 is any amino acid
  Variant (80)..(88): xaa in position 80 to 88 is any or no amino acid
  Variant (95)..(96): xaa in position 95 to 96 is any amino acid
  Variant (100)..(103): xaa in position 100 to 103 is any amino acid
  Variant (105)..(105): xaa in position 105 is any amino acid
  Variant (107)..(109): xaa in position 107 to 109 is any amino acid
  Variant (110)..(126): xaa in position 110 to 126 is any or no amino acid
  Variant (128)..(128): xaa in position 128 is any or no amino acid
  Variant (130)..(130): xaa in position 130 is any or no amino acid
  Variant (132)..(132): xaa in position 132 is any or no amino acid
  Variant (134)..(134): xaa in position 134 is any or no amino acid
  Variant (136)..(137): xaa in position 136 to 137 is any amino acid
  Variant (138)..(138): xaa in position 138 is any or no amino acid
  Variant (153)..(154): xaa in position 153 to 154 is any amino acid
  Variant (156)..(156): xaa in position 156 is any amino acid
  Variant (158)..(161): xaa in position 158 to 161 is any amino acid
  Variant (162)..(162): xaa in position 162 is any or no amino acid
  Variant (164)..(172): xaa in position 164 to 172 is any amino acid
  Variant (174)..(176): xaa in position 174 to 176 is any amino acid
  Variant (178)..(183): xaa in position 178 to 183 is any amino acid
  Variant (184)..(198): xaa in position 184 to 198 is any or no amino acid
  Variant (208)..(208): xaa in position 208 is any amino acid
  Variant (210)..(212): xaa in position 210 to 212 is any amino acid
  Variant (214)..(215): xaa in position 214 to 215 is any amino acid
  Variant (218)..(218): xaa in position 218 is any amino acid
  Variant (221)..(222): xaa in position 221 to 222 is any amino acid
  Variant (224)..(224): xaa in position 224 is any amino acid
  Variant (225)..(236): xaa in position 225 to 236 is any or no amino acid
  Variant (238)..(238): xaa in position 238 is any or no amino acid
  Variant (244)..(245): xaa in position 244 to 245 is any amino acid
  Variant (250)..(250): xaa in position 250 is any amino acid
  Variant (252)..(252): xaa in position 252 is any amino acid
  Variant (263)..(263): xaa in position 263 is any amino acid
  Variant (265)..(266): xaa in position 265 to 266 is any amino acid
  Variant (269)..(270): xaa in position 269 to 270 is any amino acid
  Variant (271)..(288): xaa in position 271 to 288 is any or no amino acid
  Variant (290)..(291): xaa in position 290 to 291 is any amino acid
  Variant (294)..(295): xaa in position 294 to 295 is any amino acid
  Variant (298)..(299): xaa in position 298 to 299 is any amino acid
  Variant (302)..(303): xaa in position 302 to 303 is any amino acid
  Variant (305)..(305): xaa in position 305 is any amino acid
  Variant (306)..(316): xaa in position 306 to 316 is any or no amino acid
  Variant (318)..(318): xaa in position 318 is any amino acid
  Variant (326)..(329): xaa in position 326 to 329 is any amino acid
  Variant (334)..(334): xaa in position 334 is any amino acid
  Variant (337)..(337): xaa in position 337 is any amino acid
  Variant (338)..(391): xaa in position 338 to 391 is any or no amino acid
  Variant (394)..(394): xaa in position 394 is any amino acid
  Variant (397)..(397): xaa in position 397 is any amino acid
  Variant (401)..(401): xaa in position 401 is any amino acid
  Variant (407)..(408): xaa in position 407 to 408 is any amino acid
  Variant (416)..(416): xaa in position 416 is any amino acid
  Variant (418)..(418): xaa in position 418 is any amino acid
  Variant (419)..(427): xaa in position 419 to 427 is any or no amino acid
  Variant (430)..(430): xaa in position 430 is any amino acid
  Variant (433)..(442): xaa in position 433 to 442 is any or no amino acid
  Variant (453)..(453): xaa in position 453 is any amino acid
  Variant (455)..(455): xaa in position 455 is any amino acid
  Variant (457)..(457): xaa in position 457 is any amino acid
  Variant (459)..(459): xaa in position 459 is any amino acid
  Variant (461)..(466): xaa in position 461 to 466 is any amino acid
  Variant (468)..(474): xaa in position 468 to 474 is any or no amino acid
  Variant (484)..(484): xaa in position 484 is any amino acid
  Variant (489)..(491): xaa in position 489 to 491 is any amino acid
  Variant (492)..(531): xaa in position 492 to 531 is any or no amino acid
  Variant (541)..(542): xaa in position 541 to 542 is any amino acid
  Variant (545)..(545): xaa in position 545 is any amino acid
  Variant (553)..(553): xaa in position 553 is any amino acid
  Variant (557)..(557): xaa in position 557 is any amino acid
  Variant (559)..(560): xaa in position 559 to 560 is any amino acid
  Variant (561)..(575): xaa in position 561 to 575 is any or no amino acid
  Variant (578)..(579): xaa in position 578 to 579 is any amino acid

SEQ ID NO: 16598 - protein, 10 aa, Artificial sequence
  Variant (2)..(2): xaa in position 2 is any amino acid
  Variant (3)..(3): xaa in position 3 is Asn or Thr
  Variant (5)..(5): xaa in position 5 is any amino acid
  Variant (7)..(7): xaa in position 7 is any amino acid
  Variant (8)..(8): xaa in position 8 is Phe, Ile, Leu or Val
  Variant (9)..(9): xaa in position 9 is any amino acid
LXXDXYXXXM

SEQ ID NO: 16599 - protein, 25 aa, Artificial sequence
  Variant (2)..(4): xaa in position 2 to 4 is any or no amino acid
  Variant (8)..(10): xaa in position 8 to 10 is any amino acid
  Variant (11)..(11): xaa in position 11 is Ala or Gly
  Variant (12)..(14): xaa in position 12 to 14 is any amino acid
  Variant (15)..(15): xaa in position 15 is Ala, Asp, Glu, Gly, Asn, Gln or Ser
  Variant (16)..(19): xaa in position 16 to 19 is any amino acid
  Variant (22)..(22): xaa in position 22 is any amino acid
  Variant (25)..(25): xaa in position 25 is Ala, Glu, Gln or Ser
GXXXTSNXXXXXXXXXXXXGTXAHX

SEQ ID NO: 16600 - DNA, 738 bp, Escherichia coli
  CDS (1)..(738)
atgacgttaactgcttcatcttcttcccgcgctgttacgaattctcctgtggttgttgcccttgattatcataatcgtgatgacgcgctggcctttgtcgacaagatcgacccacgcgattgtcgtctgaaggtcggcaaagagatgtttacattgtttgggccacagtttgtgcgcgaacttcaacagcgtggttttgatatctttcttgacctgaaattccacgatatccccaacactgcagcgcacgctgtcgctgctgcagctgacttaggcgtgtggatggtgaatgttcatgcctctggtggggcgcgtatgatgaccgcagcgcgtgaggcactggttccgtttggcaaagatgcaccgcttttgattgctgtgacagtgttgaccagcatggaagccagcgacctggtcgatcttggcatgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgaagctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatga

SEQ ID NO: 16601 - protein, 245 aa, Escherichia coli
MTLTASSSSRAVTNSPVVVALDYHNRDDALAFVDKIDPRDCRLKVGKEMFTLFGPQFVRELQQRGFDIFLDLKFHDIPNTAAHAVAAAADLGVWMVNVHASGGARMMTAAREALVPFGKDAPLLIAVTVLTSMEASDLVDLGMTLSPADYAERLAALTQKCGLDGVVCSAQEAVRFKQVFGQEFKLVTPGIRPQGSEAGDQRRIMTPEQALSAGVDYMVIGRPVTQSVDPAQTLKAINASLQRSA

SEQ ID NO: 16602 - DNA, 681 bp, Thermoplasma volcanium GSS1
  CDS (1)..(681): transl_table=11
ctggcatggatatccagttgcgtggataagagaattatagtagccttggatgttaaggaaaagaaaaaagctatagatattgcagaaagcctatcggacattgtatttgcttttaagataaactggcccttagtactatattcatctcctgaggttataggtgaaatttcgcaatatggtaaggttatatgtgactttaaagtggcagatatcccttatacgaactcgctaataacagagagagttcgggatcttggtgcatggggaataatatctcactcgtttcttggagaagaatcccttaaatccgtggtcaatgcagctaaaggcatgcatgtattttcagttgtggctatgtcgcatcctggctcagatatgataaactccaatgctatgcaactaatgaaactatccatagaatgtggggtttacggatttgttgcccctgcaaacaagattgatgacctaagaatgatcaggtctgcaacggacagagtaataatatcgccaggaataggagcacagggaggtgatccgtacacagctgttctgaatggatcggattatttaatagtgggccggagcgtttatgaaagcgataagccagagttagaggtttcaaagcttcagcaaactgccgagagagctattgaggacagggagagacttaaaaacagttaa

SEQ ID NO: 16603 - protein, 226 aa, Thermoplasma volcanium GSS1
MAWISSCVDKRIIVALDVKEKKKAIDIAESLSDIVFAFKINWPLVLYSSPEVIGEISQYGKVICDFKVADIPYTNSLITERVRDLGAWGIISHSFLGEESLKSVVNAAKGMHVFSVVAMSHPGSDMINSNAMQLMKLSIECGVYGFVAPANKIDDLRMIRSATDRVIISPGIGAQGGDPYTAVLNGSDYLIVGRSVYESDKPELEVSKLQQTAERAIEDRERLKNS

SEQ ID NO: 16604 - DNA, 726 bp, Pyrococcus horikoshii OT3
  CDS (1)..(726): transl_table=11
atgggccgaaaccccagcgaaagccctcaagagtgcaattcacgtggcctatatcctaaagaaagaggagataacgcccgaaatactggaggtggtcaagtgatagttttggccttagatgtttatgaaggagaaagggccattaaaatagctaaaagtgttaaggattacatttcgatgataaaggttaactggccactcattcttggaagtggagtggatataataagaagacttaaggaggagacaggagttgagataatagctgatcttaagcttgctgacataccgaatactaataggttgatagcaagaaaggtctttggggctggagcggactatgtaatagtgcataccttcgttggtagggatagcgtaatggcagtgaaggagcttggggaaataataatggtggttgaaatgagccatcctggagcactcgagttcattaatcctttaacagatagattcatagaagtcgcaaatgaaattgagccttttggggttatagctcctgggacaaggcctgagagaattggatacattagggatagattgaaggaagggataaagattctcgcccctgggataggggcccagggtggtaaagctaaggatgctgttaaagctggagcggattatataatagtgggaagggcaatatataacgctccaaatccaagagaagcagcaaaagcgatatacgatgaaataagaggtgtttag

SEQ ID NO: 16605 - protein, 241 aa, Pyrococcus horikoshii OT3
MGRNPSESPQECNSRGLYPKERGDNARNTGGGQVIVLALDVYEGERAIKIAKSVKDYISMIKVNWPLILGSGVDIIRRLKEETGVEIIADLKLADIPNTNRLIARKVFGAGADYVIVHTFVGRDSVMAVKELGEIIMVVEMSHPGALEFINPLTDRFIEVANEIEPFGVIAPGTRPERIGYIRDRLKEGIKILAPGIGAQGGKAKDAVKAGADYIIVGRAIYNAPNPREAAKAIYDEIRGV

SEQ ID NO: 16606 - DNA, 768 bp, Agrobacterium tumefaciens str. C58
  CDS (1)..(768): transl_table=11
ttgcagcggcctcccccacatgcgactggacggcaatggaaacatggcagggataagacaatgaccgcgcgcgaaaaactcatcgtcgggctggatgttccgactgtgcagcaggcagaagacatcgtgtcgaaaatcggcgacgaggtcctgttctacaagatcggttatcagctggtattcgccgggggtcttgaattcgcgcgtgacctcgtccagagcggcaagaaggtctttctcgacatgaagctgctcgatatcgacaacaccgtcgcctcgggcgtcgaaaacatcgcccgcatgggcatgtcgatgctgacgctgcatgcctatcccaaagccatgcgtgctgccgtcaaggcggcggaaggctccggcctctgcctgctgggcgtcaccgtgctgacctccatggatgacagcgatctggtcgaggccggttacgcgtccgacgcgcgttcgctggtgctgcgccgggctgaacaggcacgcgaggccggtatgggcggcattgtctgttcggcggaagaatcgaccgctgtgcgtgaaattctcggccccgaccttgccgtggtcacccccggcattcgccccgccggcgccgatcttggcgatcagaagcgggtgatgacgccctatgacgccatcaaggccggttcgagccatctggttgtcgcccgtcccatcgtcagggcggaagacccgaaagcggcggcccgcgccattctggacgatatgctgcgcgcgagttttccggccaatcagtaa

SEQ ID NO: 16607 - protein, 255 aa, Agrobacterium tumefaciens str. C58
MQRPPPHATGRQWKHGRDKTMTAREKLIVGLDVPTVQQAEDIVSKIGDEVLFYKIGYQLVFAGGLEFARDLVQSGKKVFLDMKLLDIDNTVASGVENIARMGMSMLTLHAYPKAMRAAVKAAEGSGLCLLGVTVLTSMDDSDLVEAGYASDARSLVLRRAEQAREAGMGGIVCSAEESTAVREILGPDLAVVTPGIRPAGADLGDQKRVMTPYDAIKAGSSHLVVARPIVRAEDPKAAARAILDDMLRASFPANQ

SEQ ID NO: 16608 - DNA, 648 bp, Thermoplasma acidophilum DSM 1728
  CDS (1)..(648): transl_table=11
gtgatgtcggaatcaaggcttgtggttgcactagacctcacggacaaggatagagccctggaaatagccagatccataggaagacaggtgttcgccataaagataaactggcccctggtcctggcaggatccggatcgataataggcgagatcgcaagggtgtcgcgggttgtctgtgacttcaagatagcagatataccgaacacgaacagcataatagcaaaatttgcgagggatcagggagcatggggcataatatcgcattcattcacaggccttgaatcactgagatcggtcgtcgaagcatctggcgatactaaggtcttctcggttgtggccatgtcgcatcccggttcggatctcattaacgacaattaccggaagctgatggatatatctgagagggcaggcgtctacggctatatagcgcctggcaataaattatccgacctgtctgaaatacggaagcgcacgaaaaagaccataatgtctccaggcataggatcgcagggaggaagggcatcggatgccataaaggccggcgcggatctggttatagtcggaagatccatatacgaaagtgcagatccggtgacagcagcagaagccataaacgaggaaatagcaaaggccgttgaacaaaactag

SEQ ID NO: 16609 - protein, 215 aa, Thermoplasma acidophilum DSM 1728
MMSESRLVVALDLTDKDRALEIARSIGRQVFAIKINWPLVLAGSGSIIGEIARVSRVVCDFKIADIPNTNSIIAKFARDQGAWGIISHSFTGLESLRSVVEASGDTKVFSVVAMSHPGSDLINDNYRKLMDISERAGVYGYIAPGNKLSDLSEIRKRTKKTIMSPGIGSQGGRASDAIKAGADLVIVGRSIYESADPVTAAEAINEEIAKAVEQN

SEQ ID NO: 16610 - DNA, 1482 bp, Drosophila melanogaster
  CDS (1)..(1482)
atggttgcccagaactccgacaaaatgcgggccctggccctgaagctcttcgagatcaatgccttcaagttcggcgacttcaagatgaaagtgggcataaattcgccggtctacttcgacctccgagtgatcgtcagttatccggatgtgatgcaaaccgtatccgacctgctggtggaacacatcaaggacaagcagctgagcgccaaacacgtgtgcggtgttccctacacggcgctcccgctggccaccattgtgtccgtgcagcagggaactcccatgctggtgcggcgcaaggaggccaaggcgtacggcaccaagaagctggtcgagggcatcttcaatgctggcgacacctgtctgattgtcgaggacgtggtcacctccggctccagcatcctggacacggtgcgggatctgcaaggcgagggcattgtggtcaccgacgccgtggtcgtcgtagaccgtgagcagggcggagtggccaacatcgccaagcacggcgtgcggatgcactcgctcttcacgctctcctttctgctgaacacacttcacgaggccgggcgcatcgagaagtccacagtggaggcggtggccaagtacatcgccgccgtgcaaatcaacagcgatggtaccttcgtcggcggcgataagggcgacgttgtcagagccaacgacttgcagcgcactaaactgacctacgagaatcgcgccaatctggctaagagcgcggtggccaagcgcctcttcaacctgatagccagcaaacagacgaacctctgcttggccgccgacctgacacacgccgatgagatcctggacgtggccgacaagtgcggtccgtacatttgcctgctgaagacgcacgtagacattgtggaggatttcagtgataaattcatcgctgacctgcaagctctggcccagcggcacaatttcctgctgatggaggatcgcaagtttgcagacatcggcaacacggtgtccctgcagtacggcaagggcatctataagatttccagttgggcagatctggtcacggcccacaccttacctggacgtagtattctgcagggtctgaaggcgggccttggcgaaggaggagccggcaaggaacgcggcgtcttcctgctggcggagatgtctgccagcggcaacctgatcgacgccaagtacaaggagaacagcaacaagatcgcaaccgagggagccgatgtagatttcgttgccggtgtggtatgccaatcctccgatgcctttgccttccccggacttctgcaactgacgcccggtgtgaagatagacgagggcgtggaccaattgggccagcagtaccagagtccggagcatgtggtcaaggagcggggtgccgacatcggagtggtgggcaggggcattctgaaggccagcagcccgaagcaggcggctcagacgtaccgcgaccgcctgtgggcagcctaccaggatcgagttgccaagtag

SEQ ID NO: 16611 - protein, 493 aa, Drosophila melanogaster [sequence omitted]

SEQ ID NO: 16612 - DNA, 780 bp, Brucella melitensis 16M
  CDS (1)..(780): transl_table=11
gtgagggtcttccgtgcccggctctcttgtgcgaagagagtaaaaatcacagcggagatttccatgacgacagaattgcacgatgacgcatccgggcgcctgatcgtgggccttgacgtgccgacaattgccgaggcggaaaaggtggtcgaagaactgggcaatgctgtttccttctacaagatcggctatcagcttgtttttgccggtgggcttgatttcgccaaaagccttgtggcggcgcgcaaaaaagtcttcctcgacatgaagctgctcgatatcgacaacacgattgccaaaggcgtggaaaatgtcgcgaagatgggtgtttccatgctcacgcttcatgcctatccgaaggcaatgcgtgcggcggtggaagccgccagagggtcggacctatgccttttgggcgtgacggtcctgacctccatggacaatgccgatcttcgggaagccggttatttcgacaatgcggaaacgctggtgctgaaacgtgcccgtcaggcgcatgaggccggtatgggcggcattgtcgcctcggcggtggaggcgcaggccattcgccaggcggttggccccgatatggccatcgtcacaccgggcatccgcccggcagggagcgagaagggcgaccagaagcgcgtgatgacgccagccgatgccttgagggccggtgcgagccatctcatcgtggcgcgcccgatcgtgggcgcaccggatcgcaaggcggcagcccttgccatcctgaaggaaatgcgctcgattggaagaagttag

SEQ ID NO: 16613 - protein, 259 aa, Brucella melitensis 16M
MRVFRARLSCAKRVKITAEISMTTELHDDASGRLIVGLDVPTIAEAEKVVEELGNAVSFYKIGYQLVFAGGLDFAKSLVAARKKVFLDMKLLDIDNTIAKGVENVAKMGVSMLTLHAYPKAMRAAVEAARGSDLCLLGVTVLTSMDNADLREAGYFDNAETLVLKRARQAHEAGMGGIVASAVEAQAIRQAVGPDMAIVTPGIRPAGSEKGDQKRVMTPADALRAGASHLIVARPIVGAPDRKAAALAILKEMRSIGRS

SEQ ID NO: 16614 - DNA, 657 bp, Methanopyrus kandleri AV19
  CDS (1)..(657): transl_table=11
gtgctcgaacccgatacgcgcctgatcgttgcgctggacgtgtcaccggatcgcgcggtggagatcgcggaaacacttgacggatacgtcgacgggttcaaagtagggtacgaagtggtgctggccgaaggggcggcggggatagagcgggtcgccgaagtgctagaagaatcgttcctgctcgtggatttgaaaacggcggacattccggagatatcgcggtcgatcgtcgagcgtgtgagcgaggccggcgccaacgccgccatagttcacgggttcgtaggtccggacgtcgtcgaggaatgcgctgaggtgctaccggtgttcgtggtagctacgatgagtcacccgggggcgcgggagttctacgatcgagcttgccgggacatcgttaaagcatgcgacgacatcgacggtgttgtcgggtacgtggccccggcgacgagacccgagagagtccgggaggtccggaagatcaccgacaagctcatcgccagccccggtgtaggagctcagggagcggcgcccggtgacgcggtgcgagctggtgcggatttcgagatagtcggtcgggcgatcacggaagcgcacgaccccgtggaagcggcgaaggatttgactcgggcgatgaggacttccaggccggccgaacggtga

SEQ ID NO: 16615 - protein, 218 aa, Methanopyrus kandleri AV19
MLEPDTRLIVALDVSPDRAVEIAETLDGYVDGFKVGYEVVLAEGAAGIERVAEVLEESFLLVDLKTADIPEISRSIVERVSEAGANAAIVHGFVGPDVVEECAEVLPVFVVATMSHPGAREFYDRACRDIVKACDDIDGVVGYVAPATRPERVREVRKITDKLIASPGVGAQGAAPGDAVRAGADFEIVGRAITEAHDPVEAAKDLTRAMRTSRPAER

SEQ ID NO: 16616 - DNA, 732 bp, Methanosarcina acetivorans C2A
  CDS (1)..(732): transl_table=11
atgcaacaatcactctcccacttatcgtttccgctgtgcggacgcgcctttcaaagagatgatttgatggaaaggaatacctgtatgatccttgctctggacgtaaccgacagggaagaagcgctgaaaattgcagaagacgtctgggaattcgtggacgcaataaaggtaggctaccctctcatacttgccacagggctcgggattatcagggaacttgccgagttcgctccggtaatagccgatttcaaagttgccgatatccccaacaccaaccgccttatctgcgaccaggtctttgaagccggagccgatgcagtcatcgcacagggctttacaggcagggacagccttgatgcctgcattgaaatcgcttccgaatacagaaaggacgtcttcgttgtgagcgaaatgagccaccccggcggtgccgatttcatgcagccggttgcagaagcaattgcaaaaatggcgcttgaagcaggagctttcgggcttgtcgcccctgctacccgtcccaaaagagtgaagaaaatcaggagaatcatcggggacaaactcacaatcatctcccccggtgtgggtgcccagggcggaaaagcctcggacgttattgctgccggcgcagactgggtgatagtgggtaggagcatctacaaggcagaatccccaaaagaagctgccaggcagattgccgaggaaattcaggctgagctccggggagaatactga

SEQ ID NO: 16617 - protein, 243 aa, Methanosarcina acetivorans C2A
MQQSLSHLSFPLCGRAFQRDDLMERNTCMILALDVTDREEALKIAEDVWEFVDAIKVGYPLILATGLGIIRELAEFAPVIADFKVADIPNTNRLICDQVFEAGADAVIAQGFTGRDSLDACIEIASEYRKDVFVVSEMSHPGGADFMQPVAEAIAKMALEAGAFGLVAPATRPKRVKKIRRIIGDKLTIISPGVGAQGGKASDVIAAGADWVIVGRSIYKAESPKEAARQIAEEIQAELRGEY

SEQ ID NO: 16618 - DNA, 666 bp, Thermosynechococcus elongatus BP-1
  CDS (1)..(666): transl_table=11
gtggccttggatgtacccaatttggaggtggcgatcgccactatccatcggctgccccaagtgcaattttggaaagtggggctagaactcttttgcgccagtgggccgatgattcttgatgtcctcaaggatcaggggaagcgcatctttctcgatttgaagcttcatgatattcccaatacggtagcagccgcagcacgagcgatcgccccctatggcgtggactttgtcaccatccacactgccactggtttaaccggtctcaaaactgctcaggcagccctcggggaaagcgccactcaactcatcggtgtcacattgctcaccagtattggcgcagacaccctgcagcaggaactccaaattccccttgatccggctacctatgttgaatgcatggctaatcttgcccatcaagcaggactggcgggcattgtctgctcaccccaggaagccgcacgggtgaaacaacgctggggagagaatttcttgagaatttgtccggggattcgcccccttggcagcgcaacgggagatcaagcgcgatcgctgacgcctaatgctgcctttgctgctggtgcctcttaccttgtcattggccgcccgattttacaagcagcggatcccgccgccgcctttgatgacctttgctctagccttgtttaa

SEQ ID NO: 16619 - protein, 221 aa, Thermosynechococcus elongatus BP-1
MALDVPNLEVAIATIHRLPQVQFWKVGLELFCASGPMILDVLKDQGKRIFLDLKLHDIPNTVAAAARAIAPYGVDFVTIHTATGLTGLKTAQAALGESATQLIGVTLLTSIGADTLQQELQIPLDPATYVECMANLAHQAGLAGIVCSPQEAARVKQRWGENFLRICPGIRPLGSATGDQARSLTPNAAFAAGASYLVIGRPILQAADPAAAFDDLCSSLV

SEQ ID NO: 16620 - DNA, 888 bp, Escherichia coli CFT073
  CDS (1)..(888): transl_table=11
ttgatgttctattgtgcttcggcaccgacggcgcggaaaagcctgccagaggagaaatcgcaactgttaatttttatttccacgggtagaatgctcgccgtttacctgtttcgcgccacttccggtgcccatcatcaagaaggtctggtcatgacgttaactgcttcatcttcttcccgcgctgttacgaattctcctgtagttgttgcccttgattatcataatcgcgatgccgcgatggcctttgtcgacaagatcgacccacgcgattgtcgtctgaaggtcggcaaagagatgtttacattgtttgggccacagtttgtgagcgaacttcaacagcgtggttttgatatctttcttgacctgaaattccacgatattcccaacactgcagcacacgctgtcgctgctgcggctgacttaggcgtgtggatggtgaatgttcatgcctccggtggggcgcgtatgatggccgcagcgcgtgaggcactggttccgtttggcaaagatgcaccgcttttgattgctgtgacagtgttgaccagcatggaagccagcgacctggccgatcttggcgtgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgatgctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatga

SEQ ID NO: 16621 - protein, 295 aa, Escherichia coli CFT073
MMFYCASAPTARKSLPEEKSQLLIFISTGRMLAVYLFRATSGAHHQEGLVMTLTASSSSRAVTNSPVVVALDYHNRDAAMAFVDKIDPRDCRLKVGKEMFTLFGPQFVSELQQRGFDIFLDLKFHDIPNTAAHAVAAAADLGVWMVNVHASGGARMMAAAREALVPFGKDAPLLIAVTVLTSMEASDLADLGVTLSPADYAERLAALTQKCGLDGVVCSAQEAVRFKQVFGQEFKLVTPGIRPQGSDAGDQRRIMTPEQALSAGVDYMVIGRPVTQSVDPAQTLKAINASLQRSA

SEQ ID NO: 16622 - DNA, 639 bp, Pseudomonas syringae pv. tomato str. DC3000
  CDS (1)..(639): transl_table=11
atgcgcctggctgatcagctcgaccccaagctgtgccgggtcaaggttggcaaggagctgttcaccagctgtgcgtcggacatcgtcgaggcccttcgcggcaagggcttcgatgtttttctggatctcaaatttcatgacattcccaacaccacggcgatggcggtcaaggccgctgccgagatgggcgtgtggatggtcaacgtgcattgctcgggcgggctgcgcatgatggcagcgtgccgggaagtgctggagcagcgcaccggtcctcagcctttgctgatcggcgtgaccgtactcaccagtatggagcgtgaagaccttgccggtatcggcctggatattgatccgcaagtacaggtgctgcgcctggcagcgctggctgaaaaagccggtatggatggcctggtctgttcggcgctggaagcccaggcccttaaagccgctcacccgtcactgcagctggtcaccccaggcattcgcccggcgggcagcgcacaggacgatcaacgtcgcattctgaccccgcgccaggcactggacgcgggttccgactacctcgtgatcggccggccgatcagccaggcagcggacccggccaaggcactggccgcagtggttgccgaactggcctga

SEQ ID NO: 16623 - protein, 212 aa, Pseudomonas syringae pv. tomato str. DC3000
MRLADQLDPKLCRVKVGKELFTSCASDIVEALRGKGFDVFLDLKFHDIPNTTAMAVKAAAEMGVWMVNVHCSGGLRMMAACREVLEQRTGPQPLLIGVTVLTSMEREDLAGIGLDIDPQVQVLRLAALAEKAGMDGLVCSALEAQALKAAHPSLQLVTPGIRPAGSAQDDQRRILTPRQALDAGSDYLVIGRPISQAADPAKALAAVVAELA

SEQ ID NO: 16624 - DNA, 702 bp, Helicobacter hepaticus ATCC 51449
  CDS (1)..(702): transl_table=11
atgaaattgtgtattgctcttgataatccacatttgcaagataatcttatgttgcttcaagcattagattctctttctcaatgtcaaaaacacgatatatggcttaaagttggtttaagaagctttgtgcgtgatggcataaaaggtatagaaaagcttaaaaaatacggcgattatagaatcttccttgatttaaaactttatgatattccaaatacaatgcttgagacgattatagagatgcaaaaaattggcattgatatgcttaccattcatacaagctgtggatttgaagcaatgaggactattgcaaagcttaaagaaaatcaaagtaatatgcccttaatcgtaggtgtaagtgcgctcacaagctttgataatgagagttttatggagatttacaatgcttcacttttttcccacacactcaaacttgcttctttagcatttcaggcagggattgatggggtagtgtgttcagtgcaggagagtttagcaataaaaaaggcaacttgtagcacatttttaactattacacctggcattcgtccttttggcgagagtgcgaatgaccaaaagcgagtggcaaacttgcaagaagcgagagaagcaatgagtgattttgtcgttattgggcgtccaatttataaagacgaaaatccacttagcgtagtggagagaatcttggcttttcaaagataa

SEQ ID NO: 16625 - protein, 233 aa, Helicobacter hepaticus ATCC 51449
MKLCIALDNPHLQDNLMLLQALDSLSQCQKHDIWLKVGLRSFVRDGIKGIEKLKKYGDYRIFLDLKLYDIPNTMLETIIEMQKIGIDMLTIHTSCGFEAMRTIAKLKENQSNMPLIVGVSALTSFDNESFMEIYNASLFSHTLKLASLAFQAGIDGVVCSVQESLAIKKATCSTFLTITPGIRPFGESANDQKRVANLQEAREAMSDFVVIGRPIYKDENPLSVVERILAFQR

SEQ ID NO: 16626 - DNA, 714 bp, Rhodopseudomonas palustris CGA009
  CDS (1)..(714): transl_table=11
atggcgccagtcgacatccctgaccgcgaccggctgatcgtcgcgctcgatttgcctgatctccgtgtcgccgaagcgatggtcgaccggctcggcgacagcgtcggtttctacaagatcggctatcagctcgcttatgcgggcggcctgccgctcgcccgtgctctggtcggcgccggcaagaaggtgttcgtcgatcttaagctgcacgacatcggcaacaccgtcgcgcgcggcgtcgaaagcctgagccatctcggcgcatccttcctcaccgtccatgcctacccgcagaccatgaaggccgcggtcgaggcccgtggctcctcgaaggtgaagatcctcgctgtcaccgtgctgacctcttatgacgaccgcgatctggcggacgccggctatcggttcggcgtgcgcgacctggtcgaagcgcgcgcccgccaggcgcaggcgatcggtgtcgacggcctggtctgttcgccagaggaagccgcgcatctgcgcagcattgtcggacccgaaatggatctagtgacgccgggcatccgtcccgccggtgcggccgcgggcgatcaaaagcggatcatgacgcccgctaaggcgatcgcggccggtgccagctatctggtggtcggtcggcccgtgctggacgcgccagatcccaaggccgctgcggatgcgatcgttgccgagatcgctgccgcacgcggatcataa

SEQ ID NO: 16627 - protein, 237 aa, Rhodopseudomonas palustris CGA009
MAPVDIPDRDRLIVALDLPDLRVAEAMVDRLGDSVGFYKIGYQLAYAGGLPLARALVGAGKKVFVDLKLHDIGNTVARGVESLSHLGASFLTVHAYPQTMKAAVEARGSSKVKILAVTVLTSYDDRDLADAGYRFGVRDLVEARARQAQAIGVDGLVCSPEEAAHLRSIVGPEMDLVTPGIRPAGAAAGDQKRIMTPAKAIAAGASYLVVGRPVLDAPDPKAAADAIVAEIAAARGS

SEQ ID NO: 16628 - DNA, 720 bp, Geobacter sulfurreducens PCA
  CDS (1)..(720): transl_table=11
atgacaagagatcaagcgcgggagaaggttatcttcgccctcgattccagtgaattcgcccatgtccagtactgggccgaaaccctgtccgaccgggtgggcatgttcaaggtcggcaagcagttgttcaccgcctgcgggccggccacggtccggatgatccagaaattcggcggagaggttttcctggacctcaagttccacgatattcccaacaccgttgccatggcctcccttgaggcagcccggctgggagtaaaactcttcaacctccatgccctgggagggtacgagatgatggcccgcacggtggaggcgctggacaaggagttcaaggggggggagagagcgaaggtgctggccgttaccatccttacctcctcaaccgaagagaccctgcgccaggtggggatcgaatcgccggtggaggagatggtcgtgcggctcgccaccctggccaggaaggccggcatcgacggcgtggtcgcttcaccgcgggagatcccccttatccgcgaggcatgcggtcccgatttcctcatcgtcacgccgggggtacgcccggccttcgccgctctcaacgaccagaagcgggtcatgactcctgctgaagcggtcagggcagggggggattacctcgttatcggccgcccgatcggcgacgcccctgacccggccggcgcagccgaaatgattctcgacgagatcatggccggctga

SEQ ID NO: 16629 - protein, 239 aa, Geobacter sulfurreducens PCA
MTRDQAREKVIFALDSSEFAHVQYWAETLSDRVGMFKVGKQLFTACGPATVRMIQKFGGEVFLDLKFHDIPNTVAMASLEAARLGVKLFNLHALGGYEMMARTVEALDKEFKGGERAKVLAVTILTSSTEETLRQVGIESPVEEMVVRLATLARKAGIDGVVASPREIPLIREACGPDFLIVTPGVRPAFAALNDQKRVMTPAEAVRAGGDYLVIGRPIGDAPDPAGAAEMILDEIMAG

SEQ ID NO: 16630 - DNA, 708 bp, Lactobacillus johnsonii NCC 533
  CDS (1)..(708): transl_table=11
atgagtagacctgttatcgttgccttagatttagacaatgaaaagaaattaaatgaactattaccgaaactaggtaaacctgaaaatgtttttattaagatcgggatggaactcttctttaacgaaggccctaaaatcgtaaaacaattatcagaacagggttatcaaatctttttagacttaaaaatgaacgatattcctaatacagtctataacggtgcaaaggcattagctcgtttgggtattacctacaccacggttcacgcacttggtggcagtcaaatgattaaggccgcaaaagatgggttaattgcgggaactccgattgataaaaatgttcctaaattactagctgtaactgaattaacttctatttcagacgaaattctacattatgagcaaaattgcaatttatcgatgaatgatcaagtattaagcttagctacaacagctaaaaaagcaggtgcagacggtgtgatttgttctccactcgaagttaaagacttacgtcaaaaagttggagaagactttttgtacgtaactcctggaattagaccagctggtaatgctaaagatgatcaatcacgcgtagccaccccacttcaagcaaaagaatggggttcaacagcgattgttgttggtcggccaattactttagccactgatccagaagccgcatatgaagcaattaaaaaggagttcaactaa

SEQ ID NO: 16631 - protein, 235 aa, Lactobacillus johnsonii NCC 533
MSRPVIVALDLDNEKKLNELLPKLGKPENVFIKIGMELFFNEGPKIVKQLSEQGYQIFLDLKMNDIPNTVYNGAKALARLGITYTTVHALGGSQMIKAAKDGLIAGTPIDKNVPKLLAVTELTSISDEILHYEQNCNLSMNDQVLSLATTAKKAGADGVICSPLEVKDLRQKVGEDFLYVTPGIRPAGNAKDDQSRVATPLQAKEWGSTAIVVGRPITLATDPEAAYEAIKKEFN

SEQ ID NO: 16632 - DNA, 675 bp, Wolbachia endosymbiont of Drosophila melanogaster
  CDS (1)..(675): transl_table=11
atgaacccaataatatgcgcactggatacacaagacttaaataaggctatttctctagctaatgctctgcgtggtaaagttggcatggtaaagctgggattagaattttttgctgctcaaggtctttctggagtgcaagaagttgcaaaatgcaatgtaccaatttttttagatctgaaattgcatgacattccaaacactgtagctaaaacagttgaagtaataaaagttctgaacgttgaaatgttaactctgcacatcagcggtgggacaaaaatgcttgaagaagcgctaagtgtagtgcaaggcacaaaaataaagctgattggagtgacagtgctaactagtatgagcaatgaggatttaaacgagcttggagtagcaagagaagtaaaatcacaggtaattttgcttgcaaagcttgcaaaaaagattggactctatggaatagtctgttctgcattggaagctcaggaagtgcgccgagaatgcggtgaagactttaaaattattactccaggaattcgtatagatccaggtcatgacgaccaaaaaagaacagcaacaccaaaagaagcaataaattcaggagctgattatatcgtcattggcagacccattacaaaaactacaagtagtgcggagctaatattgaaatccatgaaagaattttaa

SEQ ID NO: 16633 - protein, 224 aa, Wolbachia endosymbiont of Drosophila melanogaster
MNPIICALDTQDLNKAISLANALRGKVGMVKLGLEFFAAQGLSGVQEVAKCNVPIFLDLKLHDIPNTVAKTVEVIKVLNVEMLTLHISGGTKMLEEALSVVQGTKIKLIGVTVLTSMSNEDLNELGVAREVKSQVILLAKLAKKIGLYGIVCSALEAQEVRRECGEDFKIITPGIRIDPGHDDQKRTATPKEAINSGADYIVIGRPITKTTSSAELILKSMKEF

SEQ ID NO: 16634 - DNA, 720 bp, Bdellovibrio bacteriovorus HD100
  CDS (1)..(720): transl_table=11
atgaacaaaaatctgcgtgctcaccccatgaaaaatccgattattttggctctggatgtggatacccgcgatcaggccctgaaaattgccgacgatctttcagatatcgtcggggggatcaagctggggccgcgtctgtgcctgcgttacgggatggatttcgtcaaagaaatggcgcaacgagccccgatttttctggataacaagcacttcgacattccctccaccatggaggccgctgtgcgcgccagctttgaggcgggggcgtctttggtgacggtgcatgccctgagtggcaaagaggctctgacccgcatggcagcggtggaaaaagagctgaatcaacagcgtccgttccgcattctggcggtgacgattctgacgtcctgggatcaaaattcgctgccagtgaatatgaaatctcaaccgatcgcccagcacgtgacggagctggcttctttggtgaaggattcgggtttgtccggtgtcgtgtgttcccctcacgaattggaccttttacaaaaccgagatctttaccttgtcactccgggaattcgctttagtatgcaggattccggcgatcaaaaacgtatcatgggacccaaagaggcactgcgtgcaggtgcttccgcgctggtcgtgggtcgccctattctggaagcttccaacatcaaggaagcggccactgattttgtgatggcaatgtatgaagaaaaataa

SEQ ID NO: 16635 - protein, 239 aa, Bdellovibrio bacteriovorus HD100
MNKNLRAHPMKNPIILALDVDTRDQALKIADDLSDIVGGIKLGPRLCLRYGMDFVKEMAQRAPIFLDNKHFDIPSTMEAAVRASFEAGASLVTVHALSGKEALTRMAAVEKELNQQRPFRILAVTILTSWDQNSLPVNMKSQPIAQHVTELASLVKDSGLSGVVCSPHELDLLQNRDLYLVTPGIRFSMQDSGDQKRIMGPKEALRAGASALVVGRPILEASNIKEAATDFVMAMYEEK

SEQ ID NO: 16636 - DNA, 717 bp, Bacillus cereus ATCC 10987
  CDS (1)..(717): transl_table=11
atgtcacagtcgttaatcgttgcactagattttccagggaaacaagatgtagaacaattcttgcgccactttgaaggggaagagttatttgtcaaagttggtatggagttattttacaaagaaggccctgcaattattacgtacttaaaagaaaaaggacataagatttttctagatttaaaacttcatgatattccaaatacagtaaaaagcgctatgcgtagcctagctagtctagatgttgatatggtaaatgttcatgctgctgggggaagcagtatgatgaaagctgcgattgagggattagaggaaggtaagcaagaaggaaaagagagaccgatttgtattgcagttacacaactaacaagcacttcggaagctatgatgaaaaaagagatcggcattgagaaaacgttagaagaagcggttgctcattatgcaaaactaacgaaagaaagtggacttgatggcgttgtttgctcaacgcttgaagttccaaaactacgtgaagtatgcggaaatgaatttgtaacagtaacaccggggattcgtcttgcgagcgatgatgtaaatgaccaggtgcgcgtagcaacaccgaaacgtgcgagggaacttggctcaagctatatcgtagttggacgtagtattacaaaagcagaaaatccgcttgaagcgtataaaacagtaaaacaacagtgggaaggtgtaacagtatga

SEQ ID NO: 16637 - protein, 238 aa, Bacillus cereus ATCC 10987
MSQSLIVALDFPGKQDVEQFLRHFEGEELFVKVGMELFYKEGPAIITYLKEKGHKIFLDLKLHDIPNTVKSAMRSLASLDVDMVNVHAAGGSSMMKAAIEGLEEGKQEGKERPICIAVTQLTSTSEAMMKKEIGIEKTLEEAVAHYAKLTKESGLDGVVCSTLEVPKLREVCGNEFVTVTPGIRLASDDVNDQVRVATPKRARELGSSYIVVGRSITKAENPLEAYKTVKQQWEGVTV

SEQ ID NO: 16638 - DNA, 1407 bp, Apis mellifera
  CDS (1)..(1407)
atggatgctgaattaaaagagctagctatagcactttatgaaatagatgcatttaaatttggtgattttgtaactaaagttggtcttaaaactccaatatattttgatctaagagtattaatatcacatccaaaaataatggttcgcttggcaaaaatactatggacatttgcagaagaatgtccagatataactcaaatttgtggtgttccttatacagctttaccattagcaacattaatttctgcagactctaatgtgcccatgttaataaaacgaaaagaagcaaaagcatatggtacgaaaaagctcatagagggcaattttaagcaaggagatcattgtgtaattattgaagatgtggtcacaagtggtagcagtattttagaaacagcatttattctaagaaaagaaggtttaaaagtaacagacacatttgttgtaattgatagagaacaaaatggtaagaaaaatatagagcatcatggaattagaatgaggagtttatatacaactaccagacttatggcatatttgttagaagctaacaagattactccaaaaatagttaaaaatgtgactgattatttattaaaatttcaagcaccgatcatttctgttcaagataaacggttaaaaactccatttcatattcgtagcacaaagaccaaaaatgcaattgcttccaagttgtttaatttgatggaaacaaagcaatccactatatgtctagcagcagatttaactaaagcaaatgatattatagaaatagctgatttaataggaccacatattgtgttatttaaaacacatatagatatattagaagattttagctatgattttataaaacgtttaaaagatttagctaaaaaacatgagtttttattaatggaagatagaaaatttgccgatatcggaaatacggtatccttacaatatgagaaaggcatttataaaatatctgaatgggcagatattgttacagtgcacgcagttgcaggtccaaatatcatagatggcttgaaaaatagtttaaaaaatataaatgaacctcgtggtttgtttatattagcggaaatgtcttccaaaggagctttgacggttaatgaatatgcgcagagcgctgtatctatcgcacaaagttcagatatggtgactggaattgtttgtcaatcaaatattttctcaaatttgggacttattcaattgacaccaggcgtgaaactgtcgaaaacttctgataatttagggcaacaatacaatataccagaatctgttgtaaattctggagctgatttagctgtagttggtagaggtattactgaagctcaagataaattggctgcaactttacaatacaaaaaagaactttggacagcttatctgaaacgaatatcgaattag

SEQ ID NO: 16639 - protein, 468 aa, Apis mellifera
MDAELKELAIALYEIDAFKFGDFVTKVGLKTPIYFDLRVLISHPKIMVRLAKILWTFAEECPDITQICGVPYTALPLATLISADSNVPMLIKRKEAKAYGTKKLIEGNFKQGDHCVIIEDVVTSGSSILETAFILRKEGLKVTDTFVVIDREQNGKKNIEHHGIRMRSLYTTTRLMAYLLEANKITPKIVKNVTDYLLKFQAPIISVQDKRLKTPFHIRSTKTKNAIASKLFNLMETKQSTICLAADLTKANDIIEIADLIGPHIVLFKTHIDILEDFSYDFIKRLKDLAKKHEFLLMEDRKFADIGNTVSLQYEKGIYKISEWADIVTVHAVAGPNIIDGLKNSLKNINEPRGLFILAEMSSKGALTVNEYAQSAVSIAQSSDMVTGIVCQSNIFSNLGLIQLTPGVKLSKTSDNLGQQYNIPESVVNSGADLAVVGRGITEAQDKLAATLQYKKELWTAYLKRISN

SEQ ID NO: 16640 - DNA, 1434 bp, Oryza sativa (japonica cultivar-group)
  CDS (1)..(1434)
atggacgccgccgcgcaggaatccctcatcctggagctccacgccatcgaggccatcaagttcggcaccttcgtgctcaagtccggcatcacctccccgatctacctcgacctccgcgcgctcgtctcccacccgggcctcctctcctccatcgccaccctcctccacaccctcccggcgacccgcccctacgacctcctctgcggcgtcccctacaccgcgctccccatcgcctccgtcctctccgtccaccgctccgtccccatggtcatgcgccgcaaggaggccaaggcccacggcaccgccaagtccatcgagggcgccttccgcgccggggaggccgtgctcatcatcgaggacctcgtcaccagcggcgcctccgttctcgagaccgccgcgccgctccgcgaccaggggctcgtcgtcgccgacgccgtcgtcgtcgtcgaccgcgagcagggcgggagggagaaccttgccgccaatgggatcacgctgcactcgctcatgaccctcacggaggtgctcgccgtgctgctcaagcacgggaaggtgaccgaggagaaggcgagggaggtaaggcagtttcttgacgccaataggaaggtgaccgttcccggagcggcgggcgccgttaagcccaaagcggtcaggaaggggtttgctgagagggctggattggccaagaacccgatggggaagaggcttttcgaggtgatggaggcaaagcagagcaatttatgtgttgctgccgatgtgggaactgcaaaggagctccttgagcttgcagagaaggttggtccagagatttgcatgctgaaaactcatgtggatatcttgtctgactttactccagattttggagctaagctttgctcgattgccgagaagcacaactttttgatatttgaagaccgcaagtttgctgacattggaaacacagtgactatgcaatatgaaggaggaatatttcgcatattagactgggctgatatcgtcaatgcccatataattcctggacctggaattgtggatggtctgaagcttaagggtttgccaaaaggaagagggctgcttttgcttgctgaaatgagctcggctggcaaccttgctcatggagagtacactgctgcagctgtaaagattgctgagcaacattctgattttgtaattggatttatatccgttaatccagcatcttggtcagttgcgccatcaagtccagcatttatccatgccactcctggagtgcagatggtttctggaggagatgctcttggtcaacagtacaatacccctcattctgttataaacgacagaggcagtgacataattatagtcggacgagggattataaaggcgagtaatccagccgagaccgcgagggagtaccgcatccaagggtggggagcataccaatccagcttgccatga

SEQ ID NO: 16641 - protein, 477 aa, Oryza sativa (japonica cultivar-group)
MDAAAQESLILELHAIEAIKFGTFVLKSGITSPIYLDLRALVSHPGLLSSIATLLHTLPATRPYDLLCGVPYTALPIASVLSVHRSVPMVMRRKEAKAHGTAKSIEGAFRAGEAVLIIEDLVTSGASVLETAAPLRDQGLVVADAVVVVDREQGGRENLAANGITLHSLMTLTEVLAVLLKHGKVTEEKAREVRQFLDANRKVTVPGAAGAVKPKAVRKGFAERAGLAKNPMGKRLFEVMEAKQSNLCVAADVGTAKELLELAEKVGPEICMLKTHVDILSDFTPDFGAKLCSIAEKHNFLIFEDRKFADIGNTVTMQYEGGIFRILDWADIVNAHIIPGPGIVDGLKLKGLPKGRGLLLLAEMSSAGNLAHGEYTAAAVKIAEQHSDFVIGFISVNPASWSVAPSSPAFIHATPGVQMVSGGDALGQQYNTPHSVINDRGSDIIIVGRGIIKASNPAETAREYRIQGWGAYQSSLP

SEQ ID NO: 16642 - DNA, 1428 bp, Oryza sativa (japonica cultivar-group)
  CDS (1)..(1428)
atggacgccgccgcaatggaatccctcatcctggagctccacgccatcgaggccgtcaagttcggcgccttcgtgctcaagtccggcatcacctccccgatctacctcgacctccgcatgctcgtcgcccacccgcgcctcctctccaccgtcgcctccctcctcggctccctcccggcgacccgcccctacgacctcctctgcggcgtcccctacaccgcgctccccatcgcctccgtcctctccgccgccgcctccgtccccatgctcctccgccgctaccacgtcacgccgcacgccgccgccgaatgcctcgacgggtccttccgcgccggggacgccgtgctcatcgtcgaggacctcgtcaccacgggctcctccgtgctcgagaccgtcgcgccactccgcgaggtcgggctcgtcgtcgccgacgccgtcgtggtcatcgaccgcgagcagggcgggagggagaacctcgccgcgaacggggtcgcgctccactcgctcatgacgctcacggaggtgctcgccgtcctcgtgaagcgcgggaagctgggcgaggagaaggcccaggaggtgaagcgattcctcgacgcaaacaggaagatggctgtgccgggactgccggttaaaccgaaagtagttaggaaggcattttctgagagagctggattggcgacgaatccgatggggaggaagctgttcgagttgatggaggccaagcaaagcaacttgtgtgttgctgcagatgtcgggacagcaacagagctacttgatctcgccgataagattggtccagagatctgcatgttgaaaactcatgtggatatcttgtctgattttacaccggattttggccacaagctccgttcgattgctgagaggcacagctttttgatatttgaagaccgcaagtttgcagacattggaaacacagtaactatgcaatatgaaggaggaatattccgcatattagactgggctgatattgttaatgcacatatagtttctggacctggaattgtagaaggcttgaagctgaagggtctgccaaaaggaagagggttacttttgctttctgaaatgagttcagctggcaaccttgctcatggagattacactgctgcagccgtgaagattgctgagcaacattctgatattgtaattggatttatatcagtaaatcctgcatcttggtcagtgacgccgtcaagtccagcgttcatccatgctactcctggagttcagttggttgctgggggagactcgcttggtcaacagtacaacactccttactctgtcataaacgacagaggcagcgacataattatagtcggtcgtgggattataagggcgaacaatcctgctgagaccgcgagagagtaccgcatccaaggatggcatgcttaccaatccagcttatcatga

SEQ ID NO: 16643 - protein, 475 aa, Oryza sativa (japonica cultivar-group)
MDAAAMESLILELHAIEAVKFGAFVLKSGITSPIYLDLRMLVAHPRLLSTVASLLGSLPATRPYDLLCGVPYTALPIASVLSAAASVPMLLRRYHVTPHAAAECLDGSFRAGDAVLIVEDLVTTGSSVLETVAPLREVGLVVADAVVVIDREQGGRENLAANGVALHSLMTLTEVLAVLVKRGKLGEEKAQEVKRFLDANRKMAVPGLPVKPKVVRKAFSERAGLATNPMGRKLFELMEAKQSNLCVAADVGTATELLDLADKIGPEICMLKTHVDILSDFTPDFGHKLRSIAERHSFLIFEDRKFADIGNTVTMQYEGGIFRILDWADIVNAHIVSGPGIVEGLKLKGLPKGRGLLLLSEMSSAGNLAHGDYTAAAVKIAEQHSDIVIGFISVNPASWSVTPSSPAFIHATPGVQLVAGGDSLGQQYNTPYSVINDRGSDIIIVGRGIIRANNPAETAREYRIQGWHAYQSSLS

SEQ ID NO: 16644 - DNA, 1437 bp, Dictyostelium discoideum
  CDS (1)..(1437)
atgaatattaaagaattagtattaaaattaaatgaaattgatgcaattaaattaggagaatttaaattaaagagtggtattatttcaccaatttatattgatcttagagttacagtatcatcaccaccattgttagcagcaattgcagagatgatgtatcaaaaggtttataaatctggtaatgcacaagagacaccagcattagtatgtggtgtaccatatacagcattaccaattgcaacaggtatgtcaattgccaacaatattccaatggtagtacgtagaaaagaagccaaagcatatggtaccaaacaattgattgaaggtcgtttcaaagagggtgacaatgtattggttgttgaagatttagtaacaagtggtgcaagtgtacttgaaacagttagagatttaaattcagttggtttaaaagttacagacgtagtcgtgttattagatcgtcaacaaggtgccagacaagcacttgagaaacaaggctaccgtcttcactcagtctttacaatggaagagttaatcaacaccttaatcgaagctggtaaattaaccggccgtactttagagttggttcaatcattcttagacgccaatcgtaatgtagtagtaccattaccaccaacccttgccccaccagcaccagcaccaattgttattaataaaccatttgaagagagagctaaacttgcatcaaatccaatggcatctaaattattcacattaatgtcaagcaagaagaccaatcttgcagttgcagctgatttaactgataaacaacaacttttagatttagcagaatcaattggttcagaaatttgtgttttgaagacccatgttgatatcattgataattatgatgaagagtttattaaatcattgaaatgcatagcagcaaaacataatttcttgatttttgaagatagaaaattcgcagatattggaaacactgtgaaatatcaatttgagaatggtgtttataaaatctcaaaatgggcagacatggtcaccgtacatggtgtcgcaggttcatccattgtcgatggtttcaaatcaggtttgaaagagtatggttcaggtttattattattggctcaaatgtcatcaaaaggttctttgtgtgttggtgattatacaactcaaatgattgaaatggcaaataataacaaagaggaggttatgggtttaatttgtcaagaacgattaccatcaatgactgatggtttggttttaatgactccaggtgttcaattcaattcaactggtgatgctatgggtcaacaatataatactccagaatatatcattaaagaaaagaatactgatgttatcattgttggtagaggtatttatcaaagtaatgatccaaaatctgttgcaaataaatatagaactgctgcttgggaaacttatcaatcaaaattttaa

SEQ ID NO: 16645 - protein, 478 aa, Dictyostelium discoideum
MNIKELVLKLNEIDAIKLGEFKLKSGIISPIYIDLRVTVSSPPLLAAIAEMMYQKVYKSGNAQETPALVCGVPYTALPIATGMSIANNIPMVVRRKEAKAYGTKQLIEGRFKEGDNVLVVEDLVTSGASVLETVRDLNSVGLKVTDVVVLLDRQQGARQALEKQGYRLHSVFTMEELINTLIEAGKLTGRTLELVQSFLDANRNVVVPLPPTLAPPAPAPIVINKPFEERAKLASNPMASKLFTLMSSKKTNLAVAADLTDKQQLLDLAESIGSEICVLKTHVDIIDNYDEEFIKSLKCIAAKHNFLIFEDRKFADIGNTVKYQFENGVYKISKWADMVTVHGVAGSSIVDGFKSGLKEYGSGLLLLAQMSSKGSLCVGDYTTQMIEMANNNKEEVMGLICQERLPSMTDGLVLMTPGVQFNSTGDAMGQQYNTPEYIIKEKNTDVIIVGRGIYQSNDPKSVANKYRTAAWETYQSKF

SEQ ID NO: 16646 - DNA, 708 bp, Desulfovibrio vulgaris subsp. vulgaris str. Hildenborough
  CDS (1)..(708): transl_table=11
atggccgaactcgttgtcgcactggattttcccgccgcagacgtggcggtggacatggcaggcagactccgcggcaccgcgccgtggatgaaggtaggcctcgaactcttctgcgccgcaggtcccgatgtcgtgcgtgccgtggcagacctcggcttcagggtctttctcgacctcaagttccacgacatccccaacacggtgcgcggtgcggtgcgttcggcggtgcgttccggggcggacatggtcaacatccatctcatgggcggcgaacgtatggcccgtgccgccgtggaaggtctgcacgagggtgcccagacgacgggttccgtaccgttgctcttcggggtgaccgtgctcaccagcaccgcacagggtgaactgccgggcatttcgacggacataggcgagtacgccgcctctctcgcggcatccggtgctgcgtggggcttgaacggggtcgtctgttcggggtatgaagtggagagcatcaagaagcgttgcggcgcatcgttcctgtgcctcactccgggcatccgtcccggtggcggggcagggggtgacgaccagcgccgggtgatgacacccgcacaggcggtgtccgccggttctgactacctcgttgtgggcaggcccgtgactggggctgccgaccccgctgccgcagcgcgcgccatcatggcggagatggctgcggtcaggcgatag

SEQ ID NO: 16647 - protein, 235 aa, Desulfovibrio vulgaris subsp. vulgaris str. Hildenborough
MAELVVALDFPAADVAVDMAGRLRGTAPWMKVGLELFCAAGPDVVRAVADLGFRVFLDLKFHDIPNTVRGAVRSAVRSGADMVNIHLMGGERMARAAVEGLHEGAQTTGSVPLLFGVTVLTSTAQGELPGISTDIGEYAASLAASGAAWGLNGVVCSGYEVESIKKRCGASFLCLTPGIRPGGGAGGDDQRRVMTPAQAVSAGSDYLVVGRPVTGAADPAAAARAIMAEMAAVRR

SEQ ID NO: 16648 - DNA, 624 bp, Picrophilus torridus DSM 9790
  CDS (1)..(624): transl_table=11
atgaacaggattatatttgcgcttgatgtttatgattataatgaggctttaaatttatcaaaagaactttcaaatgatgtctttgcgataaaggtaaactggccgcttgttatgaacaatggcatatcaatagttaaagagatatcaaggtattcaaatgttatatgtgatttcaagatagcggatatagacaacacaaacaggcttataactgaaaaggccagggaaaacaatgcctggggtattataacacattcatttacaggcagaaggagtctaaaggctgttgtttctgcggccggtgacatgaaggtcttttcccttgtttcaatgtcccaggaatcattcatagataattacacggacgatcttattaaaatgtccatggaggaaaatgtttacggccttgttgctcctggaaacagaatagatattttaagacatataagatcaatgtcgggtgatcttaaaataatagcgcctggcataggcgcccagggtggaagcataaccgatgcaatcatggccggtgcagattatgtaataataggcagatcgatatacagtgatccggagccattaaaaaaggttaaaagtttaaatgaaattttaggtgatgattaa

SEQ ID NO: 16649 - protein, 207 aa, Picrophilus torridus DSM 9790
MNRIIFALDVYDYNEALNLSKELSNDVFAIKVNWPLVMNNGISIVKEISRYSNVICDFKIADIDNTNRLITEKARENNAWGIITHSFTGRRSLKAVVSAAGDMKVFSLVSMSQESFIDNYTDDLIKMSMEENVYGLVAPGNRIDILRHIRSMSGDLKIIAPGIGAQGGSITDAIMAGADYVIIGRSIYSDPEPLKKVKSLNEILGDD

SEQ ID NO: 16650 - DNA, 696 bp, Staphylococcus aureus subsp. aureus MRSA252
  CDS (1)..(696): transl_table=11
atgatgaaagatttaccaattattgcattagattttgaatcaaaagaaaaagtaaatcaatttttagatttatttgatgaatcattattcgtaaaagtaggtatggaacttttttatcaagaaggtcctcaattaattaatgagataaaagaaagaggccatgatgtatttttagatttaaaactgcatgatattcccaatacagttggtaaagcgatggaaggactagctaaattgaatgttgatctggtaaatgttcatgctgctggtggcgtaaaaatgatgtctgaggccattaaaggattaagaaaacataatcaacatacaaaaattattgcagtaacacagcttacgtcaacaacagaagacatgttacgacacgaacaaaatatacaaacatcgattgaagaggccgttttaaattatgccaagttagcaaatgcagctggtttagatggcgttgtttgttcacctcttgaaagtcgtatgttgactgaaaagttaggtacatcatttttaaaagtaacaccaggcattagacctaaaggtgcatctcaagatgaccaacaccgtattacgacaccggaagaagcaagacagcttggttcgacgcatattgtagtcggtagaccgattacacaaagtgacaatccagtcgaaagttatcataaaattaaagaaagttggttagtataa

SEQ ID NO: 16651 - protein, 231 aa, Staphylococcus aureus subsp. aureus MRSA252
MMKDLPIIALDFESKEKVNQFLDLFDESLFVKVGMELFYQEGPQLINEIKERGHDVFLDLKLHDIPNTVGKAMEGLAKLNVDLVNVHAAGGVKMMSEAIKGLRKHNQHTKIIAVTQLTSTTEDMLRHEQNIQTSIEEAVLNYAKLANAAGLDGVVCSPLESRMLTEKLGTSFLKVTPGIRPKGASQDDQHRITTPEEARQLGSTHIVVGRPITQSDNPVESYHKIKESWLV

SEQ ID NO: 16652 - DNA, 684 bp, Acinetobacter sp. ADP1
  CDS (1)..(684): transl_table=11
gtgagtattattgttgccttagacgcaaagagccaatatgacgctttgagcattgctgatcagctcgatccatcactttgtcgtgtaaaagtgggcaaagagctttttactcatgatggtccacaaacagtaagaatcttacaagatcgtggttttgagttgtttttagaccttaaatttcatgacattccaaacaccacagcacaggctgtatgtgctgcggcagacttaggtgtatggatggtcaatgttcatgcgtctggcggtcgtaaaatgatggaaacctgtgttgaacgacttaaagctggaaattaccgtactcaacttattgcggtaacggtattaacctctatggggcgtgaagatttacgtgacattggtttagatgttgaaccttttgagcaagttaaacgtctggcacagctaacgcaagaaagcggtctggatggtgtggtatgttctgctcaagaagcaaaaatgttacgtgatttactaggaacagaatttgctttggtcactccaggtattcgacctgagggtgcaaatgcagatgaccaaaaacgcattgtgacgccaaagcaggcaatgttggatggttcgactcatctagtcattggtcgtccaattacaaaatccgaacgaccaaatgaaatgttgaaacagattttatcgagtctggcttaa

SEQ ID NO: 16653 - protein, 227 aa, Acinetobacter sp. ADP1
MSIIVALDAKSQYDALSIADQLDPSLCRVKVGKELFTHDGPQTVRILQDRGFELFLDLKFHDIPNTTAQAVCAAADLGVWMVNVHASGGRKMMETCVERLKAGNYRTQLIAVTVLTSMGREDLRDIGLDVEPFEQVKRLAQLTQESGLDGVVCSAQEAKMLRDLLGTEFALVTPGIRPEGANADDQKRIVTPKQAMLDGSTHLVIGRPITKSERPNEMLKQILSSLA

SEQ ID NO: 16654 - DNA, 744 bp, Erwinia carotovora subsp. atroseptica SCRI1043
  CDS (1)..(744)
atgaaaaacgagaatctacagcaaaagaatcaaacggtatcatccccgattgttgtcgcgctggactatgccagtcaggatgcggcgctgtcgtttgttgaccgtatcgatccgcaggattgccgtttgaaggtaggcaaagagatgtttaccttatttggtccacagttcgtgcagacgttgcaacagcgcggctttgatgtgtttctcgatctgaaattccacgatattccgaacaccgtcgcgcatgctgtggcggcagccgccgatcttggcgtgtggatggtcaatgtccacgccagcggcggttcgcgtatgatggcagcggcgaaagacgcgctggtgccgtttggtaaagatgcaccgctgctgattgccgtgaccgtgttgaccagtatggacgaagaagatctacgcgggcttggcattaccgttagcccagcggagcaggcggaaaggctggctgtactaacgcataacagtgggttggatggcgtggtgtgctctgcacatgaagcgcagcggttgaagcaggtatgcggtcaggcatttaagctaatcacgccggggattcgccccgcaggtagtgacgttggcgatcagcgccgcatcatgacgcccattcaggcgcagcaggcgggtgtggattacatggtgattggacgtccgatcacccaatcgtcggatccggctcagacgctgtgtgatattcgcgcgtcgctgctaaacggtattgcatcatga

SEQ ID NO: 16655 - protein, 247 aa, Erwinia carotovora subsp. atroseptica SCRI1043
MKNENLQQKNQTVSSPIVVALDYASQDAALSFVDRIDPQDCRLKVGKEMFTLFGPQFVQTLQQRGFDVFLDLKFHDIPNTVAHAVAAAADLGVWMVNVHASGGSRMMAAAKDALVPFGKDAPLLIAVTVLTSMDEEDLRGLGITVSPAEQAERLAVLTHNSGLDGVVCSAHEAQRLKQVCGQAFKLITPGIRPAGSDVGDQRRIMTPIQAQQAGVDYMVIGRPITQSSDPAQTLCDIRASLLNGIAS

SEQ ID NO: 16656 - DNA, 711 bp, Propionibacterium acnes KPA171202
  CDS (1)..(711): transl_table=11
atggacatcacccgcccgattatcgctctcgatcttcctagcgccgaggcagctcttgacttcgtaggtcgattcgacggggagaatcttttcgtcaaagtcggcatggagttgttttacgcagcggggcctagtgtggtgaccagcctcaaggaggccgggcacgacgtcttctgtgacctcaagcttcacgacattcccaataccgtcaagggtgccgcttctagcctctccaggctgggcgcggacctactcaccgtccatgcagccggtggtaggagcatgatggaggcttcgcttgagggcctgggagatgccgccgagaccactcgtgtcatcgccattactcaactcacctccacctccccggaggcgttgaaaactgagcagctagtggatgtgccgcttgtcgagtcggtgcgcaactacgccaagctcgcccaggctgctggactggccggagtcgtctgttcggctcacgaggccgccgatatcgcctcggtaaccggtccaaacttcctgcgcgtcacgccgggaattcgtccggcagggtccgcagtaggggatcagtccagggtcgccactccgggcaacgccgcctcgatggggtcttcggcgatcgtggtcgggcggcccattaccaaagctgacgacccggtagccgcttatcacgctattcgcgatgactggaatgccgggcgtaaggcctga

SEQ ID NO: 16657 - protein, 236 aa, Propionibacterium acnes KPA171202
MDITRPIIALDLPSAEAALDFVGRFDGENLFVKVGMELFYAAGPSVVTSLKEAGHDVFCDLKLHDIPNTVKGAASSLSRLGADLLTVHAAGGRSMMEASLEGLGDAAETTRVIAITQLTSTSPEALKTEQLVDVPLVESVRNYAKLAQAAGLAGVVCSAHEAADIASVTGPNFLRVTPGIRPAGSAVGDQSRVATPGNAASMGSSAIVVGRPITKADDPVAAYHAIRDDWNAGRKA

SEQ ID NO: 16658 - DNA, 711 bp, Desulfotalea psychrophila LSv54
  CDS (1)..(711): transl_table=11
atgacaaatatcccgcttaatgaacgagtaattgtagcacttgaccttgactcacctgaagcagttaaagagatggtgaaaaagtgcgagcctgagacgaatttttttaagattggtttacaggtctttatgaatagccattttgataccgttgactggattcttgatcgaggtcataaggtaatgctcgatttgaaattttttgatattcctgaaacggtaaaactggccattgagcaggtaaatcaacggggcgtttccctggtaaccattcatggtaatgaccctattatcagggcagctgtatcggctgcccgtggcgatatgaagttgcttgccgtaactgttcttaccagctttggcgaagaggatatgcgagccatgggcatgactggaagcatagaggatctggtttatttcagggcgaaacgggcccttgaattgggttgtgatggcgttgtttcttcagggcttgaggcagcacgtatgcgtagagacttgggagagaaactcttgattgtgactcccggcattcgtcccggggcaaatatcagcgatggatcagatgatcaaacgcgcattgttaccgctggtactgccataaaaaatggtgccaaccatgttgtggttgggcgtcctattacaaaatctgctgatccggctgctgttattgccatgatgaaggctgatattgaagcatcttgcatgtag

SEQ ID NO: 16659 - protein, 236 aa, Desulfotalea psychrophila LSv54
MTNIPLNERVIVALDLDSPEAVKEMVKKCEPETNFFKIGLQVFMNSHFDTVDWILDRGHKVMLDLKFFDIPETVKLAIEQVNQRGVSLVTIHGNDPIIRAAVSAARGDMKLLAVTVLTSFGEEDMRAMGMTGSIEDLVYFRAKRALELGCDGVVSSGLEAARMRRDLGEKLLIVTPGIRPGANISDGSDDQTRIVTAGTAIKNGANHVVVGRPITKSADPAAVIAMMKADIEASCM

SEQ ID NO: 16660 - DNA, 738 bp, Yersinia pseudotuberculosis IP 32953
  CDS (1)..(738): transl_table=11
atgacgtccgcaactaaaactaataacagtggctcaatatcctccccaattgttgttgcgttggattatgccaataaagacgctgcgttagcctttgctgatcaggttagtccacaggattgccggttaaaagtgggcaaagagatgtttacgctgtacggccccgagcttatccgtgacttacatcagcgcggctttgacgtatttcttgatttgaaattccatgacatccctaatactaccgcgcgtgccgtggctgcggcagcagagttgggggtctggatggtcaatgttcatgccagtggcggtgcccgcatgatgtcggcggcgaaagaagccttattgccttatggtgcacaagcccccttactgattgccgttactgtactgaccagcatggatagcgaagatctgcgggatatcggtattactatcagtccggctgagcaggccgagcggttagcgaaactgacctgggattgcggtttggatggcgtggtgtgctcggctcatgaagcggtgcgtttgaagcaagtttgtggcgaagacttctcgctcgttaccccaggtattcgcccacaaggcagtgaagccggtgaccagcggcggatcatgacacctgaacaggcggtagctgtaggtgttgattacatggtaatcggtcgcccaattacacaatctcctgatccggaaaaaacgctgcgcgaaatattggcatcactgacgaaggtggcataa

SEQ ID NO: 16661 - protein, 245 aa, Yersinia pseudotuberculosis IP 32953
MTSATKTNNSGSISSPIVVALDYANKDAALAFADQVSPQDCRLKVGKEMFTLYGPELIRDLHQRGFDVFLDLKFHDIPNTTARAVAAAAELGVWMVNVHASGGARMMSAAKEALLPYGAQAPLLIAVTVLTSMDSEDLRDIGITISPAEQAERLAKLTWDCGLDGVVCSAHEAVRLKQVCGEDFSLVTPGIRPQGSEAGDQRRIMTPEQAVAVGVDYMVIGRPITQSPDPEKTLREILASLTKVA

SEQ ID NO: 16662 - DNA, 720 bp, Bacillus licheniformis ATCC 14580
  CDS (1)..(720): transl_table=11
atgaacaatacgccgcccatcatcgcgcttgattttgcatcagcacaggaaacatatgcgtttttggaccggtttcaaggagaagagctgttcgttaaggtgggcatggagcttttttatcaggaaggacctgccatccttgaaaatctgcaggagcgcggctgccgcattttcctcgatctaaagtgccacgacattccaacgaccgtatacaaggcgatgaaaaggctggcgggatttggcgtcagtcttgtcaatgtgcacgcagcaggcggaaagcaaatgatggagtcggcgcttgaaggccttgaagcggggactccggcaggccaaaaacgcccttcattaattgccgtgactcagctgacaagcacgtcctcagaaatgcttcagcgtgagctcctgattgaaacgccgcttctcgatacagttgtccactacagccggctggctgaagaaagcggtcttgacggcgtcgtctgctccgttcatgaagccgaacacatttaccgggctgtgtctgtagattttctgaccgtgacacccggaattcgcatggcagatgacaaaaacaacgaccaggtccgggtggcgacgcctggctacgcaagggaaaaaggcgtgtcggcgatcgttgtcggccgttcgattacccaggcggaagatcctgtgtcagcctacagaagaataggacatgagtgggagggaaccaaggcatga

SEQ ID NO: 16663 - protein, 239 aa, Bacillus licheniformis ATCC 14580
MNNTPPIIALDFASAQETYAFLDRFQGEELFVKVGMELFYQEGPAILENLQERGCRIFLDLKCHDIPTTVYKAMKRLAGFGVSLVNVHAAGGKQMMESALEGLEAGTPAGQKRPSLIAVTQLTSTSSEMLQRELLIETPLLDTVVHYSRLAEESGLDGVVCSVHEAEHIYRAVSVDFLTVTPGIRMADDKNNDQVRVATPGYAREKGVSAIVVGRSITQAEDPVSAYRRIGHEWEGTKA

SEQ ID NO: 16664 - DNA, 738 bp, Mannheimia succiniciproducens MBEL55E
  CDS (1)..(738): transl_table=11
ttgaaagccaaatttagcaaagaggaagttaatatgagtaataaaattatcgtagcattagattacgaaacggaaaaagaagcgctccaattagtggatcaaatcgatccgagtttatgccgcttaaaagtgggtaaagaaatgtttactaccttaggtacaaattttgtaaaactgctgcaagaccgtgactttgatgtgtttttggatttaaaattccacgatattccgaatacggttgcaagagcggtacgttcagccgccgatcttggagtatggatggtggatctacatgccagcggcggtttacgaatgatggaagaagcgaagaagattcttgagccttacggtaaagatgcgccgattctgattagcgttaccgttttaaccagtatggaagatttggatttgttacaaatcggtattaacgcttcaccgatggagcaagttatccgccttgctcatctaagtcaacgtgcgggtttagacggtgtggtttgttcgccgcaggaagtggaaattttacgtcaacatttaggtaaagagttcaaattaattacaccgggaattcgtcccgtgggttctgaattcggtgatcaacgccgagtcatgactcctccggcggcaattgaagccggttccgattatttagtgattgggcgcccgattacgcaagcggcaaatccggctgaagtgttgcgttcaattaatgcgtctattgcgaatttaatcgcttaa

SEQ ID NO: 16665 - protein, 245 aa, Mannheimia succiniciproducens MBEL55E
MKAKFSKEEVNMSNKIIVALDYETEKEALQLVDQIDPSLCRLKVGKEMFTTLGTNFVKLLQDRDFDVFLDLKFHDIPNTVARAVRSAADLGVWMVDLHASGGLRMMEEAKKILEPYGKDAPILISVTVLTSMEDLDLLQIGINASPMEQVIRLAHLSQRAGLDGVVCSPQEVEILRQHLGKEFKLITPGIRPVGSEFGDQRRVMTPPAAIEAGSDYLVIGRPITQAANPAEVLRSINASIANLIA

SEQ ID NO: 16666 - DNA, 690 bp, Legionella pneumophila subsp. pneumophila str. Philadelphia 1
  CDS (1)..(690): transl_table=11
atgacacctaaattaatcgttgcgttggattttgataatcaagataacgctatacagttggttgaaaaacttgatccgaatcattgcgcacttaaggttgggagtgagctttttactctattagggcctcagtttgtaaaagcattggtaagaagagagtttaaagtatttttagatttaaaatttcacgatatccctaatacagttgctaaagcatgccactccgctgcagaattaggggtatggatgataaatgttcatgccatcggcggcttaaaaatgttacaagctgccagggaatctttaaaaacgtatggtaaagacaggcctttgttgatagcagtgactgtgctgaccagttttgaagaaggggagctggccagtgttggtattagtaacacattgcctgagcaagcaacccatctggctatgcttgccagagaggctgggcttgatggtgtggtaagctctgcacatgaagttaaaattataaaacagaagtgtggtgagaattttattaccgttactcctggcataagactgccaaataatctaaaagatgatcaatcgcgagtaatgactccacaacaagccatcagagaaggaagtgattttctggttattggaagaccaattacgcaagcgagcaatccttatgaggttgtctcagcattattacgtgatctttga

SEQ ID NO: 16667 - protein, 229 aa, Legionella pneumophila subsp. pneumophila str. Philadelphia 1
MTPKLIVALDFDNQDNAIQLVEKLDPNHCALKVGSELFTLLGPQFVKALVRREFKVFLDLKFHDIPNTVAKACHSAAELGVWMINVHAIGGLKMLQAARESLKTYGKDRPLLIAVTVLTSFEEGELASVGISNTLPEQATHLAMLAREAGLDGVVSSAHEVKIIKQKCGENFITVTPGIRLPNNLKDDQSRVMTPQQAIREGSDFLVIGRPITQASNPYEVVSALLRDL

SEQ ID NO: 16668 - DNA, 729 bp, Methylococcus capsulatus str. Bath
  CDS (1)..(729): transl_table=11
atgccgaatttcctttcgaacaagcccattcccgtggccgatcgcctgatcatggcgctggacctgccggatgtctccgaagccaagaccttggtggaacgcctcggcgacgccgtgagcttctacaaggtggggctggaactgttcatgtccggcgactgtttcgctttggtggattggctcaaggccaaagacaagaaggttttcgtcgatctcaagttcttcgacgtgccggagaccgtcggccgcgcggtcaaggcgctgagccggcgcggggtggatttcgccaccgtgcacggcaacgatgcgatcatggaggcggcggcccgcaacaaggggagcctcggcattctggcggtcacggttctgaccagcctggaccagggggatctgcgtgatctcggcttccagtgcgacgtgcaggaattggtcttgtcccgtgcccggcgcgccctggcagtgggttgcgacggggtggtgtcgtccgggctcgaggtcccgctgttgcgcggtgagatcgaccacgagctaatggtcgtgtcgcccggcatccggcctgtcgaaaaccgtcctgaggacgaccagaagcgggtggttacggtcgatcaggcgttccgcaacggtgccgattacatcgtggtggggcggccgatccgcgatgcagccgatccccgcgaggctgcccagcgggcacaggctcagatccgcgacgtgttcgcggcgggctga

SEQ ID NO: 16669 - protein, 242 aa, Methylococcus capsulatus str. Bath
MPNFLSNKPIPVADRLIMALDLPDVSEAKTLVERLGDAVSFYKVGLELFMSGDCFALVDWLKAKDKKVFVDLKFFDVPETVGRAVKALSRRGVDFATVHGNDAIMEAAARNKGSLGILAVTVLTSLDQGDLRDLGFQCDVQELVLSRARRALAVGCDGVVSSGLEVPLLRGEIDHELMVVSPGIRPVENRPEDDQKRVVTVDQAFRNGADYIVVGRPIRDAADPREAAQRAQAQIRDVFAAG

SEQ ID NO: 16670 - DNA, 699 bp, Nocardia farcinica IFM 10152
  CDS (1)..(699): transl_table=11
atgcccaccaccacgaccgtcagaggccggctggctatcgcgctcgacaccagcgatctggacaccgcggtgtcgatcgcgaaggccgtgcagcccgacatcggcgtcgccaaagtcggccttcaactgttcagcgcggcggggcgcgacgccgtgcgcgctatgcaggatctcggcatggacgtcttcctcgacgtcaagctgcacgacatccccaacaccgtctacggggccagcaccgtcctcggagccctgggcgtccaatacctgaccgtccacgcaggcggtggaacggccatgctcgaagctgcggtgaggggactcggcgagggcgcgagcagcgccgggttcgcagccccgaccgtgctggcggtcaccgtgctgaccagcgcgccggacgcatcgccggaacttctcaacgaacgcctggcggcggctgtcgccgccgattgtggcggcgttgtctgcgcggccagcgacctgcccgtcattcgcgccgctgcgcccgacatcctgaccgtggttcccggcatccgtccggccggcggcgaggtgcacgaccagcagcgtgtggcgacccctgccgatgccattcgcagtggtgcaagcattctcgtcctcggtcgagcgatcaccgctgctccggaccccgccgaagccgcgcgggccatcaccgaggaagtcgcgcaagcactttga

SEQ ID NO: 16671 - protein, 232 aa, Nocardia farcinica IFM 10152
MPTTTTVRGRLAIALDTSDLDTAVSIAKAVQPDIGVAKVGLQLFSAAGRDAVRAMQDLGMDVFLDVKLHDIPNTVYGASTVLGALGVQYLTVHAGGGTAMLEAAVRGLGEGASSAGFAAPTVLAVTVLTSAPDASPELLNERLAAAVAADCGGVVCAASDLPVIRAAAPDILTVVPGIRPAGGEVHDQQRVATPADAIRSGASILVLGRAITAAPDPAEAARAITEEVAQAL

SEQ ID NO: 16672 - DNA, 690 bp, Legionella pneumophila str. Paris
  CDS (1)..(690): transl_table=11
atgacacctaaattaatcgttgcgttggattttgataatcaagataacgctttacagttggttgacaaactggatccgaatcattgcgcacttaaggttggaagtgagctttttactctattagggcctcagtttgtaaaagaattggtaagaagagagtttaaagtatttttagatttaaaatttcacgatatccctaatacagttgctaaagcatgccactccgctgcagaattaggggtatggatgataaatgttcatgccatcggtggcttaagaatgttgcaagctgccagagaatctttaaaaacgtatggtaaagacaggcctttgttgattgcagtgactgtgctgaccagttttgaagaaggggagctggccagtgttggtattagtaatacattgcctgagcaagcaacccatctggctatgcttgccagagaggctgggcttgatggtgtggtaagctctgcacatgaagttaaaattataaaacagaagtgtggtgagaattttattaccgttactcctggcataagactgccaaataatctaaaagatgatcaatcgcgagtaatgactccacaacaagccatcagagaaggaagtgattttctggttattggaagaccaattacgcaagcgagcaatcctcatgaggttgtctcagctctattgcgtgatctttga

SEQ ID NO: 16673 - protein, 229 aa, Legionella pneumophila str. Paris
MTPKLIVALDFDNQDNALQLVDKLDPNHCALKVGSELFTLLGPQFVKELVRREFKVFLDLKFHDIPNTVAKACHSAAELGVWMINVHAIGGLRMLQAARESLKTYGKDRPLLIAVTVLTSFEEGELASVGISNTLPEQATHLAMLAREAGLDGVVSSAHEVKIIKQKCGENFITVTPGIRLPNNLKDDQSRVMTPQQAIREGSDFLVIGRPITQASNPHEVVSALLRDL

SEQ ID NO: 16674 - DNA, 690 bp, Legionella pneumophila str. Lens
  CDS (1)..(690): transl_table=11
atgacacctaaattaatcgttgcgttggattttgataatcaagataacgctttacagttggttgaaaaacttgatccgaatcattgcgcacttaaggttgggagtgagctttttactctattagggcctcagtttgtaaaagaattggtaagaagagagtttaaagtatttttagatttaaaatttcacgatatccctaatacagttgctaaagcatgctactccgctgcagaattaggggtatggatgataaatgttcatgccatcggcggcttaaaaatgttgcaagctgccagggaatctttaaaaacgtatggtaaagacaggcctttgttgattgcagtgactgtgttgaccagttttgaagaaggggagctggccagtgttggtattaggaatacattgcctgagcaagcaactcatctggctatgcttgccagagaggctgggcttgatggtgtggtaagctctgcacatgaagttaaaattataaaacagaagtgtggtgagaattttattaccgttactcctggcataagactgccaaataatctaaaagatgatcaatcgcgagtaatgactccacaacaagccatcagagaaggaagtgattttctggttattggaagaccaattacgcaagcgagcaatccttatgaggttgtctcagcactattgcgtgatctttga

SEQ ID NO: 16675 - protein, 229 aa, Legionella pneumophila str. Lens
MTPKLIVALDFDNQDNALQLVEKLDPNHCALKVGSELFTLLGPQFVKELVRREFKVFLDLKFHDIPNTVAKACYSAAELGVWMINVHAIGGLKMLQAARESLKTYGKDRPLLIAVTVLTSFEEGELASVGIRNTLPEQATHLAMLAREAGLDGVVSSAHEVKIIKQKCGENFITVTPGIRLPNNLKDDQSRVMTPQQAIREGSDFLVIGRPITQASNPYEVVSALLRDL

SEQ ID NO: 16676 - DNA, 696 bp, Photobacterium profundum SS9
  CDS (1)..(696): transl_table=11
atgttagaccctaaagtgattgtcgcactcgactacccgaaccaagatgcagcattagcgtttgtcgaccgtattgagccgggaagctgccgtctaaaagtgggtaaagaaatgttcactttatatggccctgacttcgtgcgtaagttgcatgaatgtggtcactctgtatttttagacctgaaattccatgatattccaaatacttgttcgcgtgctgttgcagctgcggcagagttaggtgtttggatggtgaacgttcatgcaagtggcggtgaacgcatgatggctgcatcacgtgatattcttgagccgtatggtaaagatcgtccgctattgattgcggtaacggtattaaccagtatggaagcatcagatcttgcgggtattggtattgcctgtgcaccacaagaacaagtattaaacttggcaacattaactaaaaacagtggtctcgatggcgtagtctgttcagctcaagaatcaacgatgttgaaatcagcactgggtaaagagtttcagttaattactccaggcattcgtcctgttggtagtgctgctggcgatcagcgtcgtgttatgacaccagttgaagccgttagtgcgggatctgattacttagttatcggccgccctattacacaggcaactgatccttctgctgtattagctgaaatcaatcaatcactggcttaa

SEQ ID NO: 16677 - protein, 231 aa, Photobacterium profundum SS9
MLDPKVIVALDYPNQDAALAFVDRIEPGSCRLKVGKEMFTLYGPDFVRKLHECGHSVFLDLKFHDIPNTCSRAVAAAAELGVWMVNVHASGGERMMAASRDILEPYGKDRPLLIAVTVLTSMEASDLAGIGIACAPQEQVLNLATLTKNSGLDGVVCSAQESTMLKSALGKEFQLITPGIRPVGSAAGDQRRVMTPVEAVSAGSDYLVIGRPITQATDPSAVLAEINQSLA

SEQ ID NO: 16678 - DNA, 696 bp, Streptococcus thermophilus LMG 18311
  CDS (1)..(696): transl_table=11
atgagagaaaatcgtcctgttattgcccttgatttcccgactcttgaggatgtgaaggctttccttgctaagtttcctgctgatgaaaagctctatgtgaagattggtatggagctttactatgcggctggtcctgagattgtacgctacgttaaagagcttggccatagtgttttccttgaccttaagcttcacgatattccaaatactgtcaaatcagctatgcgtgtcttgtctaaccttggcgttgatatgacaaatgtgcatgcggctggtggtgtggagatgatgaaagctgcgcgtgaaggcttgggagatggaccaatcttgattgctgtaacccagttgacctctacgtctgaagagcagatgcgtgattttcaaaatatccaaaccacacttcaagaatcagtggttcattatgctcagaaaactgctgaagcaggtctcgatggtgttgtctgttcagcacacgaagtagccaaaatcaaagaagcaactaaccaagacttcgtttgtttgacacctggtattcgtccagcaggagcagcggttggtgaccaaaaacgggtcatgacacctgctgatgctcatcaaattggttcagactacattgttgtcggtcgcccaattacgcaagctgaagatccagtggcagcttatcacgacatcaaggcccaatggaacgatcaataa

SEQ ID NO: 16679 - protein, 231 aa, Streptococcus thermophilus LMG 18311
MRENRPVIALDFPTLEDVKAFLAKFPADEKLYVKIGMELYYAAGPEIVRYVKELGHSVFLDLKLHDIPNTVKSAMRVLSNLGVDMTNVHAAGGVEMMKAAREGLGDGPILIAVTQLTSTSEEQMRDFQNIQTTLQESVVHYAQKTAEAGLDGVVCSAHEVAKIKEATNQDFVCLTPGIRPAGAAVGDQKRVMTPADAHQIGSDYIVVGRPITQAEDPVAAYHDIKAQWNDQ

SEQ ID NO: 16680 - DNA, 696 bp, Streptococcus thermophilus CNRZ1066
  CDS (1)..(696): transl_table=11
atgagagaaaatcgtcctgttattgcccttgatttcccgactcttgaggatgtgaaggctttccttgctaagtttcctgctgatgaaaagctctatgtgaagattggtatggaactttactatgcagctggtcctgagattgtacgctacgttaaagagcttggccatagtgttttccttgaccttaagcttcacgatattccaaatactgtcaaatcagctatgcgtgtcttgtctaaccttggcgttgatatgacaaatgtgcatgcggctggtggtgtggagatgatgaaagctgcgcgtgaaggcttgggagagggaccaatcttgattgctgtaacccagttgacctctacgtctgaagagcagatgcgtgattttcaaaatatccaaaccacacttcaagaatcagtggttcattatgctcagaaaactgctgaagcaggtctcaatggtgttgtctgttcagcacacgaagtagccaaaatcaaagaagcaactaaccaagacttcgtttgtttgacacctggtattcgtccagcaggagcagcggttggtgaccaaaaacgggtcatgacacctgatgatgctcatcaaattggttcagactacattgttgtcggtcgcccaattacgcaagctgaagatccagtggcagcttatcacgacatcaaggcccaatggaacgatcaataa

SEQ ID NO: 16681 - protein, 231 aa, Streptococcus thermophilus CNRZ1066
MRENRPVIALDFPTLEDVKAFLAKFPADEKLYVKIGMELYYAAGPEIVRYVKELGHSVFLDLKLHDIPNTVKSAMRVLSNLGVDMTNVHAAGGVEMMKAAREGLGEGPILIAVTQLTSTSEEQMRDFQNIQTTLQESVVHYAQKTAEAGLNGVVCSAHEVAKIKEATNQDFVCLTPGIRPAGAAVGDQKRVMTPDDAHQIGSDYIVVGRPITQAEDPVAAYHDIKAQWNDQ

SEQ ID NO: 16682 - DNA, 735 bp, Geobacillus kaustophilus HTA426
  CDS (1)..(735): transl_table=11
gtgcacacgccgttcattgtcgcgcttgatttcccatcaaaacaagaggtggagcggtttttgcggccgtttgccggaacgccgctgttcgtcaaagtcggcatggagctgtactatcaggaaggtccagccatcgtcgcgtttctcaaagaacaaggacatgccgtctttttagacttaaaactgcacgacattccgaatacggtgaaacaggcgatgaaagggctcgcccgcgtcggcgccgatttggtgaacgtccacgccgccggcggccggcgcatgatggaagcggcgatcgaggggcttgacgccggcacgccaagcggaagaatgcggccgcgctgcatcgctgtcacccagctgacaagcacggacgagcgaatgcttcatgaggagctgtggatttcccgcccgcttgtggaaacagtcgcccattacgccgccttggcgaaagaaagcggccttgacggcgtcgtctgttcagcgaacgaagcggcgttcatcaaagaacggtgcggcgcctcgttccttgccgtcaccccgggtatccgctttgctgatgatgcggcgcacgaccaagtgcgcgtcgtcaccccaaggaaagcgcgtgcgcttggttctgactacatcgtcatcggccgcagcctcacccgcgccgccgatccgctcaggacgtatgcccgcctgcaacacgaatggaacggaggagagagagagtcaactacccccacttag

SEQ ID NO: 16683 - protein, 244 aa, Geobacillus kaustophilus HTA426
MHTPFIVALDFPSKQEVERFLRPFAGTPLFVKVGMELYYQEGPAIVAFLKEQGHAVFLDLKLHDIPNTVKQAMKGLARVGADLVNVHAAGGRRMMEAAIEGLDAGTPSGRMRPRCIAVTQLTSTDERMLHEELWISRPLVETVAHYAALAKESGLDGVVCSANEAAFIKERCGASFLAVTPGIRFADDAAHDQVRVVTPRKARALGSDYIVIGRSLTRAADPLRTYARLQHEWNGGERESTTPT

SEQ ID NO: 16684 - DNA, 738 bp, Salmonella enterica subsp. enterica serovar Paratyphi A str. ATCC
  CDS (1)..(738): transl_table=11
atgacgtttactgcttcatcttcttcctgcgctattactgaatcgcctgtcgttgtggcgttggattaccatgaacgcgataaagccctggcgtttgtcgataaaatcgatcctcgcgattgtcgcttaaaagtgggcaaagagatgttcacgctgtttggtccacagctcgttcgggatctccagcaacgtgggtttgatgtctttcttgatctaaaatttcatgatattcccaacaccacggcccgggcagtcgccgcagcggcagacctgggcgtctggatggtaaacgttcacgcgtctggcggggcgagaatgatggccgcagcgcgcgacgcgctggcgccattcggtaaagatgcgccgttgctcattgccgtgaccgtgttgaccagtatggaaaccagcgatctgcgtgatcttggcgtgacgttgtcaccggcggaacatgcggagcggctggcgcgcctgacgcagcaatgcgggctggatggcgtggtctgttccgctcaggaagcggtcagatttaaacaggtctttggcgctgcatttaagctggtgacgccgggcattcggcccgcaggcagcgaggcaggcgaccagcgacgcattatgacgcccgaacaggcattatccgccggcgtcgactatatggtgattggccgcccggttacgcaatcagtagatccggcgcaaacgctgaaggatattaacgcgtcactgaaacgggaggcataa

SEQ ID NO: 16685 - protein, 245 aa, Salmonella enterica subsp. enterica serovar Paratyphi A str. ATCC
MTFTASSSSCAITESPVVVALDYHERDKALAFVDKIDPRDCRLKVGKEMFTLFGPQLVRDLQQRGFDVFLDLKFHDIPNTTARAVAAAADLGVWMVNVHASGGARMMAAARDALAPFGKDAPLLIAVTVLTSMETSDLRDLGVTLSPAEHAERLARLTQQCGLDGVVCSAQEAVRFKQVFGAAFKLVTPGIRPAGSEAGDQRRIMTPEQALSAGVDYMVIGRPVTQSVDPAQTLKDINASLKREA

SEQ ID NO: 16686 - DNA, 720 bp, Anaplasma marginale str. St. Maries
  CDS (1)..(720): transl_table=11
ttgcactttttgacaagtgttcacgtcactacaatgcgcagtagtccgataatttgtgcgctggatatgatggatatcacccgcgcacttgaggtgactaaggcgatatccggcaaggttgccatggtaaaattggggctggagttcttcactgcatacggtattactggtgtgcggcaggtaattgagctcggcgtacccgtgtttcttgacctaaagcttcatgatatcccaaatacggtggttagggccatacattcggtcaaagacttaaatattgccatgcttaccattcacgtgagtggggggaaggacatgatgcgcgccgcggctgatgccttgtctgatacaaatatacttcttgccggggttacggttttgacgagcattggcggcgatgacttcatagatttcggaatacatgagtctttggaatctcacgtcatgaggctggtaggcctggctgtggatgccgggttgcgagctgtggtatgttctgcccatgaagtcggtgtgatacgtggcagatatccggacattacgcttgttgttcccggaattcgctttaattctggagttgatgatcaaaaacggacaaaaacacccatggatgcgctgtcagatggagcgaactatttagttgttggccgtcctgtgacccaaagccctgatccattagccgcgattgacgaaattctccgctctataggggtgcactga

SEQ ID NO: 16687 - protein, 239 aa, Anaplasma marginale str. St. Maries
MHFLTSVHVTTMRSSPIICALDMMDITRALEVTKAISGKVAMVKLGLEFFTAYGITGVRQVIELGVPVFLDLKLHDIPNTVVRAIHSVKDLNIAMLTIHVSGGKDMMRAAADALSDTNILLAGVTVLTSIGGDDFIDFGIHESLESHVMRLVGLAVDAGLRAVVCSAHEVGVIRGRYPDITLVVPGIRFNSGVDDQKRTKTPMDALSDGANYLVVGRPVTQSPDPLAAIDEILRSIGVH

SEQ ID NO: 16688 - DNA, 696 bp, Idiomarina loihiensis L2TR
  CDS (1)..(696): transl_table=11
atggcgttaccgaaaatttatgttgcattagattgccagacacaggaagccgctgacaatttagtgagtcaattaccagctggaaaagttggtcttaaagtgggtaaggaattgtttactgctattggacctgactgggtgaaaaagcaggttgagcaaggtttttcagtatttttagatttaaagtttcatgatattccaaacacagtggctaaggcggtaacctcagcagctaaaatcggtgttgatatagtgaacgtgcacgccagcggcggtaccgaaatgatgagcgcagcaagggatgcattaaagcaatttgataaaccacctttgttaattgctgtgacggtacttactagcatgagtgattcagacctaaacgaaatcggaattcaggcaactgcggaacagcaagtacttaaactggcaaaactagcgcagcaggctggcttgaacggcgtggtttgctctgctcaggaagctcgtatgctgaaacatgatttgggtacgtcatttaagcttgtaacgccgggtatccgacccgccaacagcgccactggtgaccaaaagcgggttatgacaccagaagccgcaatagaggctggagtcgattacatggttattgggcgacccattacgcaggcagctgacccaaccgccagcgttgcggagatattaacctctataggagaataa

SEQ ID NO: 16689 - protein, 231 aa, Idiomarina loihiensis L2TR
MALPKIYVALDCQTQEAADNLVSQLPAGKVGLKVGKELFTAIGPDWVKKQVEQGFSVFLDLKFHDIPNTVAKAVTSAAKIGVDIVNVHASGGTEMMSAARDALKQFDKPPLLIAVTVLTSMSDSDLNEIGIQATAEQQVLKLAKLAQQAGLNGVVCSAQEARMLKHDLGTSFKLVTPGIRPANSATGDQKRVMTPEAAIEAGVDYMVIGRPITQAADPTASVAEILTSIGE

SEQ ID NO: 16690 - DNA, 711 bp, Zymomonas mobilis subsp. mobilis ZM4
  CDS (1)..(711): transl_table=11
gtgcccaatactgactttttatccaatcccgtttttgttgccctcgatacaccagacctgaaaaaggctgaaaagctggcgacgatcctccgccctcatgttggcgggatcaagcttggtctggaattttttatggcgcatggccattacggggttgaaaaaatcgcagatcaagggctgcctatttttcttgatctcaaatttcatgatattccgaatacagtggcttctgcgattgaggctttgtttcatgcagtcaagtcgccgcctgctattttaacggttcataccgaaggcggtgaagccatgatgcgcgcggccaaaaaggccgcagacaaaggctcgaaagtggtgggtgtcactattctgaccagtctcgatcaaagtgaccttggtgtgattggcatgacgggaacgccagaatcgcaggttgaaaaactggcacgtctggcacgtagatccggtcttgatggcattgtctgttctggtgaagaagtcgaacaggtgcatgaagaatggcgcgatggcttctttgttgttcccggaatacggcctgccgatagtgtcgtcggtgaccaaaaacgggtttgcacgcctgccgatgctttggatcggggcgcttctattttagttattggccgcccgattacccgtgcagatgaacctgccgaggtggcctcggctattgccagacaattgcgccggaaataa

SEQ ID NO: 16691 - protein, 236 aa, Zymomonas mobilis subsp. mobilis ZM4
MPNTDFLSNPVFVALDTPDLKKAEKLATILRPHVGGIKLGLEFFMAHGHYGVEKIADQGLPIFLDLKFHDIPNTVASAIEALFHAVKSPPAILTVHTEGGEAMMRAAKKAADKGSKVVGVTILTSLDQSDLGVIGMTGTPESQVEKLARLARRSGLDGIVCSGEEVEQVHEEWRDGFFVVPGIRPADSVVGDQKRVCTPADALDRGASILVIGRPITRADEPAEVASAIARQLRRK

SEQ ID NO: 16692 - DNA, 735 bp, Silicibacter pomeroyi DSS-3
  CDS (1)..(735): transl_table=11
atgacagacagaatgctcgccgacgatcgcctgatcgtcgcccttgacgtgcccaatgcggtggccgggctggccctggccgaacggctgggcgacgcggtttccttttacaagatcgggctggggatgctcaccggtggcggtctcgctctggccaacgagctgaaacaggaacatggcaagcgcatcttcctggacatgaaactgttcgacatcggcaacacggtcgaggccgccgtgcggggcctgtcccagttcgatctggatttcctgaccgtgcatggcgacccgcatgtggtgcgcgccgccaaggagggcgccgccggcaaggacctcaagatcctggccgtcaccattctgacctcgctgaaccgcgacgatctggatgcgtcgctgatcaaacccggtgatgtgcacgaccttgttctggaacgtgccgcccgcgcctttgaggccggggccgatggtgtcatcgccagcccgcaggaggcggccgcgatccgcgccctacccgaggctgccgggcggctgatcgtgacccccggcatacgccccgcgggtgccgatctgggcgatcagaaacgcgtcgcgacaccggccaacgccattgccgacggggttgatcacatcgtggtggggcggcccgtcgtccacgctcccgaccctcgcgccgccgctctgtcgatccttgccgaaatgacctctccgcaagcagtggcaccaaaccggagttga

SEQ ID NO: 16693 - protein, 244 aa, Silicibacter pomeroyi DSS-3
MTDRMLADDRLIVALDVPNAVAGLALAERLGDAVSFYKIGLGMLTGGGLALANELKQEHGKRIFLDMKLFDIGNTVEAAVRGLSQFDLDFLTVHGDPHVVRAAKEGAAGKDLKILAVTILTSLNRDDLDASLIKPGDVHDLVLERAARAFEAGADGVIASPQEAAAIRALPEAAGRLIVTPGIRPAGADLGDQKRVATPANAIADGVDHIVVGRPVVHAPDPRAAALSILAEMTSPQAVAPNRS

SEQ ID NO: 16694 - DNA, 645 bp, Francisella tularensis subsp. tularensis SCHU S4
  CDS (1)..(645): transl_table=11
ttgagaaactcaatgaaaataatgttctcagcagatggtatctctaagtcagatttagagaaaacagccgctgtatcaaagtatgttgactgtgttaagattggtcatattctatgctcaacgttatcttttaaagaaattcatgagctagtaggcgacaaagatattttcctagactttaagttacacgatatcccaaatacagttaaaactgcaattgaaaattattcaaaagctattccaaattttaaatattttacatttcatggtactgctagtgatgagatgataaaagcagcccttacggcagatactcaagctataccattagctgtgattacacttagtagtgatgctaattttgataaggcagatagccttgctaaatttcaaagatgtgtggatttaggtgtggaaaactttatatgtcatccacatttagttgctgatgtcagagctaaatttggcgataaaatcaagctatatgtcccaggtgtaaggcttgagagtgatctaagtgatgatcattttaacgctttgacccctaaaaaagccaaagagcttggcgttgattacattattgtaggtaggccgctattacgcgctgaaaatatcgttgagaagctaaaagagtttgagtgctaa

SEQ ID NO: 16695 - protein, 214 aa, Francisella tularensis subsp. tularensis SCHU S4
MRNSMKIMFSADGISKSDLEKTAAVSKYVDCVKIGHILCSTLSFKEIHELVGDKDIFLDFKLHDIPNTVKTAIENYSKAIPNFKYFTFHGTASDEMIKAALTADTQAIPLAVITLSSDANFDKADSLAKFQRCVDLGVENFICHPHLVADVRAKFGDKIKLYVPGVRLESDLSDDHFNALTPKKAKELGVDYIIVGRPLLRAENIVEKLKEFEC

SEQ ID NO: 16696 - DNA, 723 bp, Synechococcus elongatus PCC 6301
  CDS (1)..(723): transl_table=11
atgactgatttggcagctcgcgatcgcatcattgtaccactggacgtaccggacgttgaagctgcgattactctgattgatcgcttgccagaagctcagttctttaaggttggactcgaactgtttgtggcaaccggatcaacggttctaacgattttaaaagagcgacagaaaaagatttttctcgaccttaagctacacgacattcccaacacgatggccggagcttgtcgcagtgcggctcgctatggcgtggacttgctgaccatccatgcgactgctggtaaacccgcgctggaagcggcgcaggcaggtgcgatcgctggtgcagcagcagcgggcgttcagcctcctaccctgctggccgtcacggtcttgactagtttgagccaacagcaactcacggaagagctgcatgtgccggaagcagtccccaactacgtccagcatttggcccgtcaagccgaagcctgtggcattggcggctgtgtctgttcaccacaggaactcgtagtactcaagaccgcctgcagtgatgactttgtccgtgtgaccccgggggtgcggcccacctgggcggcggcgggcgatcaacaacgggtaatgacgcctcagcaagcgatcgcagcaggggccacctaccttgtggttggccggccgatcacggctgccgatgatccggcggcagctttccagcgggtctgcgaggaactgaccccatga

SEQ ID NO: 16697 - protein, 240 aa, Synechococcus elongatus PCC 6301
MTDLAARDRIIVPLDVPDVEAAITLIDRLPEAQFFKVGLELFVATGSTVLTILKERQKKIFLDLKLHDIPNTMAGACRSAARYGVDLLTIHATAGKPALEAAQAGAIAGAAAAGVQPPTLLAVTVLTSLSQQQLTEELHVPEAVPNYVQHLARQAEACGIGGCVCSPQELVVLKTACSDDFVRVTPGVRPTWAAAGDQQRVMTPQQAIAAGATYLVVGRPITAADDPAAAFQRVCEELTP

SEQ ID NO: 16698 - DNA, 720 bp, Bacillus clausii KSM-K16
  CDS (1)..(720): transl_table=11
atgaataggccattttttatcgctttggattttgatgagcacgccaaacgccagcgcttcttggagtcgtttgctgccgaaacgcttgatgtaaaaatcggtatggaactgttttaccgggaagggttgtctgtagtccatgaattaaaggaagccggttatcggttgtttcttgatttaaaacttcatgatattcccaataccgttggaaggacgatgcgtgctttagccgaattggacgtcgatgtcgtcaatgtccatgctgcagggggaaaagcaatgatggaagcggctttagaagggctcgatgcagggacaagagcaggaaaacagcggccgaaactcatcgctgttacgcagctgacgagcacggacagccgtatgctcgctgaagagttgctgatcgataaggcgatggatgaagtcgtggtacggtatgcgcagcttgcccaggaaagtggattagacggtgttgtttgctcagcccatgaagtcccccttattcgggcagcatgcagcgatcggtttttgacggttacgcctggcattcgcaggcaagtcgaccaagttggcgaccaagtgcgtgtcgtcacaccaggggaagcaaaagcgctcggtagttgggcgattgtcgtcgggcgaagcattacagcagcagcagatccactagctgtttacagagaaatgaaccaagattggaaaggggcgaccgaacattga

SEQ ID NO: 16699 - protein, 239 aa, Bacillus clausii KSM-K16
MNRPFFIALDFDEHAKRQRFLESFAAETLDVKIGMELFYREGLSVVHELKEAGYRLFLDLKLHDIPNTVGRTMRALAELDVDVVNVHAAGGKAMMEAALEGLDAGTRAGKQRPKLIAVTQLTSTDSRMLAEELLIDKAMDEVVVRYAQLAQESGLDGVVCSAHEVPLIRAACSDRFLTVTPGIRRQVDQVGDQVRVVTPGEAKALGSWAIVVGRSITAAADPLAVYREMNQDWKGATEH

SEQ ID NO: 16700 - DNA, 840 bp, Campylobacter jejuni RM1221
  CDS (1)..(840): transl_table=11
atgaagctttgtgtcgcacttgatctttctacaaaagaagaatgcttacaacttgccaaagaattaaaaaatttagacatatggttaaaagtaggtttaagagcatatttaagagatggttttaaattcatagaagaacttaaaaaagttgatgattttaaaatatttcttgatcttaaaattcatgatattcccaacactatggcagatgcttgcgaagaagtatcaaaacttggtgttgatatgatcaatatccacgcaagtgctggaaaaatagccatacaagaagttatgacacggcttagcaaattttcaaaaagacctttagttttagcagtttctgctcttacgagttttgatgaagaaaatttctttagtatttatagacaaaaaattgaagaagctgtaattaatttttcaaaaatatcctatgaaaatggacttgatggtatggtatgctctgtttttgaaagcaaaaaaattaaagagcacacaagttcaaatttcttaacccttactcctggaattcgtccttttggagaaacaagtgatgatcaaaaacgtgttgctaatcttgcaatggctagagaaaatttgagtgattatatcgttgtgggaaggcctatatataaaaatgaaaatcctagggctgtatgtgaaaaaattttaaacaaaatacacagaaaaaatataagcgaaaacgatatagagcaaaattatgaagtaattcagcaaaaagaatgggatatgtgtaatcactttgaagaatggattaaaactcagcctgataaagaacatgctttaaaagaattttatgctaagtgtgggataaaatattga

SEQ ID NO: 16701 - protein, 279 aa, Campylobacter jejuni RM1221
MKLCVALDLSTKEECLQLAKELKNLDIWLKVGLRAYLRDGFKFIEELKKVDDFKIFLDLKIHDIPNTMADACEEVSKLGVDMINIHASAGKIAIQEVMTRLSKFSKRPLVLAVSALTSFDEENFFSIYRQKIEEAVINFSKISYENGLDGMVCSVFESKKIKEHTSSNFLTLTPGIRPFGETSDDQKRVANLAMARENLSDYIVVGRPIYKNENPRAVCEKILNKIHRKNISENDIEQNYEVIQQKEWDMCNHFEEWIKTQPDKEHALKEFYAKCGIKY

SEQ ID NO: 16702 - DNA, 696 bp, Ehrlichia ruminantium str. Welgevonden
  CDS (1)..(696): transl_table=11
atgaagcataatccaattatttgtgcattggatactcatgatatacataaggcattgcgattgacaaagatgttatatggaaaaatatctatggtgaaattaggattggaattctttgtagcacatggaatatctggtgtacagagaatatctgattgtggaattccaatatttcttgatttaaagttacatgatattcctaatactgtgagtcgtgctgtatcagtaattaagtcttcaaatattgctatgcttactattcatattagtggtggtcaagaaatgataaaaagaaccatggatgttatatttgatagtatgcttaagataataggtgtgactgtacttacaagtattgatgtttgtgatttaaaggaaataggtattgggaattctacagtgcaacaagttattttattatcaaaacttgctcaaaaagtaggattatatggtatagtttgttctcctcttgaagtgaaggaggttcgtgcacaatgtgataaagatctaaaaattatagttccaggtataagattaggagataatattgatgatcagaaaagaactgattctcctaaaagtgcaatattgtctggagcagattatttagtgatagggcgcccaattactgaaaatactgaccctgtaaaagtagttgatattattctttcatcaatagcggatttacacaattaa

SEQ ID NO: 16703 - protein, 231 aa, Ehrlichia ruminantium str. Welgevonden
MKHNPIICALDTHDIHKALRLTKMLYGKISMVKLGLEFFVAHGISGVQRISDCGIPIFLDLKLHDIPNTVSRAVSVIKSSNIAMLTIHISGGQEMIKRTMDVIFDSMLKIIGVTVLTSIDVCDLKEIGIGNSTVQQVILLSKLAQKVGLYGIVCSPLEVKEVRAQCDKDLKIIVPGIRLGDNIDDQKRTDSPKSAILSGADYLVIGRPITENTDPVKVVDIILSSIADLHN

SEQ ID NO: 16704 - DNA, 693 bp, Staphylococcus aureus subsp. aureus COL
  CDS (1)..(693): transl_table=11
atgaaagatttaccaattattgcattagattttgaatcaaaagaaaaagtaaatcaatttttagatttatttgatgaatcattattcgtaaaagtaggtatggaacttttttatcaagaaggtcctcaattaattaatgagataaaagaaagaggccatgatgtatttttagatttaaaactgcatgatattcctaatacagttggtaaggcgatggaaggactagctaaattgaatgttgatctggtaaatgttcatgctgctggtggcgtaaaaatgatgtctgaggccattaaaggattaagaaaacataatcaagatacaaaaattattgcagtaacacagcttacgtcaacaacagaagacatgttacgacacgaacaaaatatacaaacatcgattgaagaggccgttttaaattatgccaagttagcaaatgcagctggtttagatggcgttgtttgttcacctcttgaaagtcgtatgttgactgaaaagttaggtacatcatttttaaaagtaacaccaggtattagacctaaaggtgcatctcaaaatgaccaacaccgtattacgacaccggaagaagcaagacagcttggttcgacgcatattgtagtcggtagaccgattacacaaagtgacaatccagtcgaaagttatcataaaattaaagaaagttggttagtataa

SEQ ID NO: 16705 - protein, 230 aa, Staphylococcus aureus subsp. aureus COL
MKDLPIIALDFESKEKVNQFLDLFDESLFVKVGMELFYQEGPQLINEIKERGHDVFLDLKLHDIPNTVGKAMEGLAKLNVDLVNVHAAGGVKMMSEAIKGLRKHNQDTKIIAVTQLTSTTEDMLRHEQNIQTSIEEAVLNYAKLANAAGLDGVVCSPLESRMLTEKLGTSFLKVTPGIRPKGASQNDQHRITTPEEARQLGSTHIVVGRPITQSDNPVESYHKIKESWLV

SEQ ID NO: 16706 - DNA, 693 bp, Staphylococcus epidermidis RP62A
  CDS (1)..(693): transl_table=11
gtgagaaatctacccattatagcattagattttaaatcagcagacgaggttcatacatttttaaataagtttaatgaaccgttatgcgtcaaaattgggatggagttattttatcaaacagggccagctttaattaaatccattaaaaaaagaggtcatgatatctttttagatttaaaattacatgacatacctaatactgtgagcaaagcaatggaaggcttagcacgtttagacattgatttagtcaatgttcatgctgccggtggtattaaaatgatggaagaagctaaaaaagggttaagaaaacataatgctgatattaaaatcattgcagttactcaattaacttcaactactgaaagacaattacatgaagaacaaaatattcaaacctctatagaggaggcagttctaaattatgcgcgtcttactaaaaaagctggattagacggtgtcgtatgttctcctcttgaggctaagatgatttctaaagaactaggttctgactttttaaaagtgacaccaggtattcgcccgaaaggcgcagctcgtaatgatcaacaacgaattacaacacctgaggaagctaaaactttggggtcaacacatatcgtagtaggtcgacctatcactcaaagtgagcatccaattgacagttatcataaaataaaagaaagttggttaagttaa

SEQ ID NO: 16707 - protein, 230 aa, Staphylococcus epidermidis RP62A
MRNLPIIALDFKSADEVHTFLNKFNEPLCVKIGMELFYQTGPALIKSIKKRGHDIFLDLKLHDIPNTVSKAMEGLARLDIDLVNVHAAGGIKMMEEAKKGLRKHNADIKIIAVTQLTSTTERQLHEEQNIQTSIEEAVLNYARLTKKAGLDGVVCSPLEAKMISKELGSDFLKVTPGIRPKGAARNDQQRITTPEEAKTLGSTHIVVGRPITQSEHPIDSYHKIKESWLS

SEQ ID NO: 16708 - DNA, 711 bp, Gluconobacter oxydans 621H
  CDS (1)..(711): transl_table=11
atgtccaggcgcacacgactgatcgcagccctcgataccgcatcccgctccacagcccaggactgggccgacagcctgaaaaatgacgtcgacgccatcaagctgggtctcgagtttacctatgcctgcggactggatgcggtaaaaaccgtatcggccgggcacgaactgtttctggacctgaagctgcacgacattccccataccgtcgcatcaggtctgactgccctcgccccgctcaggccagccctgacgacaatccatgccagtggcggttccgaaatgatcgcccggtcccgggaagctcttgagagcgcttttcccgctgacacaaaacgcccgaaactgcttgccgttacggttctgacgagcatgaacgctgagggtctgttggacatcggcgtcaacgccacgccccaggaacaggtgctcagacttggaaaactggctatcagcgctggtgccgacggtctggtctgttcggcgcatgagattgcgcctctacgcgatgcattgggtgacgagcccgttctggtcgtgccgggcatccgtcctgctggcagcgcgtccgacgaccagaagcgcatcatgacgcccggacaggctgcccaagccggcgccgactggatcgtcgtagggcgccccatcacgaaagccgcagatccagttctggccgccagagccatcatggaggaactggccagcgcatga

SEQ ID NO: 16709 - protein, 236 aa, Gluconobacter oxydans 621H
MSRRTRLIAALDTASRSTAQDWADSLKNDVDAIKLGLEFTYACGLDAVKTVSAGHELFLDLKLHDIPHTVASGLTALAPLRPALTTIHASGGSEMIARSREALESAFPADTKRPKLLAVTVLTSMNAEGLLDIGVNATPQEQVLRLGKLAISAGADGLVCSAHEIAPLRDALGDEPVLVVPGIRPAGSASDDQKRIMTPGQAAQAGADWIVVGRPITKAADPVLAARAIMEELASA

SEQ ID NO: 16710 - DNA, 708 bp, Lactobacillus acidophilus NCFM
  CDS (1)..(708): transl_table=11
atggacagacccgtaattgttgctctagatttagataatgaagaacaactaaataagatcttaagtaaattaggcgacccgcatgatgtttttgtcaaagttggcatggaacttttttataatgcaggcattgatgtaatcaagaagttaacgcagcaaggctataagattttcttagatttaaaaatgcatgatattccaaatactgtttataacggagctaaagctttagctaaacttggcatcacctttacaacggttcatgcacttggtggtagccaaatgattaaatccgccaaagacggtttaattgccggaacacctgctggtcatagtgtaccgaaattacttgcagttactgaattaacttcgatctcggacgatgttttgagaaatgaacaaaattgccgtttgccaatggctgaacaagtattgagcttagccaagatggctaagcattctggagccgatggggtgatctgctcaccacttgaagtaaaaaaattgcatgagaatatcggtgacgatttcttatatgtcactccaggcattcgtccagctggcaatgctaaggatgatcaatcccgtgtggctacaccaaagatggctaaagaatggggctcaagcgcaatcgtggtaggtcggcccattactttagcaagtgatcccaaggcagcatatgaagcaattaagaaggagtttaactaa

SEQ ID NO: 16711 - protein, 235 aa, Lactobacillus acidophilus NCFM
MDRPVIVALDLDNEEQLNKILSKLGDPHDVFVKVGMELFYNAGIDVIKKLTQQGYKIFLDLKMHDIPNTVYNGAKALAKLGITFTTVHALGGSQMIKSAKDGLIAGTPAGHSVPKLLAVTELTSISDDVLRNEQNCRLPMAEQVLSLAKMAKHSGADGVICSPLEVKKLHENIGDDFLYVTPGIRPAGNAKDDQSRVATPKMAKEWGSSAIVVGRPITLASDPKAAYEAIKKEFN

SEQ ID NO: 16712 - DNA, 696 bp, Ehrlichia ruminantium str. Gardel
  CDS (1)..(696): transl_table=11
atgaagcataatccaattatttgtgcattggatactcatgatatacataaggcattgcgattgacaaagatgttatatgaaaagatatctatggtgaaattaggattggaattctttgtagcacatggaatatctggtgtacagagaatatctgattgtggaattccaatatttcttgatttaaagttacatgatattcctaatactgtgagtcgtgctatatcagtaattaagtctttaaatattgctatgcttactattcatattagtggtggtcaagaaatgatgaaaagaaccatggatgttatatttgatagtatgcttaagataataggtgtgactgtacttacaagtattgatgtttgtgacttaaaggaaataggtattgggaattctacagtgcaacaagttattttattatcaaaacttgctcaaaaagtaggattatatggtatagtttgttctcctcttgaggtgaaggaggttcgtgcacaatgtgataaagatctaaaaattatagtgccaggtataagattaggagataatattgatgatcagaaaagaactgattctcctaaaagtgcaatattgtctggagcagattatttagtgatagggcgcccaattactgaaaatactgatcctgtaaaagtagttgatattattctttcatcaatagcggatttacacaattaa

SEQ ID NO: 16713 - protein, 231 aa, Ehrlichia ruminantium str. Gardel
MKHNPIICALDTHDIHKALRLTKMLYEKISMVKLGLEFFVAHGISGVQRISDCGIPIFLDLKLHDIPNTVSRAISVIKSLNIAMLTIHISGGQEMMKRTMDVIFDSMLKIIGVTVLTSIDVCDLKEIGIGNSTVQQVILLSKLAQKVGLYGIVCSPLEVKEVRAQCDKDLKIIVPGIRLGDNIDDQKRTDSPKSAILSGADYLVIGRPITENTDPVKVVDIILSSIADLHN

SEQ ID NO: 16714 - DNA, 678 bp, Wolbachia endosymbiont strain TRS of Brugia malayi
  CDS (1)..(678): transl_table=11
atgaatccaataatatgcgcactagacacgcaagacttaaatgaggccatatccttggctaatactttgcgtgacaaggttggcatgataaagctggggttagaatttttcgccgctcatggtccttctggagtgagagaagttgcaaagtgcaatgtaccaacttttttggatctgaaattgcacgacattccaaacactgtagctaaaacagttgaagcgataaaagttctgaatattgaaatattaacattacatatcagcggtggaacaaaaatgcttgaagaggctctaagtatagtgaaagacacaaaaacgaaactaattggagtaacagtattaaccagtatgagcaatgaggatttgagcgaacttggaatagcaagagaggtaaaatcacaggtaattctgtttgcaaagcttgcaaagaaggttggactacacggaatagtctgctcggcattagaagctcaagaagtgtatcaagaatgtggtaaagactttaaaattattacttcaggaattcgtgtaggttttggtcatgatgaccaaaaaaggacagcgacaccaaaagaagcaataaattcaggagctgattatattgtaattggtagacctattacaaaaagtaatagtcctgcaaacagtgcagaattaatattgaaatcacttagttaa

SEQ ID NO: 16715 - protein, 225 aa, Wolbachia endosymbiont strain TRS of Brugia malayi
MNPIICALDTQDLNEAISLANTLRDKVGMIKLGLEFFAAHGPSGVREVAKCNVPTFLDLKLHDIPNTVAKTVEAIKVLNIEILTLHISGGTKMLEEALSIVKDTKTKLIGVTVLTSMSNEDLSELGIAREVKSQVILFAKLAKKVGLHGIVCSALEAQEVYQECGKDFKIITSGIRVGFGHDDQKRTATPKEAINSGADYIVIGRPITKSNSPANSAELILKSLS

SEQ ID NO: 16716 - DNA, 732 bp, Xanthomonas oryzae pv. oryzae KACC10331
  CDS (1)..(732): transl_table=11
atgagccgggcgccgctgccgctggccgcccatgagcggctgatcttcgcgctggatgtgcccagccacgatgaggcgatcgcctgggtggaccggcttggcgattcggtggcgttctacaagatcggcatggaactgctggcctccggcgagtacttccatgtgctcgatgcgctggccaagcgcgacaagcgcgtgttcgtggatcttaaattcttcgacattcccgccaccgtggccggcaccatccgtcgcctggcacagtggccggtgagctattgcaccgtgcacggctggcacgccggcatgctgcaggctgccgccgacgccaaccacggcgccatgcgtctgctggcggtgaccgtgctgacctcgatgggccgcccggacctggcggcgatgggcatcgaccgcgaaccggtggacgtggtggtggagcgcgcgctggccgcagaggccgccggcatcgatggcgtcatcgcctccggccaggaagccggcccgatccgccgcgccaccggcccggccttttcgatcgtctgccccggcatccgccccggaggcccggtcgccgacgatcagcaacgcatagtgggcgtggcgcaggccttcaccgacggcgccgatgccatcgtcgtcggccgcccgatccgcctggccgccgatccggccgcggctgcggcggcgatccaggcagagatccttgcggcggtggggcaggaccgcagctga

SEQ ID NO: 16717 - protein, 243 aa, Xanthomonas oryzae pv. oryzae KACC10331
MSRAPLPLAAHERLIFALDVPSHDEAIAWVDRLGDSVAFYKIGMELLASGEYFHVLDALAKRDKRVFVDLKFFDIPATVAGTIRRLAQWPVSYCTVHGWHAGMLQAAADANHGAMRLLAVTVLTSMGRPDLAAMGIDREPVDVVVERALAAEAAGIDGVIASGQEAGPIRRATGPAFSIVCPGIRPGGPVADDQQRIVGVAQAFTDGADAIVVGRPIRLAADPAAAAAAIQAEILAAVGQDRS

SEQ ID NO: 16718 - DNA, 705 bp, Vibrio fischeri ES114
  CDS (1)..(705): transl_table=11
atgaaagaccaaaaggtgatcgtggcactggattatgataatcaagcagatgcgttaacgtttgttgataaaattgatccaagttcatgtcgtttaaaagtaggcaaagagatgtttactttatttgggcctgagtttgttaaagaacttcataaacgtggtttttctgtttttctagatttaaagtttcatgatattccaaatacctgttcaaaagcggtaagagcggcagcagaaatgggtgtatggatggttaacgttcatgcgagtggtggtgagcgtatgatgagtgcctcgcgtgaaatattagaaccttatggtagtgaccgtccattattaattggtgtgacggtgttaacgagcatggagcagcaagacttagctggcattggtctagacatagcaccacaagaacaagtaaaacgtttagcggcattaacgaaaaacagcggtttagatggtgtcgtatgttcagctcaagaggcatcaatgctaaaagctgatttaggtaaagagttccagttagtaacaccaggaattcgtccagcaggtgctgatgttggtgaccaaaagcgtattatgacgccagtagatgcgattacagcaggttctgactacctagttataggtcgcccgattacacaagcggagaatccatcacaggtccttaatgagattaatctttctctcgcttctgttttataa

SEQ ID NO: 16719 - protein, 234 aa, Vibrio fischeri ES114
MKDQKVIVALDYDNQADALTFVDKIDPSSCRLKVGKEMFTLFGPEFVKELHKRGFSVFLDLKFHDIPNTCSKAVRAAAEMGVWMVNVHASGGERMMSASREILEPYGSDRPLLIGVTVLTSMEQQDLAGIGLDIAPQEQVKRLAALTKNSGLDGVVCSAQEASMLKADLGKEFQLVTPGIRPAGADVGDQKRIMTPVDAITAGSDYLVIGRPITQAENPSQVLNEINLSLASVL

SEQ ID NO: 16720 - DNA, 741 bp, Neisseria gonorrhoeae FA 1090
  CDS (1)..(741): transl_table=11
atgaatcctttaatcaccgacttccaaactccgcaacaacgtacccccgtcatcgttgcccttgattttgccaacgaaaaagacacgctcggattcgtccgcaaccttgatccggcgttgtgccaaatcaaaatcggcaaagagctgtttaccgctacggggcgcagtttggcggaaagcctgattcatcagggtttcaaactctttcttgatttgaaataccacgatattccccacaccgtcgcgcaggcgtgtaaagtcgccgccgatatgggcgtgtggatggtcgatatgcacgcgtcgggcggcagacgtatgatggaagccgccgccgaagccgttgccggatacggcacgaaaccgctcttaatcggcgtaaccgtgttgaccagcatggagcaaagcgatttggcggaaatcggtttgaacaccgcccctgaagaacaagtcatccgtttggcaaaactggcacaaagttcgggcttggacggcgtggtctgttccgcccaagaagccgcgccgctgcgccgcgaattgggacgggattttgtcttggttacaccgggtatccgcttggacgttgccggcaacaacgacgaccaacgccgcattatgacacccgccgaagccttggcggcgggttcgacttatctggtgatgggccgccccgttacccgagccgccgatccggtcgccgtattgcgcgaagtgaaccgcgtggcaaaccttgaagcaaactga

SEQ ID NO: 16721 - protein, 246 aa, Neisseria gonorrhoeae FA 1090
MNPLITDFQTPQQRTPVIVALDFANEKDTLGFVRNLDPALCQIKIGKELFTATGRSLAESLIHQGFKLFLDLKYHDIPHTVAQACKVAADMGVWMVDMHASGGRRMMEAAAEAVAGYGTKPLLIGVTVLTSMEQSDLAEIGLNTAPEEQVIRLAKLAQSSGLDGVVCSAQEAAPLRRELGRDFVLVTPGIRLDVAGNNDDQRRIMTPAEALAAGSTYLVMGRPVTRAADPVAVLREVNRVANLEAN

SEQ ID NO: 16722 - DNA, 738 bp, Salmonella enterica subsp. enterica serovar Choleraesuis str
  CDS (1)..(738): transl_table=11
atgacgtttactgcttcatcttcttcctgcgctattactgaatcgcctgtcgttgtggcgttggattaccatgaacgcgataaagccctggcgtttgtcgataaaatcgatcctcgcgattgtcgcttaaaagtgggcaaagagatgttcacgctgtttggtccacaactcgttcgggatctccagcagcgtgggtttgatgtctttcttgatctaaaatttcatgatattcccaacaccacggcccgggcggtcgctgcagcggcagacctgggcgtctggatggtaaacgttcatgcgtctggcggggcgagaatgatggccgcagcgcgcgacgcgctggcgccattcggtaaagatgcgccgttgctcattgccgtgaccgtgttgaccagtatggaaaccagcgatctgcgcgatctgggcgtgacgttgtcaccggcggaacatgcggagcggttggtgcgcctgacgcagcaatgcgggctggatggcgtggtctgttccgctcaggaagcggtcagatttaaacaggtctttggcgctgcatttaagctggtgacgccgggcattcggcccgcaggcagcgaggcaggcgaccagcgacgcattatgacgcccgaacaggcattatccgctggcgtcgactatatggtgattggccgcccggttacgcaatcggtagatccggcgcaaacgctgaaggatattaacgcgtcactgaaacgggaggcataa

SEQ ID NO: 16723 - protein, 245 aa, Salmonella enterica subsp. enterica serovar Choleraesuis str
MTFTASSSSCAITESPVVVALDYHERDKALAFVDKIDPRDCRLKVGKEMFTLFGPQLVRDLQQRGFDVFLDLKFHDIPNTTARAVAAAADLGVWMVNVHASGGARMMAAARDALAPFGKDAPLLIAVTVLTSMETSDLRDLGVTLSPAEHAERLVRLTQQCGLDGVVCSAQEAVRFKQVFGAAFKLVTPGIRPAGSEAGDQRRIMTPEQALSAGVDYMVIGRPVTQSVDPAQTLKDINASLKREA

SEQ ID NO: 16724 - DNA, 717 bp, Brucella abortus biovar 1 str. 9-941
  CDS (1)..(717): transl_table=11
atgacgacagaattgcacgatgacgcatccgggcgcctgatcgtgggccttgacgtgccgacaattgccgaggcggaaaaggtggtcgaagaactgggcaatgctgtttccttctacaagatcggctatcagcttgtttttgccggtgggcttgatttcgccaaaagccttgtggcggcgcgcaaaaaagtcttcctcgacatgaagctgctcgatatcgacaacacgattgccaaaggcgtggaaaatgtcgcgaagatgggtgtttccatgctcacgcttcatgcctatccgaaggcaatgcgtgcggcggtggaagccgccagagggtcggacctatgccttttgggcgtgacggtcctgacctccatggacaatgccgatcttcgggaagccggttatttcgacaatgcggaaacgctggtgctgaaacgtgcccgtcaggcgcatgaggccggtatgggcggcattgtcgcctcggcggtggaggcgcaggccattcgccaggcggttcgccccgatatggccatcgtcacaccgggcatccgcccggcagggagcgagaagggcgaccagaagcgcgtgatgacgccagccgatgccttgagggccggtgcgagccatctcatcgtggcgcgcccgatcgtgggcgcaccggatcgcaaggcggcagcccttgccatcctgaaggaaatgcgctcgattggaagaagttag

SEQ ID NO: 16725 - protein, 238 aa, Brucella abortus biovar 1 str. 9-941
MTTELHDDASGRLIVGLDVPTIAEAEKVVEELGNAVSFYKIGYQLVFAGGLDFAKSLVAARKKVFLDMKLLDIDNTIAKGVENVAKMGVSMLTLHAYPKAMRAAVEAARGSDLCLLGVTVLTSMDNADLREAGYFDNAETLVLKRARQAHEAGMGGIVASAVEAQAIRQAVRPDMAIVTPGIRPAGSEKGDQKRVMTPADALRAGASHLIVARPIVGAPDRKAAALAILKEMRSIGRS

SEQ ID NO: 16726 - DNA, 735 bp, Pseudomonas syringae pv. syringae B728a
  CDS (1)..(735)
atgcgcgccgatttcgacttacctgagaccacgctcatgtccgcctgccagactcctgtcatcgtcgccctggattttccgacccgcgaagccgccttgcgcctggctgatcagctcgaccccaaactgtgcagggtcaaggtcggcaaggaactgttcaccagttgcgcggccgacatcgtcgagaccctgcgccacaggggcttcgaagtgtttctggatctcaaattccacgacatccccaacaccacggcgatggcggtcaaggcggcggccgagatgggcgtgtggatggtcaatgtgcactgctcgggcggcttgcgcatgatggcggcctgtcgggaagtgcttgagcagcgcaccggtccacagccgttgctgatcggcgtgaccgttctgaccagcatggaacgtgaagacctggccggtatcggcctggacatcgacccgcaggtacaggtgctgcgccttgcggctctggccgggaaggccggaatggatggtctggtctgctcggcactggaagcgcaggccctgaaagccgctcacccgtcgttgcaactggtgacgcccggcatccgtccggcgggcagtgcgcaggacgatcagcgccgtatcctgacccctcgtcaggcactggatgcaggctctgactacctcgtcatcggccgcccgatcagccaggcggctgatccggcgaaggccctggcggcggtggttgccgagctggcttga

SEQ ID NO: 16727 - protein, 244 aa, Pseudomonas syringae pv. syringae B728a
MRADFDLPETTLMSACQTPVIVALDFPTREAALRLADQLDPKLCRVKVGKELFTSCAADIVETLRHRGFEVFLDLKFHDIPNTTAMAVKAAAEMGVWMVNVHCSGGLRMMAACREVLEQRTGPQPLLIGVTVLTSMEREDLAGIGLDIDPQVQVLRLAALAGKAGMDGLVCSALEAQALKAAHPSLQLVTPGIRPAGSAQDDQRRILTPRQALDAGSDYLVIGRPISQAADPAKALAAVVAELA

SEQ ID NO: 16728 - DNA, 693 bp, Haemophilus influenzae 86-028NP
  CDS (1)..(693): transl_table=11
atgacaagcaaaattattgtggcattggattatgagaaagaagcagaggctcttgctttagttgatcaaattgatccaagtttgtgtcgattaaaagtgggtaaagaaatgtttactacacttggtattaattttgtaaaacaattacatcaacgtaactttgatgtttttttggatcttaaatatcacgatattccaaatacggtagcaagagcagttcgttctgctgctgatttaggcgtatggatggtggatttacacgcaagtggtggtttgcgtatgatggaagaggcgaagaaaattcttgaaccttatgggaaagatgcaccattgcttattgccgtgacggtattaaccagtatggaagatttggatttattacaaattgggattaatgcatcgccaatggaacaagttttacgcttagctcatttaacccaacgggcgggtttagatggtgtagtctgttcccctcaagaagttgaaattttacgtaatacttgtggtaaagagtttaaattagttacaccggggattcgtccaataggaactgattttggtgatcaacgacgtgtgatgacgcctactgcagcaattcgtgcaggttcagattatttagttattggacgccctataactcaagcggataatcctgcggaggttctccgttctattaatgtatctattgggtaa

SEQ ID NO: 16729 - protein, 230 aa, Haemophilus influenzae 86-028NP
MTSKIIVALDYEKEAEALALVDQIDPSLCRLKVGKEMFTTLGINFVKQLHQRNFDVFLDLKYHDIPNTVARAVRSAADLGVWMVDLHASGGLRMMEEAKKILEPYGKDAPLLIAVTVLTSMEDLDLLQIGINASPMEQVLRLAHLTQRAGLDGVVCSPQEVEILRNTCGKEFKLVTPGIRPIGTDFGDQRRVMTPTAAIRAGSDYLVIGRPITQADNPAEVLRSINVSIG

SEQ ID NO: 16730 - DNA, 768 bp, Rhodobacter sphaeroides 2.4.1
  CDS (1)..(768)
atggcccggcttgacacgcagcagccctcgtcccatcacccgcccgacctcagcagcaaggagcttcccatggccgacgaccgtctgatcgtggcactcgatgtgccgaacgtcgtgcaggggctggatctcgcggagcggctcggcgatgcggtctcgttctacaagatcggcttgggcatgctgaccggcggcggcctcgcgctggccaacgagctgaagcaggaacggggcaagcgcatcttcctcgacatgaagctcttcgacatcggcgcgaccgtcgaggccgccgtgcggggcttcgcgagctacgatctcgatttcctgacggtccatggcgatccgcaggtggtgcgggccgcggtgcagggcgcctcgggcagcgggctgcgcatcctcgcggtgacggtgctgacctcgctcgaccgggcggatctcgatgcgaacatgatccgggcgggcgatctggccgagatcacgctcgagcgggcggcacgggcgctggatgcgggcgcgcatggggtgatcgcgagcccgcaggaggcggcggcgatccgggccctgccgcaggcggcggggcggctgatcgtgacgccgggcgtgcggcccacgggcgccgcgctcggagatcagaagcgggtggcgacccccgcccgcgcgatcgcggacggggcggaccatatcgtcgtcggccggccgatctggcaggccggggatccgcgggccgcggctctcgccgttcaggcagagcttccgacccgcggctga

SEQ ID NO: 16731 - protein, 255 aa, Rhodobacter sphaeroides 2.4.1
MARLDTQQPSSHHPPDLSSKELPMADDRLIVALDVPNVVQGLDLAERLGDAVSFYKIGLGMLTGGGLALANELKQERGKRIFLDMKLFDIGATVEAAVRGFASYDLDFLTVHGDPQVVRAAVQGASGSGLRILAVTVLTSLDRADLDANMIRAGDLAEITLERAARALDAGAHGVIASPQEAAAIRALPQAAGRLIVTPGVRPTGAALGDQKRVATPARAIADGADHIVVGRPIWQAGDPRAAALAVQAELPTRG

SEQ ID NO: 16732 - DNA, 708 bp, Lactobacillus gasseri
  CDS (1)..(708)
atgacaagaccagttatcgttgccttagatttagacaatgaaaagaaattaaatgaactcttacctaagctaggtaaaccagaaaatgtttttattaaaattggaatggaactcttttttaatgaaggtcctgcaattgttagaaacttatctagacaaggctaccaaatttttttagatttaaagatgagtgatatacctaataccgtctacaatggtgctaaagccttagctcaattaggaatcacttatactactgtccatgctcttggtggtagtcaaatgattaaagcagcaaaagaaggtttaattgctggcaccccggtcggtaaaaatatccctaaattattagctgttacagaattaacttcaatttctgatgatattttgcacgaagaacaaaattgtaacttatcaatgaaccagcaagttttaagtctagctgaaactgccaaaaaggctggagctgatggagtaatttgttcaccattagaagttaagaatttgcgtcaaaatgttggcgatgactttttatacgtaactcctggcattcgcccagcaggaaatgccaaagatgatcaatctagagtagctaccccagcccaagcaaaagaatggggttcaaccgctatcgtcgtaggacgaccgattaccctagcaactaatccagaagcagcatacgaagcaattaagaaggagttcaactaa

SEQ ID NO: 16733 - protein, 235 aa, Lactobacillus gasseri
MTRPVIVALDLDNEKKLNELLPKLGKPENVFIKIGMELFFNEGPAIVRNLSRQGYQIFLDLKMSDIPNTVYNGAKALAQLGITYTTVHALGGSQMIKAAKEGLIAGTPVGKNIPKLLAVTELTSISDDILHEEQNCNLSMNQQVLSLAETAKKAGADGVICSPLEVKNLRQNVGDDFLYVTPGIRPAGNAKDDQSRVATPAQAKEWGSTAIVVGRPITLATNPEAAYEAIKKEFN

SEQ ID NO: 16734 - DNA, 708 bp, Magnetospirillum magnetotacticum MS-1
  CDS (1)..(708)
ttgatcaatcccgtctatgtcgccatcgataccaccgaggccgcccgcgccatctcccttgccgaacgcctgaaggggcaggtcggcggtttcaagctgggcctggaatacttcaccgccaacggccccgccggtatggaggcggtgtcgggtctgggcatgccgctcttcgtcgatctcaagctgcatgacattcccaataccgtggccgccgccatgaagggcgtggtccgtctgggcgccgccatcaccaccattcatgcctcgggcggcgccgccatgatccgcgccgccgtcgatgccgccaatgacgaggcggccaagttgggcatcgccccgcccgccgtggtggcggtgaccgtgctgaccagcctggatcaggccggggccgagcaggtgggtttcgatcgtccggtgctcgatcaggtcaagcgcctcgccgccctggcccaggacagcggcgcagccggtatcgtctgttcgcccctggaagtggaggcggtgcgcgcgctctgcggtcccgatttcaagctggtcattccgggcatccgcccggcctggagcgaagcgggtgaccagaagcgctttcttacccccgccgaggcccgcgccaagggcgccgatgtcctggtgatcgggcggcccatcaccggcgccgccgatccggccgaggccgccgcgcggatcaaggccgaactggggctttaa

SEQ ID NO: 16735 - protein, 235 aa, Magnetospirillum magnetotacticum MS-1
MINPVYVAIDTTEAARAISLAERLKGQVGGFKLGLEYFTANGPAGMEAVSGLGMPLFVDLKLHDIPNTVAAAMKGVVRLGAAITTIHASGGAAMIRAAVDAANDEAAKLGIAPPAVVAVTVLTSLDQAGAEQVGFDRPVLDQVKRLAALAQDSGAAGIVCSPLEVEAVRALCGPDFKLVIPGIRPAWSEAGDQKRFLTPAEARAKGADVLVIGRPITGAADPAEAAARIKAELGL

SEQ ID NO: 16736 - DNA, 696 bp, Leuconostoc mesenteroides subsp. mesenteroides ATCC 8293
  CDS (1)..(696)
atgacagaacagccagtttttattgctttggactttcctgatgcaactactacttacaaatttttgaagcctttttcagatttagtagaaaagccagcattgaaagttggtatggaacttttttatcgtacgggaccagagttcatcacagaactacgtgcattgggctatacgattttcttagatttaaaactttacgatattccaaacactgttggtcgtgcagtcgctaatatatcaaaactagatgtacaatatttaactctgcatgcagctggagggaaaaaaatgctagaagcagctgttgccaataaaagtgaagcgttaaaattacttgcagtgacgcagctaacttctttttctgaagctgagatacaagagatacaattaaccacagcaactattgaagaaagtgttgcacatttggctgagcttgcttactcggtgggcatagacgggacaattagttcacccttagaggctggtttaattaagtcacacacgaatgatcgatttttacgtatcacacctggtattcgtttagctggtgatgaagctggagatcaagtgcgtgtaactacgccagcggaagccaagaaattgaattcaactggattagttgttggtcgatcaattacacaatcgaccaacccagtggctgcatatcaatgtgttgtcaatgaatggagaaaataa

SEQ ID NO: 16737 - protein, 231 aa, Leuconostoc mesenteroides subsp. mesenteroides ATCC 8293
MTEQPVFIALDFPDATTTYKFLKPFSDLVEKPALKVGMELFYRTGPEFITELRALGYTIFLDLKLYDIPNTVGRAVANISKLDVQYLTLHAAGGKKMLEAAVANKSEALKLLAVTQLTSFSEAEIQEIQLTTATIEESVAHLAELAYSVGIDGTISSPLEAGLIKSHTNDRFLRITPGIRLAGDEAGDQVRVTTPAEAKKLNSTGLVVGRSITQSTNPVAAYQCVVNEWRK

SEQ ID NO: 16738 - DNA, 732 bp, Nostoc punctiforme PCC 73102
  CDS (1)..(732)
atggggaatggtggacaggcagaacaacgagttattgtggcattggatgtgccagatgaacaaagtgcgatcgctcttatagatcaactcccgcaagtcggtttttggaaagtcggcttagagttgtttaccagcactggccccaaaattctggaagtcctaaagtctaaggaaaagcgcattttcttagatttaaagtttgatgatatccccaacaccgttgctggtgcttgccggagtgcagctagatacggagtggatttgctgacgattcatgctacctgtggtagagatgccctgaaagccgcaattgaggcggcacacgaaggggctgtaaaagcaggtgtacaaccaccaaagttaattgctattaccctgctgacgagcatttctgctaggcagttggcgtttgatttaaaaatacctctggaattgccagaatatgctctagaaatggccctgctggctcaagaatgtggtttggatggggtagtttgttcgcctcaagaagtggcacagctacgagagacttgtggagatcgctttttgctagtttgtcccggcgttagaccaacttgggcagataatgcagatcaaaagcgatcgctcactccagcacaagccatgaaagctggtgcagattatttagtaattggccgtcccattactactgctactgagccagagttagcctggaaaaggatttctgaggagttaaccacagtggcatga

SEQ ID NO: 16739 - protein, 243 aa, Nostoc punctiforme PCC 73102
MGNGGQAEQRVIVALDVPDEQSAIALIDQLPQVGFWKVGLELFTSTGPKILEVLKSKEKRIFLDLKFDDIPNTVAGACRSAARYGVDLLTIHATCGRDALKAAIEAAHEGAVKAGVQPPKLIAITLLTSISARQLAFDLKIPLELPEYALEMALLAQECGLDGVVCSPQEVAQLRETCGDRFLLVCPGVRPTWADNADQKRSLTPAQAMKAGADYLVIGRPITTATEPELAWKRISEELTTVA

SEQ ID NO: 16740 - DNA, 525 bp, Pseudomonas syringae pv. syringae B728a
  CDS (1)..(525)
atgtttctggatctcaaattccacgacatccccaacaccacggcgatggcggtcaaggcggcggccgagatgggcgtgtggatggtcaatgtgcactgctcgggcggcttgcgcatgatggcggcctgtcgggaagtgcttgagcagcgcaccggtccacagccgttgctgatcggcgtgaccgttctgaccagcatggaacgtgaagacctggccggtatcggcctggacatcgacccgcaggtacaggtgctgcgccttgcggctctggccgggaaggccggaatggatggtctggtctgctcggcactggaagcgcaggccctgaaagccgctcacccgtcgttgcaactggtgacgcccggcatccgtccggcgggcagtgcgcaggacgatcagcgccgtatcctgacccctcgtcaggcactggatgcaggctctgactacctcgtcatcggccgcccgatcagccaggcggctgatccggcgaaggccctggcggcggtggttgccgagctggcttga

SEQ ID NO: 16741 - protein, 174 aa, Pseudomonas syringae pv. syringae B728a
MFLDLKFHDIPNTTAMAVKAAAEMGVWMVNVHCSGGLRMMAACREVLEQRTGPQPLLIGVTVLTSMEREDLAGIGLDIDPQVQVLRLAALAGKAGMDGLVCSALEAQALKAAHPSLQLVTPGIRPAGSAQDDQRRILTPRQALDAGSDYLVIGRPISQAADPAKALAAVVAELA

SEQ ID NO: 16742 - DNA, 708 bp, Desulfovibrio desulfuricans G20
  CDS (1)..(708)
atgatgccggaacttgtggttgctcttgattatcctgaaagcgaacaggctgttgccatggctgcacggctgcaaggaagctgcccctgggtcaaggtggggcttgaactgtacacggccgccgggccggacatcctgcgccgtctcaaagacatggggttttctgtttttctcgatctgaagtttttcgacattcccaataccgtccgcggtgcggtgcgttcatcggtctgcgccggtgcggacatggtcaacattcatctgctggggggcgcccgtatggcgcaggccgccgtgcaggggctgcaggaaggctgtgaatgcaaggggcttgctgcgccgccggtgctgctgggcgtgacagtgcttaccagtatggcccagcaggatctgcctgccggtcttgacctgccgctggacagcgtggtggatgtgctggcgcgctccggcagagagtggggcttgaacggtgtcgtgtgttcggggtatgaagttgaaagcatcaaaaaaagctgtggtacagactacatctgtcttactccgggcatccggcccgccgcggcggatgacgaccagcgcagaaccatgaccccgcagcaggctgcgcgggccggttccgactatctggttgtgggcagacccgttaccggagccgctgacccggccggggccgcgtacagcatcatggaatctgtccggcaggcgtag

SEQ ID NO: 16743 - protein, 235 aa, Desulfovibrio desulfuricans G20
MMPELVVALDYPESEQAVAMAARLQGSCPWVKVGLELYTAAGPDILRRLKDMGFSVFLDLKFFDIPNTVRGAVRSSVCAGADMVNIHLLGGARMAQAAVQGLQEGCECKGLAAPPVLLGVTVLTSMAQQDLPAGLDLPLDSVVDVLARSGREWGLNGVVCSGYEVESIKKSCGTDYICLTPGIRPAAADDDQRRTMTPQQAARAGSDYLVVGRPVTGAADPAGAAYSIMESVRQA

SEQ ID NO: 16744 - DNA, 693 bp, Actinobacillus pleuropneumoniae serovar 1 str. 4074
  CDS (1)..(693)
atggataataaaattattgttgctttagactatgaaacagaatatgaagcattgagttttgtagatcaagttgatccgtctctttgtcgtgtgaaagtgggcaaagaaatgtttacgacgttaggcacgaattttgttaaacaattacacgaacgtaaatttgatgttttccttgatttaaaatatcacgatattccgaataccgtggctcgtgcggtacgttccgctgcggatttaggcgtgtggatggtggatttgcacgcttcgggcggcttaaccatgatggaggaagcgaaaaaaatcttagagccgtacggtaaagatgcgccgttacttattgcggtaacggttttaaccagtatggaagatttagacttattacaaatcggtattaacgcttcgccgatggaacaggtgattcgtttggcgcaccttgcgcaacgtgccggcttagacggtgtggtttgttctccgcaagaagtagaagtgcttcgtacgcattgtggtaaagattttaaattagtgacgccgggtattcgtccggagggttctgatgtcggcgatcaacgtcgaattatgacgcctaaacaagcgattgaaaccggatccgattatttggttatcggtcgtccgattacacaggctcaagacccgttatcggtattaaaatcaattaacgcctctattcgttaa

SEQ ID NO: 16745 - protein, 230 aa, Actinobacillus pleuropneumoniae serovar 1 str. 4074
MDNKIIVALDYETEYEALSFVDQVDPSLCRVKVGKEMFTTLGTNFVKQLHERKFDVFLDLKYHDIPNTVARAVRSAADLGVWMVDLHASGGLTMMEEAKKILEPYGKDAPLLIAVTVLTSMEDLDLLQIGINASPMEQVIRLAHLAQRAGLDGVVCSPQEVEVLRTHCGKDFKLVTPGIRPEGSDVGDQRRIMTPKQAIETGSDYLVIGRPITQAQDPLSVLKSINASIR

SEQ ID NO: 16746 - DNA, 714 bp, Fusobacterium nucleatum subsp. vincentii ATCC 49256
  CDS (1)..(714): transl_table=11
atgaaaaaagaaattataatagcacttgattttcctactttggaaaaaacactagactttttagataagttcaaagaggaaaaattatttgtaaaagttggaatggaactatatttacaaaatggaccaatagtaatagatgaaatcaaaaaaagaggacataaaattttcttagatttaaaattacatgatattccaaatactgtttactctgctgcaaaaggtttagctaaatttaatattgatatcttaactgttcatgcagctggtggttctgaaatgttaaaaggagctaaaagagctatgacagaagcaggagtaaatacaaaggttattgctataactcaacttacttctacaagtgaagaagatatgagaaaagaacaaaatatacaaacaagtatagaagaatctgttttaaactatgcaagacttgcaaaagaaagtggagttgatggggttgtatcttctgtccttgaaacaaagaaaattaggggacaaagtggagaagatttcattataataaatccaggaataagattagcagaagattcaaaaggtgaccaaaagagagtagctactccaatagacgctagtagagatggagcaagttatattgttgttggaagatcaataactggaaatgcaaatccagaagagagatatagacttataaaaaatatgtttgaaatgggggataaatatgttggatag

SEQ ID NO: 16747 - protein, 237 aa, Fusobacterium nucleatum subsp. vincentii ATCC 49256
MKKEIIIALDFPTLEKTLDFLDKFKEEKLFVKVGMELYLQNGPIVIDEIKKRGHKIFLDLKLHDIPNTVYSAAKGLAKFNIDILTVHAAGGSEMLKGAKRAMTEAGVNTKVIAITQLTSTSEEDMRKEQNIQTSIEESVLNYARLAKESGVDGVVSSVLETKKIRGQSGEDFIIINPGIRLAEDSKGDQKRVATPIDASRDGASYIVVGRSITGNANPEERYRLIKNMFEMGDKYVG

SEQ ID NO: 16748 - DNA, 699 bp, Psychrobacter sp. 273-4
  CDS (1)..(699)
atgaacaacgcaatcaattctcctgtcatcgttgcattagacaatatgacaaagaatgcctctcttgcgttagctgaccaattagatccggcgttatgccgattaaaagtaggtaaagagctgtatacccggtgtggtcctgagatagtcaaagcactacatcaacgccaatttgaagtttttttagacttaaaatttcatgatatcccgaataccaccgcacaagcagtattggctgccgctgagcttggtatatggatggtcaacgtccatgccagtgcagggctagaagcgatggcattggcaaagcagcgcttactagatagtgattttgacacgctactgattgcagtgactgtcttaacgtctatggacaatgaagcactcatgcaaactggtatcaccgacggcttagatgcacaagttagccgcttagcacaattgaccaagcaagcaggtcttgatggcgtggtatgctcagcgcaagaagcaaagacactaaaggcattatgtggtcaagactttaagctaataacccctggtattcgcttgctagacgacaacgctgatgatcaaaagcgtatttgcacgccgaaacaggcattaaacgatggctctgattatctggtcattgggcgctcaattacccaagcagcagatcctgcggctaagttgcagttaatacttcaaagcctttaa

SEQ ID NO: 16749 - protein, 232 aa, Psychrobacter sp. 273-4
MNNAINSPVIVALDNMTKNASLALADQLDPALCRLKVGKELYTRCGPEIVKALHQRQFEVFLDLKFHDIPNTTAQAVLAAAELGIWMVNVHASAGLEAMALAKQRLLDSDFDTLLIAVTVLTSMDNEALMQTGITDGLDAQVSRLAQLTKQAGLDGVVCSAQEAKTLKALCGQDFKLITPGIRLLDDNADDQKRICTPKQALNDGSDYLVIGRSITQAADPAAKLQLILQSL

SEQ ID NO: 16750 - DNA, 693 bp, Haemophilus influenzae R2846
  CDS (1)..(693)
atgacaagtaaaattattgtggcattggattatgagaaagaagcagaggctcttgctttagttgatcaaattgatccaagtttgtgtcgattaaaagtgggtaaagaaatgtttactacacttggtattaattttgtaaaacaattacatcaacgtaattttgatgtttttttggatctgaaatatcacgatattccaaatacggtagcaagagcagttcgttctgctgctgatttaggcgtatggatggtggatttacacgcaagtggtggcttgcgtatgatggaagaagcgaagaaaattcttgaaccttatgggaaagatgcaccattgcttattgctgtgacggtattaaccagtatggaagacttggatttattacaaattgggattaatgcatcgccaatggaacaagttttacgcttagctcatttaacccaacgggcgggtttagatggtgtagtctgttcccctcaagaagttgaaattttacgtaacgcttgtggagaagattttaaattagtgaccccagggattcgtccaataggaactgattttggcgatcaaagacgtgtaatgacgcctactgcagcaattcgtgcaggttcagattatttagttattggacgcccaataactcaagcggataatcctgcggaggttctccgttctattaatgtatctattgggtaa

SEQ ID NO: 16751 - protein, 230 aa, Haemophilus influenzae R2846
MTSKIIVALDYEKEAEALALVDQIDPSLCRLKVGKEMFTTLGINFVKQLHQRNFDVFLDLKYHDIPNTVARAVRSAADLGVWMVDLHASGGLRMMEEAKKILEPYGKDAPLLIAVTVLTSMEDLDLLQIGINASPMEQVLRLAHLTQRAGLDGVVCSPQEVEILRNACGEDFKLVTPGIRPIGTDFGDQRRVMTPTAAIRAGSDYLVIGRPITQADNPAEVLRSINVSIG

SEQ ID NO: 16752 - DNA, 717 bp, Anabaena variabilis ATCC 29413
  CDS (1)..(717)
atgactaataacaaaataattgtggctttggatgtgccggatacggagagtgcgatcgctctcattgataagttagagtcggtgactttctggaaggttggcttggaattgtttactagttccgggccgagaattctagaagtgctgaaatctagacaaaagcgtatctttctcgatttaaaatttcacgacattcctaataccgtggctggggcttgccgtggtgcagcccgctacggggtggatttgatgacaattcatgctacctctggcagagatgccctcaaggctgcgaaagaggcggtagaggaaggggctgcacaagctggggtgaaaccgtctaagttaattgctgtgacggtgttaaccagtatttctgctagacagttggcgttagatttgaaaattcctgtagagttgccagaatatgctttagatatggcgttgatggcgcaagaagtaggattagatggggctgtttgttcaccccaggaagtggcgcagttgcggcaaatttgcggtgatgactttgtgctggtttgtccgggagtacgtccaacatgggcagaagcaaaagaccaaaagcgatcgctcaccccctcccaagccatccaagccggggctgattatttagtaattggtcgtcccattactgctgctgctgaacctgagttagcctggaaacgaattgctcaagagttaactacagtggcatga

SEQ ID NO: 16753 - protein, 238 aa, Anabaena variabilis ATCC 29413
MTNNKIIVALDVPDTESAIALIDKLESVTFWKVGLELFTSSGPRILEVLKSRQKRIFLDLKFHDIPNTVAGACRGAARYGVDLMTIHATSGRDALKAAKEAVEEGAAQAGVKPSKLIAVTVLTSISARQLALDLKIPVELPEYALDMALMAQEVGLDGAVCSPQEVAQLRQICGDDFVLVCPGVRPTWAEAKDQKRSLTPSQAIQAGADYLVIGRPITAAAEPELAWKRIAQELTTVA

SEQ ID NO: 16754 - DNA, 687 bp, Ehrlichia canis str. Jake
  CDS (1)..(687)
atgtggtgtaatccaattatttgtgctttagacacttatgatattaatcatgcattgcggttgacaaaaatgctttatggtaaaatatcaatggtaaaattaggattggaattttttactgcacatgggttatctggtgtgcaagcagtctctgattgtggtattccaatatttcttgacttaaaattacatgatattcctaatactgttggtaaggctatatcagtgattaaatctttaaatattgctatgcttactattcatattagtggtggtagagatatgatgctaagtgctatagatagtatatttggtagtatgataaaattaataggtgtcactgtgttaacaagtattgatgattctgatttaaaagacatcggtattgatagatcatctattcaacatgtaatgctgttgtctaaagtggctcaagaaattggattatatggcatagtttgttctgcttttgaggtacaggaagtacgtaatcagtgtggcaaagattttaaacttgtagttcctggtataagatttgaagatgattatagtgatcaaaagagagtgaaaaatcccaaagatgcgattctagctggtgcagattatttagtaattggtcgtccaattactatgagtagtgatcctatacaaacagttgatgcaattttatcttcaattaatttataa

SEQ ID NO: 16755 - protein, 228 aa, Ehrlichia canis str. Jake
MWCNPIICALDTYDINHALRLTKMLYGKISMVKLGLEFFTAHGLSGVQAVSDCGIPIFLDLKLHDIPNTVGKAISVIKSLNIAMLTIHISGGRDMMLSAIDSIFGSMIKLIGVTVLTSIDDSDLKDIGIDRSSIQHVMLLSKVAQEIGLYGIVCSAFEVQEVRNQCGKDFKLVVPGIRFEDDYSDQKRVKNPKDAILAGADYLVIGRPITMSSDPIQTVDAILSSINL

SEQ ID NO: 16756 - DNA, 717 bp, Bacillus cereus G9241
  CDS (1)..(717): transl_table=11
atgtcacagtcgttaatcgttgcattagattttccagggaaacaagatgtagaacaattcttgcgccactttgaaggggaagagttatttgtcaaagttggtatggagttattttacaaagaaggccctgcgattattacgtacttaaaagaaaaaggacataagatttttctagatttaaaacttcatgatattccaaatacagtaaaaagcgctatgcgtagcctagctagtctagatgttgatatggtaaatgttcatgctgctgggggaagcagtatgatgaaagctgcaattgagggattagaggaaggtaagcaagaaggaaaagagagaccgatttgtattgcagttacacaactaacaagcacttcggaagctatgatgaaaaaagagatcggcattgagaaaacgttagaagaagcggttgctcattatgcaaaactaacaaaggaaagtggacttgatggcgttgtttgttcaacacttgaagttccgaaattacgtgaagtatgcggaaatgaatttgtaacagtaacaccggggattcgtcttacaagcgatgatgtaaatgaccaggtgcgcgtagcaacaccgaaacgtgcgagggaacttggctcaagctacatcgtagttggacgtagtattacaaaagcagaaaatccgcttgaagcgtataaaacagtaaaacaacagtgggaaggtgtaacagtatga

SEQ ID NO: 16757 - protein, 238 aa, Bacillus cereus G9241
MSQSLIVALDFPGKQDVEQFLRHFEGEELFVKVGMELFYKEGPAIITYLKEKGHKIFLDLKLHDIPNTVKSAMRSLASLDVDMVNVHAAGGSSMMKAAIEGLEEGKQEGKERPICIAVTQLTSTSEAMMKKEIGIEKTLEEAVAHYAKLTKESGLDGVVCSTLEVPKLREVCGNEFVTVTPGIRLTSDDVNDQVRVATPKRARELGSSYIVVGRSITKAENPLEAYKTVKQQWEGVTV

SEQ ID NO: 16758 - DNA, 735 bp, Pseudomonas fluorescens PfO-1
  CDS (1)..(735)
atgcgcgccgatttcgacttgcctgagagcccacccatgtccgcctgccagactcctatcatcgtcgccctggatttccctacccgtgacgccgcactgaagctggccgaccagttggacccgaagctgtgccgggtcaaagtgggcaaggaactgttcaccagttgcgccgcggaaatcgtcggcaccctgcgtgacaagggttttgaagtattcctcgacctgaaattccacgacattcccaacaccacggcgatggcggtcaaggctgcggccgagatgggcgtgtggatggtcaacgttcactgctccggcggcctgcgcatgatggcggcctgccgtgaagagctggacaagcgcagcggcccgcagccgttgctgattggcgtgaccgtgctgaccagcatggagcgtgaggatctggcaggtatcggtctggacatcgagccgcaggagcaggtgctgcgtctggcggcactggccgagaaggccgggatggacggtctggtgtgctcggcgctggaagccaccgcgctgaaaaccgcgcacccgtcgctgcaactggtgaccccggggatccgtccggcgggcagtgcgcaggacgaccagcgtcgcatcctgactccgcgtcaggcgctggatgccggctccgactatctggtgatcggccgtccgatcagtcaggcggcggatccggccaaggccctggcctcggtggttgccgaactggcctga

SEQ ID NO: 16759 - protein, 244 aa, Pseudomonas fluorescens PfO-1
MRADFDLPESPPMSACQTPIIVALDFPTRDAALKLADQLDPKLCRVKVGKELFTSCAAEIVGTLRDKGFEVFLDLKFHDIPNTTAMAVKAAAEMGVWMVNVHCSGGLRMMAACREELDKRSGPQPLLIGVTVLTSMEREDLAGIGLDIEPQEQVLRLAALAEKAGMDGLVCSALEATALKTAHPSLQLVTPGIRPAGSAQDDQRRILTPRQALDAGSDYLVIGRPISQAADPAKALASVVAELA

SEQ ID NO: 16760 - DNA, 744 bp, Rhodospirillum rubrum
  CDS (1)..(744)
atgcccatggcacagatgacgcaaaatccggttttcgtcgcgatcgacaccaccgttgtcggcgatgcgaccacccttgccgcccgcctccatgacgaggtcggcggcatcaagcttggactcgagtttttcgcccgcaatgggcacaagggcgtcaaggaggtgtgcagggccggcgccctgccgctgttccttgatctcaagttccatgacatccccaatacggtggccggggcggtgcgcgcggtgatgccgctggcgccggccttgctcaatgtccacgcctgtggcgggcgggcgatgatgatcgccgcgcgcgaggccgcgcaaagcgaggccctggccctggggatcgcgccgcccaagatgatcgccgtgaccgtgctgaccagcatggacgacgacgatctgggcggaaccggcgtcgccggcggcgtgcttgatcaggtgcggcgtttggccgccctgacccgcgacgccgggcttgatggcgtggtctgctcggcccgcgaggcccgggtgctgcgcgccgatttgggcgatgatttcttgctggtgacgccgggggtgcggccgctgtggtcgaccaccaacgaccagaagcgggtggtcaccccgcaagaggcgatggccgagggggccgatgtgctggtgatcggccggccgatcaccggggcgaccgatcccgcccaggcggcgcggctgatcgccggggaaatcgtgggatgggacgtcgggatatga

SEQ ID NO: 16761 - protein, 247 aa, Rhodospirillum rubrum
MPMAQMTQNPVFVAIDTTVVGDATTLAARLHDEVGGIKLGLEFFARNGHKGVKEVCRAGALPLFLDLKFHDIPNTVAGAVRAVMPLAPALLNVHACGGRAMMIAAREAAQSEALALGIAPPKMIAVTVLTSMDDDDLGGTGVAGGVLDQVRRLAALTRDAGLDGVVCSAREARVLRADLGDDFLLVTPGVRPLWSTTNDQKRVVTPQEAMAEGADVLVIGRPITGATDPAQAARLIAGEIVGWDVGI

SEQ ID NO: 16762 - DNA, 702 bp, Thermobifida fusca
  CDS (1)..(702)
ttggccgcacccatcgccgtcgcgctcgacgccccggatgtggagaccgcttcccgctgggccgccgcggtcgccccgcacgtcagcaccctgaaagtcgggctggagctgtacctgcgctacgggcccgcggttgtggaggccgtgcgcggtgcgcgggagaccgcgctgttcctcgacctgaaactgcacgacatccccgccacggtcgcgggcgctgcccgatcggtggccgggcttgctccggcgttcctcaccgtgcatgcggccggaggcgccgacatggtccgcgccgcggtggaggcggcacccgagacgcggatcgccgcggtgaccgtgctgacgtcgctggacgaggccgcgctcggcgcggtggggatgcgcggcccggcgagggacgcggtgcgccggcttgcggtgctcgcagtggaggcgggggcccgggccttggtgtgctccccgcaggaggcggctatggtccgcgccgaggtcggcccggacgtcacgctcatcaccccgggggtgcggccggccggggccgcccagggggaccaggcgcgggtggcgactcccgaggcggcgctggcggccggggcggacctgctggtcatcggacggcccattacccgcgcaccggatccgggggcggcggctgcggcgctcgccgcagagctccaaaaaaccggggcgtccccctcctga

SEQ ID NO: 16763 - protein, 233 aa, Thermobifida fusca
MAAPIAVALDAPDVETASRWAAAVAPHVSTLKVGLELYLRYGPAVVEAVRGARETALFLDLKLHDIPATVAGAARSVAGLAPAFLTVHAAGGADMVRAAVEAAPETRIAAVTVLTSLDEAALGAVGMRGPARDAVRRLAVLAVEAGARALVCSPQEAAMVRAEVGPDVTLITPGVRPAGAAQGDQARVATPEAALAAGADLLVIGRPITRAPDPGAAAAALAAELQKTGASPS

SEQ ID NO: 16764 - DNA, 675 bp, Novosphingobium aromaticivorans DSM 12444
  CDS (1)..(675)
atgagcaacccgatctacctcgccctcgaccttccccgcctcgacgcggccgtcgcgctcgcccagaaggtcaagggccatgtcggaggcctcaagctcggcctcgaattcttctgcgcccatggccaccacggcgtccacgaagtcgccaaggtcggcctgccgatcttcctcgacctgaaactgcacgacattcccaacaccgtcgcgggcgccatgcagtcgatccacgtcctcgagcccgccatcgtcaccattcacgccggtggtggccgcgcgatgatggaagacgccaaggccgccgcgggcgagcataccaaggtcgtcgcagtcaccgtcctcaccagcctcgacgatgccgacatgagcacgatgggcgtcggcggctctgcctacgaccaggccatacgccttgccgacctggcccaggaggccgggctcgacggtatcgtctgttccggccacgaagtcggcgcgatccacaagcgctggaagaacggcttcttcgtcgtgccgggcctgcgccccgccgaaggcaagctgggcgaccagaagcgtgccgtcacgccgcgcgccgcgcgcgatgcgggggccagcgttctcgtcatcggccggccgatcagccgcgccgaagatccggtcgctgcggcccgcgcgatcgaagccacgctctga

SEQ ID NO: 16765 - protein, 224 aa, Novosphingobium aromaticivorans DSM 12444
MSNPIYLALDLPRLDAAVALAQKVKGHVGGLKLGLEFFCAHGHHGVHEVAKVGLPIFLDLKLHDIPNTVAGAMQSIHVLEPAIVTIHAGGGRAMMEDAKAAAGEHTKVVAVTVLTSLDDADMSTMGVGGSAYDQAIRLADLAQEAGLDGIVCSGHEVGAIHKRWKNGFFVVPGLRPAEGKLGDQKRAVTPRAARDAGASVLVIGRPISRAEDPVAAARAIEATL

SEQ ID NO: 16766 - DNA, 717 bp, Microbulbifer degradans 2-40
  CDS (1)..(717)
atgaacattccagatcctcaactcgttattgcactcgattttgacacccaagagtcctgcttggagcttgtagaccaactagacccaacgctttgccgtttaaaaattggtaaagagctgtttacttcctgtgggcctaaaattgtcgaaaagatacagtggaaagggtttgacgtattcctcgatttgaaatttcacgatatacccaataccgtagcaaaagcggttaaggctgcagccgagttgggcgtatggatggtgaacgtacacgcgagtggcggcgaaaaaatgatgctagccgcaagagaagcgttagaaggttatcaagttaagcctttgttaattgcagttaccgtactaaccagtatgagcgacgaagacttaaaagcgcttggcattactgtaaccgctgccgagcaagttcagcgtttagctgcgttagctaagcaggcgcaaatggatggcgttgtatgctcggcgcaagaggttgttcagcttaaagcatccctcggcgaagagtttaaaatgataacccccggtattcgcccatcttttgcgggtaatgacgaccaaacgcgtattatgaccccagagcaagcacttaaagcgggtagcgattacctagttgttggtcgcccagtaacccaagcggacgaccctttgcgtgcgctagagcaaattgccgcagaaatggctcgtgcatcactaggtagctag

SEQ ID NO: 16767 - protein, 238 aa, Microbulbifer degradans 2-40
MNIPDPQLVIALDFDTQESCLELVDQLDPTLCRLKIGKELFTSCGPKIVEKIQWKGFDVFLDLKFHDIPNTVAKAVKAAAELGVWMVNVHASGGEKMMLAAREALEGYQVKPLLIAVTVLTSMSDEDLKALGITVTAAEQVQRLAALAKQAQMDGVVCSAQEVVQLKASLGEEFKMITPGIRPSFAGNDDQTRIMTPEQALKAGSDYLVVGRPVTQADDPLRALEQIAAEMARASLGS

SEQ ID NO: 16768 - DNA, 687 bp, Oenococcus oeni PSU-1
  CDS (1)..(687)
atgaacaaacccgtttttatcgctttggattttcctaatttaaaaactgctttcgattttctgaacaaatttcctagtcatgaaaaaccagctgttaaagtcggcatggaacttttttatgccgaaggaccgaaaattattcaacagttaaggcaaaaaggctacaaagttttccttgatttaaaactatacgatattcctcatacagtggccgcagcggttaggtctttgctggctttggatgttcagtacttaacgatccatagtcttggcggattaaaaatgatggaagcagctgtcgatgccgctgaggggaaaataaaattattagctgtcactcaattgacttctataagtgcaaacgaaatgcgtggtactcaattaaccagtgcaacaattgaacaatccgtcaaacatttgacgcaattggctttattggcgggggttgacggaacgatttcttcgcctctggaagcaaatataatcaagcaaataacgccggatgattttctgaaaattacaccgggaatccgcttgttcaatgatcaaaatggcgatcaaattagaattacgacgcctaagaaagctaaagagttcggagcaagtggattggttgtcgggcgatcaataactcaggcagcagaccccttgtctgtctatcgaaaaattttggaggaatttgaataa

SEQ ID NO: 16769 - protein, 228 aa, Oenococcus oeni PSU-1
MNKPVFIALDFPNLKTAFDFLNKFPSHEKPAVKVGMELFYAEGPKIIQQLRQKGYKVFLDLKLYDIPHTVAAAVRSLLALDVQYLTIHSLGGLKMMEAAVDAAEGKIKLLAVTQLTSISANEMRGTQLTSATIEQSVKHLTQLALLAGVDGTISSPLEANIIKQITPDDFLKITPGIRLFNDQNGDQIRITTPKKAKEFGASGLVVGRSITQAADPLSVYRKILEEFE

SEQ ID NO: 16770 - DNA, 741 bp, Pediococcus pentosaceus ATCC 25745
  CDS (1)..(741)
atgttaagagcggttcagaatggagtttttatggaaaaaccagttatgattgcgctagattttaaggatcggggagaacttaaccaattcttggagcaatttccggaacatttgaagttaaccattaaattgggaatggaactcttctacggaatgggtcccgaaatcgttcgagatatgcgtcaaaaagggcatgacatctttcttgatttaaaattgaacgatattcctaatacggtagaaaaagcaatgatgcaattaggtcgaatgggggttcaatacacaacaatccatgcgatgggtggttctgatatgattcgagcggctaaacgaggattggttgctggagctagagaagtagacttaccaacgcctaaactattagcagtaacggaattaacttctatttcagaaaagcaactaagtgaagaacagaatgttagtttaccaatggcagatcaagtacttagcctagcaaaattgactagtacggctggcggagatggtgtaatttgttctccaaacgaagttagttatttaaaaccccaacttccagaagattttctgtttgtgacacctggaattcgacctgccggagcagcaaagggtgatcaaaaacggacgatgactgctgcggaagctgccaaagcaggaagctcagctattgtggtaggtagaccaattactcaatctgaggacccggttgtggcgtaccaagcaattttaagtgaatttaactaa

SEQ ID NO: 16771 - protein, 246 aa, Pediococcus pentosaceus ATCC 25745
MLRAVQNGVFMEKPVMIALDFKDRGELNQFLEQFPEHLKLTIKLGMELFYGMGPEIVRDMRQKGHDIFLDLKLNDIPNTVEKAMMQLGRMGVQYTTIHAMGGSDMIRAAKRGLVAGAREVDLPTPKLLAVTELTSISEKQLSEEQNVSLPMADQVLSLAKLTSTAGGDGVICSPNEVSYLKPQLPEDFLFVTPGIRPAGAAKGDQKRTMTAAEAAKAGSSAIVVGRPITQSEDPVVAYQAILSEFN

SEQ ID NO: 16772 - DNA, 738 bp, Thiobacillus denitrificans ATCC 25259
  CDS (1)..(738)
atgacgcacaagattatcgtcgcgctggattttccggcgggtgccccggcgctggcactggcggatcggctcgatcccgcacgatgccggctcaaggtcggcaaggagttgttcacggcagccggacccgatctcgtgcgcgcgctggtcgcgcgcggcttcgaggtctttctcgatctcaagtttcacgatatcccgaataccgtcgccgccgcgtgccgcgcggccgcgggactcggcgtgtggatgctcaacgtccacgccgcgggcggtcggcgcatgatggacgccgcccgcgaggcgctcgaatccctgcccccgggggatggcgccgcggatacgccgcaacgccctttgctgatcgcggtcactgtgttgacgagcatgagcgccggcgacctcgccgagaccggcgtcgccgacacgccggccgagcaggtgatgcggctcgcccgcctcgcacacgcctgcgcgctcgacggcgtcgtctgctccgcgcaggaggccgcaggtctgcgtgccgcgctcggcgcggacttccgtctggtcaccccggggattcgcccggcgggcgccgcagcggcggaccagcgccgcgtgatgacgccggtcgaggcgctgcgcgccggagccaccgatctggtgatcggccgccccatcaccggcgcgggcgatccgctcgcggcgctcgcggcgattcaagcggacattgaagaaaatctagggagagcgttttga

SEQ ID NO: 16773 - protein, 245 aa, Thiobacillus denitrificans ATCC 25259
MTHKIIVALDFPAGAPALALADRLDPARCRLKVGKELFTAAGPDLVRALVARGFEVFLDLKFHDIPNTVAAACRAAAGLGVWMLNVHAAGGRRMMDAAREALESLPPGDGAADTPQRPLLIAVTVLTSMSAGDLAETGVADTPAEQVMRLARLAHACALDGVVCSAQEAAGLRAALGADFRLVTPGIRPAGAAAADQRRVMTPVEALRAGATDLVIGRPITGAGDPLAALAAIQADIEENLGRAF

SEQ ID NO: 16774 - DNA, 729 bp, Chloroflexus aurantiacus
  CDS (1)..(729)
atgagtctcgcgccacgcgaacggatactggttgcgctcgatacacccgatctggatgcagcagttgctttagcaacccggttgcgcgggcaggttggcggctataaagtcggcctggaaatctgctctgcggtcggcgtaccccagattgtatccgccatgactgcggttggcggaagtgtctttctcgatctcaaactgcacgacattccgaacacggtcgccggtgcagtccgcgccgtctgcaacctcggcccggcagtccagatgttgacactccactgtagtggaggtagcgcaatgctccgcgccgcagtcaatgcagcccaaagcatgccctaccgtccactgctgttgggcgttaccgtgctcaccagtctcgatgccacagcactcgccggcgaactgcgtgtcacgtcggacatcaccgactacgtagttcatctggctcgcatggcgcaggattgtggtctcgacggcgtggtagcttcgccgcacgaagtgagtgccattcgtactgcctgccctcacgtgcggatagtcacccccggtattcgcccacagtgggccgcagaaggtgaccagcgtcgcgtcatgacaccggcagccgccctacgcgctggtgccgactatctggtcatcggacgaccaattactgcgccaccggcaatcatcggcgatccggtcaccgcagtcgcacggattcttgcagaattggaacaggaatga

SEQ ID NO: 16775 - protein, 242 aa, Chloroflexus aurantiacus
MSLAPRERILVALDTPDLDAAVALATRLRGQVGGYKVGLEICSAVGVPQIVSAMTAVGGSVFLDLKLHDIPNTVAGAVRAVCNLGPAVQMLTLHCSGGSAMLRAAVNAAQSMPYRPLLLGVTVLTSLDATALAGELRVTSDITDYVVHLARMAQDCGLDGVVASPHEVSAIRTACPHVRIVTPGIRPQWAAEGDQRRVMTPAAALRAGADYLVIGRPITAPPAIIGDPVTAVARILAELEQE

SEQ ID NO: 16776 - DNA, 672 bp, Streptococcus pyogenes M49 591
  CDS (1)..(672)
atgaaagaagaacgcccaattattgctttagacttttcatcatttgaggagactaaagcatttttagacttatttccagcagaagaaaaactatacgtgaaaattggtatggaattatattatgcgcaaggaccagatattgttcggtatatcaaatcgttagggcataatgtatttttggatttaaaattacatgatattccaaatactgttcgtgctgctatggcagttcttaaagaattagatattgatatggcaactgttcatgcagctggtggtgtagagatgctaaaagcagctcgagaaggactaggtcaaggccctaccttaattgcggtaacacagctaacttcaaccagtgaagaccaaatgcgtggtgatcaaaatattcaaacgagtcttttagagtctgttttgcattacagcaagggggcagctaaagctcagctagatggggtggtttgttcggcacaagaagtagaagctatcaaggcggtgacgcctacaggatttaattgcttaactcctggcattcgtcctaaaggcagtaatattggcgatcaaaaacgagtgatgactccaaaccaagcaagacgcattggaagtgattatattgtggtagggcgaccaaaattaccaggcaaagacccagtggctacttacaagctataa

SEQ ID NO: 16777 - protein, 223 aa, Streptococcus pyogenes M49 591
MKEERPIIALDFSSFEETKAFLDLFPAEEKLYVKIGMELYYAQGPDIVRYIKSLGHNVFLDLKLHDIPNTVRAAMAVLKELDIDMATVHAAGGVEMLKAAREGLGQGPTLIAVTQLTSTSEDQMRGDQNIQTSLLESVLHYSKGAAKAQLDGVVCSAQEVEAIKAVTPTGFNCLTPGIRPKGSNIGDQKRVMTPNQARRIGSDYIVVGRPKLPGKDPVATYKL

SEQ ID NO: 16778 - DNA, 840 bp, Campylobacter coli RM2228
  CDS (1)..(840): transl_table=11
atgaaactctgcgtagctcttgatcttgccaccaaagaagagtgcttaaggcttgctaaagaattaaaaggtttagatctttggctaaaagtgggtttaagagcctatttaagagatggctttaaattcatagaagaacttaaaaaaatcgatgaatataaaatttttctcgatcttaaaattcatgatattcctaataccatggcagatgcttgcgaggaaatttcaaaacttggcgttgatatgattaatatccatgcaagtgctggaaaagtcgctatgcaagaagtgatgtctagactcaatcgcttcaataaaagacccttggtgttagcagtttcagcacttactagctttgatgaagaaaatttttacagcatttataagcaaaacatcgatgaagctgtgattcatttttcaaaaatgtcttatcaaaatggacttgatggtatggtatgttcggtttttgaaagtaaaaaaattaaagaacatacaaattcaaatttcttaaccctcactcctggaattcgtccttttggggaagcaagtgatgatcaaaaacgcgttgctaatcttacaatggctagagaaaatttaagtgattatatcgttgtgggaagacctatatataaaaatgaaaatcctagagctgtatgtgaaaaaattttagacaaaatacacagaaaaaatataagcgaaaatgatatagagcaaaattatgaagcaatgcagcaaaaagaatgggatatgtgcaatcattttgaagaatggatcaaaactcagcctgataaagaacaagctttgaaagaattttatactaagtgcgggataaaatattga

SEQ ID NO: 16779 - protein, 279 aa, Campylobacter coli RM2228
MKLCVALDLATKEECLRLAKELKGLDLWLKVGLRAYLRDGFKFIEELKKIDEYKIFLDLKIHDIPNTMADACEEISKLGVDMINIHASAGKVAMQEVMSRLNRFNKRPLVLAVSALTSFDEENFYSIYKQNIDEAVIHFSKMSYQNGLDGMVCSVFESKKIKEHTNSNFLTLTPGIRPFGEASDDQKRVANLTMARENLSDYIVVGRPIYKNENPRAVCEKILDKIHRKNISENDIEQNYEAMQQKEWDMCNHFEEWIKTQPDKEQALKEFYTKCGIKY

SEQ ID NO: 16780 - DNA, 684 bp, Campylobacter lari RM2100
  CDS (1)..(684): transl_table=11
atgaaactttgcgtggcttttgatgtggcaagctatgatgagtgtataaatttagccaaagaattaaaaggtttagatctttgggttaaaatagggcttagatcgtatttaagagatggagtaaagcttttagaagcgattaaaaaagtggataattttaaaatctttttagatttaaagctttatgatataccaaatactatggcagatgcttgtgaagaacttgctaagcttgatgtaaatatgtttaatatccatgcaagtgcaggtaaaagtgctatgtgtatgattatggagcgcttaaatgctttaagtaaaagacctttggtgcttgctgtatctgctttaactagctttgatgagcaagaattttttagtgtatataaacaagatattaaacaagctgttaaggatttttctaaaattagttatgaaagcggtcttgatggtatggtttgttcagtatatgaaagcttactgattaaagaaaatacaagtgcaaattttattacattaacgcctggaatccgtccgtttaaagaaaattcagatgatcaaaaaagagtagctgatatacagtgtgctaaggataatttgtcagattttatcgtggttggaagacctatttataaagcaaaagaacctagaaggatttgcgagaatatattagagcatttaaaataa

SEQ ID NO: 16781 - protein, 227 aa, Campylobacter lari RM2100
MKLCVAFDVASYDECINLAKELKGLDLWVKIGLRSYLRDGVKLLEAIKKVDNFKIFLDLKLYDIPNTMADACEELAKLDVNMFNIHASAGKSAMCMIMERLNALSKRPLVLAVSALTSFDEQEFFSVYKQDIKQAVKDFSKISYESGLDGMVCSVYESLLIKENTSANFITLTPGIRPFKENSDDQKRVADIQCAKDNLSDFIVVGRPIYKAKEPRRICENILEHLK

SEQ ID NO: 16782 - DNA, 681 bp, Campylobacter upsaliensis RM3195
  CDS (1)..(681): transl_table=11
atgaaactttgcgtagccttagatttagaaaataaagagcgttgtttagagcttgtaagggaactaaaagaccttgatatatggcttaaaataggacttagagcctatataagagatggctttaaatttatagaagagcttaaaaaattaagcacacagcccctttttttagacctaaaaatttatgatatcccaaacactatgagtgatgcttgtgaggagtgtgcgaaacttggggttaatatgataaatcttcacgcaagtgctgggaaaaaggctatgcaaagcgttatgcaaagattgcaaaatttacaaaaacgccccttagtgcttggtgtttcggctcttactagctttgatgaagaagaattttatagcatttataggcaaaatttaaaagaagcagtaataaatttgtcaaaacttgcctatgaaagtgggcttgatggtatggtttgctctgtgtttgaaagccttttgattaaacaaaatacaagcgaaaattttctcacccttacccctgctatccgcccctttaaagaggaagcaaacgatcaaaaaagagtggcaaatttagaaagtgcgaaagaaagtaagagcgattttatagtcgttgggcgtcctatttatgaggctttaaaccctaaagaagtctgcgaaaaaattcttgcaagtttataa

SEQ ID NO: 16783 - protein, 226 aa, Campylobacter upsaliensis RM3195
MKLCVALDLENKERCLELVRELKDLDIWLKIGLRAYIRDGFKFIEELKKLSTQPLFLDLKIYDIPNTMSDACEECAKLGVNMINLHASAGKKAMQSVMQRLQNLQKRPLVLGVSALTSFDEEEFYSIYRQNLKEAVINLSKLAYESGLDGMVCSVFESLLIKQNTSENFLTLTPAIRPFKEEANDQKRVANLESAKESKSDFIVVGRPIYEALNPKEVCEKILASL

SEQ ID NO: 16784 - DNA, 675 bp, Wolbachia endosymbiont of Drosophila ananassae
  CDS (1)..(675): transl_table=11
atgaacccaataatatgcgcactggatacacaagacttaaataaggctatttctctagctaatgctctgcgtggtaaagttggcatggtaaagctgggattagaattttttgctgctcaaggtctttctggagtgcaagaagttgcaaaatgcaatgtaccaatttttttagatctgaaattgcatgacattccaaacactgtagccaaaacagttgaagtaataaaagttctgaacattgaaatgttaactctgcacatcagcggtggaacaaaaatgcttgaagaagcgctaagtgtagtgcaaggcacaaaaataaagctgattggagtgacagtgctaactagtatgagcaatgaggatttaaacgagcttggagtagcaagagaggcaaaatcacaggtaattttgcttgcaaagcttgcaaaaaagattggactccatggagtagtctgttctgcactagaagctcaagaagtgcgccgagaatgcggtgaagactttaaaattattactccaggaattcgtatagatccaggtcatgacgaccaaaaaagaacagcaacaccaaaagaagcaataaattcaggagctgattatatcgtcattggcagacccattacaaaaactacaagtagtgcggagctaatattgaaatccatgaaagaattttaa

SEQ ID NO: 16785 - protein, 224 aa, Wolbachia endosymbiont of Drosophila ananassae
MNPIICALDTQDLNKAISLANALRGKVGMVKLGLEFFAAQGLSGVQEVAKCNVPIFLDLKLHDIPNTVAKTVEVIKVLNIEMLTLHISGGTKMLEEALSVVQGTKIKLIGVTVLTSMSNEDLNELGVAREAKSQVILLAKLAKKIGLHGVVCSALEAQEVRRECGEDFKIITPGIRIDPGHDDQKRTATPKEAINSGADYIVIGRPITKTTSSAELILKSMKEF

SEQ ID NO: 16786 - DNA, 675 bp, Erythrobacter litoralis HTCC2594
  CDS (1)..(675): transl_table=11
gtgagcaacccggtcttcctcgcgctcgacatcccgcggctggaagcgggcaaggcgctggtcgacaaggtcaaggcgcatatcggtggtgtgaagctcggcatggagttcttctatgcccacggccatcacggggtgcacgaaattgcgcactgtggtctgccggtcttcctcgacctcaagctgcacgacattcccaacaccgtcgccgccgcgatgcaatcgatccatgtgctggagccggccatcgtcacggtccacgcatcgggcgggcgcgcgatgatggaagacgccaaggcggcggcgggcgagaacaccaaggtcgtcggcgtaaccatgctgaccagcctggacgagcgcgacctcgaacgcaccggggtcgatggcagcccgcacgatcatgtcatgcggctggccgaactggcggagaacgccgggctcgacgggatcgtctgctccggacaggaagtcggcgcggtacacaagcaatggaaacagggcttcttcgttgttcccggcctgcgcccggcaggcagcgcaagtggtgaccagaagcgcgtcgtcaccccacgccaggcgcgtgacgacggtgccagcgtcctggtgatcggccgcccgatcagcaaggcggacgatccggaacaggctgcgcgggatatcgaggcgacgctgtga

SEQ ID NO: 16787 - protein, 224 aa, Erythrobacter litoralis HTCC2594
MSNPVFLALDIPRLEAGKALVDKVKAHIGGVKLGMEFFYAHGHHGVHEIAHCGLPVFLDLKLHDIPNTVAAAMQSIHVLEPAIVTVHASGGRAMMEDAKAAAGENTKVVGVTMLTSLDERDLERTGVDGSPHDHVMRLAELAENAGLDGIVCSGQEVGAVHKQWKQGFFVVPGLRPAGSASGDQKRVVTPRQARDDGASVLVIGRPISKADDPEQAARDIEATL

SEQ ID NO: 16788 - DNA, 714 bp, Lactococcus lactis subsp. cremoris SK11
  CDS (1)..(714)
atgcaagaaaatagacctgttattgccctagatttcccagaattctcagatgtgaaagatttccttgaaaaatttgacccgtctgaaaaactctacatcaaacttggtatggaacttttttataccgccggcccacaagtagtatattatgtgaaatcgctcggtcatagcgttttccttgatttaaaacttcatgatattccaaatacagttgaatcatccatgcgtgttttagcccgtttgggagttgatatggtcaatgttcacgctgctggcggggttgagatgatggttgcagctaaacgcggtttagaagcagggactccaactggacgtcaaagaccaaaactaattgccgttacgcaattaacctcgacttctgaggaaattatgcaaaatgaccaaaaaattatgaccagtcttgaagaatctgtcattaactacgcacaaaaaacagcccaagccggacttgatggtgtcgtttgctccgctcatgaagttgaaaaaattaaagcggcaacatcaaaagaattcatttgtttaacaccgggaattcgtccagaaggagcaagtaaaggcgaccaaaaacgagtaatgacaccaaaagaagcaagaacaattggttcagattacattgttgttggtcgaccaattacacaagcaaaagaccctgtttcagcttatcatgcgataaaggaagaatggaatcaataa

SEQ ID NO: 16789 - protein, 237 aa, Lactococcus lactis subsp. cremoris SK11
MQENRPVIALDFPEFSDVKDFLEKFDPSEKLYIKLGMELFYTAGPQVVYYVKSLGHSVFLDLKLHDIPNTVESSMRVLARLGVDMVNVHAAGGVEMMVAAKRGLEAGTPTGRQRPKLIAVTQLTSTSEEIMQNDQKIMTSLEESVINYAQKTAQAGLDGVVCSAHEVEKIKAATSKEFICLTPGIRPEGASKGDQKRVMTPKEARTIGSDYIVVGRPITQAKDPVSAYHAIKEEWNQ

SEQ ID NO: 16790 - DNA, 720 bp, Lactobacillus casei ATCC 334
  CDS (1)..(720)
atgacgcctattatcgcactggattttaaagataagaccacaactcttgattttttaagccaatttccaaaagaagaacatttgttcgttaaagttggcatggaacttttctatgctgaaggcccagcaattatcaccgagattcaacaagcccgaccggtgtcgatttttctcgatttaaaacttcacgatatccctaacaccgtggaaaaagcggcgtggcaattgggtaaactaggtgtggcgatgaccactgtccacgcagcaggcgggaaagacatgatgatcgcagccaaacgcgggctattggctggcgcaaaggcagctggtcatccagcaccaaaaatgcttgcgatcacgcagctaacttctacagatcagacgatgctgacaaatcagctttcgattgagatcccgatcagtcaagcggttcagcatcttgcagccatcgcgcaggcaagtaatgccgatggtgtggtggcaagtgctttggaaacaccactcattcgaagtgtgacgcgacctgattttctggtagtcaccccgggaattcgaccgtatggtgcggcagtcggcgaccaaaaacgagtcgtgaccccgggcagagccaagcgtttaggcagttcagcgattgttgttggccggccgattacgcaggctgatgatccggtggcggcttatcaatcagttaaggaagcgtgggaaacagcacatgactaa

SEQ ID NO: 16791 - protein, 239 aa, Lactobacillus casei ATCC 334
MTPIIALDFKDKTTTLDFLSQFPKEEHLFVKVGMELFYAEGPAIITEIQQARPVSIFLDLKLHDIPNTVEKAAWQLGKLGVAMTTVHAAGGKDMMIAAKRGLLAGAKAAGHPAPKMLAITQLTSTDQTMLTNQLSIEIPISQAVQHLAAIAQASNADGVVASALETPLIRSVTRPDFLVVTPGIRPYGAAVGDQKRVVTPGRAKRLGSSAIVVGRPITQADDPVAAYQSVKEAWETAHD
